United States Patent 8,541,208 (PROCESS FOR THE PRODUCTION OF FINE CHEMICALS) - sequence listing, part 6

SEQ ID NO: 19974 - DNA, 813 bp, Geobacter sulfurreducens
  CDS (1)..(813)
atgctcgttatctgttgtgtgaagcaggtacccgacacgactcaggtgcagatcgatcccgttaccaataccctggtgcgggaggggatcccatttatcgtcaatccttacgatactcacgccctggaggaaagcctgcggctcaaggatcgttatggcgttcgggtggccgctatctccatggggccgcccaatgccgaagcaaccatccgcaaggcagtggcgcttggcgttgaccgggcgattctgctgtccgatcgcgccttcggcggggcggacaccctcgccacgagcaatgtcctctccgccgcaatccgcaaacttgccgaagaggacgaagtggcgctggtcctttgcgggaagcagaccattgatggcgatacggcgcaggtggggcccggcatcgccacccgtctgggtatgacccagcttacgctggtggaccgcatcgagggcatcgacatggatgcccgcacgatccaggtgcgccgcaagctggaggggcggtacgaactggttaagggaccgatccctgccatgttgacggtggtgcgggagatcaaccggccacgctaccccgcagttcctgcccggctcatggcggcttcctgcgcggtggaggtctggaacaacgaggtgttgcggcttgattctgcctccattggactcaagggctcaccaacctgggtcagcaggatcttttcacccgagcgcgcaaagggacagatcctcggtgacggcgagaaggaccctgccgggacggcatgtcttcttgtcgatacgcttcgcgccaaggatttgctgccgttctag

SEQ ID NO: 19975 - protein, 270 aa, Geobacter sulfurreducens
MLVICCVKQVPDTTQVQIDPVTNTLVREGIPFIVNPYDTHALEESLRLKDRYGVRVAAISMGPPNAEATIRKAVALGVDRAILLSDRAFGGADTLATSNVLSAAIRKLAEEDEVALVLCGKQTIDGDTAQVGPGIATRLGMTQLTLVDRIEGIDMDARTIQVRRKLEGRYELVKGPIPAMLTVVREINRPRYPAVPARLMAASCAVEVWNNEVLRLDSASIGLKGSPTWVSRIFSPERAKGQILGDGEKDPAGTACLLVDTLRAKDLLPF

SEQ ID NO: 19976 - DNA, 819 bp, Geobacter sulfurreducens
  CDS (1)..(819)
atgctcgccatttcctgcatcaaacaagtgccggataccacccaggtccagatcgatccggtgaccaacaccctcgtgcgggagggtatcccgttcatcgtcaacccctatgacacccatgccctggaagaggggctgcggatcaaggaccgctacggcttcagggccgtggcgctttccatggggccgcccaatgccgaagccgccctcaagaaggcgctggccatgggcgccgatgaggcgatcctctgctccgaccgctgtttcggcggtgccgacaccctatccaccagtaacgtgctggccgccgccatcaagcggatcgccgatgaggccggcgacgagatcggcatcgtcttctgcggcaagcaaaccattgacggcgatacggcccaggtggggccgggcattgccgttcgcctcgggttcagccagctcacgctggtggaccggatcgagcacctggacgcggcggcccgcacgatcagggtgcggcgcaagctggagggacgctacgaggtggtggaggcgccgctgccggtcatgattaccgtggtgcgcgagctgaaccgccctcgctatcccaccgttccgctgcggcttgcctccgttgacgccgcggtcaaagtctggaacaatgaggtcctgcgccttgacgtgaacagcgtcggcctcaaggggtcgcccacctgggtgagccggatcttttcgccggagcgggccaagggagagatcatcggcgacggcatggtagatccggtgggcacggccaacctgctgatcaatcaactgctggcaaaggatctgctggcggtgtga

SEQ ID NO: 19977 - protein, 272 aa, Geobacter sulfurreducens
MLAISCIKQVPDTTQVQIDPVTNTLVREGIPFIVNPYDTHALEEGLRIKDRYGFRAVALSMGPPNAEAALKKALAMGADEAILCSDRCFGGADTLSTSNVLAAAIKRIADEAGDEIGIVFCGKQTIDGDTAQVGPGIAVRLGFSQLTLVDRIEHLDAAARTIRVRRKLEGRYEVVEAPLPVMITVVRELNRPRYPTVPLRLASVDAAVKVWNNEVLRLDVNSVGLKGSPTWVSRIFSPERAKGEIIGDGMVDPVGTANLLINQLLAKDLLAV

SEQ ID NO: 19978 - DNA, 777 bp, Ashbya gossypii
  CDS (1)..(777)
atgtcgaagccgctcaggatcctagtccccatcaagcgggtgatcgacccgcagctcagacccagaatcaacgccgctgggacggcggtgcagaagacaggcgtgcaattcagtgtcaacccgttcgatgatatcgccgtagaggaggctgtgcgcatcagggaggccaagaaggtgcccgtagagagcatccacgctgtctccatcgggcctgcgaaggcgcaggaggcgctgctgacggccatggccaagggcgcggactcctcgacgctcgtggacgcacaggactcggagctggagccgctggccgtcgcgaagatcctgcgcgagctggtcgtgcagcagaagatcgacctcgtcatcatgggcaagcaggccaccgacagcgacaacaacaacaccgggcagatgctggcgggccttctcaactggccgcaggccaccaacgccgcgcgtgttgagctggacgcgactggcacgcgtgcgaccgtcacgcgcgaggtcgagggcggcgaggaggtcgtcagtgccgcgctgccactcgtggtcaccacggacctgcggctcaacacgccgcgctacgtcacgctgcccaacaagatgaaggcgaagaagaagccgatggcgaagctcaacctcgccgcgttccccggcgtcgactccgccgcccgcctcaatctgctgcgcttcgaggagccgcccgcgcgcgcgccgggcaccgtcgtcgcgtccgtggacgagctgctcgccaaactcagggaggccaaggccgtttaa

SEQ ID NO: 19979 - protein, 258 aa, Ashbya gossypii
MSKPLRILVPIKRVIDPQLRPRINAAGTAVQKTGVQFSVNPFDDIAVEEAVRIREAKKVPVESIHAVSIGPAKAQEALLTAMAKGADSSTLVDAQDSELEPLAVAKILRELVVQQKIDLVIMGKQATDSDNNNTGQMLAGLLNWPQATNAARVELDATGTRATVTREVEGGEEVVSAALPLVVTTDLRLNTPRYVTLPNKMKAKKKPMAKLNLAAFPGVDSAARLNLLRFEEPPARAPGTVVASVDELLAKLREAKAV

SEQ ID NO: 19980 - DNA, 951 bp, Oryza sativa
  CDS (88)..(849)
aagaaccttactaccagtggtctttccccgtgaagaggaggaaggtgaggtcgccgggcgcccaccattgccgtcgcgtggcgaggcatgaagatcctagtggcggtgaagcgggtggtggactacgccgtcaaggtgcgggtgaggcccgaccggacgggcgtcgagacggcgagcgtcaagatgtccatgaacccattctgcgagatcgccgtcgaggaggcgctccgcctccgcgagtccggcgccgccaccgaggtcgtcgccgccaccgtcggcccctcccagtccgccgacaccctccgcaccgcgctcgccatgggcgccgaccgcgccgtccacgtcctccacgaccccgacccctcccgccccctcctccccctcgccgtcgccaagatcctccgcgccctcgcgctccaggagaaccccggcctcgtcatcctcggcaagcaggcaattgatgatgattgcaaccaaacaggacaaatgctagctgggttgcttaattggccacaaggaacctttgcctcaaaggttatattgaacaaggaaaaggctactgtggagagagaggtcgatggcggaatcgagaccattagcttggatttgcctgcagttatcaccacggatttgagactgaaccaaccaaggtatgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatatgcaaataaagtgtagttataaatggtcatcgtatgcaaataaaaatgtggcgttcccgt

SEQ ID NO: 19981 - protein, 253 aa, Oryza sativa
MKILVAVKRVVDYAVKVRVRPDRTGVETASVKMSMNPFCEIAVEEALRLRESGAATEVVAATVGPSQSADTLRTALAMGADRAVHVLHDPDPSRPLLPLAVAKILRALALQENPGLVILGKQAIDDDCNQTGQMLAGLLNWPQGTFASKVILNKEKATVEREVDGGIETISLDLPAVITTDLRLNQPRYATLPNIMKAKSKVIKKVTPEDLDVDIRSDMEVVEVTEPPKRKAGVILSSVDELVDRLKNEARVL

SEQ ID NO: 19982 - DNA, 786 bp, Porphyromonas gingivalis
  CDS (1)..(786)
atgaatatcgttgtttgtatcaaacaggtacccgatactaccgaaatcaaattggatcctgtaaaaggcacgctcattcgtgacggtgtgcccagtatcatgaaccccgatgacaagggagctttggaacaggctcttcgcttcaaggacacacacaatgctcacgtaactgtgatcaccatgggaccgccacaggcagaagctatcctgcgcgaagcatatgccatgggtgcagatcatgccatccttgtcagcgatcgtaagttcggtggagccgacacattggccacaagttacacactctctcaagctttgagaaagatcgaccacgatctgattatcgccggtcgtcaagctatcgacggtgatacggctcaggtaggacctcagattgccgagcaacttgacctgccacagatcacatacgtggaagaagccacattcgatggcaagcaaactctgactgttcgcaagagcacggaagaaggacatgaggttttggaagtagagcttccttgtatgctcactttattggctacggctaataagcctcgctacatgcgcgttcgtggcattatggaaaccttcgacagacctattgagtgctggggagcaagcgacattgatgttgatccggaaagaatcggtttggccggttctcccacgagcgtcaagaagtcgttcactaagggagccaaggccatgggagcactgcatgaagatatcactcccgaagaagctgctgacattatcttcaataaactgaaagagaaattcatcatctga

SEQ ID NO: 19983 - protein, 261 aa, Porphyromonas gingivalis
MNIVVCIKQVPDTTEIKLDPVKGTLIRDGVPSIMNPDDKGALEQALRFKDTHNAHVTVITMGPPQAEAILREAYAMGADHAILVSDRKFGGADTLATSYTLSQALRKIDHDLIIAGRQAIDGDTAQVGPQIAEQLDLPQITYVEEATFDGKQTLTVRKSTEEGHEVLEVELPCMLTLLATANKPRYMRVRGIMETFDRPIECWGASDIDVDPERIGLAGSPTSVKKSFTKGAKAMGALHEDITPEEAADIIFNKLKEKFII

SEQ ID NO: 19984 - DNA, 867 bp, Porphyromonas gingivalis
  CDS (1)..(867)
atgaagattatcgttcttgctaaacaggtgcctgatacccgtaatgtgggtaaggatgccatgaaagccgacggcactgtgaatcgttccgtcttgccggctatcttcaatcccgaagacctcaatgctttggagcaggctctgcgtgtcaaggaaactatgcctgatacgaccgttcatattctcacgatgggacctcctcgtgcagcagacatcatacgcgaagccatgtatcgtggtgccgatggtggctacttgcttacagacaaagcttttgccggtgccgatactttggctaccagctatgcccttgccacagctattcgccatatcggattgcctgatctgatcatctccggtcgtcaggctatcgatggcgatacggcacaagtaggcccacaggtggcagagaaactcggacttccgcaagtgacctatgctgaagatattctgaaaatagatgccaaaagtatcgagatcaagcgtcgtcttgagcgaggtgtagagaccgttgtcgcttcaatgcctttagttgtaacggtaaacggctcctcagctccgtgtcgtccacgcaatgccaagttgctccagcgatataaatatgctcgtacagcttccgaaaccaaagacacgacagaggagatcaaagcactccttggccaacgtccgggcttgcatattgtggaattgggtgccgcagaagtaggggcagacctcgctcagtgcggtctgtccggttcacctacaaaggtgaaacatatagagagtgttgtgttccaggccaaagaagcaaaacgaatgctccccgaagatggagagattgaagctttgatgcaggaacttattgctaatcatacaatcggataa

SEQ ID NO: 19985 - protein, 288 aa, Porphyromonas gingivalis
MKIIVLAKQVPDTRNVGKDAMKADGTVNRSVLPAIFNPEDLNALEQALRVKETMPDTTVHILTMGPPRAADIIREAMYRGADGGYLLTDKAFAGADTLATSYALATAIRHIGLPDLIISGRQAIDGDTAQVGPQVAEKLGLPQVTYAEDILKIDAKSIEIKRRLERGVETVVASMPLVVTVNGSSAPCRPRNAKLLQRYKYARTASETKDTTEEIKALLGQRPGLHIVELGAAEVGADLAQCGLSGSPTKVKHIESVVFQAKEAKRMLPEDGEIEALMQELIANHTIG

SEQ ID NO: 19986 - DNA, 825 bp, Gloeobacter violaceus
  CDS (1)..(825)
atgaacatttttgtactgattaagcaagttcctgaccagggtgccaaggccggcatcaacccggacgggacgatcgatcgggccagagccaagcgcatgctcaaccccttcgaccgctatgccctcgaagcggcgctatttgtccgccgcctctacggcggcacggtgacggcgatcagcatgggtccgcccccggccgtcgaggtgctctacgaggccatcgcccacggtgtggatcaggccatcttgctgagcgaccggcgtctggccgcctcggacaccctggctaccgcctacgcgctctactgcaccgtccgctacgccggagcgttcgatctggtcttctgcgggttgcaaactaccgacggcgacaccgcccaggtcggcccgcaactggccgagcggctgcaggttccccagattacctactgcgaaaaatttgaaattgctcaaggtgcgatcgtcgcccgccgggtcatcgaaggcggcgcccagacggtgcgctgtcctctgccggcagtcgtcaccgtcgccaactccgccccccgcctggcctacaagaccctgcgcggcgcccggcgcgtccagcaactgcagcgcgacgaagcggagcgctcgcgggttatccgcaccgtcaacctcgacgacattggcgccgacccggtccgctgcggcctcaaaggttcgcctacaatcgtggccgccaccgaaaaagtcggcgaaattggcggcaactgtaccctctaccagggcaagcctctccagcaactggtagacgatttgcttgccgcccaggtgattgcaccggagcttgtgaagcaatga

SEQ ID NO: 19987 - protein, 274 aa, Gloeobacter violaceus
MNIFVLIKQVPDQGAKAGINPDGTIDRARAKRMLNPFDRYALEAALFVRRLYGGTVTAISMGPPPAVEVLYEAIAHGVDQAILLSDRRLAASDTLATAYALYCTVRYAGAFDLVFCGLQTTDGDTAQVGPQLAERLQVPQITYCEKFEIAQGAIVARRVIEGGAQTVRCPLPAVVTVANSAPRLAYKTLRGARRVQQLQRDEAERSRVIRTVNLDDIGADPVRCGLKGSPTIVAATEKVGEIGGNCTLYQGKPLQQLVDDLLAAQVIAPELVKQ

SEQ ID NO: 19988 - DNA, 750 bp, Chromobacterium violaceum
  CDS (1)..(750)
atgaaagttctagtcgcagtgaaacgcgttgtcgattacaacgtgaaagtccgcgtcaaagccgacggcagcgacgttgatatcgccaacgtcaagatgtcgatgaatcccttcgacgagatcgccgtggaagaggcggtgcgtctgaaggaagccggcaaggtgagcgagatcgtcaccgtgtccatgggcgtcaagcagtgcgaggaaacgctgcgcaccgcgctggcgatgggcgccgaccgcgccatcctggtggaaaccgacgtcgagctgcagccgctggccgtggccaagctgctgaaggccgtcgccgacaaggagcaaccgcaactggtgatcctgggcaagcaggcgatcgacgacgacgccaaccagaccggccagatgacttccgcgctgctgggctggtcccagggcacgttcgcctccaaggtcgacctggcggccgagaccgtggacgtgatccgcgagatcgacggtggcctggaaaccgtcaagctgcgcctgccggccgtggtcaccgccgacctgcgcctgaacgagccgcgcttcatcaagctgcccaacatcatggccgccaagaagaagccgctggacaagaccacgccggccgaactgggcgtcgacgccgcgccgcgcctgaagacgctgaaagtggccgaaccggccaagcgttccgccggcatcaaggtggccaacgccgccgaactggtcgccaaactcaagaacgaagcaaaggtgctgtaa

SEQ ID NO: 19989 - protein, 249 aa, Chromobacterium violaceum
MKVLVAVKRVVDYNVKVRVKADGSDVDIANVKMSMNPFDEIAVEEAVRLKEAGKVSEIVTVSMGVKQCEETLRTALAMGADRAILVETDVELQPLAVAKLLKAVADKEQPQLVILGKQAIDDDANQTGQMTSALLGWSQGTFASKVDLAAETVDVIREIDGGLETVKLRLPAVVTADLRLNEPRFIKLPNIMAAKKKPLDKTTPAELGVDAAPRLKTLKVAEPAKRSAGIKVANAAELVAKLKNEAKVL

SEQ ID NO: 19990 - DNA, 771 bp, Neurospora crassa
  CDS (1)..(771)
atgtcagccctacggatattggtgcccgtcaagcgggttattgactatgcggtcaagccgcgagtcaacaaggcccagacgggagtcgagacggccggtgtcaagcacagcatgaaccccttcgacgagctatcggtcgaagagagcgtgcgcatccgcgaggggaagaagacccccgtcgaggacatttgcgtcatcagcgccgggccaaccaaggcccaggacgtcctgcgcaccgccatggccatgggcgccgaccgggccatccacgtcgagaccaaggagggcgaggacctcgagccgctgggcgtcgccaagctgctcaaggccgccaccgaacagaacaagagcaacctcgtgatcctgggcaagcagagcatcgacgacgacgccggccagacgggccaaatgctggccggtctgctgggctgggcgcaggccacccaggcgagcaagatcgagttcaccggcggcgattctgtgcaggtgacgagggaggtggatggcggtgttgagacgctcaaggccaagctgcccatggtcatcacgaccgacttgcgcctcaacgagccccggtacgcgagcttgcccaacattatgaaggccaagaagaagccgctcgagaagaagacgctggcggattacggtattacggccgagaagaggctcaaaactatcaaggtcaccgagcctcccccgagacagggtggtggcaaagtggaggatgtggatggcttggtctcgaagctcaaggagcttggtgctctttaa

SEQ ID NO: 19991 - protein, 256 aa, Neurospora crassa
MSALRILVPVKRVIDYAVKPRVNKAQTGVETAGVKHSMNPFDELSVEESVRIREGKKTPVEDICVISAGPTKAQDVLRTAMAMGADRAIHVETKEGEDLEPLGVAKLLKAATEQNKSNLVILGKQSIDDDAGQTGQMLAGLLGWAQATQASKIEFTGGDSVQVTREVDGGVETLKAKLPMVITTDLRLNEPRYASLPNIMKAKKKPLEKKTLADYGITAEKRLKTIKVTEPPPRQGGGKVEDVDGLVSKLKELGAL

SEQ ID NO: 19992 - DNA, 750 bp, Bordetella bronchiseptica
  CDS (1)..(750)
atgaaaatactggtaccagtcaagcgcgtggtcgactacaacgtcaaggtgcgcgtcaaatcggatcaaacgggggtggacatcgccaacgtgaagatgtccatgaacccgttcgacgagatagcggtcgaggaggccacgcggctcaaggagaagggcgcggtggcggaggtggtggcggtttcttgcggcgccgcacaatgccaggagacgctgcgcacggcgatggcgatcggggcggaccgcgcggtgctggtgcagaccgacgcggagctgcagccgctggcggtggccaagctgctcaaggcgctggtggacaaggagcagccgcagctggtgattctgggcaagcaggcgatcgacgacgacgccaaccagacggggcagatgctggcggcgctgctggattggccgcaggcgacgtttgcgagcaaggtggagctgggcgatggtcaggtgacggtgacgcgcgaggtcgatggggggctggagacgctgtcgctgaatctgccggcgatcgtgaccacggacctgcggctgaacgagccgcgctacgtgacgctgcccaacatcatgaaggccaagaagaagccgctggagacggtgagcccgcaggatctgggggtggatccggcgccgcgcctgaagacgctgaaggtgagcgagccgccggcgcgccaggccggcatcaaggtgcctgatgtggccacgctggtggacaaactgaagaacgaagcgaaggtggtgtga

SEQ ID NO: 19993 - protein, 249 aa, Bordetella bronchiseptica
MKILVPVKRVVDYNVKVRVKSDQTGVDIANVKMSMNPFDEIAVEEATRLKEKGAVAEVVAVSCGAAQCQETLRTAMAIGADRAVLVQTDAELQPLAVAKLLKALVDKEQPQLVILGKQAIDDDANQTGQMLAALLDWPQATFASKVELGDGQVTVTREVDGGLETLSLNLPAIVTTDLRLNEPRYVTLPNIMKAKKKPLETVSPQDLGVDPAPRLKTLKVSEPPARQAGIKVPDVATLVDKLKNEAKVV

SEQ ID NO: 19994 - DNA, 756 bp, Bordetella bronchiseptica
  CDS (1)..(756)
atgaagattctcgttcccgtcaagcgcgtggtggactacaacgtgaaggtccgcgtgaagtcggacaacacgggcgtggacatcgccaacgtcaagatgagcatgaatcccttcgacgaaatcgccgtcgaggaagccgttcggctgaaggaaaagggcgcggccagcgaggtgatcgcggtgtcgtgcggggtggcgcagtgccaggaaaccttgcgcacggccctggccatcggcgccgaccgggccatcctggtcgagacggcggccgagctgcagccgctggcggtggccaagctgctcaaggccctggtggaccgggaacagcccggcctggtcatcctgggcaagcaggcgatcgacgacgacgccaaccagacgggccagatgctggccgccctggccgatctgccgcaggcgaccttcgcgtccaaggtcgagctcgccggcgacaaggtcagcgtgacgcgcgaggtcgacggcgggctggaaaccctgtcgctggacacgccggccgtcatcaccaccgatctgcgcctgaacgagccgcgctatgtcaccttgcccaacatcatgaaggccaagaagaagccgctcgacacgatcaagccggaggacctgggtgtggacgtcgcgccgcgcctgaagacgctcaaggtgtccgagccgccgcagcgcgccgccggcgtgaaggtgcccgatgtcgccgccctggtggaaaagctgaagaacgaagcaaaagtgatccaaggatag

SEQ ID NO: 19995 - protein, 251 aa, Bordetella bronchiseptica
MKILVPVKRVVDYNVKVRVKSDNTGVDIANVKMSMNPFDEIAVEEAVRLKEKGAASEVIAVSCGVAQCQETLRTALAIGADRAILVETAAELQPLAVAKLLKALVDREQPGLVILGKQAIDDDANQTGQMLAALADLPQATFASKVELAGDKVSVTREVDGGLETLSLDTPAVITTDLRLNEPRYVTLPNIMKAKKKPLDTIKPEDLGVDVAPRLKTLKVSEPPQRAAGVKVPDVAALVEKLKNEAKVIQG

SEQ ID NO: 19996 - DNA, 835 bp, Mus musculus
  CDS (6)..(773)
ggaagatggcggagctgcgcgcgctcgtggctgtcaagagggtcatcgacttcgctgtgaagattcgggtaaagccggacaagtctggagtggtcactgatggtgtgaagcactccatgaaccccttctgtgagattgcagtggaagaggctgtgcggctaaaggagaagaaactggtgaaggagatcattgccgtcagctgtggcccctcacagtgccaggagaccatccgaactgctctggccatgggtgcagacagaggcatccacgtggagataccaggggcacaggcagaaagcttaggccccctgcaggtggcccgggtcctggccaagctggctgaaaaggagaaagtggaccttttgttcctgggcaagcaggctattgatgatgactgtaaccagacaggtcagatgacagctggacttctggactggccgcagggtacattcgcctctcaggtgacactggagggggacaaggtaaaagtggaacgggaaattgacgggggtctggagacccttcgcctgaagctgcccgctgtggtgactgctgacctaaggctcaatgagcctcgctatgccaccctgcccaacatcatgaaagccaagaagaagaagattgaagtggtcaaggctggagacctgggcgtggacctgacctccaaggtctctgtgatcagtgtggaagagccccctcagcgctcagcaggagtcaaggtggagaccacagaagacctggtggccaagctgaaggaggtggggcggatctgagaccctccctgatactctgcaataaaactgtgcctttccaagaaaaaaaaaaaaaaaaaaaa

SEQ ID NO: 19997 - protein, 255 aa, Mus musculus
MAELRALVAVKRVIDFAVKIRVKPDKSGVVTDGVKHSMNPFCEIAVEEAVRLKEKKLVKEIIAVSCGPSQCQETIRTALAMGADRGIHVEIPGAQAESLGPLQVARVLAKLAEKEKVDLLFLGKQAIDDDCNQTGQMTAGLLDWPQGTFASQVTLEGDKVKVEREIDGGLETLRLKLPAVVTADLRLNEPRYATLPNIMKAKKKKIEVVKAGDLGVDLTSKVSVISVEEPPQRSAGVKVETTEDLVAKLKEVGRI

SEQ ID NO: 19998 - DNA, 774 bp, Bacillus anthracis
  CDS (1)..(774)
atgaacatctacgtactcatgaaacgaacatttgatacagaagaaaaaatcgtaattaaaaacggtgcaatttacgatggcgaagcggaattcatcatcaacccttacgatgaatatgcgattgaagaagcaattcaagtaagagacgcacaaggtggagaagttactgttgtaacagtcggtggcgaagatagtgagaaagaacttcgtacggcgttagcgatgggctgtgataaagcggtattaattaatattgaagatgatgtagaaaatggtgaccagtttacaacagcaaaagtgcttgctgaatatttaaaagataaagatgcagatttaattttaggcggaaacgttgcaattgatggtgcatctggacaagttggtccgcgtgtagctgaagcattaaatattccgtacgtaacgacaattacaaaacttgaaattgacggtacaaacgtgaagattgagcgcgatgttgaaggtgatacagaagtggttgaaacttcattaccagttttagtaacagcacagcaaggtttaaatgaaccgcgttatccatcgcttccaggtattatgaaagcgaagaaaaagccactagaagaattagaattagatgatttagatttagaagaagatgatgtggaagcaaagacaaaaacaattgaaatctatttgcctcctaagaaagatgcaggaaaagtgttacaaggcgagctgcaagatcaagtaaaagaacttgtatcgttgctccatacagaagcgaaagtaatctaa

SEQ ID NO: 19999 - protein, 257 aa, Bacillus anthracis
MNIYVLMKRTFDTEEKIVIKNGAIYDGEAEFIINPYDEYAIEEAIQVRDAQGGEVTVVTVGGEDSEKELRTALAMGCDKAVLINIEDDVENGDQFTTAKVLAEYLKDKDADLILGGNVAIDGASGQVGPRVAEALNIPYVTTITKLEIDGTNVKIERDVEGDTEVVETSLPVLVTAQQGLNEPRYPSLPGIMKAKKKPLEELELDDLDLEEDDVEAKTKTIEIYLPPKKDAGKVLQGELQDQVKELVSLLHTEAKVI

SEQ ID NO: 20000 - DNA, 753 bp, Coxiella burnetii
  CDS (1)..(753)
atgaaaattctcgttggcgtaaaaagggttgttgattttaaagttaaagtccgtgtaaaagcggatggctcaggtattgaaacggatcaaataaaaatgtcaatgaatccgttcgatgaaattgcgctagaagaagccatccgcattaaagagaagggattagcttccgaagtgattgtcgtttccattggtcttgaggcttgccgcgagacactgctcaatgcactggctatgggagcagatcgagccctattaataaaaacagatcaagcgcaagaaccgattcatgtcgctcacttacttaaagtattaattgaaaaggaatcgccaaccctcttgattttaggcaaacaagctattgatgacgattgcaatcagacgggccagatgttggcagccctcttggattgggggcaggggacgttcgtttctaaatgcgatatcgaaggcgatcaattgcgcattacgcgtgaagtggatacggggttagagacactgcttgttcaattgcccgcggtaattactgccgatttacgcttaaacaaaccgcgttatcccactttaccgaacattatgaaagccaaaagcaagccgctaactattttaacgccagaggagcttggggtaacgttaacgcctcaccttacaacgcttaaaatcgaaagcccgccccaacgagcgccgggaattaaagtaaataatatcaatgaacttttgaacttattaaaacaaaaggataaagttttggcatga

SEQ ID NO: 20001 - protein, 250 aa, Coxiella burnetii
MKILVGVKRVVDFKVKVRVKADGSGIETDQIKMSMNPFDEIALEEAIRIKEKGLASEVIVVSIGLEACRETLLNALAMGADRALLIKTDQAQEPIHVAHLLKVLIEKESPTLLILGKQAIDDDCNQTGQMLAALLDWGQGTFVSKCDIEGDQLRITREVDTGLETLLVQLPAVITADLRLNKPRYPTLPNIMKAKSKPLTILTPEELGVTLTPHLTTLKIESPPQRAPGIKVNNINELLNLLKQKDKVLA

SEQ ID NO: 20002 - DNA, 753 bp, Vibrio parahaemolyticus
  CDS (1)..(753)
atgaaaatactagtgccaattaaaagggtcattgatccctacattaaggtccgtgttaaaccggacaacagcgatgttgaaaccaataacgtcaagatgactatcaacccgttttgcgaaatcgccgttgaagaagcggtgcgactaaaagagcaagggattgcagaagaagtcatcgttgtgagtgctggcggcacacaatgtcaggaacaattgcgcacggccctagcactaggagcagatcgcgcaattcatatcgaaacggcagacaagattgagccgctcgtggtgtccaagttgctcaaagcgattgttgaacaagagcaagcccaactggtgctcaccggcaaacaatcgatcgatacggacaacaaccaagtcgcgcagatgctggccgctttgcttgactggcctcaggcgacttttgcatcggatgtaaaaattgaagaccgcaaagtgcaggtggtgcgagaagtcgatggtggattgatgacagtagcaatgaacttgccagcggtgatcagcactgatttgcgtttaaacgagcctcgcttcgcttccctgccaaacatcatgaaagccaaacgtaagcccctcgatacgatcacaccagagagcttgggcgttgaagttgtgtttagccaaaccatcacggaagttaccccaccagcgcaaagaaaagccggtatcaaagtggagtctgtttcagaacttctcgataagctacgtaacgaagcgaaggtgatttcatga

SEQ ID NO: 20003 - protein, 250 aa, Vibrio parahaemolyticus
MKILVPIKRVIDPYIKVRVKPDNSDVETNNVKMTINPFCEIAVEEAVRLKEQGIAEEVIVVSAGGTQCQEQLRTALALGADRAIHIETADKIEPLVVSKLLKAIVEQEQAQLVLTGKQSIDTDNNQVAQMLAALLDWPQATFASDVKIEDRKVQVVREVDGGLMTVAMNLPAVISTDLRLNEPRFASLPNIMKAKRKPLDTITPESLGVEVVFSQTITEVTPPAQRKAGIKVESVSELLDKLRNEAKVIS

SEQ ID NO: 20004 - DNA, 750 bp, Pseudomonas syringae
  CDS (1)..(750)
atgaaggttcttgtagctgtcaaacgagtggtcgactacaacgtcaaggttcgcgtcaaggcggacaactccggcgtcgatcttgccaacgtcaaaatgtccatgaacccgttctgcgaaatcgctgttgaagaagcggtgcgcttgaaagagaagggcgtggcaacggaaatcgtggtcgtgaccattgggccgaccaccgctcaggaacaattgcgtacggctctggcgctgggtgcagaccgtgccgtgctggtcgagtccgcagaagaactcacttcgcttgccgtggccaagctgctcaaggccgtggtcgataaggagcagccacacctggtgatcctcggtaaacaggcgatcgacagcgacaacaaccagaccggccagatgctggctgcgctgagcggctacccgcaaggtactttcgcgtcgaaagtcgaagtgaccggcgacaaggttgccgtgacccgcgaaatcgacggcggcctgcagaccgtttccctgagcctgcccgccatcgtgaccacagacctgcgtctgaacgagccgcgctacgcctcgctgcccaacatcatgaaggccaagaaaaagccgcttgaagtgctgacgcccgatgcgcttggcgtgtccacggcctcgaccaacaagaccctcaaggtcgaagcgccggctgcacgcagcgccggtatcaaggtcaagtcggtggctgaactggtcgagaaactgaaaaacgaagcgaaggtaatctaa

SEQ ID NO: 20005 - protein, 249 aa, Pseudomonas syringae
MKVLVAVKRVVDYNVKVRVKADNSGVDLANVKMSMNPFCEIAVEEAVRLKEKGVATEIVVVTIGPTTAQEQLRTALALGADRAVLVESAEELTSLAVAKLLKAVVDKEQPHLVILGKQAIDSDNNQTGQMLAALSGYPQGTFASKVEVTGDKVAVTREIDGGLQTVSLSLPAIVTTDLRLNEPRYASLPNIMKAKKKPLEVLTPDALGVSTASTNKTLKVEAPAARSAGIKVKSVAELVEKLKNEAKVI

SEQ ID NO: 20006 - DNA, 750 bp, Pseudomonas putida
  CDS (1)..(750)
atgaaggttcttgtagctgtcaaacgagtggtcgactacaacgtcaaggttcgcgtcaaagcggacaactccggcgtcgaccttgctaacgtcaagatgtccatgaaccccttctgcgaaatcgccgtggaagaagccgtacgcctgaaggaaaaaggcgttgcgaccgagatcgtcgtggtttccgtcggcccgaccactgcccaggagcaactgcgtactgccctggccctgggtgccgaccgtgccatcctggtagaagccgctgacgaactgaactccctggccgtggccaaggcgctgaaggccgttgtcgacaaggagcagccgcagctggtcatcctcggcaagcaggccatcgacagtgacaacaaccagaccggccagatgctggccgcgctgactggcttcgcccagggtacctttgcgtccaaggtcgaagtcgctggcgacaagcttaatgtcacccgtgaaatcgatggcggcctgcagaccgttgcactgaacctgcctgcgatcgtcaccaccgacctgcgcctgaacgagccacgctacgcgtcgctgccgaacatcatgaaggccaagaagaagccgctggagactgttactccagacgcactgggcgtttccctcgcctccaccaacaagaccgtgaaggttgaagccccggctgcccgcagcgcgggcatcaaggtcaaatcggtggccgaactggtcgagaagctgaagaacgaagcgaaggtaatctaa

SEQ ID NO: 20007 - protein, 249 aa, Pseudomonas putida
MKVLVAVKRVVDYNVKVRVKADNSGVDLANVKMSMNPFCEIAVEEAVRLKEKGVATEIVVVSVGPTTAQEQLRTALALGADRAILVEAADELNSLAVAKALKAVVDKEQPQLVILGKQAIDSDNNQTGQMLAALTGFAQGTFASKVEVAGDKLNVTREIDGGLQTVALNLPAIVTTDLRLNEPRYASLPNIMKAKKKPLETVTPDALGVSLASTNKTVKVEAPAARSAGIKVKSVAELVEKLKNEAKVI

SEQ ID NO: 20008 - DNA, 789 bp, Clostridium tetani
  CDS (1)..(789)
atgaacatagtagtttgtataaaacaagtaccagataccacagaggtaagaatagatcctataaaaggaacattaataagagatggaattcctagcataataaatcctgatgataaaaatgctatagaagaggcattaaaaataaaagataaaataaaaggcactaaagtaatagcaataactatgggcccccttcaatcggaaagtgcactaagagaagctttagctatgggagttgataaggggattttattaagtgatagaaaatttgcaggttcagatacattagctacatcctatatattatcttcagtcattaaaaagataggagactatgacataatattttgtggaagacaagcaatagatggagatacagcacaggtaggaccaggtattgcagaacatttaaagatacctcaaataacttatgtaagtggattggatgtaaatggaagagagctaattgttaatagggatatagaggaaggttcatatgtaataaaatcgaaaatgccaatacttttaacggctataaaagaattaaatgaaccaagatatccatccattgctggaatatataaagctcatagagaaaaaagaattgatatatggacagcaaatgatttagaaatagatgaggagaaaataggacttaatggatcccctactaaagtaaaaaaatcctttactccttcaataagttctcaaggggaaataatagaaggaacagctgaggaagcttcatataaattagtttcaaagcttagagaaaaacaaataatatag

SEQ ID NO: 20009 - protein, 262 aa, Clostridium tetani
MNIVVCIKQVPDTTEVRIDPIKGTLIRDGIPSIINPDDKNAIEEALKIKDKIKGTKVIAITMGPLQSESALREALAMGVDKGILLSDRKFAGSDTLATSYILSSVIKKIGDYDIIFCGRQAIDGDTAQVGPGIAEHLKIPQITYVSGLDVNGRELIVNRDIEEGSYVIKSKMPILLTAIKELNEPRYPSIAGIYKAHREKRIDIWTANDLEIDEEKIGLNGSPTKVKKSFTPSISSQGEIIEGTAEEASYKLVSKLREKQII

SEQ ID NO: 20010 - DNA, 789 bp, Clostridium tetani
  CDS (1)..(789)
atgagaatattggtatgtattaaacaagtacctggaacttctaaagtggaagtagatgaaaagacaggagtattaaaaagagatggaatagattctaaaatgaatccatacgatttatatgctcttgaaactgcacttaaattaaaagaagattttggaggagaagtaaaagttgtaactatgggacctccgcaagcaaaagaaataataagtgaagcttatgctatgggagcagatgatggaatcattatatctgacagaagattcgcaggagctgacgtattagcaacttcatatgcaatatatcaaggaattaaacaagtaggagattttgatcttataatatgtggaaaacaaacaactgatggagatactgctcaagtaggacctgaagtagctgaatatttggatattgcacatatagcaaatgttttgaaaatagaagaggtaggagaagatggcttagtagtagagatggacatgccggaatcagtagaattagctgaagtgaagtttccatgtttaataactgtagaaaaagatatttttcaaccaagacttccctcttataaaagaaagaaatcaactgaacaaaaagaaataaaaatgcttagtctagacaactttgatgataaagatgaacataaatatggtttaaatggttcaccaacacaagtagaaaaaatattcccaccaccagtaaatgatcacaaagaaatgtgggaaggcaatggaatagaattaggcgatagagtttttcaagaattaaagaaattaaaatatgtttaa

SEQ ID NO: 20011 - protein, 262 aa, Clostridium tetani
MRILVCIKQVPGTSKVEVDEKTGVLKRDGIDSKMNPYDLYALETALKLKEDFGGEVKVVTMGPPQAKEIISEAYAMGADDGIIISDRRFAGADVLATSYAIYQGIKQVGDFDLIICGKQTTDGDTAQVGPEVAEYLDIAHIANVLKIEEVGEDGLVVEMDMPESVELAEVKFPCLITVEKDIFQPRLPSYKRKKSTEQKEIKMLSLDNFDDKDEHKYGLNGSPTQVEKIFPPPVNDHKEMWEGNGIELGDRVFQELKKLKYV

SEQ ID NO: 20012 - DNA, 780 bp, Clostridium tetani
  CDS (1)..(780)
atgaatatagttgtttgcgtaaagcaagttccagatactacagaagttaaaatagatccagtaacaggaacacttataagagaaggtgttccatcaataatgaacccagatgataaaaatgccctagaagaagctttaagattaaaagaaagcaatggtgctaaggtaacagtaataacaatgggaccacaacaagcagaatcaactctaagagaagcattatcaatgggagcagatgaagcaatattaatatcagatagagcttttgcaggtgcagatacattagcaacagcaacagcattaagtgcagctattaaaaagctagactacgatatagtatttgctggaagacaagctatagatggagatacagcgcaagttggaccagaaatagcagaaaacttagacttacctcaaattacttatgtagaaaaagttgaagtagatggagaagaattaaaagttagaagagcttgggaagatggatacgaaaatataagagttaaaacaccagttcttttaacagcaataaaagaacttaatgaaccaagatatatgcacgtagctcatatatttggagcgtttgataaagaaataaaaacttggaatgcagactttttagaagtagataaatcccttcttggactaagaggatctccaacaaaagttaagagatcaacaacaaaagaagcaaagggaaaaggcgaagttataagcctaactccaaaggaagcagcacaatgtgcagtagcaaaactaaaggaaaagcactacatctaa

SEQ ID NO: 20013 - protein, 259 aa, Clostridium tetani
MNIVVCVKQVPDTTEVKIDPVTGTLIREGVPSIMNPDDKNALEEALRLKESNGAKVTVITMGPQQAESTLREALSMGADEAILISDRAFAGADTLATATALSAAIKKLDYDIVFAGRQAIDGDTAQVGPEIAENLDLPQITYVEKVEVDGEELKVRRAWEDGYENIRVKTPVLLTAIKELNEPRYMHVAHIFGAFDKEIKTWNADFLEVDKSLLGLRGSPTKVKRSTTKEAKGKGEVISLTPKEAAQCAVAKLKEKHYI

SEQ ID NO: 20014 - DNA, 873 bp, Bacteroides thetaiotaomicron
  CDS (1)..(873)
atgagtttgaaaattgttgtattggcaaaacaagttcccgacacacgtaacgttgggaaagatgccatgaaagccgacggaactattaaccgtgcggcactccctgccatcttcaaccccgaagacctgaatgcccttgagcaagctcttcgtctgaaagatgctcacccaggctctaccgtaaccattctgacaatgggaccgggacgcgctgctgatattattcgtgaaggacttttccgtggtgccgataatggttatttgctaactgaccgcgcttttgccggtgcagatacgctggctacaagctacgctctggcaactgctatccgcaaaatcggtgagtgcgacattataatcggcggtcgtcaggctatcgacggtgatacggcacaggtaggtccgcaggtggcagaaaaacttggtttgacgcaaatcacatacgctgaagagattctggaagtaggtgacggcaaaatcaaagtgaaacgtcacatcgacggtggcgttgaaacggtagaaggcccgctgcccatcgttatcacagtcaacggttcggctgctccctgccgcccgcgtaacgccaagctggtacagaagtacaaacacgccaaaaccgttacggaaaaacaacaaggtaacctcgactataccgacctgtatgacaagcgcgattacctcaacctgcccgaatggagcgtagccgacgttaacggagacctcgcccaatgcggtctgtccggttcgcctacgaaagtaaaagccatccagaacatcgtgttccaggccaaagagagcaaaaccatcagcggcagcgaccgtgatgtggaagaactgattgttgaactgttagctaaccataccatcggataa

SEQ ID NO: 20015 - protein, 290 aa, Bacteroides thetaiotaomicron
MSLKIVVLAKQVPDTRNVGKDAMKADGTINRAALPAIFNPEDLNALEQALRLKDAHPGSTVTILTMGPGRAADIIREGLFRGADNGYLLTDRAFAGADTLATSYALATAIRKIGECDIIIGGRQAIDGDTAQVGPQVAEKLGLTQITYAEEILEVGDGKIKVKRHIDGGVETVEGPLPIVITVNGSAAPCRPRNAKLVQKYKHAKTVTEKQQGNLDYTDLYDKRDYLNLPEWSVADVNGDLAQCGLSGSPTKVKAIQNIVFQAKESKTISGSDRDVEELIVELLANHTIG

SEQ ID NO: 20016 - DNA, 774 bp, Oceanobacillus iheyensis
  CDS (1)..(774)
atgaatatatatgtacttttaaagaaaacttttgatacagaagaaaaaattactgtttcaggcggtagaattgaagatgatagtgccgaattcatcataaatccttatgatgaatatgcagtggaagaagctatcgtgcagcgtgatgaacatggtggagaggttactgtagttacagttggtgatgaagagtctgaaaaacaattacgtactgctttagcaatgggtgctgataaagctgtcttgataaatacagaagaagatattgaaaatggagatcaatatactactgctaaaattttagaagcattttttgaagataaagaagtagacttaattctagcgggtaatgtagcaattgatgaagccagtgggcaagtcgggccacgtttagcagcactgttagatattccttacgtttctacaataactagcttaaagattgatgacgatacagcttcaattgaaaaagatgtagaaggggatgtggaaattattgaaacaagtttacccctgttagttacttgtcaacaaggtttaaacgaaccacgttatccttctttaccaggtataatgaaagcgaagaaaaaaccattggaagaaattgaaattgacgatttagatttggatgaagatgatgtggaagcaaaaacaaaaacagtagaagtatatcttccgccggaaaaagaagcgggtaaaattctcgaaggggaacctgctgatcaagtgaaagaattagtatccttattgaaaaacgagaaaaaagtactttaa

SEQ ID NO: 20017 - protein, 257 aa, Oceanobacillus iheyensis
MNIYVLLKKTFDTEEKITVSGGRIEDDSAEFIINPYDEYAVEEAIVQRDEHGGEVTVVTVGDEESEKQLRTALAMGADKAVLINTEEDIENGDQYTTAKILEAFFEDKEVDLILAGNVAIDEASGQVGPRLAALLDIPYVSTITSLKIDDDTASIEKDVEGDVEIIETSLPLLVTCQQGLNEPRYPSLPGIMKAKKKPLEEIEIDDLDLDEDDVEAKTKTVEVYLPPEKEAGKILEGEPADQVKELVSLLKNEKKVL

SEQ ID NO: 20018 - DNA, 777 bp, Vibrio vulnificus
  CDS (1)..(777)
atgaaagtattggtgggtatcaaacgcgtgatcgacccttatctcaaagcgcgtgtgaaagcggacggttctggcgttgaaatgaccaacgtgaaaatgacgctcaatccgttttgtgaaatcgcggtagaagaggccgtgcgggtcaaagaagcgggccatgctgaggaagtgatcgttgtctccatcggtgacgaaagctgccaagagcaattgagagctgcgttggcgctgggggcggatagagcgattcatgtcgatctctcttctgtggtggagaatgcgcaaaatgtgttggctgtagaaccgctcacggtggcgaaaattctgcatcgtctgatggagcaagaatcggttggattagtgctgctgggaaaacagtccgtcgacagtgataacaaccaagtgccgcaaatgctggcggcattgagccaaagaccttgcgcgacgtttgcttccaaagtcgttgtctcgggtgagcaggtcaacgtgacgcgagaagtcgacggcgggttggaggagttgcgattagtacttcctgccatcatcagtacggatctgcgccttaatgagccgcgatatgcctctttacccaacatcatgaaagccaagaagaaaccgctggatgtgatcacactacaacagctttccattgaggttaaatctcatcagcaattgctgacggtgaacacaccaacagagcgcaaagccggagagcgggtggcgaatgtggatcagctcatcgaaaaattaaaaaacgacgccaaggtgctgtaa

SEQ ID NO: 20019 - protein, 258 aa, Vibrio vulnificus
MKVLVGIKRVIDPYLKARVKADGSGVEMTNVKMTLNPFCEIAVEEAVRVKEAGHAEEVIVVSIGDESCQEQLRAALALGADRAIHVDLSSVVENAQNVLAVEPLTVAKILHRLMEQESVGLVLLGKQSVDSDNNQVPQMLAALSQRPCATFASKVVVSGEQVNVTREVDGGLEELRLVLPAIISTDLRLNEPRYASLPNIMKAKKKPLDVITLQQLSIEVKSHQQLLTVNTPTERKAGERVANVDQLIEKLKNDAKVL

SEQ ID NO: 20020 - DNA, 750 bp, Shewanella oneidensis
  CDS (1)..(750)
atgaaagtattggtgcctgttaagcgcgtagttgatgccaatgtgaaggtcagggtaaaagctgacaacaccagcgttgataccgcaaacctcaaaatggcgttgaaccctttttgtgaaattgcagtagaagaagcggttcgtttaaaagaagcgggcagtgctacagaagtagtggtcgttagtatcggcaataaagccgttcaagaacaattacgtaccgcgttagccctaggtgctgaccgtgctatccatattgatactgaagaagagttagcgccagtatccattgctaaattacttaaagccgtacaagaaaaagaacaagcgcaattagtactgtttggtaagcaatccattgatggtgataacaaccaaacgggccaaatgtttgcggcattaaccgatatgccacaggcaacttttgcttcagcaatcaaagttgaaggtaattcaatccaagtggcccgtgaaatcgacggtggtatgcaaaccctgagtctgccattacctgcggtagtgacagccgatttacgtttaaacgagccacgttatgcttcattaccgaacatcatgaaagccaaacgtaagccattagatgtgctgacggtagcggatttaggtgtgacgctaaaagcccatcaaactgtagtcaaggtgacgccacctgctgaacgtaaggccggtatcatggttgcgtcggtagcagagctggttgaaaagttaaagaatgaagcgaaggtgatctaa

SEQ ID NO: 20021 - protein, 249 aa, Shewanella oneidensis
MKVLVPVKRVVDANVKVRVKADNTSVDTANLKMALNPFCEIAVEEAVRLKEAGSATEVVVVSIGNKAVQEQLRTALALGADRAIHIDTEEELAPVSIAKLLKAVQEKEQAQLVLFGKQSIDGDNNQTGQMFAALTDMPQATFASAIKVEGNSIQVAREIDGGMQTLSLPLPAVVTADLRLNEPRYASLPNIMKAKRKPLDVLTVADLGVTLKAHQTVVKVTPPAERKAGIMVASVAELVEKLKNEAKVI

SEQ ID NO: 20022 - DNA, 762 bp, Leptospira interrogans
  CDS (1)..(762)
atgaaaatcatcgtattagtgaaacaggtacctgacaccgaaacgagtattaaagtaggggacaaatccattaacgaaaccggaattaaatggattatctctccttatgatgaatttgccattgaagaaggaatcagacttcgtgaaaaacacggtggagaagtcatcgccgtttccctcggaccagacagagtcgtagaagctcttcgaaccgcttacgcaatgggcgcagaccgcgcggttcatatcaaagtggataactacgttcctttcgacacgaacaatacagcagaactgatttcaaactttgcaaaagcagaaaacgcagacgtaattatcggaggaagacaatccatcgatacagattcttctcaagttgtcatccaagttgcagaacttttaggaattcctcatattgcatttgcaatcaatcttgaaattaatggaaccgcggttaaagctacaaaagaagtagaaggtggaactcaaaccgtcgaaacttctactccagtggctcttacagcacagaaaggattgaacgaacctcgttatccttctctcaaagggatcatgaccgctaagaaaaaacctgtggaaactaaatctgcagcagatctaggtagccccgctagtaaaatcgaaattgttggactggagcctcctcctccaagaattccaggtagaaaactagaagctgcagatgcgaacgcttttgcatctcaactcgtgaaggctcttagagaagaagctaaggttatataa

SEQ ID NO: 20023 - protein, 253 aa, Leptospira interrogans
MKIIVLVKQVPDTETSIKVGDKSINETGIKWIISPYDEFAIEEGIRLREKHGGEVIAVSLGPDRVVEALRTAYAMGADRAVHIKVDNYVPFDTNNTAELISNFAKAENADVIIGGRQSIDTDSSQVVIQVAELLGIPHIAFAINLEINGTAVKATKEVEGGTQTVETSTPVALTAQKGLNEPRYPSLKGIMTAKKKPVETKSAADLGSPASKIEIVGLEPPPPRIPGRKLEAADANAFASQLVKALREEAKVI

SEQ ID NO: 20024 - DNA, 789 bp, Corynebacterium efficiens
  CDS (1)..(789)
atgtggatgtccacaatcgtggtgctggtgaaaaacgttccagacacgtggtcaaagcggaccctggaggccgacttcaccctcgatcgtgagggcgttgacgaggtcctggatgagatcaacgagttcgcactcgaacaggccctgcgactccgggaagccaacccgggtcacaaggtggtggcactgtccgccggccctgaatccgctgatgaggcactgcgcaaggccctttccatgggtgcggatgaggccatcctgctcaccgatggggcactggcgggttccgatctgctgggcaccgcctgggcgttgaacaacgccatcaacaccatcccggatgtctccctcatcgtggccggagcggcttcgtccgatggttccatgggtgcgctgccgggtgtgctggccgagtaccgccaggtgcctgcactgaccggactgtccagggtcgccattgagggtgctgacgtgaccggcacccgtgtggatcaccgcggcagcttcgagctcaaggccgctctgcctgcggtggtctccatcaccgataaggccgacaagccccgtttcccgaatttcaagggcatcatggccgcgaagaaggcgaccatcgcgcgcctcaacctggcgcagatcggtgtcaccccggagcaggtcggcctggcacacgcggcaaccgccgtgaccgccgcatccgagcgtccggcacgtacccgcggtgaggtcatcagctccggcgatgccgcggcacggatcgccgagcacctggccgccgacaacgtgatctag

SEQ ID NO: 20025 - protein, 262 aa, Corynebacterium efficiens
MWMSTIVVLVKNVPDTWSKRTLEADFTLDREGVDEVLDEINEFALEQALRLREANPGHKVVALSAGPESADEALRKALSMGADEAILLTDGALAGSDLLGTAWALNNAINTIPDVSLIVAGAASSDGSMGALPGVLAEYRQVPALTGLSRVAIEGADVTGTRVDHRGSFELKAALPAVVSITDKADKPRFPNFKGIMAAKKATIARLNLAQIGVTPEQVGLAHAATAVTAASERPARTRGEVISSGDAAARIAEHLAADNVI

SEQ ID NO: 20026 - DNA, 962 bp, Phytophthora infestans
  CDS (42)..(797)
accaagtcaaagattcggatctccccactacaactactgctatgaaggttctggtacccgtaaagcgcgtggtggactacgccgtcaagatccgtgtggagcccaagggcgtggatcttaagaacgttaagatgagcatgaaccccttctgtgagatcgccgtggaggaggccatccgcctcaaggagaagaaggtggcgtccgagatcgtcgccgtttcgatcggcccgaagcagagccaggagaccctccgaacggccctcgctatgggtgctgaccgtggtattcacattacgacggacatgcgcacggaccaggagctgcagccgctagccgttgccaagctgctcaaggaggtcgtggccaaggagggccccaagctcgtcatctgtggcaagcagagtatcgacgccgacgccgcccagacgggccctatgcttgccggtctgctggactggagccaaggcacgttcgcctcggatgtcgctgtggacggtgacgccgtcaacatcacccgtgagactgactctggtgtggagacgctcaagctcggtctgcccgccgtggtgaccgccgacttgcgtcttaacgagcctcgctacgccacgctgcctaacattatgaaggccaagaagaaaaaaatcgagacccttgcagccgacagcttcggcgtggacctcgccccgcgcatcgacgtggtggaggtcaaggaccccgcctcacgcaaggccggtatcaaggtggctagcgtggacgaactcgtggacaagctgaagaatgaggccggtgtgatctagagcggcaaacgaaaatgcagtttagtagcactgcgggttatatacacgtagttgagttgcaccaagttcaacgttgtgcataatctgcaaatcgtgacctttattgcaagtacagatggaccggcaactttggtgatgtgaaaaaaaaaaaaaaaaaaaaaaaaa

SEQ ID NO: 20027 - protein, 251 aa, Phytophthora infestans
MKVLVPVKRVVDYAVKIRVEPKGVDLKNVKMSMNPFCEIAVEEAIRLKEKKVASEIVAVSIGPKQSQETLRTALAMGADRGIHITTDMRTDQELQPLAVAKLLKEVVAKEGPKLVICGKQSIDADAAQTGPMLAGLLDWSQGTFASDVAVDGDAVNITRETDSGVETLKLGLPAVVTADLRLNEPRYATLPNIMKAKKKKIETLAADSFGVDLAPRIDVVEVKDPASRKAGIKVASVDELVDKLKNEAGVI

SEQ ID NO: 20028 - DNA, 792 bp, Chlorobium tepidum
  CDS (1)..(792)
atgaacatacttgtctgtgtaaagcaggtcccggatatggaggggcatttcatttcgaattcatccggcagctggttcgatgaggccggacttgcctggcggatgaacgagtatgacacctttgcggttgaagaggccattcggcttaaggagcagcttggcggcgaagcgcgggtgacggtgctctccgtcggcccggcgcgggtggtcgaaacgattcgcaaggcgctctcgacgggatgcgacgacggcgtgcacatcgtcgacccggaagcgcccgagcgcgatccgtggcagatcgcctcgatgatcgccggatttgccgtcgggcgcgggttcgacctcatttttaccggtatgcagtccgaagaccgaggctccgcgcaggtcggcgtgctggtggccgaacggcttggcatcgcctccgtgacgggtatcacggcgttcgagtggcaggatggcgcgatgacggtcgagcgcgaactcgaaggcggacgcaggtgcaggctccgcctgaaagctccggcgctcatgacctgccagctcggtctcaactcgccgcgctatcctaccctgccgaacatcatgaaatcaaaacgcacaatgctcaccgttctgtctccggaatcggtcggacttgaatcgccgaaagtattgtcctgcaatttccgcccccatgaacccaacggtgcgggtgtgattctcgagggcgacgccggggcgatggctgctcgggtgcttgaaattctcgaagctaaagggctcgtttccggcaaaggaggtgcgcgatga

SEQ ID NO: 20029 - protein, 263 aa, Chlorobium tepidum
MNILVCVKQVPDMEGHFISNSSGSWFDEAGLAWRMNEYDTFAVEEAIRLKEQLGGEARVTVLSVGPARVVETIRKALSTGCDDGVHIVDPEAPERDPWQIASMIAGFAVGRGFDLIFTGMQSEDRGSAQVGVLVAERLGIASVTGITAFEWQDGAMTVERELEGGRRCRLRLKAPALMTCQLGLNSPRYPTLPNIMKSKRTMLTVLSPESVGLESPKVLSCNFRPHEPNGAGVILEGDAGAMAARVLEILEAKGLVSGKGGAR

SEQ ID NO: 20030 - DNA, 852 bp, Rhizobium loti
  CDS (1)..(852)
atgcacattgtaatctgtatcaagcaggtgccggactccgcgcagatacgtgtccacccggtgacgaacacgatcatgcgccagggcgtgccgaccatcatcaacccttacgacctgttcgccctcgaagaggcactgaaattgcgcggcgcccatggcggcgaggtcaccgtgcttacgatgggtccgccgatggcagaagatgcgctgcgcaaggcgctcacctatggcgccgaccgagcggtactcttgaccgaccgctgttttgccggctccgacacgctggcgacctccttcgcgctttctcgggcaatcgtgagaattgccgagaccttcggcgcgccggacatcgtcttcgccggcaagcagacgattgacggcgataccgcccaggtcgggcccggcatcgccaagcgcctcggcctcctgcagttcacctatgtggcgaagatcgactctatcgatgtcgatgcgcgcgagatcaccgtcaagcgccgttcggaaggcggtacgcagatgctgaaaagcaggctgccttgcctcatcacaatgctggaaggcaccaacgaaatccgcaggggctcgctcgacgacgccatgcgcgccgcgcgcagccagatcgtgaaatggagcgcggccgaagctggcattgaggacctcaacaaatgcggcctgcgcggctcgccgacggtcgtcaagcgcgttttcgccccaaccacgaaggcggaaaaggcgacgcagatcgacatgaccgacaagacgcagcacgacctcgctgacgaactgatcgccgcaatctttacccgccagccagcgctggaacacgaactcgccttcgacggcggccagtga

SEQ ID NO: 20031 - protein, 283 aa, Rhizobium loti
MHIVICIKQVPDSAQIRVHPVTNTIMRQGVPTIINPYDLFALEEALKLRGAHGGEVTVLTMGPPMAEDALRKALTYGADRAVLLTDRCFAGSDTLATSFALSRAIVRIAETFGAPDIVFAGKQTIDGDTAQVGPGIAKRLGLLQFTYVAKIDSIDVDAREITVKRRSEGGTQMLKSRLPCLITMLEGTNEIRRGSLDDAMRAARSQIVKWSAAEAGIEDLNKCGLRGSPTVVKRVFAPTTKAEKATQIDMTDKTQHDLADELIAAIFTRQPALEHELAFDGGQ

SEQ ID NO: 20032 - DNA, 783 bp, Butyrivibrio fibrisolvens
  CDS (1)..(783)
atgaatatcgtagtatgtattaaacaggttcctgatacaaagggcggagttaagttcaacccagatggaactcttgatagagcagcaatgcttgcaattatgaacccagatgacaaggcaggtcttgaggctgcacttcgcatcaaggatgcaacaggtgcaaaggttacagttgtaacaatgggtcttccaaaggcagatgacatgcttcgtgaagctcttgcaatgggcgctgatgaagcagttcttatcactgatagacgtttaggtggtgcagatacttgggcaacatcttctacaatcgcagcaggtcttagaaatcttgattatgaccttatcatcacaggccgacaggctatcgatggtgatacagctcaggttggtccacagattgctgagcaccttggtcttcctgttatttcttatgctgaggatatcaaagttgagggcgatagtgttatcgtacagcgtcagtatgaggatagatatcatgaaatcaaggctaagatgccttgccttattacagctctttcagaattaaatgagccgcgttacatgactccaggtggagtatttgatgcatttgataaggaagtaacagtatggggcagagatgatcttaaggatcttgatgatgcaaacatcggtcttgctggatcacctacaaagattgccaaggcttcagataaggttcgtaagggcgcgggtgaaaaggtggcccttgatcctcaggagtctgtaaactatatcgtatcaaagcttaaagaaaagcatgtaatttaa

SEQ ID NO: 20033 - protein, 260 aa, Butyrivibrio fibrisolvens
MNIVVCIKQVPDTKGGVKFNPDGTLDRAAMLAIMNPDDKAGLEAALRIKDATGAKVTVVTMGLPKADDMLREALAMGADEAVLITDRRLGGADTWATSSTIAAGLRNLDYDLIITGRQAIDGDTAQVGPQIAEHLGLPVISYAEDIKVEGDSVIVQRQYEDRYHEIKAKMPCLITALSELNEPRYMTPGGVFDAFDKEVTVWGRDDLKDLDDANIGLAGSPTKIAKASDKVRKGAGEKVALDPQESVNYIVSKLKEKHVI

SEQ ID NO: 20034 - DNA, 789 bp, Corynebacterium glutamicum
  CDS (1)..(789)
atgtccacaatcgtggttctggttaaaaatgttccagacacctggtctaagaggactctggaagctgatttcacccttgaccgtgagggtgtagatcgagtcttggatgagatcaatgagtttgctctggagcaggcactgcgcttgcgggagtccaacccggatgctggttaccgcgttgttgcgctgagcgccggccctgccggtggggaagaggcgctgcgtaaggcgctgtccatgggtgctgatgaagcaatccagctcagtgatgatgccttggctggttctgatcttttgggaaccgcttgggcgctgaacaacgctatcaacaccatcgcgggtgttgctctcatcgtgacgggttcggcttcttccgatggttccatgggtgcgcttcctggcgtgttagctgagtaccgccaggtcccagcgttgactaacttgtctgcgctgaaggtcgagggtgcatctattactgccactcgcattgataaccacggcacctatgagttgcaggctgcacttcctgcggttgtgtcgatttccgataaggctgacaagccacgtttccctaacttcaagggcatcatggctgctaagaaggctgagatcaagaagctttccttggctgaaatcggcgtggctccagagcaggttggtctgtctcacgcggcaactgctgttactgctgcagctgatcgtcctgagcgctcccaaggtgatgtcattggtgcatcgggtgctgctgaaaagattgctgagtacctcgcttcagagaacctcatctag

SEQ ID NO: 20035 - protein, 262 aa, Corynebacterium glutamicum
MSTIVVLVKNVPDTWSKRTLEADFTLDREGVDRVLDEINEFALEQALRLRESNPDAGYRVVALSAGPAGGEEALRKALSMGADEAIQLSDDALAGSDLLGTAWALNNAINTIAGVALIVTGSASSDGSMGALPGVLAEYRQVPALTNLSALKVEGASITATRIDNHGTYELQAALPAVVSISDKADKPRFPNFKGIMAAKKAEIKKLSLAEIGVAPEQVGLSHAATAVTAAADRPERSQGDVIGASGAAEKIAEYLASENLI

SEQ ID NO: 20036 - DNA, 747 bp, Xanthomonas axonopodis
  CDS (1)..(747)
atgaaaatcctcgtcgcctacaagcgcgtggtggactacaacgtccgcattcaggtcaagccggatggctccggcgtggtgaccgagggcgtcaagctctcgcccaacccgttcgacgaaatcgccctggaagaagcattgcgcctgcgcgatgccggcatcgccacggaagtcgtggtcgccaccctggcgccggccgatgcggctgcgcacttgcgcaacggcctggccatgggcgccaatcgcgcaatccatgtggtgaccgatgcggctgttcagcccctgaccgccgcacgcgcgctgctcaaattggtcgagaaggaacagccggatctggtcatcctcggcaagcaggcgatcgacgacgacgccaatcagaccggccagatgctcgccacactctggggccgcccgcaggccaccttcgccggcaagctcgtcgttgccgatggcaaagccacggtcacgcgcgaggtcgacgccggcctggagacgctggaagtggacctgccggcggtgatcaccaccgatctgcgcctgaacgagccgcgcttcatcaagctgccggacatcatgaaggccaagagcaagccattggaaacgctggcgtttgccgacctgggtatcgacgcgcatgacagcctgaccaccacccactacgccgcgccgtccaagcgcagccgcggcgtgatggtcaaggacgccgccgagctggtggccgcactcaagcagaaggggttgctgtaa

SEQ ID NO: 20037 - protein, 248 aa, Xanthomonas axonopodis
MKILVAYKRVVDYNVRIQVKPDGSGVVTEGVKLSPNPFDEIALEEALRLRDAGIATEVVVATLAPADAAAHLRNGLAMGANRAIHVVTDAAVQPLTAARALLKLVEKEQPDLVILGKQAIDDDANQTGQMLATLWGRPQATFAGKLVVADGKATVTREVDAGLETLEVDLPAVITTDLRLNEPRFIKLPDIMKAKSKPLETLAFADLGIDAHDSLTTTHYAAPSKRSRGVMVKDAAELVAALKQKGLL

SEQ ID NO: 20038 - DNA, 783 bp, Thermoanaerobacter tengcongensis
  CDS (1)..(783)
atgaacattattgtttgcataaagcaggtgcctgacacaagtgaagtgaagatagaccctgtcacaaagactctcataagagaaggagtgccaagtataataaatccggaggataaaaatgctttggaagaagctataagaatcagagaaaagtatggagggaaggttacagtcatcactatggggccacaacaggcagaagaagctttaagagaagcccttgcgatgggagccgatgaggcttatctcctttctgataaggcatttgcaggtgccgatacttgtgcaactgccaaaactttggcaacgatgattaaaaaactggagtatgatttagtattttgtggaagacaggctatagatggcgacacagctcaagtgggaccgcagctggctgaacagcttggtattcctcaagtgacatacgttaaagagataaaagttgaaggggattcccttattgtcaaaaggacacttgaagatggctacgaagtgataaaagttaagatgcctgtgcttctcacggcaactaaggaacttaacactccaagatatccttcaataaagggaatatttgaagcctatagagaaaaagaagtaaaaattgtaactgcttcagaattgggaattgaccctcaggaagtgggacttaagggttcgccgactagagttatagccactacaacccctgagacagagagagcaggagagatttttacaggcaatgtaaaagaatgtgtacaaaacctcgttcagagattagttgaaaaacatcttatatga

SEQ ID NO: 20039 - protein, 260 aa, Thermoanaerobacter tengcongensis
MNIIVCIKQVPDTSEVKIDPVTKTLIREGVPSIINPEDKNALEEAIRIREKYGGKVTVITMGPQQAEEALREALAMGADEAYLLSDKAFAGADTCATAKTLATMIKKLEYDLVFCGRQAIDGDTAQVGPQLAEQLGIPQVTYVKEIKVEGDSLIVKRTLEDGYEVIKVKMPVLLTATKELNTPRYPSIKGIFEAYREKEVKIVTASELGIDPQEVGLKGSPTRVIATTTPETERAGEIFTGNVKECVQNLVQRLVEKHLI

SEQ ID NO: 20040 - DNA, 789 bp, Fusobacterium nucleatum
  CDS (1)..(789)
atgagaatagtagtttgtataaaacaagttccagatacaactgaagttaaaatagatccagtaaaagggacaattatcagagatggagttcctagtatcatgaacccagatgataaaggtggattagaagaagctctaaaattaaaagatttatatggagcagaagttattgttataacaatgggaccacctcaagcagaagctatattaagagaagcttatgcaatgggagctgacagagctatccttataacagatagaaaatttggaggagctgacacattagctacttctaatactattgctgcagcaataagaaaaatagaagatattgatttaatagttgcaggaagacaagcaattgatggagatactgcacaagttggacctcaaattgcagaacatttaggattacctcaagtatcttatgtgaaagaaatggaatataaagaagattcaaaatcatttgttattaaaagagcaacagaagatggatacttcttattagaacttcctactcctggattagtaactgtactttcagaagctaaccaaccaagatatatgaatgttggagctatcgttgatgtatttgaaagaccaattgaaacttggacatttgatgatattgaaatagaccctgcaaaaataggtttagctggatcaccaacaaaggttaataaatcatttactaagggagtaaaagaaccaggtgtattgcatgaagttgatgcaaaagaagcagctaacattatattagaaaaattaaaagaaaaatttataatctaa

SEQ ID NO: 20041 - protein, 262 aa, Fusobacterium nucleatum
MRIVVCIKQVPDTTEVKIDPVKGTIIRDGVPSIMNPDDKGGLEEALKLKDLYGAEVIVITMGPPQAEAILREAYAMGADRAILITDRKFGGADTLATSNTIAAAIRKIEDIDLIVAGRQAIDGDTAQVGPQIAEHLGLPQVSYVKEMEYKEDSKSFVIKRATEDGYFLLELPTPGLVTVLSEANQPRYMNVGAIVDVFERPIETWTFDDIEIDPAKIGLAGSPTKVNKSFTKGVKEPGVLHEVDAKEAANIILEKLKEKFII

SEQ ID NO: 20042 - DNA, 780 bp, Fusobacterium nucleatum
  CDS (1)..(780)
atggaaatattagtttgtataaaacaagttgcagacgattctgttgaagtatttatgaatgaaaaaacaggaaaacctgcattagaaggagttgaaaaagtagtaaatgcttttgacacttatgctttggaaatggcagtaagattaaaagagacaaaaggagatattactgtaattactctttcattaggaggagaagatgctaaaaatggtttaaagaactgtttagcagttggagcagatgaagcatttcatattaaagatgaaaattatcaagaaaaagatgctgttatcattgcccaagctctttttaagggtattcaaaaaatagaagaacaaagaggtaaaaaatttgatattattttctgtggaaaagaaactactgactttgcagctggacaagttgggattatgttagcagatgaactaaattatggagtggtaactaatttagttgatatagacacagaaggtgaaaaggttattgctaaaaaagaaacagaaacaggttatgaaaaagtagaagttgcttctccttgtctagtaactgtaaataaacctaattatgaacctcgttatccaacaatcaaaagtaaaatggcagctagaaaaaaagaaatagctgaagtttctactgaagtagcaaatgaaagtgcagtaaaagaagttaaattattctcacctccaaaaagacaagctggagtaaaaataaaaactggaactgctgaagaattagttgcacaggctattcaaaaaatgttggaagcaaaagtattttag

SEQ ID NO: 20043 - protein, 259 aa, Fusobacterium nucleatum
MEILVCIKQVADDSVEVFMNEKTGKPALEGVEKVVNAFDTYALEMAVRLKETKGDITVITLSLGGEDAKNGLKNCLAVGADEAFHIKDENYQEKDAVIIAQALFKGIQKIEEQRGKKFDIIFCGKETTDFAAGQVGIMLADELNYGVVTNLVDIDTEGEKVIAKKETETGYEKVEVASPCLVTVNKPNYEPRYPTIKSKMAARKKEIAEVSTEVANESAVKEVKLFSPPKRQAGVKIKTGTAEELVAQAIQKMLEAKVF

SEQ ID NO: 20044 - DNA, 780 bp, Clostridium beijerinckii
  CDS (1)..(780)
atgaatatagtagtttgtgtaaaacaagttccagatactacagcagtaaaaattgatcctaaaactggtacattaataagagatggtgttccatcaataatgaacccagaggataaacacgctttagaaggtgcattacaattaaaagaaaaagttggaggaaaagttactgtaataagtatgggacttccaatggctaaagcagtattaagagaagcattatgtatgggagctgatgaagctgttctattaacagatagagcacttggaggagcagatactttagctacttcaaaggcacttgcaggagtaatagctaaattagattatgatttagtatttgctggaagacaagcgattgatggagatactgctcaagtaggaccagaaatagcagaacatttaaacattcctcaagtaacttacgttcaagacgttaaagttgaaggaaatacattaatagtaaatagagcactagaagatggacatcaagtagtagaagttaaaactccatgtctattaactgcaatcgaagaattaaatgaaactagatatatgaatgttttagatatattcgaaacttcagatgatgaaatcaaagttatgagcgcagctgatatagatgtagatgtagctgaattagggcttaaaggctcacctacaaaggttaagaagtcaatgactaaggaagttaaaggtgcaggagaaatcgtaagagaagcacctaaaaatgcagcatactatgttgtaggaaaattaaaagaaaaacactacatctaa

SEQ ID NO: 20045 - protein, 259 aa, Clostridium beijerinckii
MNIVVCVKQVPDTTAVKIDPKTGTLIRDGVPSIMNPEDKHALEGALQLKEKVGGKVTVISMGLPMAKAVLREALCMGADEAVLLTDRALGGADTLATSKALAGVIAKLDYDLVFAGRQAIDGDTAQVGPEIAEHLNIPQVTYVQDVKVEGNTLIVNRALEDGHQVVEVKTPCLLTAIEELNETRYMNVLDIFETSDDEIKVMSAADIDVDVAELGLKGSPTKVKKSMTKEVKGAGEIVREAPKNAAYYVVGKLKEKHYI

SEQ ID NO: 20046 - DNA, 852 bp, Azospirillum brasilense
  CDS (1)..(852)
atgcacatcgttgtctgtatcaaacaggtgcccgacagcgcccagatccgcatccaccccgtgacgaacacgatcatgcgtcagggcgtcccggccatcatcaaccccttcgacctcttctcgctggaggaggcgctgcggatcaaggacaaggtcggcgcccgcgtcaccgtcctgaccatggggccgccgatggccgaaacctcgctgcgcaaggcgctgtcgctgggcgccgacgatgcggtgctgctgaccgaccgcaagttcgccggatcggacacgctggcgacctcctacgccctgacctccgccatcaagaagctgtcggaagaggaacaggtcgatctggtcttctgcggcaagcagacggtagacggcgacaccgcgcaggtcggtccgggcatcgccacgcggctgggcttccagcagctcacctacatcacgaagatcgaatcgatcgatcagggggcgcgggagatcgtcgtgcaccgccggtccgaaggcggcgtgcaggtgctgaagaccgccctgccctgcatgatcacgatgctggaaggcacgaacaccatccgcttcggcaagatggacgacatgttccgcgccgcccgctacggcctgaagacgtggaacaaggacaccaccggcgccgaagagacgaaggtcgggctgaagggctcgcccaccgtcgtgtcgaaggtcttcgtgccgaagccgcgcgcccagaaggcgacgatggtcgaggccgaggcccccaccgccgaggcccaggccgccgccgcagtcgaagccatcttcggcgcccagccgaaactcgccgacgagctgctcgcccgcgccgccgccggcctgtga

SEQ ID NO: 20047 - protein, 283 aa, Azospirillum brasilense
MHIVVCIKQVPDSAQIRIHPVTNTIMRQGVPAIINPFDLFSLEEALRIKDKVGARVTVLTMGPPMAETSLRKALSLGADDAVLLTDRKFAGSDTLATSYALTSAIKKLSEEEQVDLVFCGKQTVDGDTAQVGPGIATRLGFQQLTYITKIESIDQGAREIVVHRRSEGGVQVLKTALPCMITMLEGTNTIRFGKMDDMFRAARYGLKTWNKDTTGAEETKVGLKGSPTVVSKVFVPKPRAQKATMVEAEAPTAEAQAAAAVEAIFGAQPKLADELLARAAAGL

SEQ ID NO: 20048 - DNA, 852 bp, Rhizobium leguminosarum
  CDS (1)..(852)
atgcacatcgtggtctgtatcaaacaggtgccggactctgcgcagatacgcgtccacccggtgacaaatacgatcatgcgccaaggcgtaccgaccatcattaacccttacgacctgtttgctctcgaagaggcactacaagttcgtaaccgctatgggggcgaggtgactgttctcacgatggggccgcccatggctgagcaagcgctacgcaaagccctcacccacggcgcagatcgcgcagtgcttctcaccgaccgccactttgctggatctgacacgctggcgacctcgtatgctctttctcaagcagtagcgaagattggcgagagctatggggcgccagatatcgtctttaccggaaagcagacaattgacggcgacacggcccaggtcgggcccggaattgcaaagaggctgaacctccagcaactgacttacgtaacgaagatagtctccattgatcccacttcgcgcgagctcatggttgaacgacacgcggagagcggcacgcagatgctgaagagcacgttgccgtgtctcatcaccgtgctggaaggtgtcaatgcaatccgccggggctctctcgatgacgccttccgtgccgcgcgaagcccggttcttaaatggggggccgctgacgccggcattggggagttgaccaaatgcggcctaaggggatcgccgacggtcgtgaagcgagtattcgctcctggtccgcgcgccgaaaaagctatgcaaatggacattaacgacaaaacgttggccgaggtcgcggcggacacggtcgctgcaatttttgcgcgcgagcctgttttggaacgcaagctcacgtcccatggcaatcggtga

SEQ ID NO: 20049 - protein, 283 aa, Rhizobium leguminosarum
MHIVVCIKQVPDSAQIRVHPVTNTIMRQGVPTIINPYDLFALEEALQVRNRYGGEVTVLTMGPPMAEQALRKALTHGADRAVLLTDRHFAGSDTLATSYALSQAVAKIGESYGAPDIVFTGKQTIDGDTAQVGPGIAKRLNLQQLTYVTKIVSIDPTSRELMVERHAESGTQMLKSTLPCLITVLEGVNAIRRGSLDDAFRAARSPVLKWGAADAGIGELTKCGLRGSPTVVKRVFAPGPRAEKAMQMDINDKTLAEVAADTVAAIFAREPVLERKLTSHGNR

SEQ ID NO: 20050 - DNA, 780 bp, Clostridium perfringens
  CDS (1)..(780)
atgaaaatagtagtttgcttaaaacaagtgccagatacaacagctgttaaaatagatccaaaaacaggaactcttataagagatggagttccatcaataataaacccagaggataaacatgctttagaagctgcattacaattaaaagataataatggagcagaagtaactgtattaagtatgggaccacctcaagctaaatcagctttaagagaagctttatgcatgggagctgataaagcaattcttataactgatagagcatttgcaggtgcagatacattagctacttcaaaggctttagctggagcattaaagaaattagaatatgacataatatttgcaggaagacaagctatcgatggagatactgcacaggttggtccagaaatagctgaacatttaaatattcctcaagtaacttatgttcaaggcgttaaagttgaagaagatggattattagtaaatagagctttagaagatggatatgaattaataaaagttaaagctccagtacttttaactgctataaaagagttaaatgagccaagatacatgaatgttaaaaatatatttgaaacatctgatgatgaaatcttagtatggtcagctgatgacatagatgtagataaagctgaattaggattaaaaggatctccaacaaaagttaagagatcaatgactaaagaagctaaaggtgcaggagaaatagttaaagaatcacctaaagattcagttacttatgtactaggcaaattaaaagaaaaacactacatctaa

SEQ ID NO: 20051 - protein, 259 aa, Clostridium perfringens
MKIVVCLKQVPDTTAVKIDPKTGTLIRDGVPSIINPEDKHALEAALQLKDNNGAEVTVLSMGPPQAKSALREALCMGADKAILITDRAFAGADTLATSKALAGALKKLEYDIIFAGRQAIDGDTAQVGPEIAEHLNIPQVTYVQGVKVEEDGLLVNRALEDGYELIKVKAPVLLTAIKELNEPRYMNVKNIFETSDDEILVWSADDIDVDKAELGLKGSPTKVKRSMTKEAKGAGEIVKESPKDSVTYVLGKLKEKHYI

SEQ ID NO: 20052 - DNA, 789 bp, Clostridium perfringens
  CDS (1)..(789)
atgaagattatggtttgtattaaacaggttccaggaacttcaaaggttgaggttgatgaaaaaacaggggttttaaagagagatggagtagattctaaaatgaacccttatgatttatatgctttagaaactgcattgaggataaaagaaaagaaaggtggaaatataaaggttataagtatggggccaccacaagctaaggcagtaataaaagaggcttattctatgggagctgatgaaggaaccttagtttcagatagaaagtttgctggggctgatgttttagcaacttcatatacattatcacaaggagttaaaaaatgtggagattttgatattattctttgtggaaaacaaactacagatggagatacagcacaggttggacctgaaatggctgaatatttaggaattcctcatgttgctaatgttagaagaatattagatgttaatgatgattttattaaagttgaaatggatatgcctaatacaatagaggtactagaagtaaaatatccttgtcttttaactgtagataaagatatttttcaacctagattaccttcctataaaaagaaacttgaaacagatgaaagagaaataaatgtaatatctttaaatgattttgaagataaagatgagaaaaaatatggtttaaatgggtcaccaactcaagttgaaagaatatttccaccaagcaataatgatgaccatgaaatttggacaggagattcatctgaattaagtgaaagaatggaagataaattaagagagcttaagtttatatag

SEQ ID NO: 20053 - protein, 262 aa, Clostridium perfringens
MKIMVCIKQVPGTSKVEVDEKTGVLKRDGVDSKMNPYDLYALETALRIKEKKGGNIKVISMGPPQAKAVIKEAYSMGADEGTLVSDRKFAGADVLATSYTLSQGVKKCGDFDIILCGKQTTDGDTAQVGPEMAEYLGIPHVANVRRILDVNDDFIKVEMDMPNTIEVLEVKYPCLLTVDKDIFQPRLPSYKKKLETDEREINVISLNDFEDKDEKKYGLNGSPTQVERIFPPSNNDDHEIWTGDSSELSERMEDKLRELKFI

SEQ ID NO: 20054 - DNA, 750 bp, Ralstonia solanacearum
  CDS (1)..(750)
atgaaagtcctggtcgcagtcaagcgcgtgattgactacaacgtgaaggttcgcgtgaaggcggacggcagcggtgtcgatcttgccaacgtcaagatgagcatgaacccgttcgacgaaatcgccgtggaagaggcggtgcgcctgaaggaagcgggcgtggccaccgaagtgatcgccgtgtcgtgcggcgtggcgcagtgccaggagaccctgcgcaccgccatggccatcggcgccgaccggggcatcctggtcgagaccggcgaagagctgcagccgctggccgtggccaagctgctcaaggcgctgatcgacaaggaacagccgcagctgatcatcctgggcaagcaggcgattgacgacgacgcgaaccagaccggccagatgctggcggcgctggccggcctgccgcaagccaccttcgcctcgaaggtgcagatcgacgacggccgcgcttcggtcacgcgtgaagtggacggtggcctggaaacgctgtcggtcaagctgccggcggtggtcaccaccgacctgcgcctgaacgagccgcgctacgtgacgctgccgaacatcatgaaggccaagaagaagcaactggacacggtcaagccggaagacctgggcgtggacgtggcgccgcgtctgaagacgctcaaggtggccgagccgcccaagcgcagcgccggcgtgatggtgcccgatgtggcgacgctggtggccaagctcaagacggaagccaaggtgctgtga

SEQ ID NO: 20055 - protein, 249 aa, Ralstonia solanacearum
MKVLVAVKRVIDYNVKVRVKADGSGVDLANVKMSMNPFDEIAVEEAVRLKEAGVATEVIAVSCGVAQCQETLRTAMAIGADRGILVETGEELQPLAVAKLLKALIDKEQPQLIILGKQAIDDDANQTGQMLAALAGLPQATFASKVQIDDGRASVTREVDGGLETLSVKLPAVVTTDLRLNEPRYVTLPNIMKAKKKQLDTVKPEDLGVDVAPRLKTLKVAEPPKRSAGVMVPDVATLVAKLKTEAKVL

SEQ ID NO: 20056 - DNA, 765 bp, Salmonella typhimurium
  CDS (1)..(765)
atgaaaataataacctgctttaagttggtgcctgaagaacaggacattaccgtgaccccggagcattcgctcaattttgatcgtgccgaggccaaaatcagccagtttgatttaaatgcaattgaggccgccgcgcagttagctggcggtggcgacgagatcgccgcgctcaccgtcggcggctctctgttacaaaattcaaaagtccgcaaagatgtgttatcccgcgggccagatgcgcttttcatggttcaggatgcgcaaatggagcacgccctgcccaaagaaaccgcgctggcgctagcatccgcggcggagaaaatcggctttgacctgttgctctttggagagggctccggcgatatttatgcccaacaggtgggcctgctgactggcgaactcctgaaactccccgtcatcaacgcagtaagccatattcaacgcgacggcgacaaaatcatcgttgaacgcacactggaagaagacgttgaaattatcgagctcacgctgcccgcggtgctttgcgtgacctcagatattaacgttccacgcatcccgtcaatgaaagccattctcggcgccgggaaaaaagccgttacgtcgtggctggcgagcgatatccactggaccccaaccacgccaatggcggaactggtcgccatctcggtaccgccgcagacagaacgcaagcatatcattctcgataacgattcgccggaagccattaccgcactggccgaccatttgaaaaaatccctgaactaa

SEQ ID NO: 20057 - protein, 254 aa, Salmonella typhimurium
MKIITCFKLVPEEQDITVTPEHSLNFDRAEAKISQFDLNAIEAAAQLAGGGDEIAALTVGGSLLQNSKVRKDVLSRGPDALFMVQDAQMEHALPKETALALASAAEKIGFDLLLFGEGSGDIYAQQVGLLTGELLKLPVINAVSHIQRDGDKIIVERTLEEDVEIIELTLPAVLCVTSDINVPRIPSMKAILGAGKKAVTSWLASDIHWTPTTPMAELVAISVPPQTERKHIILDNDSPEAITALADHLKKSLN

SEQ ID NO: 20058 - DNA, 855 bp, Salmonella typhimurium
  CDS (1)..(855)
atggagcgttcagtcatgaagggcaaatggtggataaaccgttactggaaaaagcaaaaaggattttggctcatagcatttagtaaatatatgaaggagtcaccaatgaaagctttagtttgtgtaaaacaagttgtcgatcataacgttagaattagaataaagcgagatcattctgatgttgatatttctgattcaaaactcagtatcaatccatttgatgaaattgcagttgaagaagcagtacgtttaaaagaacggggattaatcagtgaggttgttgtagtgtctataggaaacacaggtgtaggggatgtattgcgtacagcactggcagcaggggcagacagggcaatacacatattaacaaaaaactctcttacaccactaattgtggccaaaactatcaccgctattacccggaatgaaaaacccgatattatattattaggcaagcaagctattgacgatgattgtaatcaggtaggccaaatgctggcagcattactcgatcttccccaagccactaatgttagtgaaattactatttctgataattcattaactgctgttcgtgaggttgatggaggattagaaacgttaaatttatccctgcctgcagtactcactacagatctacgtctgaatacaccgaggaatatcagcttgccgaatgttattaaagccaaaaagaaacctgttaaggagatagatttcgattcacttggtattaacccgtcatccagattgactattattaaagttgatgagccagcaagaaggaaagcaggcataatcgttccagatattaacacgctgctagataaattaaaaaacgaagaaaaagtaatttaa

SEQ ID NO: 20059 - protein, 284 aa, Salmonella typhimurium
MERSVMKGKWWINRYWKKQKGFWLIAFSKYMKESPMKALVCVKQVVDHNVRIRIKRDHSDVDISDSKLSINPFDEIAVEEAVRLKERGLISEVVVVSIGNTGVGDVLRTALAAGADRAIHILTKNSLTPLIVAKTITAITRNEKPDIILLGKQAIDDDCNQVGQMLAALLDLPQATNVSEITISDNSLTAVREVDGGLETLNLSLPAVLTTDLRLNTPRNISLPNVIKAKKKPVKEIDFDSLGINPSSRLTIIKVDEPARRKAGIIVPDINTLLDKLKNEEKVI

SEQ ID NO: 20060 - DNA, 771 bp, Pyrobaculum aerophilum
  CDS (1)..(771)
atgaaaattgcagttctcgtaaagacagcgcttgacaccgggcagttgagaattagagactccgtagtgattgaagagacgccgttgaaaatcagcgatatagaccgtaacgccgttgaggaggcggtgaaattaaaaggccaagacaaggcctatgccgtaactgtgttaaagtgggggcctcttcagaaaaaagtccaagaggctgagaacgtgttgcgcgaagctctggccatggggcttgacgaggcgtatttaatagctgatgagaaattattaaacgcgagccacgtggccacggccaaggccatagcggcagtggttaaaaaaataggcgctgatttagtgctggccggggaggccactgtggacaattacacaggacaaatccctgcgagagtggcggcggagctgggctggcctgtcatcacatacgtaagagagttgaaagttgaggggggaaaaatcattgccaagagggatttagaagatcacgtagaagtggtggaggcgcccctcccctctgtggtttctgtaactagggaaataaaccagccccgaatacctactctcctggcgattagagccgccatgaaaaagccggtgaataagctcacgctcgccgacttggggctagacattgcgcccaaaatttccgcgggctataagccgctggtaatacagaggaagaaaatagtgattaaagacggcactcctgaggagaaggcggagaagttaattcaatacttgaggcaggaaggggtgatatga

SEQ ID NO: 20061 - protein, 256 aa, Pyrobaculum aerophilum
MKIAVLVKTALDTGQLRIRDSVVIEETPLKISDIDRNAVEEAVKLKGQDKAYAVTVLKWGPLQKKVQEAENVLREALAMGLDEAYLIADEKLLNASHVATAKAIAAVVKKIGADLVLAGEATVDNYTGQIPARVAAELGWPVITYVRELKVEGGKIIAKRDLEDHVEVVEAPLPSVVSVTREINQPRIPTLLAIRAAMKKPVNKLTLADLGLDIAPKISAGYKPLVIQRKKIVIKDGTPEEKAEKLIQYLRQEGVI

SEQ ID NO: 20062 - DNA, 795 bp, Pyrobaculum aerophilum
  CDS (1)..(795)
atgaaaatcgttgtcctcacaaaagccgctgtccccctctcctcagcgataaaaatagatccgaagaccggcacgttagttagagagggcgtgccgttaacggctaatgtgtgggatagagacgcggtggagtttgcgcttaaacttagagacaaatacggaggtgaggtaatagctctgtccatggctcctcccagcggaatacctgcgcttgagagcctaataggcatgggagtggacagagctattctcgcctcagatagagtattcgcaggcgcagatacgtgggctactgcgcacgtcctcgctaagacaattgagaagtacatacccgattacgacctagtggttacaggcgaggagactattgacagcaccactgcccacataggcgcacagacggctagctggctcggcgtgccttatgtatactacgtatatgatgctgaggtaaaagggagggctcttattgtaaggcgttttctagaagacgagggagtagacgaggtttatgaggtagagatgcccgcagtaatatcagtgttaaagggctctcaaataccgagagaggtaagaatgagccgaaagctcaacgccagagagtacatacaaatagtgagtaataaggagttgggccttgatcctgaatgtgtgggtttgcggggaagccccactatagtcgccggcttatcgccggcgacatatccgccgaggaaaaaggtagtattgcaaggacagccggaggaggtggttaagaggctggttgaagttttaaaacaagagggagtgttatag

SEQ ID NO: 20063 - protein, 264 aa, Pyrobaculum aerophilum
MKIVVLTKAAVPLSSAIKIDPKTGTLVREGVPLTANVWDRDAVEFALKLRDKYGGEVIALSMAPPSGIPALESLIGMGVDRAILASDRVFAGADTWATAHVLAKTIEKYIPDYDLVVTGEETIDSTTAHIGAQTASWLGVPYVYYVYDAEVKGRALIVRRFLEDEGVDEVYEVEMPAVISVLKGSQIPREVRMSRKLNAREYIQIVSNKELGLDPECVGLRGSPTIVAGLSPATYPPRKKVVLQGQPEEVVKRLVEVLKQEGVL

SEQ ID NO: 20064 - DNA, 750 bp, Rhizobium meliloti
  CDS (1)..(750)
atgaaaatacttgtgacggtgaaacgggtggtcgactacaacgtcaagatccgggtcaaagcggatggatcgggcgtcgagcttgccaatgtgaagatgtcgatgaacccgttcgacgagatctcggtcgaagaggcgctgcggctgaaggaagccggcaaggcgagtgaagtggtggtcgtgtcgatcggcccggccaaggcggaagagacgctcaggaccgcgctcgccatgggcgccgaccgggcgatcctggtcgagacggaggaccaggtcgagccgctcgccgtcgccaagatcgtcaagggcgtggccgaggccgaacagccggggctgatcatcgtcggcaagcaggcgatcgacgacgattccaaccagaccggccagatgctgtcggcattgctcggctgggcccagggcacctttgcctccaaggtcgagatcggcgacggcaaggtcaacgtcacccgcgaggtcgacggcggcctgcagacggtcgaactgaagctgccggcggtggtcaccaccgatctcaggctcaacgaaccgcgctatgcctcgctgccgaacatcatgaaggcgaagaagaagccgctcgacaagaagaccccggccgacttcggcgtcgacaccagcccgcggctgaaagtcttgaagacggaagagccgtccggccgcaaggccggcgtcaaggtgaagacggtcgccgagctcgtcgagaagctcaagaccgaagccggcgtgctttaa

SEQ ID NO: 20065 - protein, 249 aa, Rhizobium meliloti
MKILVTVKRVVDYNVKIRVKADGSGVELANVKMSMNPFDEISVEEALRLKEAGKASEVVVVSIGPAKAEETLRTALAMGADRAILVETEDQVEPLAVAKIVKGVAEAEQPGLIIVGKQAIDDDSNQTGQMLSALLGWAQGTFASKVEIGDGKVNVTREVDGGLQTVELKLPAVVTTDLRLNEPRYASLPNIMKAKKKPLDKKTPADFGVDTSPRLKVLKTEEPSGRKAGVKVKTVAELVEKLKTEAGVL

SEQ ID NO: 20066 - DNA, 846 bp, Rhizobium etli
  CDS (1)..(846)
atgcacatagttatctgtatcaaacaggtaccggactccgcacaaatacgagtgcatccggtgacgaacacaatcatgcgtcagggggtgccaaccatcatcaacccctatgatctgttcgcccttgaagaggcgctccagttgcgcgaccgccatggcggcgaggtgaccgtgctcaccatggggccgcccatggcagaggacgcgttgcgcaaggcgctcacctacggcgccgaccgcgccgtactcttgaccgaccgtcattttgccggctccgacactctggcgacctcgtttgctctttcgcgagccatcgcgaagatcggagaggccttcggtacgcccgatatcgtctttacgggcaaacagaccatcgacggcgataccgcccaggttgggcctggcatcgccaagcgcctcgacctcctgcagctcacctacgttgccaaaatcgtctctgtcgacatcaatgggcgcgagattacggtggagcgccgctcggaagggggcacgcagacgctgatgagcaagctcccttgcctaattacaatgctcgaaggcacaaacgaaatccgccgcggctcgctcgatgacgcgctacgggccgcgcgcagccagatcgtgaagtggaatgcggccgacgctggcatagaggacctcaccaagtgcggcctgcgtggctcgccaaccgtcgttaagagggtctttgcccctcctgagcgggcggaaaaggcggagcagatcgacaccgcggaaaaaacaccgcgcgatctcgcggaggagttgatcgctgggatctttttgcgcagcggcgtcgaaagcgaactcgcctttgacgcgaattga

SEQ ID NO: 20067 - protein, 281 aa, Rhizobium etli
MHIVICIKQVPDSAQIRVHPVTNTIMRQGVPTIINPYDLFALEEALQLRDRHGGEVTVLTMGPPMAEDALRKALTYGADRAVLLTDRHFAGSDTLATSFALSRAIAKIGEAFGTPDIVFTGKQTIDGDTAQVGPGIAKRLDLLQLTYVAKIVSVDINGREITVERRSEGGTQTLMSKLPCLITMLEGTNEIRRGSLDDALRAARSQIVKWNAADAGIEDLTKCGLRGSPTVVKRVFAPPERAEKAEQIDTAEKTPRDLAEELIAGIFLRSGVESELAFDAN

SEQ ID NO: 20068 - DNA, 726 bp, Sulfolobus tokodaii
  CDS (1)..(726)
atgaatatagtaacttgttttaaaatagttcccgacgatactttaattaaaatagtcggagacaaactagacttaaacgttcctccaaaaattagtacatatgataaaaatgcaattgaagaagctgttaggataaaggagaaatatggaggaaaagcgataggagttactgctggaaatacagacagaaaaagtattagagaagcactagctatgggtttagatgaggtaatagcaataaacatgaaggagccagacgtaatgacaactgctgaggcaatagctgaaactatttcaccaataaaacctgatataattcttactggagaatctaccactgatagtagtacatcagtattttcctcctatctcgcttcactcttaaattatcccgtagtcacttatgctaagtcgattacaattgaaggtaataaagtaagggttgagaggaatttgacaacattccaagagattgtagagacggatttaccggcaataatttccgttgtaggtgagataaatactcctagaatacctagtgttaagcagatacttgagtcgtcaaaaaagccagtgaaaaatattgattataataaacagccaaaggtgaaaattgttaatgtttcgccatatgtaataactaggaaaaagattataattgaaggtaaaatggaagaagctgtagataaacttctcaattatttatctcaagaaggtgttttatga

SEQ ID NO: 20069 - protein, 241 aa, Sulfolobus tokodaii
MNIVTCFKIVPDDTLIKIVGDKLDLNVPPKISTYDKNAIEEAVRIKEKYGGKAIGVTAGNTDRKSIREALAMGLDEVIAINMKEPDVMTTAEAIAETISPIKPDIILTGESTTDSSTSVFSSYLASLLNYPVVTYAKSITIEGNKVRVERNLTTFQEIVETDLPAIISVVGEINTPRIPSVKQILESSKKPVKNIDYNKQPKVKIVNVSPYVITRKKIIIEGKMEEAVDKLLNYLSQEGVL

SEQ ID NO: 20070 - DNA, 1809 bp, Sulfolobus tokodaii
  CDS (1)..(1809)
atgagaatatttgtttcaattaagcaagttccagatgcagatgatttaagaatagatccagtaacaaataaccttgtaagagagggagtccctgcagtaattaatccaccagatttacatgcaattgaagaaggaattaggcttagagaaaggtatggtggaaaagttatagtaattacaatgggtccgccacaagctgaaaatgcattgagagaagcaatagcgatgggtgctgatgaagcatatttaataactgatagagctatggctggtgctgatacatgggcaacctcatatactttgtataaggcaataaagaagattggcgaaggtgatatttacctattcgggagaagagcagtggatggagaaacagaacaagttggaccacaaactggaaaatggctaggaattccttcagttggttatgtgtctaaattcatcgaaattggtgagggaaaagccagagtaattaggactgtagagaatgaggaagaggaaatagaagttcctttacctgcagtttttacagttttagaaacgataaataaacccagagagcctgatattcttagcctaattaaatcaaaaaccgttaagataccgaaattatctaaagatgatataggtgctgagcctaataaaattggtttagctggttcaccaactaaagtaattaaagttcatccaccaccaaaaacaagaaatccggaaatttacagaggtaatgatgcaccacaatgggtttatgataaaattgttaaatcgttgaaggaagttaatgaagtaaaagagacatatgttaaacctcaaccaaaggctaaggtaaatggtgaaatatgggtttatatagaccatactggagatgaggtaaacagggtatcatgggaaattatgtctgaagggagaagaatagcagatctcttagatactaaattagctggtgtaatagttggagatgacgaagttaaaccaattattaaagaggcatttaattacggtgttgataaagtatatcatgctagagtcaaaggatttccattttacattaatgatgtttatactagggctttatcaaaagttattaagaaatataaacctgaagctatcttcttccctggaacgagaaattcaagagaattagcatcaactaccgcaattgaagttgacactggattaattgctgattgtgtgagttttgatgtagatgaaaaaggaataatctattcaacaagaccggattttggcggtaaagaaatgagtacaattatttgtcctaatcataagccagttatgataacagtaaggggtggtgtgttttatcccattaaaattccaaaggaaggagaagtcatagttgaggaaatcgaagatctttctacgaaatttaaggtattgaattacactaaactacagaagaggaatgtattagctgaggcagatatagtaataggtgttggtagggggattaagtcaccagaaaatattaaactcgctgaggaattagcttcagtacttaacggagttgttggtgtttctaaacctttagcagatatgggatggtatcctaaagaaaggcaaataggtcaaactgggactacaattaggcctaagctttacatagccctcggaatttctggagcggtgcaacacttagtaggaatttctggagcgagaagaataatagcaataaacatagatcccgaagccccaatatttcaaaactgcgattatggtgtaataggagatatttttgaagtagtaccaggattagttaagatcgttagagaaaggggtgttcctcaatga

SEQ ID NO: 20071 - protein, 602 aa, Sulfolobus tokodaii
MRIFVSIKQVPDADDLRIDPVTNNLVREGVPAVINPPDLHAIEEGIRLRERYGGKVIVITMGPPQAENALREAIAMGADEAYLITDRAMAGADTWATSYTLYKAIKKIGEGDIYLFGRRAVDGETEQVGPQTGKWLGIPSVGYVSKFIEIGEGKARVIRTVENEEEEIEVPLPAVFTVLETINKPREPDILSLIKSKTVKIPKLSKDDIGAEPNKIGLAGSPTKVIKVHPPPKTRNPEIYRGNDAPQWVYDKIVKSLKEVNEVKETYVKPQPKAKVNGEIWVYIDHTGDEVNRVSWEIMSEGRRIADLLDTKLAGVIVGDDEVKPIIKEAFNYGVDKVYHARVKGFPFYINDVYTRALSKVIKKYKPEAIFFPGTRNSRELASTTAIEVDTGLIADCVSFDVDEKGIIYSTRPDFGGKEMSTIICPNHKPVMITVRGGVFYPIKIPKEGEVIVEEIEDLSTKFKVLNYTKLQKRNVLAEADIVIGVGRGIKSPENIKLAEELASVLNGVVGVSKPLADMGWYPKERQIGQTGTTIRPKLYIALGISGAVQHLVGISGARRIIAINIDPEAPIFQNCDYGVIGDIFEVVPGLVKIVRERGVPQ

SEQ ID NO: 20072 - DNA, 783 bp, Thermoplasma volcanium
  CDS (1)..(783)
atgcggctaagaaatgtatatacactttcaacgaatactggaataatggttaacgtaatagttctcataaaacagataatagacatagaccagatgaaaactgacagcgaaggaaaaccaattctttcaggcattccttatagagttgagaacctaagcaaaaacgccatagaagcagctgttcagctaaaggaaaagaatgggggcaaagtaacgggcataatttttgggacagaggcgtctacagctgccatgaaagaggcatatgctatgggggtagacgaaggtataataataactggatacaaaggaagcaacccaatagtaacggctaaggctataactagtatattaaagaatttgcagtatgacattgtcgtactcggagatcagtcagctgactcatatacaggaatgctgcctggcctcctttcggcaatgaccggttttccgctcctaggtaacgctaactctataacgataaacggcaggagcgtgaggataacacaggtcggcgaggccgaaaacgcagagatagaggcggatatgcctgctatagtatcggtgactcaagaaataaaccagcccaggcttccgcctgtcctccagataatggctgcaggccgtaagcctataaggatggagaagtatgatggttcgttctcaaatgtaaacgttatctcgaaccttgcgcctaagagcgaaaggaagaaaaagatcttcgaaaaagttgatgagggcatacccgagatagtcaaggtgataaaggaggagatgagatga

SEQ ID NO: 20073 - protein, 260 aa, Thermoplasma volcanium
MRLRNVYTLSTNTGIMVNVIVLIKQIIDIDQMKTDSEGKPILSGIPYRVENLSKNAIEAAVQLKEKNGGKVTGIIFGTEASTAAMKEAYAMGVDEGIIITGYKGSNPIVTAKAITSILKNLQYDIVVLGDQSADSYTGMLPGLLSAMTGFPLLGNANSITINGRSVRITQVGEAENAEIEADMPAIVSVTQEINQPRLPPVLQIMAAGRKPIRMEKYDGSFSNVNVISNLAPKSERKKKIFEKVDEGIPEIVKVIKEEMR

SEQ ID NO: 20074 - DNA, 798 bp, Thermoplasma volcanium
  CDS (1)..(798)
atgttgaacatagtggttatgattaagcaagttcctgacagcagtgaagttgaaattgatccggtgaagatgacgttaaacagaacgaaggctaggaacgtagtaaacgcttctgacttaaatgcactggaatacgccctacagataaaggataaagtgggtgccacgataactgtaatatctatggggccaccgatggcagattcagccataatagaatgcatggctaggggcgcagatcgtggcatactcataactgatagggcatttgctggtgccgatacttatccgacaggcctaacgcttgcggcaacgatatctaaaatagggaacgttgacataatatttggaggagacgaaacaactgattctagtacaggtcacgtaggtcccggggtagcagaattcctcggtatagatcaaattacatatgcaaaaacagtagactacgaagatggatatgtagtagctactcgtgaacttgaagatggtgacgaaattgtaaaagtaaagcctccggtactggtaactgtactcttgaattcaaatttaccaaggcaccagagcctcaggaaaaagatagacgctttgaggaaaggcgttgaaagttggggcgtaaatgagctcggtttaaagcctgagtgggttggtcttcgcggatctcctaccatagtaagatctatgaagacaataaaggagattgagcatatgaagaagaagatagatatagatcaccttggcgatatggttaaggaacttgttgacaagggtctaataaaggcaggtggttcccaatga

SEQ ID NO: 20075 - protein, 265 aa, Thermoplasma volcanium
MLNIVVMIKQVPDSSEVEIDPVKMTLNRTKARNVVNASDLNALEYALQIKDKVGATITVISMGPPMADSAIIECMARGADRGILITDRAFAGADTYPTGLTLAATISKIGNVDIIFGGDETTDSSTGHVGPGVAEFLGIDQITYAKTVDYEDGYVVATRELEDGDEIVKVKPPVLVTVLLNSNLPRHQSLRKKIDALRKGVESWGVNELGLKPEWVGLRGSPTIVRSMKTIKEIEHMKKKIDIDHLGDMVKELVDKGLIKAGGSQ

SEQ ID NO: 20076 - DNA, 852 bp, Rhizobium loti
  CDS (1)..(852)
atgcacattgtaatctgtatcaagcaggtgccggactccgcgcagatacgtgtccacccggtgacgaacacgatcatgcgccagggcgtgccgaccatcatcaacccttacgacctgttcgccctcgaagaggcactgagattgcgcgacgcccatggcggcgaggtcaccgtgcttacgatgggtccgccgatggcagaagatgcgctgcgcaaggcgctcacctatggcgccgaccgcgcggtactcttgaccgaccgctgttttgccggctccgacacgctggcgacctccttcgcgctttctcgggcaatcgtgagaattggcgagaccttcggcgcgccggacatcgtcttcgccggcaagcagacgattgacggcgataccgcccaggtcgggcccggcatcgccaagcgcctcggcctcctgcagttcacctatgtggcgaagatcgactctatcgatgtcgatgctcgcgagatcaccgtcaagcgccgttcggaaggcggtacgcagatgctgaaaagcaggctgccttgcctcatcacaatgctggaaggcaccaacgaaatccgcagaggctcgctcgaggacgccatgcgcgccgcgcgcagccagatcgtgaaatggagcgcggccgaagctggcattgaggacctcaacaaatgcggcctgcgcggctcgccgacggtcgtcaagcgcgttttcgcccctaccacgcgggcggaaaaggcgacgcagatcgacatgaccgacaagacgcagcacgacctcgctgacgaactgatcgcctcaatctttacccgccagccagcgctggaacacgaactcgccttcgacggcggccagtga

SEQ ID NO: 20077 - protein, 283 aa, Rhizobium loti
MHIVICIKQVPDSAQIRVHPVTNTIMRQGVPTIINPYDLFALEEALRLRDAHGGEVTVLTMGPPMAEDALRKALTYGADRAVLLTDRCFAGSDTLATSFALSRAIVRIGETFGAPDIVFAGKQTIDGDTAQVGPGIAKRLGLLQFTYVAKIDSIDVDAREITVKRRSEGGTQMLKSRLPCLITMLEGTNEIRRGSLEDAMRAARSQIVKWSAAEAGIEDLNKCGLRGSPTVVKRVFAPTTRAEKATQIDMTDKTQHDLADELIASIFTRQPALEHELAFDGGQ

SEQ ID NO: 20078 - DNA, 750 bp, Rhizobium loti
  CDS (1)..(750)
atgaagatccttgtgcccgtgaagcgggttgtggatgcgaacgtcaaggttcgcgtgaaggccgacggttcggcggtggaactcgccaacgtcaagatggcgatgaacccgttcgacgagatcgcggtggaagaggcgatccggctcaaggaagccggcaaggcagaagaaatcatcgtcgtctcgatcggcccgcagcaggcgcaggaaaccctgcgcaccgcgctcgccatgggcgccgaccgcgccatcctggtcaagaccgacgagcagaccgagccgcttggcgtcgccaaggtgctgaagggtgtcgtcgatgccgaacagcccggcctcgtcatcctcggcaagcaggcgatcgacgacgattccaatcagaccggccagatgctggcggccctgctcggctgggcgcaaggcacgttcgcttccaaggtggtgctcgatggcgacaaggccaaggtgacccgcgaagtcgacggcggcctgcaaacggtggaactgaagatgccggcgatcatcaccgccgaccttcgcctcaaccagccgcgctatgcctcgctgcccaacatcatgaaggccaagaagaagcagctcgacgaaaagaccccggccgactacggcgccgacgtcaagccgcgcctcaaggtcatcaagaccgaggagcccggcggccgcaaggcgggcgtcaaggtcaagagcgtcgccgaactggtcgacaagctcaagaacgaagccggcgttttgtaa

SEQ ID NO: 20079 - protein, 249 aa, Rhizobium loti
MKILVPVKRVVDANVKVRVKADGSAVELANVKMAMNPFDEIAVEEAIRLKEAGKAEEIIVVSIGPQQAQETLRTALAMGADRAILVKTDEQTEPLGVAKVLKGVVDAEQPGLVILGKQAIDDDSNQTGQMLAALLGWAQGTFASKVVLDGDKAKVTREVDGGLQTVELKMPAIITADLRLNQPRYASLPNIMKAKKKQLDEKTPADYGADVKPRLKVIKTEEPGGRKAGVKVKSVAELVDKLKNEAGVL

SEQ ID NO: 20080 - DNA, 762 bp, Rhodobacter sphaeroides
  CDS (1)..(762)
atgaaggttctggtgcctgtcaagcgcgtgatcgactacaacgtgaaggttcgcgtgaaggcggacgggagcggggtcgatcttgcgaacgtgaagatgtcgatgaacccgttcgacgaaatcgcggtcgaagcggcgatccgtctgcgcgaggccggcacggcgaccgaggtggtggtggtctcgatcggcgtgaagcaggcgcaggagacgctgcgcacggcgctcgccatgggggcggaccgcgcgatcctcgtcgaggccgcctcggacgtgcatcaggacatcgagccgctggcggtggcgaagatcctgaagggcgtggtcgaggccgaacagccgggcctcgtgatctgcggcaagcaggccatcgacaatgacatgaacgccaccgggcagatgctgtcggcgctgctcggctggagccaggcgaccttcgcctcggatctggccatcgagggcgatgcggccgtggtcacccgcgaggtggacggcggcatgcagaccatcaaggtcaagatgccgaccgtggtgacggtggatctgcggatgaacgagccgcgctatgcctcgctgcccaacatcatgaaggccaagaagaagccgctggaagaaaagaccgcggccgatttcggcgtcgacgtgacgccgcggctgtcggtcgtgaagacctccgagccggcgggccgcaaggccggcgtgatggtgggttcggtcgacgagctgatcgcgaaactgaaagacgaagcgggggtgatctga

SEQ ID NO: 20081 - protein, 253 aa, Rhodobacter sphaeroides
MKVLVPVKRVIDYNVKVRVKADGSGVDLANVKMSMNPFDEIAVEAAIRLREAGTATEVVVVSIGVKQAQETLRTALAMGADRAILVEAASDVHQDIEPLAVAKILKGVVEAEQPGLVICGKQAIDNDMNATGQMLSALLGWSQATFASDLAIEGDAAVVTREVDGGMQTIKVKMPTVVTVDLRMNEPRYASLPNIMKAKKKPLEEKTAADFGVDVTPRLSVVKTSEPAGRKAGVMVGSVDELIAKLKDEAGVI

SEQ ID NO: 20082 - DNA, 855 bp, Acetobacter diazotrophicus
  CDS (1)..(855)
atgcaaatctttgtctgtatcaaacaggttccggacagcggacagatccgcgtccatccggtcaccaacacgatcatgcgccagggggtgccgacgatcatcaacccctacgacctgttcgggctggaagaggcgctgcgcctgcgcgaccggttcggcggccaggtcacggtcatgaccatggggccgccgatggccgtcgaaagcctgcgcaaggcgatgaccttcggcgcggaccgtgccgtgctgctgaccgaccggattttcgccggctcggacacgctggccaccagctacgcgctggcgcagctgatccgcaaggccggtgaaacctggggcgagccggatatcgtcttctgcggcaagcagacgatcgacggcgataccgcgcaggtgggtcccggcatcgcccgtcgcctgggcctgtcgcagttgacctatgtgtccggtatcgatgacctggacatggtggaccgcaagatcctggtccgccgccgcggggaccatggggtgcaggtcctgcgctcggtgatgccggtcatgatcacgatgatggaaggcagcaacgaaatccggcgtggaacccaggctgacgccctgcgcgccgcccaggcggaaatcgtccagtggaacggcgccgccgccggcatcgaggatacggcgatgtgcgggctccgcgggtcgccgaccgtggtgaagaaggtcttcgcccccacggcccgggccgaaaaggccgagaagatcgcgaccggaaccgaaacgccggccgcgctggccgaaacgctgatcgacgccatcttcacccgccagcccgtgctgcaggccgatctgctgcagcaggccgccacgcactga

SEQ ID NO: 20083 - protein, 284 aa, Acetobacter diazotrophicus
MQIFVCIKQVPDSGQIRVHPVTNTIMRQGVPTIINPYDLFGLEEALRLRDRFGGQVTVMTMGPPMAVESLRKAMTFGADRAVLLTDRIFAGSDTLATSYALAQLIRKAGETWGEPDIVFCGKQTIDGDTAQVGPGIARRLGLSQLTYVSGIDDLDMVDRKILVRRRGDHGVQVLRSVMPVMITMMEGSNEIRRGTQADALRAAQAEIVQWNGAAAGIEDTAMCGLRGSPTVVKKVFAPTARAEKAEKIATGTETPAALAETLIDAIFTRQPVLQADLLQQAATH

SEQ ID NO: 20084 - DNA, 1695 bp, Thermoplasma acidophilum
  CDS (1)..(1695)
atgaagcaggttcctgatgtaaacaagataaagttcgatcctgaaacgaagaggatcgtgagaaaggatgtaccccttatgatgaactccttcgataagaaggcggtggaggaggctataagaatatcagaacgtcatggatgggaaacctgtgtggcaacgatggggccaccacaggcagtggaggttataaatgaggctctgagaatggggatagaacgcggatatctgatcacggatccttcactggccaattcggatacgctgatcacgtcgcgtgtgcttgcggcctttgccctcaggtatggcccagatcttgtgctgatgggaaaatattcactggatggagaaacctcacaggtaccggccgaggtatctgcactgatgggctggccatacgtgccatctgtatcgaagatcatgatatccgatcatctggaacttgaacaggagttagagaatggcatttatacctgctcggcaccgcttccatgcgttctgtcgcttagcgagaaaatcaacagggccagggccatcaagccagatacgccgcagatgtatgacagaatagtacagatcgatacaaaatggctcgggctggatctggatggcggcagggattctccaacagctgtcataggaaccgaacaggttaacagtaacagaagccctgttttcatagatcctggagctgatatgtaccggcagataatggagataattagggtgtcaaggaaaaacgacaggatgaagaccatcgatctgaattatgcggagttcagaggggaggcgtgggcaatagccattgacagtgagaatgcatcgcttgaaatagcatccaaggtcgcagacatcgcttcggaaaactcattttacgtgagggtgataggcaatgtagaattcagtgatccacggtctgtgccggctcaccatgtggatattatatccggaacagatgcggttggcctctcttattatattgtcgatgaaataaagaagcatagccccgagttcttgatctttccgtctacggtgactggtaggcagatatcttcccttgttgcggcaaggtttggtctaggattgacagccgactgcgtggacctttcgtatggtgatcgcggtctattgcagtacaaaccggctttcggcggtggggtcatagcagagattatatcccggaaaaaaccggcgatggccactgcaaggccgggcatgtttaggaaggtgaaggtaaacatagagcccagcatatcgcacatgtctcttgatcccgctggccggataaggtatggtcagttcatacctgtgcctcaggagttcaaacctcttgaaggatcaaggctgatactaggtataggccgcggcttgaagcgaaaggaagacctgccgaaaataatggagctggcatcaatgcttggcgcctccgttggcggttcaaggcccatagtggacatgaattatatcccaaggcagcagcagataggccttacaggaagcgctgtatcacctgatgtgtacatagcacttggaatctctggtcaggataatcacattgtgggattgcgatacgcaagaaagatcatagcggtgaatacagacaggaacgctccaatatttcgctattcagattatgggataatcatggatctgatgcagtttgttgaaggcttcctgcattttctcaatgcttag

SEQ ID NO: 20085 - protein, 564 aa, Thermoplasma acidophilum
MKQVPDVNKIKFDPETKRIVRKDVPLMMNSFDKKAVEEAIRISERHGWETCVATMGPPQAVEVINEALRMGIERGYLITDPSLANSDTLITSRVLAAFALRYGPDLVLMGKYSLDGETSQVPAEVSALMGWPYVPSVSKIMISDHLELEQELENGIYTCSAPLPCVLSLSEKINRARAIKPDTPQMYDRIVQIDTKWLGLDLDGGRDSPTAVIGTEQVNSNRSPVFIDPGADMYRQIMEIIRVSRKNDRMKTIDLNYAEFRGEAWAIAIDSENASLEIASKVADIASENSFYVRVIGNVEFSDPRSVPAHHVDIISGTDAVGLSYYIVDEIKKHSPEFLIFPSTVTGRQISSLVAARFGLGLTADCVDLSYGDRGLLQYKPAFGGGVIAEIISRKKPAMATARPGMFRKVKVNIEPSISHMSLDPAGRIRYGQFIPVPQEFKPLEGSRLILGIGRGLKRKEDLPKIMELASMLGASVGGSRPIVDMNYIPRQQQIGLTGSAVSPDVYIALGISGQDNHIVGLRYARKIIAVNTDRNAPIFRYSDYGIIMDLMQFVEGFLHFLNA

SEQ ID NO: 20086 - DNA, 777 bp, Thermoplasma acidophilum
  CDS (1)..(777)
atgataaagcaggttcctgacagcagcgaggttgagatcgatccggtcaagatgacgctaaacaggacaaaggcgagaaacgtagtaaatgctgcagatctaaatgcacttgaatatgcgctgaggataaaggacaaggttggagcaaacataaccgtcatatccatgggcccgccgatggccgatgccgcaataattgagtgcatggcccgtggagcagacaggggcattctaatcacggatagggccttcgccggagctgatacgtatcctacgggcctcactctggctgcaaccataaccaagctggggaacgtcgatatagtctttggcggggatgagacaaccgattccagcacgggccatgtcggtcctggtgttgcagaattcctcgggttcgatcagataacgtatgcgaaggaagtggactacgaagacggttacgttatagctacgagagatctcgaagatggggatgagatagtcaaggtgccaacgccggttgtcataacggttctcctgaactcgaacatcccgaggcaccagagcctcaggaaaaagatcgatgctatcagaaagggtgtggaatcatggggtataaatgagctcggtctcaagcctgaatgggtcggtctgcgcggttctccaacaatagtcaggtcgatgaaggctatcaaggaaccggagcacctgcacaagaccgtaacacttgacaagatcgatgatatcgttgcggatcttgtttcaaagaacataataaaggtaggtggtaagtga

SEQ ID NO: 20087 - protein, 258 aa, Thermoplasma acidophilum
MIKQVPDSSEVEIDPVKMTLNRTKARNVVNAADLNALEYALRIKDKVGANITVISMGPPMADAAIIECMARGADRGILITDRAFAGADTYPTGLTLAATITKLGNVDIVFGGDETTDSSTGHVGPGVAEFLGFDQITYAKEVDYEDGYVIATRDLEDGDEIVKVPTPVVITVLLNSNIPRHQSLRKKIDAIRKGVESWGINELGLKPEWVGLRGSPTIVRSMKAIKEPEHLHKTVTLDKIDDIVADLVSKNIIKVGGK

SEQ ID NO: 20088 - DNA, 789 bp, Streptomyces coelicolor
  CDS (1)..(789)
atgagcttgaggatcgttgtcactgtgaagtacgtgcccgacgccactggcgaccggcacttcgccgatgacctgaccgtcgaccgggacgacgtggacggtctgctctccgagctggacgagtacgcggtcgagcaggcgctgcagatctccgagaattccgacgacgacgtcgaggtcaccgtcctgacggtgggcccggaggacgccaaggacgccctgcgcaaggcgctgtccatgggtgccgacaaggcgatccacgtcgaggacgacgacctgcacggcaccgacgccatcggcacctcgctggtcctggccaaggccgtcgagaaggccggctacgacctggtcgtctccggcatggcctccaccgacggcaccatgggcgtcgttcccgcgctgctcgcggagcgcctgggcgtgccgcaggtgacgctgctgtccgaggtctcggtcgagggcggcgtcgtcaagggccgccgcgacggcgactcggccacggagcagctggaggcctccctgccggcggtcgtgtcggtcaccgaccagtcgggcgaggcgcgttacccgtccttcaagggcatcatggcggccaagaagaagccggttcagtcctgggacctgtccgacctcgacatcgacgaggacgaggtcggtctggagaacgcctacacggtcgtcgagtccgccaccgagcgtccggcgcgcaccgcgggcacgatcgtcaaggacgagggcgagggcggcaagcagctcgccgagttcctcgcgggccagaagttcatctga

SEQ ID NO: 20089 - protein, 262 aa, Streptomyces coelicolor
MSLRIVVTVKYVPDATGDRHFADDLTVDRDDVDGLLSELDEYAVEQALQISENSDDDVEVTVLTVGPEDAKDALRKALSMGADKAIHVEDDDLHGTDAIGTSLVLAKAVEKAGYDLVVSGMASTDGTMGVVPALLAERLGVPQVTLLSEVSVEGGVVKGRRDGDSATEQLEASLPAVVSVTDQSGEARYPSFKGIMAAKKKPVQSWDLSDLDIDEDEVGLENAYTVVESATERPARTAGTIVKDEGEGGKQLAEFLAGQKFI

SEQ ID NO: 20090 - DNA, 786 bp, Streptomyces griseus subsp
  CDS (1)..(786)
atgagcttgaggatcgttgtctgtgtgaagtacgtgcccgacgcgaccggtgaccggcgtttcgccgatgacctgacgctggaccgtgaggatgtcgacggtctgttgtcggagctggacgagtacgcggtcgagcaggcgttgcagatcgctgacggggcggacgatgcggagatcaccgtggtgacggtgggtccggaggatgccaaggacgcgttgcgcaaggcgttgtcgatgggtgcggacaaggcggttcacgtcgaggacgacgatctgcacggcagtgatgtgatggggacgtcgctggtgctggcgaaggctgtggagaaggccgggtatgacctggtgatctgtgggatggcgtcgacggacggtgtgatgggtgtgctgccggcgttgctggcggagcgtctgggtgtgccgcaggtgacgttgctgtccgaggtcgcggtggacggtggtgtggtgacggggcggcgtgacggtgacacggcgtccgagcagcttgaggcgtcgcttcccgcggtggtgtcggtgaccgaccagtcgggtgaggcccgttacccgtcgttcaaggggatcatggcggcgaagaagaagccggtggagtcgctggacctggacgatctgggtctggacgcggacgaggtcggtctggcgggtgcgtggacggtggtggattccgccaccgagcgtccggcgcggacggcgggcacgatcgtgaaggacgagggtgagggcggcaggcagctcgccgggttcctcgcgggccagaagttcatctag

SEQ ID NO: 20091 - protein, 261 aa, Streptomyces griseus subsp
MSLRIVVCVKYVPDATGDRRFADDLTLDREDVDGLLSELDEYAVEQALQIADGADDAEITVVTVGPEDAKDALRKALSMGADKAVHVEDDDLHGSDVMGTSLVLAKAVEKAGYDLVICGMASTDGVMGVLPALLAERLGVPQVTLLSEVAVDGGVVTGRRDGDTASEQLEASLPAVVSVTDQSGEARYPSFKGIMAAKKKPVESLDLDDLGLDADEVGLAGAWTVVDSATERPARTAGTIVKDEGEGGRQLAGFLAGQKFI

SEQ ID NO: 20092 - DNA, 756 bp, Arabidopsis thaliana
  CDS (1)..(756)
atgaagattctcgtcgccgttaaacgtgtcgtcgactacgccgtcaagatccgagtcaaacccgataagactggtgtagaaacccaaaatgtgaagatgtcaatgaatccattttgtgagatcgcgcttgaggaagcgcttcgaatcaaagaagctggttttgctaaagaggttattgcagtgagtattggaccttcacaatgtgtggatacacttcgtactggtttagctatgggtgctgatcgaggaatccatgttgagaccaattctatttttcttcctttgacgattgctaagatcttgaagagtttagctgatgttgagaatcctggattgattttcttagggaaacaggcgatagatgatgattgcaatcaaacaggacagatggttgcagctttacttggttggccacaagcaacgtttgcatcgaaggttgtgttggataaagataagaatgttgcaaccgtggatagagaagtggatggaggtcttgagactcttaatgtagacttacccgctgtgataacaactgatttgaggctgaaccaaccaagatatgcatcactccctaacataatgaaggcaaaatcaaagcctataaagaaaatgacggtgcaagatctgaaagtagacattaaatccgacatagagatcttggaagtcacggagcctccaaagaggaaatctggggttatggtttcttcggtggatgagttgatagataaacttaaaaatgaagctcatgttgtttga

SEQ ID NO: 20093 - protein, 251 aa, Arabidopsis thaliana
MKILVAVKRVVDYAVKIRVKPDKTGVETQNVKMSMNPFCEIALEEALRIKEAGFAKEVIAVSIGPSQCVDTLRTGLAMGADRGIHVETNSIFLPLTIAKILKSLADVENPGLIFLGKQAIDDDCNQTGQMVAALLGWPQATFASKVVLDKDKNVATVDREVDGGLETLNVDLPAVITTDLRLNQPRYASLPNIMKAKSKPIKKMTVQDLKVDIKSDIEILEVTEPPKRKSGVMVSSVDELIDKLKNEAHVV

SEQ ID NO: 20094 - DNA, 768 bp, Caenorhabditis elegans
  CDS (1)..(768)
atgaagattctcgtcggagtcaagagagttgtcgactatgctgtcaagatccgtgtcaagccggaccgctcgggagtcgtcaccgaaggagttcaacacagcatgaatccattcgacgagatcgctttagaggaggccgtcaagctcaaggagaagaagctcgccaccgaagtcgtcgcgttctcgctcggcggaccaaaatccgccgaagtgctccggaccgcgttggcgaagggcgccgacaaggcagttcacgttcaggtgaccgacgccgaagctggcaagctcgagtcattccacgtggcgaaggcgcttcagaagattgtcgagcaggagaagttcgacgcggtttttctcggaaagcaggcaatcgatgatgattcgtcgcaaactgctccgattctcgctggcctgctcgagtggccacaggctctctacgcgtcgaaggttgaagacgcaggcgctggacacatgaaggtcacccgtgaaattgatggaggtcttgacacgattaaggtcaaagtgccattcgtcctatccgccgatcttcgcctcaacgagccccgctacgcgactcttccaaacatcatgaaggccaagaagaagccactgaagaacattccaatcaaagatctgaatgtagatatcacaccacaaactgaaactcttgaagtcaccgagccaccagttcgccaggccggaggattcgtcgacgatgtctcggcacttgtcgccaagctcaaggagaagggattcgtcaaggcttaa

SEQ ID NO: 20095 - protein, 255 aa, Caenorhabditis elegans
MKILVGVKRVVDYAVKIRVKPDRSGVVTEGVQHSMNPFDEIALEEAVKLKEKKLATEVVAFSLGGPKSAEVLRTALAKGADKAVHVQVTDAEAGKLESFHVAKALQKIVEQEKFDAVFLGKQAIDDDSSQTAPILAGLLEWPQALYASKVEDAGAGHMKVTREIDGGLDTIKVKVPFVLSADLRLNEPRYATLPNIMKAKKKPLKNIPIKDLNVDITPQTETLEVTEPPVRQAGGFVDDVSALVAKLKEKGFVKA

SEQ ID NO: 20096 - DNA, 1000 bp, Drosophila melanogaster
  CDS (5)..(766)
gaaaatggcgcgtgttttggttggagttaagcgtgtgatcgactacgccgtcaaggtgcgcgtcaagcccgacaagactggcgtggtcacccagggcgtgaagcactcgatgaatcccttcgacgagatcgccgtggaggaggcggtgaagctgaaggagaaaaagctggccgaggaggtgatcgccgtctccgtgggcccggcccagtcgcaggaggtgatccgcaccgccctggccatgggcgccgatcgcggcgtccacgtagagatcccggccgccgagtacgagcttctgcagcccatccacgtgtcgaagattctggccaagttggctcttgacgaaaaagccgacctggtcatccttggcaagcaggccatcgacgatgatgccaaccaaacggcccagatgaccgccgccgtgctcgactggccgcagggcaccttctgcaacaagatcgagaagacagacgccggtctgaccatcacgcgtgaaattgatggtggcctggagacaatcaagaccaagaccccggctgtgctgagcgccgatctccggctgaacacccctcgctacgccacgttgccgaacatcatgaaggccaagaagaagccgctgaagaaggttacggccaaggatctcggcgtggacacctcgccccgcatcgaggtcatctccgtggaggatcctcctgtgcgccaggccggcgccaccgtcgccgacgtggatgccctggtggccaagctaaaggagggcggccacatctagatgttcctcaactagaaaattgtgagcgcatattctacgtttttaattagtcgaaagttatcagaaacgtgcatttatctagccggagagtcggatttgctgacaggctttaaatttctctgaattcaacccatacccgtgtgctttaagtgaactataaattggaatttattctcgttgtgtccagctctaagaataaagtgattgtaagctctgaaaaaaaaaaaaaaaaaa

SEQ ID NO: 20097 - protein, 253 aa, Drosophila melanogaster
MARVLVGVKRVIDYAVKVRVKPDKTGVVTQGVKHSMNPFDEIAVEEAVKLKEKKLAEEVIAVSVGPAQSQEVIRTALAMGADRGVHVEIPAAEYELLQPIHVSKILAKLALDEKADLVILGKQAIDDDANQTAQMTAAVLDWPQGTFCNKIEKTDAGLTITREIDGGLETIKTKTPAVLSADLRLNTPRYATLPNIMKAKKKPLKKVTAKDLGVDTSPRIEVISVEDPPVRQAGATVADVDALVAKLKEGGHI

SEQ ID NO: 20098 - DNA, 750 bp, Bradyrhizobium japonicum
  CDS (1)..(750)
atgaaggtcttagtgccggtaaagcgggtggtcgattacaacgtcaaggtccgcgtcaagggcgatggatcgggcgttgaactcgccaacgtcaagatgtcgatgaacccgttcgacgaaatcgcggtcgaggaagcgctgcgcctgaaggaaggtggcaaggccaccgaggtcgtggtggtttccattggaccggcgcaggcgtcggagacgatccgcaccggtcttgccatgggcgccgatcgcggcatcctggtgaaggccgagggcaccgtcgagccgctcgccgtcgccaagatcctgaagaaggtcgctgaggaagagcagccgggcctgatcatcctcggcaagcaggcgatcgacgacgacagcaaccagaccggccagatgctggccgcgctgctcggctggtcgcaggcgacgttcgcctcgaagctcgaggtcgaaggaagcgacttcaaggtcactcgtgaagtcgacgggggcttgcagaccgtgaagctgaagggaccggcgatcgtgaccaccgacctgcgtctcaacgagccgcgctacgcctcgctgcccaacatcatgaaggcgaagaagaagccgatcgcggagaagaccgtcgccgattacggcgttgacgtcaccgcgcgcctcgaggttctcaagacgaccgagccggcgggccgcaaggccggcgtcaaggtcaaggacgtcgccgagctggtgtcgaaactcaagaacgaagccggggtgctctga

SEQ ID NO: 20099 - protein, 249 aa, Bradyrhizobium japonicum
MKVLVPVKRVVDYNVKVRVKGDGSGVELANVKMSMNPFDEIAVEEALRLKEGGKATEVVVVSIGPAQASETIRTGLAMGADRGILVKAEGTVEPLAVAKILKKVAEEEQPGLIILGKQAIDDDSNQTGQMLAALLGWSQATFASKLEVEGSDFKVTREVDGGLQTVKLKGPAIVTTDLRLNEPRYASLPNIMKAKKKPIAEKTVADYGVDVTARLEVLKTTEPAGRKAGVKVKDVAELVSKLKNEAGVL

SEQ ID NO: 20100 - DNA, 813 bp, Megasphaera elsdenii
  CDS (1)..(813)
atggaaatattggtatgtgtcaaacaggttccggacactgcagaagttaagattgaccccgtaaaacatacggtcatccgcgctggtgttcctaacatttttaaccccttcgaccagaacgctttggaagcagctctcgcattgaaagatgctgacaaagacgtaaaaatcacacttctctcgatgggtcctgatcaggcaaaagacgttcttcgtgaaggcctcgcaatgggcgctgacgatgcttatcttctgtccgaccgcaaactcggtggttccgatacgttagctacgggctatgctttggcacaggctatcaaaaaattggctgctgacaaaggtatcgaacagttcgatatcatcctctgcggcaaacaggctattgacggcgataccgcacaggttggcccgcagatcgcttgcgaactcggtattcctcagattacgtatgcccgcgacatcaaagtcgaaggcgacaaagttactgttcagcaggaaaacgaagaaggctacatcgtaacggaagctcagttccctgttttgatcacggctgttaaagacttgaacgaaccgcgtttcccgaccattcgtggcacgatgaaagcaaaacgccgcgaaatcccgaacttggacgctgctgctgttgcagctgacgacgctcagatcggtttgtctggctctccgactaaagtccgtaagattttcacaccgcctcagagatccggtggtctcgttctcaaagttgaagatgacaacgaacaggcaatcgtcgaccaggtcatggaaaaactggttgcccagaaaatcatttaa

SEQ ID NO: 20101 - protein, 270 aa, Megasphaera elsdenii
MEILVCVKQVPDTAEVKIDPVKHTVIRAGVPNIFNPFDQNALEAALALKDADKDVKITLLSMGPDQAKDVLREGLAMGADDAYLLSDRKLGGSDTLATGYALAQAIKKLAADKGIEQFDIILCGKQAIDGDTAQVGPQIACELGIPQITYARDIKVEGDKVTVQQENEEGYIVTEAQFPVLITAVKDLNEPRFPTIRGTMKAKRREIPNLDAAAVAADDAQIGLSGSPTKVRKIFTPPQRSGGLVLKVEDDNEQAIVDQVMEKLVAQKII

SEQ ID NO: 20102 - DNA, 759 bp, Paracoccus denitrificans
  CDS (1)..(759)
atgaaggttctcgtgccagtcaagcgcctgatcgactacaacgtgaaggcgcgtgtgaagtctgacggttctggagttgatcttgcgaacgtgaagatgtcgatgaacccgttcgacgagatcgcggtcgaggaggcgatccgtctgaaggagaagggccaggccgaggagatcatcgcggtctcgatcggcgtcaagcaggcggccgagacgctgcgcacggcgctggccatgggcgccgaccgggcgatcctggtggtggccgcggacgacgtgcagcaggacatcgagccgctggcggtggcgaagatcctcgccgcggtggccagggcggaaggcaccgagctcatcatcgccggcaagcaggcgatcgacaacgacatgaacgccaccggccagatgctggcggcgatcctgggctgggcgcaggcgaccttcgcctcgaaagtcgagatcgaaggggccaaggccaaggtgacgcgcgaggtcgacggcggcctccagaccatcgcggtcagcctgccggcggtggtcaccgccgacctgcggctgaacgagccgcgctatgcctcgctgccgaacatcatgaaggccaagaagaagccgctcgatgaaaagaccgccgccgattacggcgtcgacgtcgcgccgcggctcgaggtggtctcggtgcgcgagcccgagggccgcaaggccggcatcaaggtgggctcggtggacgagctggtgggcaagctgaaagaagcgggggtgatctga

SEQ ID NO: 20103 - protein, 252 aa, Paracoccus denitrificans
MKVLVPVKRLIDYNVKARVKSDGSGVDLANVKMSMNPFDEIAVEEAIRLKEKGQAEEIIAVSIGVKQAAETLRTALAMGADRAILVVAADDVQQDIEPLAVAKILAAVARAEGTELIIAGKQAIDNDMNATGQMLAAILGWAQATFASKVEIEGAKAKVTREVDGGLQTIAVSLPAVVTADLRLNEPRYASLPNIMKAKKKPLDEKTAADYGVDVAPRLEVVSVREPEGRKAGIKVGSVDELVGKLKEAGVI

SEQ ID NO: 20104 - DNA, 867 bp, Bradyrhizobium japonicum
  CDS (1)..(867)
atgcataatattgtctgcatcaagcaagttccggactcggcgcagatccgcgtgcaccccgtgaccaatacaatcatgcgtcagggagtgccgaccatcatcaacccgtatgacctattcgcgctcgaggccgcgctggggctgcgcgatcggttcggtggcgaaattaccgtgcttaccatggggccgccatcggcagaggagtcgttgcgaaaggcgctgacttatggtgctgatcgcgccgtcctacttactgatcgctgctttgcgggctcggatacgctggccactacgtatgcgcttgcaacagcgatccggaaaattggcaaggaatatggtccggcaaacctcatcttcacgggaaagcagaccatcgacggcgatacagcgcaggttggtcctggcatcgcgaagcgactgggcgtagggcagctaacttacgttgcgaaggtcagatccgtggacgtcgccaatgaaacaattgaagcggagcggcgctcggaaggcggtgtgcaggttctgcacactaggttgccctgcctcatcaccatgcttgaggcgacgaatcagattcggcgaggcgcgatggcggatgccttgcgtgccgcgcgagccaaaatcgtgaaatggagcgcgcaagatgcaggtgtcgaagacatctccaaatgtgggctcaagggctcgccgactgtcgtcaaacgtgtgttcgctccccctgcgcgggccgagagggcggcgctggttgagtccgccgagcagccggcgcaggcgctaatagacgcaatcttcttgaatcaaccgaagctcgaaaccgatctggcgacacttgctcgtgacgcccgatctggactgtccgggcaatgttag

SEQ ID NO: 20105 - protein, 288 aa, Bradyrhizobium japonicum
MHNIVCIKQVPDSAQIRVHPVTNTIMRQGVPTIINPYDLFALEAALGLRDRFGGEITVLTMGPPSAEESLRKALTYGADRAVLLTDRCFAGSDTLATTYALATAIRKIGKEYGPANLIFTGKQTIDGDTAQVGPGIAKRLGVGQLTYVAKVRSVDVANETIEAERRSEGGVQVLHTRLPCLITMLEATNQIRRGAMADALRAARAKIVKWSAQDAGVEDISKCGLKGSPTVVKRVFAPPARAERAALVESAEQPAQALIDAIFLNQPKLETDLATLARDARSGLSGQC

SEQ ID NO: 20106 - DNA, 771 bp, Escherichia coli O157
  CDS (1)..(771)
atgaagattattacttgctataagtgcgtgcctgatgaacaggatattgcggtcaataatgctgatggttcgttagacttcagtaaagccgatgccaaaataagccaatacgatctcaacgctattgaagcggcttgccagctaaagcaacaggcagcagaggcgcaggtgacggccctaagtgtgggcggtaaagccctgaccaacgccaaagggcgtaaagatgtgctatcgcgcggtccggatgaactgattgtggtgattgatgaccagttcgagcaggcactgccgcaacaaacggcgagcgcactggctgcagccgcccagaaagcaggctttgatttgatcctctgtggcgatggttcttccgacctttatgcccagcaggttggtttgctggtaggcgaaatcctcaatattccggcagttaacggcgtcagcaaaattatctccctgacggcagataccctcaccgttgagcgcgaactggaagatgaaaccgaaaccttaagcattccactgcctgcggttgttgctgtttccactgatatcaactccccacaaattccttcgatgaaagccattctcggcgcggcgaaaaagccagtccaggtatggtcggcggcggatatcggttttaacgcagaggcagcatggtcagaacaacaggttgccgcgccgaaacagcgcgagcgtcagcgcatcgtgattgaaggcgacggcgaagaacagatcgccgcatttgctgaaaatcttcgcaaagtcatttaa

SEQ ID NO: 20107 - protein, 256 aa, Escherichia coli O157
MKIITCYKCVPDEQDIAVNNADGSLDFSKADAKISQYDLNAIEAACQLKQQAAEAQVTALSVGGKALTNAKGRKDVLSRGPDELIVVIDDQFEQALPQQTASALAAAAQKAGFDLILCGDGSSDLYAQQVGLLVGEILNIPAVNGVSKIISLTADTLTVERELEDETETLSIPLPAVVAVSTDINSPQIPSMKAILGAAKKPVQVWSAADIGFNAEAAWSEQQVAAPKQRERQRIVIEGDGEEQIAAFAENLRKVI

SEQ ID NO: 20108 - DNA, 1045 bp, Rhizobium leguminosarum
  CDS (161)..(1000)
caatgtcgggaagcttacaattcagtcatatgctagcaacgtcggaatcgaagccatttcaatgtgatagagaacgccaaacggttggcacgaatgatgcacgcaagcatgtgtactgacaagccgcgccacccatagagggagggagtaagaaaccgccatgcacatagttatctgtatcaaacaggtaccggactccgcacaaatacgagtcgatccggtgacgaacacaatcatgcgtcagggggtgccaaccatcatcaacccctatgatctgttcgcgcttgaagagcgctccagttgcgcgagccatggcggcgaggtgaccgtgctcaccatggggccgcccatggcagaggacgcgttgcgcaaggcgctcaccgtagccgaccgcgccgtactcttgaccgagcgtcattttgccggctccgacactctggcgacctcgtttgctctttcgcgagccatcgcgaagatcggagaggccttcggtacgcccgatatcgtctttacggccaaacagacgatcgacggcgataccgcccaggttgggcctggcatcgccaagcgcctcgacctcctgcagctcacctacgttgcgaaaatcgtctctgtcgacatcaatgggcgcgagattacggtggagcgccgctcggaagggggcacgcagacgctgatgagcaagctcccttgcctaattacaatgctcgaaggcacaaacgaaatccgccgcggctcgctcgatgacgcgctacgggccgcgcgcagccagatcgtgaagtggaatgcggccgacgctggcatagaggacctcaccaagtgcggcctgcgtggctcgccaaccgtcgttaagagggtctttgcccctcctgagcgggcggaaaaggcggagcagatcgacaccgcggaaaaaacaccgcgcgatctcgcggaggagttgatcgctgggatctttttgcgcagcggcgtcgaaagcgaactcgcctttgacgcgaattgaaggcaaggagcgacgatgttgagcacgaatcgagagagcctcctc

SEQ ID NO: 20109 - protein, 279 aa, Rhizobium leguminosarum
MHIVICIKQVPDSAQIRVDPVTNTIMRQGVPTIINPYDLFALEERSSCASHGGEVTVLTMGPPMAEDALRKALTVADRAVLLTERHFAGSDTLATSFALSRAIAKIGEAFGTPDIVFTAKQTIDGDTAQVGPGIAKRLDLLQLTYVAKIVSVDINGREITVERRSEGGTQTLMSKLPCLITMLEGTNEIRRGSLDDALRAARSQIVKWNAADAGIEDLTKCGLRGSPTVVKRVFAPPERAEKAEQIDTAEKTPRDLAEELIAGIFLRSGVESELAFDAN

SEQ ID NO: 20110 - DNA, 858 bp, Rhizobium sp
  CDS (1)..(858)
atgcacatcgtagtctgtatcaagcaagtcccggattcggcgcagatacgcgtccatccggtgacgaacacgatcatgcgccaaggcgtgccgactatcatcaacccttacgacctgtttgccctcgaacaggcactccaagtgcgtgaccaccatggcggcgaggtcacggtgctcaccatgggcccccccatggccgaagaatctttacgcaaggcgctcacttatggcgcagaccgcgcgatactcctgaccgaccggcactttgccggctccgacacgctggcgacttcatttgctctttctcaggcaatcgcgaagattggcaatagctttggatcgcctgatatcgtcttcacaggcaagcagacgatcgacggcgataccgcccaggtcggccccggaatagccaagcgcctcgacctcgtgcagttgacctatgtcgcaaaggtcacttccattgatctccgcacgcgcgcgattacggtcgagcgtcgcgcggaaggcgggacgcacgtcctgaagagcgaattgccttgcctgatcaccatgctggaaggatcgaatgccattcgccgcggctcacttgatgatgccttgcgggccgcgcgcagcgaaatcgtcaagtggaatgcggtggaggctggcattgaagacatcacaaaatgcgggctgcgcggttcgccgacggtcgtcaagcgggtctttgcccctaccccgcgcgagcaaaaagcggtgcagatcgacaccgtcgagaaggcaatgcaggacgtagctaacgaactggtcacttcaatcttcgcccatcagccggcactggagcacgagctctcctccactcgtagcgtgagcagatag

SEQ ID NO: 20111 - protein, 285 aa, Rhizobium sp
MHIVVCIKQVPDSAQIRVHPVTNTIMRQGVPTIINPYDLFALEQALQVRDHHGGEVTVLTMGPPMAEESLRKALTYGADRAILLTDRHFAGSDTLATSFALSQAIAKIGNSFGSPDIVFTGKQTIDGDTAQVGPGIAKRLDLVQLTYVAKVTSIDLRTRAITVERRAEGGTHVLKSELPCLITMLEGSNAIRRGSLDDALRAARSEIVKWNAVEAGIEDITKCGLRGSPTVVKRVFAPTPREQKAVQIDTVEKAMQDVANELVTSIFAHQPALEHELSSTRSVSR

SEQ ID NO: 20112 - DNA, 1029 bp, Xenopus tropicalis
  CDS (8)..(772)
ctgaaacatggcgctgcgagctttagttggtgtcaagagggtcatagactatgccgtgaaggtgcgggtgaagcctgataagaccggggtggtcactgatggagtaaagcactctatgaatcctttctgtgagattgcggtggaagaagcagtcaggctgaaggagaagaagattgtcagtgaaatcatcgccgtaagctgcggcccacagcaatgccaggagaccatccgaacagctttggccatgggagccgaccgaggaatacacgttgaagtggctgctaaggacgcagagagcctcgggccattccaggtctccaagatcatggcagcactggcaaaaaaagaaaatgttaacctggtgctgatggggaaacaggccattgacgatgactgtaatcagaccggacagatgaccgcagctctgcttgactggcctcaggggacatttgcttcagaagtgaaagtggaaggagagaagttgacagtagtgcgagaagtagacgggggtctcgagaccatcagcgtgaaactcccggcagtcgtcacggctgacttgcgactgaacgagccgcgttacgccactcttcccaatatcatgaaagccaaaaagaagaaaatcgagacggtgaaaccctcggatttgggagtggacatcacaagccgtatccgcgttttaagcgtggaggatcccccccaaagactagccggcgttaaagtagaaactgtacaggacctcgtatccaagttgaaggaaagcgggcgaatatgatgtggcttctctgcttctagaggttaattgctctgcggcggattcctggggtgcagggtttgactccgcctggctctgccgtcccgttacctcccggtgccttccctacgcactgccggacacccgaccctgattgtacaatggagaatggagacgagtggacgagagcaacaatcactgtaattaatcttgtgtctagtaataaaatttttcgcctttgtacatcctgaaaaaaaaaaaaaaaaaaaaaaaaaaaa

SEQ ID NO: 20113 - protein, 254 aa, Xenopus tropicalis
MALRALVGVKRVIDYAVKVRVKPDKTGVVTDGVKHSMNPFCEIAVEEAVRLKEKKIVSEIIAVSCGPQQCQETIRTALAMGADRGIHVEVAAKDAESLGPFQVSKIMAALAKKENVNLVLMGKQAIDDDCNQTGQMTAALLDWPQGTFASEVKVEGEKLTVVREVDGGLETISVKLPAVVTADLRLNEPRYATLPNIMKAKKKKIETVKPSDLGVDITSRIRVLSVEDPPQRLAGVKVETVQDLVSKLKESGRI

SEQ ID NO: 20114 - DNA, 25 bp, Primer
atgaaaataataacctgctttaagc

SEQ ID NO: 20115 - DNA, 26 bp, Primer
ttagttcagggctttcttcagatgtt

SEQ ID NO: 20116 - DNA, 465 bp, Escherichia coli; identical to SEQ ID NO: 1311
  CDS (1)..(465)

SEQ ID NO: 20117 - protein, 154 aa, Escherichia coli; identical to SEQ ID NO: 1312

SEQ ID NO: 20118 - DNA, 573 bp, Salmonella enterica subsp. enterica serovar Typhi; identical to SEQ ID NO: 1313
  CDS (1)..(573)

SEQ ID NO: 20119 - protein, 190 aa, Salmonella enterica subsp. enterica serovar Typhi; identical to SEQ ID NO: 1314

SEQ ID NO: 20120 - DNA, 465 bp, Yersinia pestis; identical to SEQ ID NO: 1315
  CDS (1)..(465)

SEQ ID NO: 20121 - protein, 154 aa, Yersinia pestis; identical to SEQ ID NO: 1316

SEQ ID NO: 20122 - DNA, 465 bp, Salmonella enterica subsp. enterica serovar Typhi; identical to SEQ ID NO: 1317
  CDS (1)..(465)

SEQ ID NO: 20123 - protein, 154 aa, Salmonella enterica subsp. enterica serovar Typhi; identical to SEQ ID NO: 1318

SEQ ID NO: 20124 - DNA, 585 bp, Yersinia pestis; identical to SEQ ID NO: 1319
  CDS (1)..(585)

SEQ ID NO: 20125 - protein, 194 aa, Yersinia pestis; identical to SEQ ID NO: 1320

SEQ ID NO: 20126 - DNA, 618 bp, Pseudomonas aeruginosa; identical to SEQ ID NO: 1321
  CDS (1)..(618)

SEQ ID NO: 20127 - protein, 205 aa, Pseudomonas aeruginosa; identical to SEQ ID NO: 1322

SEQ ID NO: 20128 - DNA, 459 bp, Campylobacter jejuni; identical to SEQ ID NO: 1323
  CDS (1)..(459)

SEQ ID NO: 20129 - protein, 152 aa, Campylobacter jejuni; identical to SEQ ID NO: 1324

SEQ ID NO: 20130 - DNA, 639 bp, Xylella fastidiosa; identical to SEQ ID NO: 1325
  CDS (1)..(639)

SEQ ID NO: 20131 - protein, 212 aa, Xylella fastidiosa; identical to SEQ ID NO: 1326

SEQ ID NO: 20132 - DNA, 534 bp, Pseudomonas aeruginosa; identical to SEQ ID NO: 1327
  CDS (1)..(534)

SEQ ID NO: 20133 - protein, 177 aa, Pseudomonas aeruginosa; identical to SEQ ID NO: 1328

SEQ ID NO: 20134 - DNA, 501 bp, Vibrio cholerae; identical to SEQ ID NO: 1329
  CDS (1)..(501)

SEQ ID NO: 20135 - protein, 166 aa, Vibrio cholerae; identical to SEQ ID NO: 1330

SEQ ID NO: 20136 - DNA, 597 bp, Pseudomonas aeruginosa; identical to SEQ ID NO: 1331
  CDS (1)..(597)

SEQ ID NO: 20137 - protein, 198 aa, Pseudomonas aeruginosa; identical to SEQ ID NO: 1332

SEQ ID NO: 20138 - DNA, 567 bp, Escherichia coli; identical to SEQ ID NO: 1333
  CDS (1)..(567)

SEQ ID NO: 20139 - protein, 188 aa, Escherichia coli; identical to SEQ ID NO: 1334

SEQ ID NO: 20140 - DNA, 486 bp, Haemophilus influenzae; identical to SEQ ID NO: 1335
  CDS (1)..(486)

SEQ ID NO: 20141 - protein, 161 aa, Haemophilus influenzae; identical to SEQ ID NO: 1336

SEQ ID NO: 20142 - DNA, 552 bp, Haemophilus influenzae; identical to SEQ ID NO: 1337
  CDS (1)..(552)

SEQ ID NO: 20143 - protein, 183 aa, Haemophilus influenzae; identical to SEQ ID NO: 1338

SEQ ID NO: 20144 - DNA, 486 bp, Haemophilus influenzae; identical to SEQ ID NO: 1339
  CDS (1)..(486)

SEQ ID NO: 20145 - protein, 161 aa, Haemophilus influenzae; identical to SEQ ID NO: 1340

SEQ ID NO: 20146 - DNA, 486 bp, Haemophilus influenzae; identical to SEQ ID NO: 1341
  CDS (1)..(486)

SEQ ID NO: 20147 - protein, 161 aa, Haemophilus influenzae; identical to SEQ ID NO: 1342

SEQ ID NO: 20148 - DNA, 591 bp, Pseudomonas aeruginosa; identical to SEQ ID NO: 1343
  CDS (1)..(591): k means g or t/u

SEQ ID NO: 20149 - protein, 196 aa, Pseudomonas aeruginosa; identical to SEQ ID NO: 1344
  misc_feature (69)..(69): Xaa can be Ala or Ser
  misc_feature (112)..(112): Xaa can be Ala or Ser

SEQ ID NO: 20150 - DNA, 468 bp, Vibrio vulnificus (strain YJ016); identical to SEQ ID NO: 1345
  CDS (1)..(468)

SEQ ID NO: 20151 - protein, 155 aa, Vibrio vulnificus (strain YJ016); identical to SEQ ID NO: 1346

SEQ ID NO: 20152 - DNA, 591 bp, Photorhabdus luminescens (subsp. laumondii); identical to SEQ ID NO: 1347
  CDS (1)..(591)

SEQ ID NO: 20153 - protein, 196 aa, Photorhabdus luminescens (subsp. laumondii); identical to SEQ ID NO: 1348

SEQ ID NO: 20154 - DNA, 486 bp, Photorhabdus luminescens (subsp. laumondii); identical to SEQ ID NO: 1349
  CDS (1)..(486)

SEQ ID NO: 20155 - protein, 161 aa, Photorhabdus luminescens (subsp. laumondii); identical to SEQ ID NO: 1350

SEQ ID NO: 20156 - DNA, 516 bp, Haemophilus ducreyi; identical to SEQ ID NO: 1351
  CDS (1)..(516)

SEQ ID NO: 20157 - protein, 171 aa, Haemophilus ducreyi; identical to SEQ ID NO: 1352

SEQ ID NO: 20158 - DNA, 660 bp, Bordetella pertussis; identical to SEQ ID NO: 1353
  CDS (1)..(660)

SEQ ID NO: 20159 - protein, 219 aa, Bordetella pertussis; identical to SEQ ID NO: 1354

SEQ ID NO: 20160 - DNA, 669 bp, Bordetella parapertussis; identical to SEQ ID NO: 1355
  CDS (1)..(669)

SEQ ID NO: 20161 - protein, 222 aa, Bordetella parapertussis; identical to SEQ ID NO: 1356

SEQ ID NO: 20162 - DNA, 669 bp, Bordetella bronchiseptica (Alcaligenes bronchisepticus); identical to SEQ ID NO: 1357
  CDS (1)..(669)

SEQ ID NO: 20163 - protein, 222 aa, Bordetella bronchiseptica (Alcaligenes bronchisepticus); identical to SEQ ID NO: 1358

SEQ ID NO: 20164 - DNA, 525 bp, Nitrosomonas europaea; identical to SEQ ID NO: 1359
  CDS (1)..(525)

SEQ ID NO: 20165 - protein, 174 aa, Nitrosomonas europaea; identical to SEQ ID NO: 1360

SEQ ID NO: 20166 - DNA, 465 bp, Shigella flexneri; identical to SEQ ID NO: 1361
  CDS (1)..(465)

SEQ ID NO: 20167 - protein, 154 aa, Shigella flexneri; identical to SEQ ID NO: 1362

SEQ ID NO: 20168 - DNA, 639 bp, Xylella fastidiosa (strain Temecula1 / ATCC 700964); identical to SEQ ID NO: 1363
  CDS (1)..(639)

SEQ ID NO: 20169 - protein, 212 aa, Xylella fastidiosa (strain Temecula1 / ATCC 700964); identical to SEQ ID NO: 1364

SEQ ID NO: 20170 - DNA, 480 bp, Vibrio parahaemolyticus; identical to SEQ ID NO: 1365
  CDS (1)..(480)

SEQ ID NO: 20171 - protein, 159 aa, Vibrio parahaemolyticus; identical to SEQ ID NO: 1366

SEQ ID NO: 20172 - DNA, 681 bp, Pseudomonas syringae (pv. tomato); identical to SEQ ID NO: 1367
  CDS (1)..(681)

SEQ ID NO: 20173 - protein, 226 aa, Pseudomonas syringae (pv. tomato); identical to SEQ ID NO: 1368

SEQ ID NO: 20174 - DNA, 546 bp, Pseudomonas syringae (pv. tomato); identical to SEQ ID NO: 1369
  CDS (1)..(546)

SEQ ID NO: 20175 - protein, 181 aa, Pseudomonas syringae (pv. tomato); identical to SEQ ID NO: 1370

SEQ ID NO: 20176 - DNA, 624 bp, Pseudomonas putida (strain KT2440); identical to SEQ ID NO: 1371
  CDS (1)..(624)

SEQ ID NO: 20177 - protein, 207 aa, Pseudomonas putida (strain KT2440); identical to SEQ ID NO: 1372

SEQ ID NO: 20178 - DNA, 534 bp, Pseudomonas putida (strain KT2440); identical to SEQ ID NO: 1373
  CDS (1)..(534)

SEQ ID NO: 20179 - protein, 177 aa, Pseudomonas putida (strain KT2440); identical to SEQ ID NO: 1374

SEQ ID NO: 20180 - DNA, 645 bp, Pseudomonas putida (strain KT2440); identical to SEQ ID NO: 1375
  CDS (1)..(645)

SEQ ID NO: 20181 - protein, 214 aa, Pseudomonas putida (strain KT2440); identical to SEQ ID NO: 1376

SEQ ID NO: 20182 - DNA, 609 bp, Clostridium tetani; identical to SEQ ID NO: 1377
  CDS (1)..(609)

SEQ ID NO: 20183 - protein, 202 aa, Clostridium tetani; identical to SEQ ID NO: 1378

SEQ ID NO: 20184 - DNA, 513 bp, Bacteroides thetaiotaomicron; identical to SEQ ID NO: 1379
  CDS (1)..(513)

SEQ ID NO: 20185 - protein, 170 aa, Bacteroides thetaiotaomicron; identical to SEQ ID NO: 1380

SEQ ID NO: 20186 - DNA, 465 bp, Escherichia coli O6; identical to SEQ ID NO: 1381
  CDS (1)..(465)

SEQ ID NO: 20187 - protein, 154 aa, Escherichia coli O6; identical to SEQ ID NO: 1382

SEQ ID NO: 20188 - DNA, 429 bp, Vibrio vulnificus; identical to SEQ ID NO: 1383
  CDS (1)..(429)

SEQ ID NO: 20189 - protein, 142 aa, Vibrio vulnificus; identical to SEQ ID NO: 1384

SEQ ID NO: 20190 - DNA, 465 bp, Shewanella oneidensis; identical to SEQ ID NO: 1385
  CDS (1)..(465)

SEQ ID NO: 20191 - protein, 154 aa, Shewanella oneidensis; identical to SEQ ID NO: 1386

SEQ ID NO: 20192 - DNA, 618 bp, Chlorobium tepidum; identical to SEQ ID NO: 1387
  CDS (1)..(618)

SEQ ID NO: 20193 - protein, 205 aa, Chlorobium tepidum; identical to SEQ ID NO: 1388

SEQ ID NO: 20194 - DNA, 648 bp, Chlorobium tepidum; identical to SEQ ID NO: 1389
  CDS (1)..(648)

SEQ ID NO: 20195 - protein, 215 aa, Chlorobium tepidum; identical to SEQ ID NO: 1390

SEQ ID NO: 20196 - DNA, 576 bp, Xanthomonas campestris (pv. campestris); identical to SEQ ID NO: 1391
  CDS (1)..(576)

SEQ ID NO: 20197 - protein, 191 aa, Xanthomonas campestris (pv. campestris); identical to SEQ ID NO: 1392

SEQ ID NO: 20198 - DNA, 654 bp, Xanthomonas axonopodis (pv. citri); identical to SEQ ID NO: 1393
  CDS (1)..(654)

SEQ ID NO: 20199 - protein, 217 aa, Xanthomonas axonopodis (pv. citri); identical to SEQ ID NO: 1394

SEQ ID NO: 20200 - DNA, 465 bp, Salmonella typhimurium; identical to SEQ ID NO: 1395
  CDS (1)..(465)

SEQ ID NO: 20201 - protein, 154 aa, Salmonella typhimurium; identical to SEQ ID NO: 1396

SEQ ID NO: 20202 - DNA, 480 bp, Pasteurella multocida; identical to SEQ ID NO: 1397
  CDS (1)..(480)

SEQ ID NO: 20203 - protein, 159 aa, Pasteurella multocida; identical to SEQ ID NO: 1398

SEQ ID NO: 20204 - DNA, 480 bp, Treponema denticola ATCC 35405; identical to SEQ ID NO: 1399
  CDS (1)..(480)

SEQ ID NO: 20205 - protein, 159 aa, Treponema denticola ATCC 35405; identical to SEQ ID NO: 1400

SEQ ID NO: 20206 - DNA, 25 bp, Primer
atgcgtttctgccttattttgatca

SEQ ID NO: 20207 - DNA, 23 bp, Primer
ttagattcgtctcgcctgccaga

SEQ ID NO: 20208 - DNA, 792 bp, Escherichia coli; identical to SEQ ID NO: 1849
  CDS (1)..(792)

SEQ ID NO: 20209 - protein, 263 aa, Escherichia coli; identical to SEQ ID NO: 1850

SEQ ID NO: 20210 - DNA, 756 bp, Bacillus halodurans; identical to SEQ ID NO: 1851
  CDS (1)..(756)

SEQ ID NO: 20211 - protein, 251 aa, Bacillus halodurans; identical to SEQ ID NO: 1852

SEQ ID NO: 20212 - DNA, 792 bp, Yersinia pestis; identical to SEQ ID NO: 1853
  CDS (1)..(792)

SEQ ID NO: 20213 - protein, 263 aa, Yersinia pestis; identical to SEQ ID NO: 1854

SEQ ID NO: 20214 - DNA, 792 bp, Salmonella enterica subsp. enterica serovar Typhi; identical to SEQ ID NO: 1855
  CDS (1)..(792)

SEQ ID NO: 20215 - protein, 263 aa, Salmonella enterica subsp. enterica serovar Typhi; identical to SEQ ID NO: 1856

SEQ ID NO: 20216 - DNA, 741 bp, Bacillus subtilis; identical to SEQ ID NO: 1857
  CDS (1)..(741)

SEQ ID NO: 20217 - protein, 246 aa, Bacillus subtilis; identical to SEQ ID NO: 1858

SEQ ID NO: 20218 - DNA, 897 bp, Agrobacterium tumefaciens; identical to SEQ ID NO: 1859
  CDS (1)..(897)

SEQ ID NO: 20219 - protein, 298 aa, Agrobacterium tumefaciens; identical to SEQ ID NO: 1860

SEQ ID NO: 20220 - DNA, 741 bp, Thermotoga maritima; identical to SEQ ID NO: 1861
  CDS (1)..(741)

SEQ ID NO: 20221 - protein, 246 aa, Thermotoga maritima; identical to SEQ ID NO: 1862

SEQ ID NO: 20222 - DNA, 822 bp, Sinorhizobium meliloti; identical to SEQ ID NO: 1863
  CDS (1)..(822)

SEQ ID NO: 20223 - protein, 273 aa, Sinorhizobium meliloti; identical to SEQ ID NO: 1864

SEQ ID NO: 20224 - DNA, 783 bp, Escherichia coli; identical to SEQ ID NO: 1865
  CDS (1)..(783)

SEQ ID NO: 20225 - protein, 260 aa, Escherichia coli; identical to SEQ ID NO: 1866

SEQ ID NO: 20226 - DNA, 816 bp, Escherichia coli; identical to SEQ ID NO: 1867
  CDS (1)..(816)

SEQ ID NO: 20227 - protein, 271 aa, Escherichia coli; identical to SEQ ID NO: 1868

SEQ ID NO: 20228 - DNA, 759 bp, Escherichia coli; identical to SEQ ID NO: 1869
  CDS (1)..(759)

SEQ ID NO: 20229 - protein, 252 aa, Escherichia coli; identical to SEQ ID NO: 1870

SEQ ID NO: 20230 - DNA, 804 bp, Deinococcus radiodurans; identical to SEQ ID NO: 1871
  CDS (1)..(804)

SEQ ID NO: 20231 - protein, 267 aa, Deinococcus radiodurans; identical to SEQ ID NO: 1872

SEQ ID NO: 20232 - DNA, 765 bp, Streptomyces coelicolor; identical to SEQ ID NO: 1873
  CDS (1)..(765)

SEQ ID NO: 20233 - protein, 254 aa, Streptomyces coelicolor; identical to SEQ ID NO: 1874

SEQ ID NO: 20234 - DNA, 849 bp, Escherichia coli; identical to SEQ ID NO: 1875
  CDS (1)..(849)

SEQ ID NO: 20235 - protein, 282 aa, Escherichia coli; identical to SEQ ID NO: 1876

SEQ ID NO: 20236 - DNA, 792 bp, Escherichia coli; identical to SEQ ID NO: 1877
  CDS (1)..(789)

SEQ ID NO: 20237 - protein, 262 aa, Escherichia coli; identical to SEQ ID NO: 1878

SEQ ID NO: 20238 - DNA, 771 bp, Rhodococcus opacus (Nocardia opaca); identical to SEQ ID NO: 1879
  CDS (1)..(771)

SEQ ID NO: 20239 - protein, 256 aa, Rhodococcus opacus (Nocardia opaca); identical to SEQ ID NO: 1880

SEQ ID NO: 20240 - DNA, 819 bp, Erwinia chrysanthemi; identical to SEQ ID NO: 1881
  CDS (1)..(819)

SEQ ID NO: 20241 - protein, 272 aa, Erwinia chrysanthemi; identical to SEQ ID NO: 1882

SEQ ID NO: 20242 - DNA, 795 bp, Bordetella pertussis; identical to SEQ ID NO: 1883
  CDS (1)..(795)

SEQ ID NO: 20243 - protein, 264 aa, Bordetella pertussis; identical to SEQ ID NO: 1884

SEQ ID NO: 20244 - DNA, 741 bp, Bordetella pertussis; identical to SEQ ID NO: 1885
  CDS (1)..(741)

SEQ ID NO: 20245 - protein, 246 aa, Bordetella pertussis; identical to SEQ ID NO: 1886

SEQ ID NO: 20246 - DNA, 744 bp, Bordetella bronchiseptica (Alcaligenes bronchisepticus); identical to SEQ ID NO: 1887
  CDS (1)..(744)

SEQ ID NO: 20247 - protein, 247 aa, Bordetella bronchiseptica (Alcaligenes bronchisepticus); identical to SEQ ID NO: 1888

SEQ ID NO: 20248 - DNA, 753 bp, Bacillus cereus (strain ATCC 14579 / DSM 31); identical to SEQ ID NO: 1889
  CDS (1)..(753)

SEQ ID NO: 20249 - protein, 250 aa, Bacillus cereus (strain ATCC 14579 / DSM 31); identical to SEQ ID NO: 1890

SEQ ID NO: 20250 - DNA, 798 bp, Vibrio parahaemolyticus; identical to SEQ ID NO: 1891
  CDS (1)..(798)

SEQ ID NO: 20251 - protein, 265 aa, Vibrio parahaemolyticus; identical to SEQ ID NO: 1892

SEQ ID NO: 20252 - DNA, 876 bp, Pseudomonas putida (strain KT2440); identical to SEQ ID NO: 1893
  CDS (1)..(876)

SEQ ID NO: 20253 - protein, 291 aa, Pseudomonas putida (strain KT2440); identical to SEQ ID NO: 1894

SEQ ID NO: 20254 - DNA, 834 bp, Bradyrhizobium japonicum; identical to SEQ ID NO: 1895
  CDS (1)..(834)

SEQ ID NO: 20255 - protein, 277 aa, Bradyrhizobium japonicum; identical to SEQ ID NO: 1896

SEQ ID NO: 20256 - DNA, 783 bp, Vibrio vulnificus; identical to SEQ ID NO: 1897
  CDS (1)..(783)

SEQ ID NO: 20257 - protein, 260 aa, Vibrio vulnificus; identical to SEQ ID NO: 1898

SEQ ID NO: 20258 - DNA, 774 bp, Oceanobacillus iheyensis; identical to SEQ ID NO: 1899
  CDS (1)..(774)

SEQ ID NO: 20259 - protein, 257 aa, Oceanobacillus iheyensis; identical to SEQ ID NO: 1900

SEQ ID NO: 20260 - DNA, 747 bp, Oceanobacillus iheyensis; identical to SEQ ID NO: 1901
  CDS (1)..(747)

SEQ ID NO: 20261 - protein, 248 aa, Oceanobacillus iheyensis; identical to SEQ ID NO: 1902

SEQ ID NO: 20262 - DNA, 783 bp, Escherichia coli O6; identical to SEQ ID NO: 1903
  CDS (1)..(783)

SEQ ID NO: 20263 - protein, 260 aa, Escherichia coli O6; identical to SEQ ID NO: 1904

SEQ ID NO: 20264 - DNA, 792 bp, Pectobacterium atrosepticum; identical to SEQ ID NO: 1905
  CDS (1)..(792)

SEQ ID NO: 20265 - protein, 263 aa, Pectobacterium atrosepticum; identical to SEQ ID NO: 1906

SEQ ID NO: 20266 - DNA, 756 bp, Salmonella typhimurium; identical to SEQ ID NO: 1907
  CDS (1)..(756)

SEQ ID NO: 20267 - protein, 251 aa, Salmonella typhimurium; identical to SEQ ID NO: 1908

SEQ ID NO: 20268 - DNA, 855 bp, Rhizobium meliloti (Sinorhizobium meliloti); identical to SEQ ID NO: 1909
  CDS (1)..(855)

SEQ ID NO: 20269 - protein, 284 aa, Rhizobium meliloti (Sinorhizobium meliloti); identical to SEQ ID NO: 1910

SEQ ID NO: 20270 - DNA, 810 bp, Rhizobium loti (Mesorhizobium loti); identical to SEQ ID NO: 1911
  CDS (1)..(810)

SEQ ID NO: 20271 - protein, 269 aa, Rhizobium loti (Mesorhizobium loti); identical to SEQ ID NO: 1912

SEQ ID NO: 20272 - DNA, 822 bp, Rhizobium loti (Mesorhizobium loti); identical to SEQ ID NO: 1913
  CDS (1)..(822)

SEQ ID NO: 20273 - protein, 273 aa, Rhizobium loti (Mesorhizobium loti); identical to SEQ ID NO: 1914

SEQ ID NO: 20274 - DNA, 810 bp, Pasteurella multocida; identical to SEQ ID NO: 1915
  CDS (1)..(810)

SEQ ID NO: 20275 - protein, 269 aa, Pasteurella multocida; identical to SEQ ID NO: 1916

SEQ ID NO: 20276 - DNA, 774 bp, Streptomyces coelicolor; identical to SEQ ID NO: 1917
  CDS (1)..(774)

SEQ ID NO: 20277 - protein, 257 aa, Streptomyces coelicolor; identical to SEQ ID NO: 1918

SEQ ID NO: 20278 - DNA, 876 bp, Pseudomonas putida; identical to SEQ ID NO: 1919
  CDS (1)..(876)

SEQ ID NO: 20279 - protein, 291 aa, Pseudomonas putida; identical to SEQ ID NO: 1920

SEQ ID NO: 20280 - DNA, 789 bp, Erwinia carotovora; identical to SEQ ID NO: 1921
  CDS (1)..(789)

SEQ ID NO: 20281 - protein, 262 aa, Erwinia carotovora; identical to SEQ ID NO: 1922

SEQ ID NO: 20282 - DNA, 825 bp, Escherichia coli; identical to SEQ ID NO: 1923
  CDS (1)..(825)

SEQ ID NO: 20283 - protein, 274 aa, Escherichia coli; identical to SEQ ID NO: 1924

SEQ ID NO: 20284 - DNA, 918 bp, Erwinia chrysanthemi; identical to SEQ ID NO: 1925
  CDS (1)..(918)

SEQ ID NO: 20285 - protein, 305 aa, Erwinia chrysanthemi; identical to SEQ ID NO: 1926

SEQ ID NO: 20286 - DNA, 876 bp, Pseudomonas putida; identical to SEQ ID NO: 1927
  CDS (1)..(876)

SEQ ID NO: 20287 - protein, 291 aa, Pseudomonas putida; identical to SEQ ID NO: 1928

SEQ ID NO: 20288 - DNA, 807 bp, Mycobacterium vanbaalenii; identical to SEQ ID NO: 1929
  CDS (1)..(807)

SEQ ID NO: 20289 - protein, 268 aa, Mycobacterium vanbaalenii; identical to SEQ ID NO: 1930

SEQ ID NO: 20290 - DNA, 798 bp, uncultured bacterium 582; identical to SEQ ID NO: 1931
  CDS (1)..(798)

SEQ ID NO: 20291 - protein, 265 aa, uncultured bacterium 582; identical to SEQ ID NO: 1932

SEQ ID NO: 20292 - DNA, 816 bp, Mycobacterium paratuberculosis; identical to SEQ ID NO: 1933
  CDS (1)..(816)

SEQ ID NO: 20293 - protein, 271 aa, Mycobacterium paratuberculosis; identical to SEQ ID NO: 1934

SEQ ID NO: 20294 - DNA, 753 bp, Bacillus cereus (strain ATCC 10987); identical to SEQ ID NO: 1935
  CDS (1)..(753)

SEQ ID NO: 20295 - protein, 250 aa, Bacillus cereus (strain ATCC 10987); identical to SEQ ID NO: 1936

SEQ ID NO: 20296 - DNA, 825 bp, Thermus thermophilus (strain HB27 / ATCC BAA-163 / DSM 7039); identical to SEQ ID NO: 1937
  CDS (1)..(825)

SEQ ID NO: 20297 - protein, 274 aa, Thermus thermophilus (strain HB27 / ATCC BAA-163 / DSM 7039); identical to SEQ ID NO: 1938

SEQ ID NO: 20298 - DNA, 756 bp, Rhodopseudomonas palustris; identical to SEQ ID NO: 1939
  CDS (1)..(756)

SEQ ID NO: 20299 - protein, 251 aa, Rhodopseudomonas palustris; identical to SEQ ID NO: 1940

SEQ ID NO: 20300 - DNA, 24 bp, Primer
atggctaacgcagatctggataaa

SEQ ID NO: 20301 - DNA, 25 bp, Primer
ttagaacggatagtcgtgataaccc

SEQ ID NO: 20302 - DNA, 1224 bp, Escherichia coli; identical to SEQ ID NO: 1403
  CDS (285)..(1166)

SEQ ID NO: 20303 - protein, 293 aa, Escherichia coli; identical to SEQ ID NO: 514

SEQ ID NO: 20304 - DNA, 882 bp, Yersinia pestis; identical to SEQ ID NO: 525
  CDS (1)..(882)

SEQ ID NO: 20305 - protein, 293 aa, Yersinia pestis; identical to SEQ ID NO: 526

SEQ ID NO: 20306 - DNA, 882 bp, Salmonella typhimurium; identical to SEQ ID NO: 1407
  CDS (1)..(882)

SEQ ID NO: 20307 - protein, 293 aa, Salmonella typhimurium; identical to SEQ ID NO: 524

SEQ ID NO: 20308 - DNA, 882 bp, Escherichia coli; identical to SEQ ID NO: 519
  CDS (1)..(882)

SEQ ID NO: 20309 - protein, 293 aa, Escherichia coli; identical to SEQ ID NO: 520

SEQ ID NO: 20310 - DNA, 864 bp, Vibrio cholerae; identical to SEQ ID NO: 531
  CDS (1)..(864)

SEQ ID NO: 20311 - protein, 287 aa, Vibrio cholerae; identical to SEQ ID NO: 532

SEQ ID NO: 20312 - DNA, 879 bp, Buchnera aphidicola str. APS (Acyrthosiphon pisum); identical to SEQ ID NO: 1413
  CDS (1)..(879)

SEQ ID NO: 20313 - protein, 292 aa, Buchnera aphidicola str. APS (Acyrthosiphon pisum); identical to SEQ ID NO: 528

SEQ ID NO: 20314 - DNA, 852 bp, Haemophilus influenzae; identical to SEQ ID NO: 533
  CDS (1)..(852)

SEQ ID NO: 20315 - protein, 283 aa, Haemophilus influenzae; identical to SEQ ID NO: 534

SEQ ID NO: 20316 - DNA, 879 bp, Buchnera aphidicola str. Sg (Schizaphis graminum); identical to SEQ ID NO: 537
  CDS (1)..(879)

SEQ ID NO: 20317 - protein, 292 aa, Buchnera aphidicola str. Sg (Schizaphis graminum); identical to SEQ ID NO: 538

SEQ ID NO: 20318 - DNA, 861 bp, Pasteurella multocida; identical to SEQ ID NO: 535
  CDS (1)..(861)

SEQ ID NO: 20319 - protein, 286 aa, Pasteurella multocida; identical to SEQ ID NO: 536

SEQ ID NO: 20320 - DNA, 882 bp, Escherichia coli; identical to SEQ ID NO: 1421
  CDS (1)..(882): r means g or a

SEQ ID NO: 20321 - protein, 293 aa, Escherichia coli; identical to SEQ ID NO: 1422
  misc_feature (288)..(288): Xaa can be Ala or Thr

SEQ ID NO: 20322 - DNA, 870 bp, Haemophilus ducreyi; identical to SEQ ID NO: 539
  CDS (1)..(870)

SEQ ID NO: 20323 - protein, 289 aa, Haemophilus ducreyi; identical to SEQ ID NO: 540

SEQ ID NO: 20324 - DNA, 777 bp, Vibrio vulnificus; identical to SEQ ID NO: 1425
  CDS (1)..(777)

SEQ ID NO: 20325 - protein, 258 aa, Vibrio vulnificus; identical to SEQ ID NO: 530

SEQ ID NO: 20326 - DNA, 879 bp, Xanthomonas axonopodis (pv. citri); identical to SEQ ID NO: 543
  CDS (1)..(879)

SEQ ID NO: 20327 - protein, 292 aa, Xanthomonas axonopodis (pv. citri); identical to SEQ ID NO: 544

SEQ ID NO: 20328 - DNA, 879 bp, Xanthomonas campestris (pv. campestris); identical to SEQ ID NO: 541
  CDS (1)..(879)

SEQ ID NO: 20329 - protein, 292 aa, Xanthomonas campestris (pv. campestris); identical to SEQ ID NO: 542

SEQ ID NO: 20330 - DNA, 22 bp, Primer
atgatgcgaatcgcgctcttcc

SEQ ID NO: 20331 - DNA, 24 bp, Primer
ttacttcaggtattcacccgtacg

SEQ ID NO: 20332 - DNA, 1662 bp, Escherichia coli K12
  CDS (1)..(1662)
atgattaaccgtatccgcgtagtcacgctgttggtaatggtgctgggggtattcgcactgttacagcttatttccggcagtctgtttttttcttcccttcaccatagccagaagagctttgtggtttccaatcaattacgggaacagcagggcgagctgacgtcaacctgggatttaatgctgcaaacgcgcattaacctgagtcgttcagcggtacggatgatgatggattcctccaatcaacaaagtaacgccaaagttgaattgctcgatagcgccaggaaaacattggcgcaggcagcgacgcattataaaaaattcaaaagcatggcaccgttacctgaaatggtcgctaccagtcgtaatattgatgaaaaatataaaaactattacacagcgttaactgaactgattgattatctagattatggcaatactggagcttatttcgctcagccaacccagggaatgcaaaatgcaatgggcgaagcgtttgctcagtacgccctcagcagtgaaaaactgtatcgcgatatcgtcactgacaacgcagatgattaccgatttgcccagtggcaactggcggttatcgcgctggtggtggtattgattctgctggtggcgtggtacggcattcgccgtatgttgcttactccgctggcaaaaattattgctcacattcgcgaaatcgccggtggtaacctggcgaataccctgaccattgacgggcgcagtgaaatgggcgacctggcgcagagcgtttcacatatgcaacgctctttgactgacaccgtcactcatgtccgcgaaggttcagatgccatctatgccggtacccgtgaaattgcggcgggcaacaccgatctttcctcccgtactgaacagcaggcatccgcgctggaagaaactgccgccagcatggagcagctcaccgcgacagtgaagcaaaacgccgataacgcccgccaggcctcgcaactggcgcaaagtgcctccgacaccgcccagcacggcggcaaagtggtggatggcgtagtgaaaacgatgcatgagatcgccgatagttcgaagaaaattgccgacattatcagcgttatcgacggtattgccttccagactaatatcctcgcgctgaatgccgcggttgaagccgcgcgtgcgggtgaacagggccgtggttttgccgtggtggcgggtgaagtgcgtaatcttgccagtcgcagcgcccaggcggcaaaagagatcaaagccctcattgaagactccgtctcacgcgttgataccggttcggtgctggtcgaaagcgccggggaaacaatgaacaatatcgtcaatgctgtcactcgcgtgactgacattatgggcgagattgcatcggcatcggatgaacagagccgtggcatcgatcaagtcgcattggcggtttcggaaatggatcgcgtcacgcaacagaacgcatcgctggtgcaggaatcagctgccgccgccgctgcgctggaagaacaggcgagtcgtttaacgcaagcagtttccgcgttccgtctggcagccagcccactcaccaataaaccgcaaacaccatcccgtcctgccagtgagcaaccaccggctcagccacgactgcgaattgctgaacaagatccaaactgggaaacattttga

SEQ ID NO: 20333 - protein, 553 aa, Escherichia coli K12
MINRIRVVTLLVMVLGVFALLQLISGSLFFSSLHHSQKSFVVSNQLREQQGELTSTWDLMLQTRINLSRSAVRMMMDSSNQQSNAKVELLDSARKTLAQAATHYKKFKSMAPLPEMVATSRNIDEKYKNYYTALTELIDYLDYGNTGAYFAQPTQGMQNAMGEAFAQYALSSEKLYRDIVTDNADDYRFAQWQLAVIALVVVLILLVAWYGIRRMLLTPLAKIIAHIREIAGGNLANTLTIDGRSEMGDLAQSVSHMQRSLTDTVTHVREGSDAIYAGTREIAAGNTDLSSRTEQQASALEETAASMEQLTATVKQNADNARQASQLAQSASDTAQHGGKVVDGVVKTMHEIADSSKKIADIISVIDGIAFQTNILALNAAVEAARAGEQGRGFAVVAGEVRNLASRSAQAAKEIKALIEDSVSRVDTGSVLVESAGETMNNIVNAVTRVTDIMGEIASASDEQSRGIDQVALAVSEMDRVTQQNASLVQESAAAAAALEEQASRLTQAVSAFRLAASPLTNKPQTPSRPASEQPPAQPRLRIAEQDPNWETF

SEQ ID NO: 20334 - DNA, 2040 bp, Pseudomonas aeruginosa
  CDS (1)..(2040)
atgggtctgttcaatgcacatgcggtggcgcagcaacgcgccgaccggatcgccacgctcctccagtcgttcgccgacggccagctcgacaccgccgtcggcgaggccccggcgcccggctacgagcgtctctacgacagcctgcgggcgctgcagcggcaactgcgcgaacaacgcgccgaactccagcaggtggaaagcctggaggcggggctggcggagatgagccgccagcacgaagccggctggatcgaccagacgattcccgccgaacgcctggaaggtcgcgcggcgcgcatcgccaagggcgtcaacgaactggtggccgcgcacatcgcggtgaagatgaaggtggtcagcgtggtcaccgcctacggccagggcaacttcgagccgctgatggaccgcctgccgggcaagaaggcgcagatcaccgaagccatcgacggcgttcgcgaacgcctgcgcggggccgccgaggcgacctcggcgcaactggccacggcggcctacaacgcgcggatcaagagcgcgctggacaacgtctcggccaacgtgatgatcgccgacaacgatctcaacatcatctacatgaaccgcaccgtcagcgagatgctcggtcgcgccgaagcggatatccgcaagcaactgccgaacttcgacgccggccgcctgatgggcgccaacatcgacgtgttccacaagaatccggcgcaccagcggcacctgctggccaacctcaccggcgtgcacaaggccgagctcaacctcggcggccggcgcttctccctcgacgtggtgccagtgttcaacgacgccaacgaacgcctcggctccgccgtgcaatggaccgaccgcaccgaggaacaccgcgccgagcaggaagtctcgcaactggtgcaggcggcggccgccggcgacttcagcaagcgcgtcgaggaggccggcaaggaaggcttcttcctcaggctggcgaaggacctgaacagcctggtggataccgccgaccgcggcttgcgcgacgtctcgcggatgctcggggcgctggcccagggcgacctcacccagcgcatcgaggccgactaccagggcaccttcggccagctcaaggatttctccaacgacaccgcacaaagcctgtcgcggatgctcgggcagattcgcgaggccgccgacaccatcaacaccgccgccagcgagatcgccagcggcaacgccgaactgtcggcgcgcaccgagcagcaggcgtcgagcctggaggaaaccgcctcgagcatggaagaactgaccagcacggtgaagctcaacgccgagaatgcccgccaggccaactcgctggcggccaatgcctcggaagtggcgacccagggcggcaccgtggtgcagaaggtggtcagcaccatgtcctcgatcaacgagtcggcgcgcaagatcgccgacatcatcggggtgatcgacggcatcgccttccagaccaacatcctcgccctcaacgccgcggtcgaggcagcccgcgccggcgagcagggccgcggcttcgcggtggtcgccggggaagtgcgcaccctcgcccagcgttccgccgccgcggccaaggagatcaagacgctgatctccgactcggtggacaaggtggagaacggcaacaccctggtggcccaggccggacagaccatgagcgacatcgtggtagcgatccgccgggtcaccgacatcatgtcggagatcgccgccgcctccgccgagcagagcaccggcatcgaagaggtgaacagcgcggtctcgcagatggacgacatgacccagcagaacgccgcgctggtggaggaagccgcggccgcggccgaggccatgcaggagcaggcgggcctgctcaaccagtcggtggcggtgttcaggctggacactccgccgagcgtggtccagctcgccagcgcgcggccgtccgcgccacgccccagcgcgccggcgccgctggcccgcagcggcatggcgcgggccagcaaggcgcgcaaggaagacggctgggaagagttctga

SEQ ID NO: 20335 - protein, 679 aa, Pseudomonas aeruginosa
MGLFNAHAVAQQRADRIATLLQSFADGQLDTAVGEAPAPGYERLYDSLRALQRQLREQRAELQQVESLEAGLAEMSRQHEAGWIDQTIPAERLEGRAARIAKGVNELVAAHIAVKMKVVSVVTAYGQGNFEPLMDRLPGKKAQITEAIDGVRERLRGAAEATSAQLATAAYNARIKSALDNVSANVMIADNDLNIIYMNRTVSEMLGRAEADIRKQLPNFDAGRLMGANIDVFHKNPAHQRHLLANLTGVHKAELNLGGRRFSLDVVPVFNDANERLGSAVQWTDRTEEHRAEQEVSQLVQAAAAGDFSKRVEEAGKEGFFLRLAKDLNSLVDTADRGLRDVSRMLGALAQGDLTQRIEADYQGTFGQLKDFSNDTAQSLSRMLGQIREAADTINTAASEIASGNAELSARTEQQASSLEETASSMEELTSTVKLNAENARQANSLAANASEVATQGGTVVQKVVSTMSSINESARKIADIIGVIDGIAFQTNILALNAAVEAARAGEQGRGFAVVAGEVRTLAQRSAAAAKEIKTLISDSVDKVENGNTLVAQAGQTMSDIVVAIRRVTDIMSEIAAASAEQSTGIEEVNSAVSQMDDMTQQNAALVEEAAAAAEAMQEQAGLLNQSVAVFRLDTPPSVVQLASARPSAPRPSAPAPLARSGMARASKARKEDGWEEF

SEQ ID NO: 20336 - DNA, 1797 bp, Caulobacter crescentus
  CDS (1)..(1797)
atggcgtcgttgggtcagaaggtcatgggggccgccggcggcgcggcgcttctctgcgcagccacggccggcgccggcctgtgggtggcctggagcctggattccgccctcagccgcgccgaagcctcggccaggatcctgcgcctgcatatgcatgccgacatgatgcacgacgccttgcgcgccgatgttctgggcgcgatcatgtccagcgacccgacgcttggagtcgacctcaaggtcgtgcgggcggatctggccgaacacacccaggccttccgggacgacatcgcccagagcggcgaactcgcccacaatcccaggaccaaggccgccctcctggcggtcgagactccgctcaacgcctacatcgccgcagccgaggacatcgtcggaaccgccgatgtcgaccccgccgccgcacacgccaagctgacggactttggccagcagttctcgacgcttgaggacaagatggaggccgcctcgaccgagatcgaggcggcggcttcgcacgacacgaacgcggccaagtcgctcggtctgctgggccaagcgatcatggcggggcttctgctgctggcggtggccctcgcggcggtgctgatgttcgccgcccgccggggcctggtcgcgccgctcaccgagatcacccgttgcctacgccgcctggccgccggggatctggacgtcatcctgcccaggaagaagagccaggacgagatcggccagatcaccgacgcgctgcgcagcttccatgaaactgtcgaggcgcgccgcaaggagctcgaggcggccgatgtgcgcgaggcgctggaaatcgaacggcgcgccgccgatcagcgtcgcgcagaggctgacgccacgcagaaggccgtcgtcgaaagcctagcgctcgcgctgggccgcatgtcccaaggcgacctgacctgccgcatcgatcgcgccttcccctctggctacgaagcccttcgcgtcgatttcaacaccgccatcgagaagctgtcgggcgtcatcgcggcctcgctcgacgcgacgcgggcgatccacggcggcacggccgaaatttccgaggcggccgatgagctggccacccgcaccgaacggcaggcggccagcctggaagaagccgtggcggcgctggacgagatcaccagcacggtgcgccagacggccgacggagcgtcgcgcgcccgcaaggtggtggagcgcgcgcgatccgccgccgacgcctccggctcgatcgtcagccaggcggtcgaagccatgggcgccatcgagaagtcgtccagccagatcggccagatcatcggcgtgatcgacgagatcgccttccagactaacctcctcgccctgaacgctggcgtcgaagccgctcgtgcgggcgaagcgggacgcggctttgcggtggtcgcccaggaagttcgggccctggcccagcgctcagccgacgccgccaaggagatcaagaccctcatcagcacgagcaccgccgaggtgggacagggcgtggagtatgtcggcaaggccggcgaggccctgcgcgccatcgcccacgaggtcgacgagatcgacgatctcgtcaccgccatggccgcgtccacccagcagcaggcgcggggtctttccgaggtcaatacgaccatgaaccagatggatcaggtgacacagcggaacgcagccatggtcgaggagaccaccgccgccagccataccctggcgcaggaagccacacgactggcgcagcgcatgggcgaactgcggatcatgcgcgccggaatgcaggcggcggcctag

SEQ ID NO: 20337 - protein, 598 aa, Caulobacter crescentus
MASLGQKVMGAAGGAALLCAATAGAGLWVAWSLDSALSRAEASARILRLHMHADMMHDALRADVLGAIMSSDPTLGVDLKVVRADLAEHTQAFRDDIAQSGELAHNPRTKAALLAVETPLNAYIAAAEDIVGTADVDPAAAHAKLTDFGQQFSTLEDKMEAASTEIEAAASHDTNAAKSLGLLGQAIMAGLLLLAVALAAVLMFAARRGLVAPLTEITRCLRRLAAGDLDVILPRKKSQDEIGQITDALRSFHETVEARRKELEAADVREALEIERRAADQRRAEADATQKAVVESLALALGRMSQGDLTCRIDRAFPSGYEALRVDFNTAIEKLSGVIAASLDATRAIHGGTAEISEAADELATRTERQAASLEEAVAALDEITSTVRQTADGASRARKVVERARSAADASGSIVSQAVEAMGAIEKSSSQIGQIIGVIDEIAFQTNLLALNAGVEAARAGEAGRGFAVVAQEVRALAQRSADAAKEIKTLISTSTAEVGQGVEYVGKAGEALRAIAHEVDEIDDLVTAMAASTQQQARGLSEVNTTMNQMDQVTQRNAAMVEETTAASHTLAQEATRLAQRMGELRIMRAGMQAAA

SEQ ID NO: 20338 - DNA, 2148 bp, Agrobacterium tumefaciens
  CDS (1)..(2148)
atgtccgcaaggcccgtgtggccggtcggaacctgccatgacggcgtctcccccattttccagaaattgcggccgttgcagcgcagacgtttgctccgtggcatcgggtcgccgagagagtttgcgatgtcgctgaaaaatctccccattaacctgaagctcatagccaccttctgtgccttgatgggcgtgtgtctgctcgcgtctgcggttgtgttctggcagacccgggggagcgagcgtgtcacgattgaaaacaaccgcaccaaggacatcatccaggctgtggatggtgcgacggcggccatgctggaacaggccgtcaaccagcgcggtttcctgctgttccgcagcgacagcacctataatgatgtcttcgcacagcgcgaactgatgctgaagaagctcagcgacgcccgcgccctggccgccggccagcctgatatcctgaagtccatcgacgatatggaaaaatccgccaccgtgttcttcaaggaactggcagagccgcagatcgccgcccgcaagacgacggaagcgccgatttctgaaatcatcgagatcggccgcaaccaggcgaaaggtcagcttgatggcttccgcgctgccgccgccaagatcaaggaacagctgaacggcctgtccaccgtctacgctgctgaacagcaggctgccgcccgcaatctggaatacgcgcttctgggcggcggtgccgtcgccggccttctcgccgttctcctgatctgggcgctgtcgcgctccatcgtcacgccgatcgtcggcatgacggcggccatgagccggcttgctgatggcgacctgacgacggaagttcccgccacggatcgtggcgacgaagtcggcaagatggcgaaggccgttctggtcttcaaggaagccggtctcgaaaaatcccgccttgccggggagactgaccgcatgcgctccgcaacggacgccgaacgccgccgcaacgaggaagaaaaggcgcgcgacgaagccgccagcgccttcgccagcgccgagcttggcaagggccttgccgctctcgccgacggcgatctttcctatcgcatcgaaacgccttttgtgcctgccatcgatccggttcgcgtgaatttcaacagcgcggtcgaaaagctgcagcaggcgctgcgcacggtgggtgaaaacgccgccgccatcaatgccggcgcttcggaaatgctctctgccgccgacgacctgtcgcgccgcaccgaacagcaggcggcctccatcgaagaaaccgctgcggctctggaagaagtcaccaccacggtgcgtgatagcgcccgcggtgcggaggatgccggcaatctggtccagcgcgcccgcgccggtgcggagaagtcgggcgtcgtggtccgcaaggcggttgccgccatgcgcgagatcgagaaatcctcgggtgaaatcggcaatatcatcggcgtcatcgacgatatcgccttccagaccaacctcttggcgctgaatgccggtgtggaagcggcccgcgccggtgatgccggcaagggttttgctgttgtcgcacaggaagttcgcgaactcgcccagcgctccgccaatgctgccaaggaaatcaagacgctgatcggcgcgtccagccagcaggtggaaaacggtgtcaatctggtcgatgagaccggcaaggctctggaactcatcgtgtcggaagtcgaagagatcaacgcccatgtcagcgccatcgtcgttgccgcccgcgaacaggcaaccggcctgcaggaaatcaacacggccgtgaacacgatggatcagggcacccagcagaatgccgccatggtggaacagcagaccgccgccagccattctctggcccgcgaagcggaagcgctgaacagcctgcttggccagttccggatgggcggcacgcgcgccgccgtcgccggtgccggcggatattccgcgccgcgccagtcttccgccaagcccgccttccagcccgcgcccgccgcaccggttcgcaaggccccggtcaagtcggcttccgcagccgcacggccggtcgcttctcccgcccgcgcgcttggccagagcctcgcccgcgccttcggcggcgctgccgaagcaccggctgccaaggatcaggactggacggaattctga

SEQ ID NO: 20339 - protein, 715 aa, Agrobacterium tumefaciens
MSARPVWPVGTCHDGVSPIFQKLRPLQRRRLLRGIGSPREFAMSLKNLPINLKLIATFCALMGVCLLASAVVFWQTRGSERVTIENNRTKDIIQAVDGATAAMLEQAVNQRGFLLFRSDSTYNDVFAQRELMLKKLSDARALAAGQPDILKSIDDMEKSATVFFKELAEPQIAARKTTEAPISEIIEIGRNQAKGQLDGFRAAAAKIKEQLNGLSTVYAAEQQAAARNLEYALLGGGAVAGLLAVLLIWALSRSIVTPIVGMTAAMSRLADGDLTTEVPATDRGDEVGKMAKAVLVFKEAGLEKSRLAGETDRMRSATDAERRRNEEEKARDEAASAFASAELGKGLAALADGDLSYRIETPFVPAIDPVRVNFNSAVEKLQQALRTVGENAAAINAGASEMLSAADDLSRRTEQQAASIEETAAALEEVTTTVRDSARGAEDAGNLVQRARAGAEKSGVVVRKAVAAMREIEKSSGEIGNIIGVIDDIAFQTNLLALNAGVEAARAGDAGKGFAVVAQEVRELAQRSANAAKEIKTLIGASSQQVENGVNLVDETGKALELIVSEVEEINAHVSAIVVAAREQATGLQEINTAVNTMDQGTQQNAAMVEQQTAASHSLAREAEALNSLLGQFRMGGTRAAVAGAGGYSAPRQSSAKPAFQPAPAAPVRKAPVKSASAAARPVASPARALGQSLARAFGGAAEAPAAKDQDWTEF

SEQ ID NO: 20340 - DNA, 1500 bp, Agrobacterium tumefaciens
  CDS (1)..(1500)
atgcacggccaagcaaaaaccgaccgacaacttgatgaacgactgaattttctggggcttggccacggtgagcggcaaaatctttcagatatgaagggtgtgatcaccggttcactcgatgcgtctctcgatcgtttttatacaaaggttcgcgcggtgccagagaccgcgaagtttttctccagcgaggcccatatccaccacgccaagagcatgcagctcaaacattggtccaggatcgcctccggcacgttcaacgaggattacaccaatgcggtgaccgccatcggccgcacccatgcaaggctggggctggagccgagatggtacatcggcggttatgccctgatgctcgacggcatcgtcaaggcggtgatcgagtccgaattgaaaggccttttcatggaaaagaaggcgaagaaggtgaaggacgccctctccgccaccatcaaggccgcccttctcgacatggattattcgatctccgtctatctcgacgtgctcgccaccgaacggcaaaaggtggaggccgagcaggcgcagatgaagaaggagcaggatcacgttctcgagctgctcaacaacgctctcgaccggctggccaatggcgatctcacctccagcatcgccgaaaagaccgcgccgcaattcgaagggctgatcgccaatttcaatgccgcggtcggcaatctctccggcgcctttgcgcagatcgtcgaagaggccaacaagatttccggcaacacgcgtgagctgaccgccgcgaccgacgacatggcccgccgcacggagcagcaggccgccgcgctggaggaaaccgccgccgccgtcgaggaaatcaccaccatttccaaactctcggcgcagcgttccgaagaggccaaggccatcgtcgaaagctcggccgtggaggcggcgcgctcgcgcgatgtggtgacggatgcggtgaaggcgatgggcgcgatcgaggaatcgtcgcagaagatcacccagatcatttccgtcatcgacgagatttcattccagaccaatcttctggcgctgaatgccggcgtggaagccgcacgcgccggtgaggccggcaagggtttcgccgtcgtcgcccaggaagtgcgcgagctcgcgcagcgctccgccaacgccgccaaggaaatcaagacgctgattgccaagtcttccgaggatgtgacgcagggcgtttcgctggtcaacaagacgggcgaatccttgaatacgatcggtaacaaggtcgatcacatcaaggatcacattacctcgctaaccaaagcggcgcaggaacagtcggtcggcattcaggaaatcagtgcggcgatcaacagcatggacaatctgacccagaagaacgcggcgatggtggaagaaaccaatgcggccacgcataatctgagcgatgtcagcgccaatctggcggcgcttgtgagccggttcagcgtttcggcaacgcgggcgcatgtggagcggacctatcgggctgcttga

SEQ ID NO: 20341 - protein, 499 aa, Agrobacterium tumefaciens
MHGQAKTDRQLDERLNFLGLGHGERQNLSDMKGVITGSLDASLDRFYTKVRAVPETAKFFSSEAHIHHAKSMQLKHWSRIASGTFNEDYTNAVTAIGRTHARLGLEPRWYIGGYALMLDGIVKAVIESELKGLFMEKKAKKVKDALSATIKAALLDMDYSISVYLDVLATERQKVEAEQAQMKKEQDHVLELLNNALDRLANGDLTSSIAEKTAPQFEGLIANFNAAVGNLSGAFAQIVEEANKISGNTRELTAATDDMARRTEQQAAALEETAAAVEEITTISKLSAQRSEEAKAIVESSAVEAARSRDVVTDAVKAMGAIEESSQKITQIISVIDEISFQTNLLALNAGVEAARAGEAGKGFAVVAQEVRELAQRSANAAKEIKTLIAKSSEDVTQGVSLVNKTGESLNTIGNKVDHIKDHITSLTKAAQEQSVGIQEISAAINSMDNLTQKNAAMVEETNAATHNLSDVSANLAALVSRFSVSATRAHVERTYRAA

SEQ ID NO: 20342 - DNA, 2010 bp, Agrobacterium tumefaciens
  CDS (1)..(2010)
atgagccttgtggcctgtaccatcggtggactgtccatctatgcggtcagcgaattccgggtccgcacggtcgaatatgaaaaggcggcggagcgcgcctataagggcgaggcgctcaaccgcttggttaccgcggtcgtgatggaggcgcgcggggtctatgccgctgccgatatcgaaaaggcggcgccctttgcggacggcatcgtcaagaacctcgatgccatggagaagctgatcgccacatggacccctctcgttccggcggaacagaaggcaaccttcgataatctctccagccgcttcaaggagttcaagaccttccgccttgagaccgcgcggcttgcccgtgaagctggcccgcaggcggccaaccagcagggcaacaacgaggcgaaccgggccaaccgcaaagcctatcaggcggaaatcgacgccgtcgtgaagaacgacattgccgagcttgaggccgtcaaggccggcatcgacggttttgtaacgacaacattctggctggtcatcaccgtcaccggcagtggcatattggccggcgcggccttcggtctttatattggagcacggcaattgagtgcgccgatccgcagggtttcggaagtgatgaacgccgtggctgacggaaatctggacgcggatgtgccctatctcggccagaacgacgagatcggtgaaatggcggcggctgttgaagtcttcaaaaagaacggccgcgaagtacgccgcatgaacgctcaggaaacagccatgcgcgccaagagcgacgatcttcaggccggcatggctgttgtcgtcgatgctgcggcagggggtgatttcagccgccgtatcaacaaggattatggcgacgacaacctcaaccgtttcgcaacaacgatcaatgcattgctcatcggggtagacaacggcgtctccgagaccagccgcgtcatcgaaggtctggcgcgtggtgacctgacagaaaagatggacggcgacttccgcggcgtcttcgccgaactcaaggagaacgtcaaccagacgctgaccaagctgcgggaaacgatgcgtgaagtgcgcggcagcacggaaggcatcagcggcaacgccaacgagctgcgctcggccgccgacgacctgtcgaagcggacggaacagcaggccgccgcactggaggaaacctccgccgcgctggacgaaatcaccgccgttgtgcgtaattccaccgatcgtgcgcaggaagccagcgccatggttgccgaaaccaaacagaagacggaagaatccgccagtgtcgtgcgtgatgccgtctccgccatggatcgcatcgagcacgcctcgcgcgaaatcagccagatcatcaacgtaatcgatgagatcgccttccagaccaacctgctggcgctgaatgccggtgtggaagcggcgcgtgcgggcgaggctggcaagggctttgccgtcgtcgcccaggaagtgcgcgaactggcgcagcgttccgcaaccgcggcgaaggacatcaaggcgctgatcaccaaatccggcgaggaggttggccgcggtgtgtcgctggtgcagagaacgggcagcgcgttgagcgagatcgagacccgcgttctcgccatcaacgagcatatccattcgatcgccacggccgccagggagcagtccaccggtctgcacgaggtgaatactgccatcaaccagatggacgaggtgacgcagcgcaacgccgccatggtggaggagacctcggccgcgacccataagctgagcagcgaggcggaccatctcgtaacactggtgacgcgcttcaatgtcggcaccgagacggcgcagcgcagccatcgtatcgagcaatctttacggccgatgacggcatccaccgggccggttgccgtctccggcaggacggcggccgtgtcgtctccggcgcgtaagctgatgaacagcgtcagccgtgcgctcaatgcccagcccgccgcagccccggcgcatggcgactggcaggaattctag

SEQ ID NO: 20343 - protein, 669 aa, Agrobacterium tumefaciens
MSLVACTIGGLSIYAVSEFRVRTVEYEKAAERAYKGEALNRLVTAVVMEARGVYAAADIEKAAPFADGIVKNLDAMEKLIATWTPLVPAEQKATFDNLSSRFKEFKTFRLETARLAREAGPQAANQQGNNEANRANRKAYQAEIDAVVKNDIAELEAVKAGIDGFVTTTFWLVITVTGSGILAGAAFGLYIGARQLSAPIRRVSEVMNAVADGNLDADVPYLGQNDEIGEMAAAVEVFKKNGREVRRMNAQETAMRAKSDDLQAGMAVVVDAAAGGDFSRRINKDYGDDNLNRFATTINALLIGVDNGVSETSRVIEGLARGDLTEKMDGDFRGVFAELKENVNQTLTKLRETMREVRGSTEGISGNANELRSAADDLSKRTEQQAAALEETSAALDEITAVVRNSTDRAQEASAMVAETKQKTEESASVVRDAVSAMDRIEHASREISQIINVIDEIAFQTNLLALNAGVEAARAGEAGKGFAVVAQEVRELAQRSATAAKDIKALITKSGEEVGRGVSLVQRTGSALSEIETRVLAINEHIHSIATAAREQSTGLHEVNTAINQMDEVTQRNAAMVEETSAATHKLSSEADHLVTLVTRFNVGTETAQRSHRIEQSLRPMTASTGPVAVSGRTAAVSSPARKLMNSVSRALNAQPAAAPAHGDWQEF

SEQ ID NO: 20344 - DNA, 1941 bp, Agrobacterium tumefaciens
  CDS (1)..(1941)
atgtcattccttcagcatgcccgtatccgcactaaaatcctttccctgatacttcccctttgcctcgtcggcattggcggtgacattctcatcgcgaagaattacagttcatctggcgagacatactcggactttatttccaacgaaaccgctgccgaaatcaatatggctatcgccagccagaggttggtcgctgtcgtctacgatgcctaccaggtatttgcctatgacccggggacaaccggtctgatggcagcgcaggaagattacaaacaaagcacgaaacgatttctcgaccttgtcagcgattccagaggtttgctgccgagcgaagtaagcagcttcgccgcctttgaaacggacgcaaaggaaatctttagcatcacagacagggcaattgaggccggagcggcagaccgtaatacagaagcaaagcagcttctcgcccaggccgatgagaaggtcgcggtggcgttgccgaaaatgcgcggctggatcaacacctactccaagactatagccgacaaggcggcggcgcttggcgtggaaacgagaaacacaatcttctacagtctggctgtcgttggcactgtcttcactgtgggcatcgcgctgacgctccttcttatctcacgcggcattacgggtccaatcgctgctcttcgcgaacgtatgctgtcgctcgctgcaggtcatagcgaagcgccggtcaagggggtcgatcggcgtgacgaagttggagagatggccaaagcagtggctgtgtttcgagacaacgctatcgaacggatgcgactggagcaggaggcagacgctaaccggtcgctatctgacaaagagcggcttgagcgtgaggcgcagaaagcgcgcgaggctgcagatacgcagtttgccgtggatggtctggcaactggactggaagagctgtcccggggcaatgtcgcctatcgcataaacgtacccttcgtgacacagctagatcggctgcgagagaatttcaacgcttcgctcgcaaagcttgaagacacgctgcttcaggtgggtcagaatgctcacgggatcgacgccggcgccaacgaaattcgcgccgcagctgacgatctatcaaaacgaacggagcagcaggccgcatccgtggaagaaacggctgccgctctcgaacagattactacagcggtaaaagactccgcacggcgcgcagaagaggctggcgctctggtggcgcgcgctcgacagggagccgaacaatcgggtcaggtcgttcgcaatgctgttgccgccatgcaggcgatcgagaagtcgtccacggagatcagcaacatcatcggcgtgattgatgagattgcgttccagacgaacctcctggcgctgaacgccggtgtcgaggcagctcgagccggcgaagcagggaagggctttgcggtggtcgctcaggaagtgcgcgagcttgcccaacgctcggctattgccgcaaaagaaatcaagacacttatacagggctccggtggccatgtgcaggctggcgtcaacctggtgggagatgcaggcaggtcgttggaaaacatctcggcggaagttcaggaaattaaccggcacgtcagcgcgatcgttgaagcggcccgagaacagtcgattggtctccaggagatcaataccgccgtaaacgcgatggatcagggcacacagcagaatgcggcgatggtcgagcaatcgactgccgccagccacaatcttgcaaaagaggcggcttcgctcacggcgcagctttcgcaatttaatctgaccgggatggcgtcggcgcaatctgctgcgctccgcaagtcggcacatgcaatggccgcggtggcaacccagtcctctgatgtcgctgtcggcaggccgaaggcacgaagggtcgcaggagctttcggcgctacacaaggtagctgggaggaattctga

SEQ ID NO: 20345 - protein, 646 aa, Agrobacterium tumefaciens
MSFLQHARIRTKILSLILPLCLVGIGGDILIAKNYSSSGETYSDFISNETAAEINMAIASQRLVAVVYDAYQVFAYDPGTTGLMAAQEDYKQSTKRFLDLVSDSRGLLPSEVSSFAAFETDAKEIFSITDRAIEAGAADRNTEAKQLLAQADEKVAVALPKMRGWINTYSKTIADKAAALGVETRNTIFYSLAVVGTVFTVGIALTLLLISRGITGPIAALRERMLSLAAGHSEAPVKGVDRRDEVGEMAKAVAVFRDNAIERMRLEQEADANRSLSDKERLEREAQKAREAADTQFAVDGLATGLEELSRGNVAYRINVPFVTQLDRLRENFNASLAKLEDTLLQVGQNAHGIDAGANEIRAAADDLSKRTEQQAASVEETAAALEQITTAVKDSARRAEEAGALVARARQGAEQSGQVVRNAVAAMQAIEKSSTEISNIIGVIDEIAFQTNLLALNAGVEAARAGEAGKGFAVVAQEVRELAQRSAIAAKEIKTLIQGSGGHVQAGVNLVGDAGRSLENISAEVQEINRHVSAIVEAAREQSIGLQEINTAVNAMDQGTQQNAAMVEQSTAASHNLAKEAASLTAQLSQFNLTGMASAQSAALRKSAHAMAAVATQSSDVAVGRPKARRVAGAFGATQGSWEEF

SEQ ID NO: 20346 - DNA, 1956 bp, Agrobacterium tumefaciens
  CDS (1)..(1956)
atgaggccattcatgtctttcctgaagaataccaagataaaaacgaaggtcgtttttgtcatctcgttgatgagcctgatgtcgctttccggaataagctacgtcagcctgcaatataaaaaaaccgacgccgtctatagcgatttcatcggccatgaggcccttgctgcggtgctgaacgccagaaccagcggcaatctcaacgcgctcggcatgcagatactgcgcgccagcctcaacgacccggcgagcagcgatttcgaagccgcggtcaaaaccttcagggcggatcgcaagcagctcgaagagcgccagaacaagatcatggagctggtgccggcgcgcacggatgccgcgcgcgacatcctcaagggtgttgtcgaggtcgaggagatcggcaaccaggtcatcaccctcatgcaggcgggcaagcaggccgaagcgcagcaaatggcgctcaacgtgctcaggaagataaccgaggtctcgccgaaaatcagtgcgggcaacgagcagctcatccaggtcatgaatgacggcagggagcggctgacggcgagcaccaatacgacgatctggacgggtctcatcaccctcgcactggtgtccatcgccctgattgcgcttggtctgctggtctcgtcgcgcggcattaccacgcctattgcgcggcttcgcgcccggatggaatcgctcgccgccggtgatacggcaagcgagatcgacggcatggaccgcagggatgaagtcggacagatggccgccaccgtccaggccttccgcgaaaacgccatcgcgcgcgtgcggctcgagaatgaaaccgaagccaaccggtccatgtccgagaaagatcggatcgaacgcgaaaaacagaaggcgcaggaggccgccgacgttcagttcgcagtcaacaatctcgccacggcgctgtccaggattgctgaaggtgacgtgacctaccgtattgcccagcctttcgtgccaaatcttgatggtattcgcggtgatttcaaccgggctgcggaacagctgcaatcgacgctgacccaggtggcgcagaatgcacgcggcatcgatgccggcgccaacgagatcaggtcggccgcagacgatctggccagacgcacggagcagcaggctgcggcggttgaagaaacggcagcggctctggaggaaatcaccacgacggtgaaggattccaccaagcgggcgcaggaagccggccacctcgttggccgcgcgaaaatcggtgcggaaaaatccggagaagtggttcagaaggccgtctccgccatggagcagatcgcgacctccgccaatgagatttccaacattatcggcgtgatcgacgagatcgccttccagaccaaccttctggcgctgaatgccggcgtagaagcggcccgtgcgggcgatgcgggcaagggctttgccgtcgtcgcgcaggaggttcgcgaactggcgcagcgttccgccaatgcggcgaaggaaatcaagaacctgatcacgacgtcgaacgggcaggttcagcagggcgtgcaactggttggcgaaaccggcagggcgctggaactgatcgtcacggaagtgcaggaaatcaaccggcacgttgccgccatttcggaatcggctcaggagcaatcctccggcctgcagcagatcaatacggctgtgaaccagatggatcaggacacccagaagaacgccgccatggtggaagaaagcacggcggcaagccacggcctcgcccgcgaggcatcgtcgctcaaccggctgattgcgcagttcaagctctctgaagccggttatgcggagaccgcagcacccatgcgcacggcatcggcggccgacaggcctgctgtttcgcccgcccgcgccctcggtggaaggatcagggctgcgttttccggcaatgcggcgttgaataccgcagcggacaactgggaggagttctga

SEQ ID NO: 20347 - protein, 651 aa, Agrobacterium tumefaciens
MRPFMSFLKNTKIKTKVVFVISLMSLMSLSGISYVSLQYKKTDAVYSDFIGHEALAAVLNARTSGNLNALGMQILRASLNDPASSDFEAAVKTFRADRKQLEERQNKIMELVPARTDAARDILKGVVEVEEIGNQVITLMQAGKQAEAQQMALNVLRKITEVSPKISAGNEQLIQVMNDGRERLTASTNTTIWTGLITLALVSIALIALGLLVSSRGITTPIARLRARMESLAAGDTASEIDGMDRRDEVGQMAATVQAFRENAIARVRLENETEANRSMSEKDRIEREKQKAQEAADVQFAVNNLATALSRIAEGDVTYRIAQPFVPNLDGIRGDFNRAAEQLQSTLTQVAQNARGIDAGANEIRSAADDLARRTEQQAAAVEETAAALEEITTTVKDSTKRAQEAGHLVGRAKIGAEKSGEVVQKAVSAMEQIATSANEISNIIGVIDEIAFQTNLLALNAGVEAARAGDAGKGFAVVAQEVRELAQRSANAAKEIKNLITTSNGQVQQGVQLVGETGRALELIVTEVQEINRHVAAISESAQEQSSGLQQINTAVNQMDQDTQKNAAMVEESTAASHGLAREASSLNRLIAQFKLSEAGYAETAAPMRTASAADRPAVSPARALGGRIRAAFSGNAALNTAADNWEEF

SEQ ID NO: 20348 - DNA, 1674 bp, Yersinia pestis
  CDS (1)..(1674)
atgttcaagcgtatgaaagtggttaccagcctgctgctggtattagtattatttggtgccttacaactggtatccggcgggctttttttcaaatcattgcagaatgaccaggaaaacttcaacgttttacaagttattcgccagcaacaatcggtattgaatgaaagctgggtctatctgttacaaacacgcaatacgttaaaccgtgccggtgttcgttacatgatggatattaaccatactggcagtggccctacggtgaaggaccttatctcttcggctaaagggacgctaagcgtcgcggaagaccgcttcaaacgttacgaaaaaatcccacaaaatagcagtcaggatccagaaggcgccaaaaaattaaaacagtcctacgaggaatattttagtgccttaaccgaactgattaatttgatggaaacgaacaaaatcaatgagttcttcaatcaccccaccaccagtttccaaaatgaatttgagcaaaattacaacaactatctgacgcaaaatgacggactgtatgattcggcggtcgaggacagtaatcaatcctttagctttgctatgggcgtggttattactgtactggtcgtcgtattagtgatgatgctccttgtctggctggggatgcaacagatcttaattcaccccctcaaccacctgattgcacacattaaacatattgccaacggtgatttgacgcaaaatattgaagttcatggtcgcaacgaagtgggcacgttggctgctagcctgaaacacatgcaatctgaattggtcactatcgtcggcgaggtgcgtgtaggcgctgatgctatctacagcggtgcgtcagaaattgcggtgggtaacaatgatttatccgcccgtactgaacagcaagcggcatcattggaagaaacggctgccagcatggagcaattaaccgcaacggtgaaacagaacgctgaaaacgcccgtcaggcgagtcaattagcattgagtgcctcagaaaccgctcagaaaggggggaaagtggtggcggatgttgtgcaaaccatgcacgagatcgcggggagttcgcagaagattgccgacattaccagcgtcatcgacggtatcgccttccagaccaatatcttggcattgaatgccgccgttgaagccgcccgtgcaggtgagcaaggccgtggttttgccgtggttgccggtgaagtgcgcaatttagcacaacgcagtgcacaggcggcgaaggaaattaaaggtctgattgacgattcggttaaccgggtagatctgggctcagtactggttgaaagtgccggtgaaaccatgggcgatatcgttaatgccgtgacccgcgtgaccgacatcatgggcgaaatcgcttctgcctcagatgaacaaagtcgtggtattgaccagattggtcaggcagttgccgaaatggaccgcgtgacacagcaaaatgcttccttggtagaagaatcggcttccgccgccgcttcactggaagagcaagccagcatgttaactcaagcgatgtccgtatttgttctgagtgtggataacagtaattccactagcgacgtcagaaaagtcaaacaacccacgcaggaaatgaacagcacggctaaaaaagcgctgggaaataatctgcaagacaattgggaaactttctag

SEQ ID NO: 20349 - protein, 557 aa, Yersinia pestis
MFKRMKVVTSLLLVLVLFGALQLVSGGLFFKSLQNDQENFNVLQVIRQQQSVLNESWVYLLQTRNTLNRAGVRYMMDINHTGSGPTVKDLISSAKGTLSVAEDRFKRYEKIPQNSSQDPEGAKKLKQSYEEYFSALTELINLMETNKINEFFNHPTTSFQNEFEQNYNNYLTQNDGLYDSAVEDSNQSFSFAMGVVITVLVVVLVMMLLVWLGMQQILIHPLNHLIAHIKHIANGDLTQNIEVHGRNEVGTLAASLKHMQSELVTIVGEVRVGADAIYSGASEIAVGNNDLSARTEQQAASLEETAASMEQLTATVKQNAENARQASQLALSASETAQKGGKVVADVVQTMHEIAGSSQKIADITSVIDGIAFQTNILALNAAVEAARAGEQGRGFAVVAGEVRNLAQRSAQAAKEIKGLIDDSVNRVDLGSVLVESAGETMGDIVNAVTRVTDIMGEIASASDEQSRGIDQIGQAVAEMDRVTQQNASLVEESASAAASLEEQASMLTQAMSVFVLSVDNSNSTSDVRKVKQPTQEMNSTAKKALGNNLQDNWETF

SEQ ID NO: 20350 - DNA, 1569 bp, Salmonella enterica subsp. enterica serovar Typhi
  CDS (1)..(1569)
atgtttttgcataacattaaaatacgttcaaaattatttatggcctttggcttattcattgttctcatggtggtgagttccgctctgtctttgtttagccttgatcgggctaatacgggtatgcaggacattattaccaatgattatcccaccacggtaaaagccaatctgttaatcgataattttaatgatttcatcatcgcgcagcagctcatgttactggatgaagaggggcgctggagccagagctcgcagaaagaactcagtgagataagccagcgcatttcggcgttactggatgagctttccagggaaaatagtcacgatgcggattcacagaaaatcattaatgaaatccgtgaagcgcgccagcaatacctggagtccagattccgtattttgaaagatattcaaagcaataatcgtcaggcggccattcaggagatgatgaccagaacggtgcaggtgcaaaaagtctataaggacaaagtccaggaacttatcgctgttcaggacgcgctgatgcatgaagcgagcgtgcaggtcaaagaggattttaaaaataatcgaacgttgttaatcactttggcgctgataagcatcgccgccggaggcgtaataggatggtatattgtgcgttctattacccgaccgcttgatgacgcggtacgctttgccgaggcgattgccgatggcgatctgactcgccatatcaccaccgactataaagatgaaacaggcgtactactgcaagcgttaatggcgatgaaaacgcgtctgctggatatcgtacaggaagtgcaaaacggttcggagagtatctccacggcggcggcgcaaattgtcgccggtaaccaggatttggcggcgcgtacggaagagcaggccagctcggttgaagaaacggcggcgtcgatggaacagattaccgccacggttaaaaacacagccgatcataccagtgaagcgaccaaactctctgctggcgccgccagcgtagtgaaaaacaatggggagatgatgaatcaagtgacgcagaaaatgcgcgtcattaacgatacggcaaatcgtatgtcggatatcatcaatatcattgattccattgcctttcagaccaatattctggcgctgaacgcggcggttgaagcggcgcgcgcgggcgaacatgggcgcggttttgccgttgtcgccggagaggttcgccagttggcgcaaaagagcgcctcgtcggccagtgaaatccgtaatttgattgaagattcaaccagtcagactcaggaagggatgcacctggtggagaaagccagcgccctgattaatggcatggtggacaacgtcgaagagatggatgtgatattacgtgagattgggcaggccagccgcgagcaaactgacggtatttcgcagattaacagcgcgattggcctgattgacgccgccacgcaacaaaactcctgccttgtggaagagtctgttgccgccgcagcgtcgctgaacgaacaggcgttacatttaaaagagctggttaacgtgttccgcgtccgcgaagaggacacgcagcccgcttaa

SEQ ID NO: 20351 - protein, 522 aa, Salmonella enterica subsp. enterica serovar Typhi
MFLHNIKIRSKLFMAFGLFIVLMVVSSALSLFSLDRANTGMQDIITNDYPTTVKANLLIDNFNDFIIAQQLMLLDEEGRWSQSSQKELSEISQRISALLDELSRENSHDADSQKIINEIREARQQYLESRFRILKDIQSNNRQAAIQEMMTRTVQVQKVYKDKVQELIAVQDALMHEASVQVKEDFKNNRTLLITLALISIAAGGVIGWYIVRSITRPLDDAVRFAEAIADGDLTRHITTDYKDETGVLLQALMAMKTRLLDIVQEVQNGSESISTAAAQIVAGNQDLAARTEEQASSVEETAASMEQITATVKNTADHTSEATKLSAGAASVVKNNGEMMNQVTQKMRVINDTANRMSDIINIIDSIAFQTNILALNAAVEAARAGEHGRGFAVVAGEVRQLAQKSASSASEIRNLIEDSTSQTQEGMHLVEKASALINGMVDNVEEMDVILREIGQASREQTDGISQINSAIGLIDAATQQNSCLVEESVAAAASLNEQALHLKELVNVFRVREEDTQPA

SEQ ID NO: 20352 - DNA, 1815 bp, Agrobacterium tumefaciens
  CDS (1)..(1815)
atgaaaaacgtaacaatctctatgcgcctttatgcgctcgtcgcattgtttctggcaatactggccgcggctctcacattcagcttgtttgaaagttatcgtgagatggagcgcgagcgcaaagccgggctggcagcgatgaacgagacggccgtcgccattatcaagcaatattaccagctggagcagggcggaagcctgacgcgggaggcggcgcagcagcaggcgaaaacaacgatcgcggcgatgcgttatggcaacggcagcggttatttctggattaatgacatgcatcccaccatggtgatgcacccgatcaagcctgaaatgaatggcacggacctcaccgctaacaaggatccgaacggcaaggcgctgttcgtggaattcgtgaatacggtgaaggcgggcggtcagggttttgtcgattattactggccgaagcccggtgcaccggatccggtcgagaaattttcccacgtcgctggcttcgccccctggggctggattgtcggcaccggcgtttatgtcgatgacctcgaggctgtattctggcgtgacgcgtattttaacggcggcctttgtgtcgtggtgggccttctggtcgttggcgtcgccgccttcgtggtgcgcagcgtgacgcggccgatcgatcttatccgccagagcatgaagcggatcgccgacggtgacggcgcggccgaaatccagtttgccgaccgcggcgatgaaatcggtgcgattgccaaaacacttctggtattgcgtgacagcgtcaatgaacgcagcgcgctgcaggcccgcgaggccgatcagcagcgggcgctggaggaggcgcgacacggcaacgagatggttctgcgttccgcatccgagcgccaggcccatgccatggagcggcttggccatgcgctcgaggcgctggccaatggcgatctgacggtcgagcttgccgatataggctcggactatgaaaaactgcgtgtggatttcaatcgtgccgtcggcgcgctgcatggcgcgatcgaggcgattgcgagaaccggccaagtcgtcaatgacagcgcctccgacatcagcggcgcgaccggcaatctttcccgccgcaccgaacagcaggcggcggcgctggaagagacggcggccgctctcgatgagatcaccgcgacggtacgcaccgcctccgagcgtgccaatgaagcccggcagatggtgcaggacacaaaaaccagtgccggccgttcgggtgagatcgtccgcaatgccgtcgatgccatgggacgtatcgaggattcgtcgaaacgtatcggtcagatcatctcggtcatcgacgaaatcgctttccagaccaacctgctggcgctgaatgccggtgtcgaggcggcgcgtgccggcgaggcggggcgcggttttgcggtggtggcgcaggaggtgcgtgaactggcgcaacgctctgccaatgccgccaaggagatcaagacccttatcaaccgctcggccgaggaagtgggcggtggcgtcgcgctggtgcgttccaccggcgatgcgctggacgagatcgtggcgctggtcaaccgcgtcgatggccatgtcaattccatcgccacggcggcgcgggaacaggcgaccggcctgcaggagatcaacacctccgtcaaccacatggatcagatgacccagcagaatgccgccatggtggaagaaacgacggcggcgagccagacgctcgccgaagaaagccagcagctgcgggcgctgctttcacgcttcgaactggggcagggcgcaggacgcgcggtttcgcgggcggcttga

SEQ ID NO: 20353 - protein, 604 aa, Agrobacterium tumefaciens
MKNVTISMRLYALVALFLAILAAALTFSLFESYREMERERKAGLAAMNETAVAIIKQYYQLEQGGSLTREAAQQQAKTTIAAMRYGNGSGYFWINDMHPTMVMHPIKPEMNGTDLTANKDPNGKALFVEFVNTVKAGGQGFVDYYWPKPGAPDPVEKFSHVAGFAPWGWIVGTGVYVDDLEAVFWRDAYFNGGLCVVVGLLVVGVAAFVVRSVTRPIDLIRQSMKRIADGDGAAEIQFADRGDEIGAIAKTLLVLRDSVNERSALQAREADQQRALEEARHGNEMVLRSASERQAHAMERLGHALEALANGDLTVELADIGSDYEKLRVDFNRAVGALHGAIEAIARTGQVVNDSASDISGATGNLSRRTEQQAAALEETAAALDEITATVRTASERANEARQMVQDTKTSAGRSGEIVRNAVDAMGRIEDSSKRIGQIISVIDEIAFQTNLLALNAGVEAARAGEAGRGFAVVAQEVRELAQRSANAAKEIKTLINRSAEEVGGGVALVRSTGDALDEIVALVNRVDGHVNSIATAAREQATGLQEINTSVNHMDQMTQQNAAMVEETTAASQTLAEESQQLRALLSRFELGQGAGRAVSRAA

SEQ ID NO: 20354 - DNA, 1950 bp, Agrobacterium tumefaciens
  CDS (1)..(1950)
atgtctttttttaaaaatgccagcatccgtaccaaaatcctgtcgctcattttgccgctctgcatcgtcggtcttggcgccgccgccttcatggccacacgctataaggaatccgatgcactctattccgaattcatcggcagcgacaatgctgcgttggtcgagcttgcgcgggcaaaccgcaatctcatcggccttgcttatggcgcgtatcaggtcatggcctatgacgcgaatgctgcggaaatcaacgtcgccaggcaggcctacatcgccagcaaacgcgagcttctcgagcggctcgacaacgtcaaggccgtgtttcccgaggagcgcgccgccgtcgacgtcttgattgcgcaatcccagtccatcgcggaaatcaccgataaggccgtcgagcttggaatggcgaacaagaacgcggaatctgccgtgcaactcgtcaaggcggacgcctcgattcagatcatgtcggccaccataacgatgttgctggacaagcttgccaaaggggtggctagtggcagcggtgatctgagtgaccaaaccaattcaacgatcctcacctcgctcgtcgtggtgggtgttgtctttgcagttggtatcatcctgacactgtttgtggcgtcaagcggcatcaccacaccgattgcccggttgcgcgagcgcatggtgtcgcttgccggtggcgagacggcggctgagatcgacggcgtggagcggaaggacgaagttggccagatggcggtcgcggttcaggtgttccgcgagaatgcgatcgagcgcatccgtctcgagcaggaaaccgaggccaacaggtcgatgtcggaaaaggaccgcatcgagcgcgagcagcagaaggcaagggaagccgcggacgtcaagtttgccgtcgataatctcgcggccggtctttcgaagctttcggacggcgatgtttcctatcgcatcgaccagccgttcacggcaacgctcgacggcgtgcgcaacgacttcaacatgtcggccgaaaagctgcaatcggccttgacccgggttgcccagaatgccggcggcatcggcgcaggtgcaaacgagatcaagtcggctgccgatgacctggccaagcgcaccgaacagcaggctgctgccgtggaggaaactgccgcagctctggaggaaatcaccacgacggtgcgggactccaccaaacgtgcacaggaggcgggccagatcgtcagccgcgccaaggcgggtgccgaacaatccggcgaagtggtgcgccgcgccgtgatcgcgatggagcagatttccaaatccgccaacgagatcagcaacatcatcggcgtgatcgatgagatcgccttccagaccaatcttctggcgttgaatgccggtgtcgaggcagcaagggcgggcgaggcgggcaagggttttgccgtcgtcgcacaggaagtgcgcgagcttgcgcaacggtccgccagtgcggccaaggagatcaaggcgctgatcaccacctcgaatgatcaggtgcagcagggcgtgcagctggtgggcgacaccggcaaggcgctggcgacgatcgtctcggaggtgcaggaaatcaaccggcacgtcgtttccatcgtggaatccgcgcaggaacagtcttccggcctgcagcagatcaatacggctgtgaaccagatggatcaggacacgcagaagaatgcggccatggtggaagagaccaatgccgcaagccatagcctcgccaaggaagtggcatcgctcaaccagctgctctcgcagttcagactggctgagggtgcctatcagcagaagagccagccggctccggtgcgcagcgccgccggcagcgacagatcggtggcatctcccgtgcgggcgcttggccgcaagcttgcttcggcattctcgggcaatgccgcgctggatacatcgaagggtgactggcaggagttctga

SEQ ID NO: 20355 - protein, 649 aa, Agrobacterium tumefaciens
MSFFKNASIRTKILSLILPLCIVGLGAAAFMATRYKESDALYSEFIGSDNAALVELARANRNLIGLAYGAYQVMAYDANAAEINVARQAYIASKRELLERLDNVKAVFPEERAAVDVLIAQSQSIAEITDKAVELGMANKNAESAVQLVKADASIQIMSATITMLLDKLAKGVASGSGDLSDQTNSTILTSLVVVGVVFAVGIILTLFVASSGITTPIARLRERMVSLAGGETAAEIDGVERKDEVGQMAVAVQVFRENAIERIRLEQETEANRSMSEKDRIEREQQKAREAADVKFAVDNLAAGLSKLSDGDVSYRIDQPFTATLDGVRNDFNMSAEKLQSALTRVAQNAGGIGAGANEIKSAADDLAKRTEQQAAAVEETAAALEEITTTVRDSTKRAQEAGQIVSRAKAGAEQSGEVVRRAVIAMEQISKSANEISNIIGVIDEIAFQTNLLALNAGVEAARAGEAGKGFAVVAQEVRELAQRSASAAKEIKALITTSNDQVQQGVQLVGDTGKALATIVSEVQEINRHVVSIVESAQEQSSGLQQINTAVNQMDQDTQKNAAMVEETNAASHSLAKEVASLNQLLSQFRLAEGAYQQKSQPAPVRSAAGSDRSVASPVRALGRKLASAFSGNAALDTSKGDWQEF

SEQ ID NO: 20356 - DNA, 1950 bp, Yersinia pestis
  CDS (1)..(1950)
atggcggtatttagcaaaattattggcagctttgataacgtaaaagtcggaaaaaaattgggtttaagttttttcctaatgttgctattggtcggggtcattgcgggcaccaccgcttatcacttctccgtgatcgaagaacatgcatataaagtggagttgagctacaaaatcaacgacgaagcgaatcaggcaaaatataaccgcgcactttatgaacgtacctatgacctgaaatacatcacagaaaacacacagcacatcaataatataaaaaatttactgacccaaagtgcaaatctccgctggtcagttgataaccgcaaaaatattgccaacattaatcatgtcgttgaggagtaccagcaacaacagacgaactttgtgaatgcggtgaccaataaagataaagtgcgtcaaagctggagcatctctgaaagcctaaataatatcaatgcactacagcaaagcctgcttaatgaaggggccgataccaatacgcagatattgctagcagaaatgagccaaaaattaatgacggtgcgttacaacgcgcgcggtttattactggatcgcaataaagatgccgaaactgcactgataacctcaattaacattgccaacagtgccgcgaatgctttcatgcctgtgttatctgccgagcagcagaaactattagcaccggttgccgctaacctagccctctataaagacaacgttctggcctatttaccggcttatcagcaagaactggaggtcggtaaagtgatggaggccagtgcgaatgcattgaatacgttggccacccaactgtttacccaagagttgcaaggtacgcacaacgagattaacaatgcccagtaccaactcgctattgcggctcttgtggccttacttttggggctattgatcgcctggcgcatgacccgtcaaattaccgtgcctctacgtgccacactggatatggcagaacgtattgccactggcgatttaaccgcggcaaccacatcatcccgtaccgacgaactgggcatgttgatgaatgccgtcgcccgaatgaatgaaaatctgcgtgccatgattgatgaaatccgcattggtgtcagccaggtatcccatgcctctggtgagattgccgctggcaatactgatttatcgtcccgtaccgagcaacaagccgccgccgtagaagaaaccgccgccagcatggaacaattaaacgccacagtaaaacagaacacggataacgctcatcacgccaatcaattggccaccgaggcctcgcagaccgcacaacagggcggcaagctggtcaatgatgtagtgcgcaccatgaatgatatctctggcagttccaaacgtatttctgaaatcacctccgtgattaacagcatcgctttccagaccaatattttggcgctgaatgccgccgttgaagcggcccgggcgggtgaacaaggccgtggctttgcggtagtcgccagtgaggtcagaaatctggcacaacgtagtgcgcaggccgctaaagaaattgaagggctgattggcgagtctgtttctcaggttaatgccggaacatcgctggtgaaaaatgccggtaacaccatggaggagattgtccgctccgtgagccacgtgcgcgatatcatggcggaaatcgcctcagcatctgatgaacaaagccgtggtatcacccaagttagcttggctatctcagaaatggacagtaccacgcagcaaaatgcggccttggtggaagaatccgccgccgccgctgactcactggctgagcaggccatcttgctggctcaggctgtggcggtgtttcggctatctgaagatgaaggcgcgacagatgaaggccgtgttgtgacgccaaaagcctctaacgggcgtcatacgccagaagaccatcggatcaaccagcagaagagctgggaaacgttctaa

SEQ ID NO: 20357 - protein, 649 aa, Yersinia pestis
MAVFSKIIGSFDNVKVGKKLGLSFFLMLLLVGVIAGTTAYHFSVIEEHAYKVELSYKINDEANQAKYNRALYERTYDLKYITENTQHINNIKNLLTQSANLRWSVDNRKNIANINHVVEEYQQQQTNFVNAVTNKDKVRQSWSISESLNNINALQQSLLNEGADTNTQILLAEMSQKLMTVRYNARGLLLDRNKDAETALITSINIANSAANAFMPVLSAEQQKLLAPVAANLALYKDNVLAYLPAYQQELEVGKVMEASANALNTLATQLFTQELQGTHNEINNAQYQLAIAALVALLLGLLIAWRMTRQITVPLRATLDMAERIATGDLTAATTSSRTDELGMLMNAVARMNENLRAMIDEIRIGVSQVSHASGEIAAGNTDLSSRTEQQAAAVEETAASMEQLNATVKQNTDNAHHANQLATEASQTAQQGGKLVNDVVRTMNDISGSSKRISEITSVINSIAFQTNILALNAAVEAARAGEQGRGFAVVASEVRNLAQRSAQAAKEIEGLIGESVSQVNAGTSLVKNAGNTMEEIVRSVSHVRDIMAEIASASDEQSRGITQVSLAISEMDSTTQQNAALVEESAAAADSLAEQAILLAQAVAVFRLSEDEGATDEGRVVTPKASNGRHTPEDHRINQQKSWETF

SEQ ID NO: 20358 - DNA, 1644 bp, Salmonella enterica subsp. enterica serovar Typhi
  CDS (1)..(1644)
atgaaaaatatcaaagtcatcaccggcgttatcgcgacgctgggcatatttagcgccttattgttggtgacaggaatactgttttattccgccgtcagcagcgatcggctgaatttccagaatgcgagcgcactgagttaccaacaacaggaactgggcggcagttttcagacattgattgaaacccgcgtcaccattaaccgcgtggcgatacgcatgttaaaaaatcagcgcgatcccgcctcgctggacgccatgaacacgctgttaaccaacgctggcgcgtcgctcaacgaagcggaaaagcatttcaacaactacgtgaactccgaagcgatcgcaggcaaagatccggcgttggatgcccaggccgaagccagctttaagcagatgtatgacgttttgcagcagtctatccactatcttaaagccgataattacgccgcctatggcaaccttgacgcgcaaaaagcgcaggatgacatggagcaggtatatgaccagtggctctctcaaaatgcgcaattaataaaattagccagcgatcagaatcagagcagttttacccagatgcaatggacgctggggataattctacttatcgtgctcatcgtgctggcgtttatctggctggggctgcaacgcgttctactccgcccgctgcaacggattatggcgcacattcaaacgatcgccgacggcgatcttacccatgagatagaggctgaaggacgtagtgaaatgggccaactggctgccggtctcaaaacgatgcagcagtcgttaatccgtaccgtcagcgcggtgcgcgataacgcagactctatctatactggcgcaggcgaaatttccgctggcagcagcgacctctcttcccgtaccgaacagcaggcctcggcgctggaggagaccgccgccagcatggaacagttaaccgccacggtacggcaaaacaccgataacgcacgacaggcgacgggtctggcgaaaaccgcatcagaaaccgcgcgtaaaggaggacgcgtggtggataacgtagtgagcaccatgaacgatatcgccgaaagctcggaaaaaatcgtggacatcaccagcgtgattgacggtatcgccttccagactaatatcctggcgctgaacgctgcggtagaagccgcccgcgccggcgaacaggggcgaggattcgcggttgtggccggagaggtacgcacgttggccagccgtagcgcgcaggccgccaaagagatcaaagtgctgattgaaaactccgtgtcgcgcattgataccggctctacgcaggtacgcgaagcgggagaaaccatgaaagagatcgttaacgccgtgacccgcgtgaccgatattatgggcgaaatcgcctctgcctccgatgagcaaagcaaaggcattgagcaggtggcgcaggcggtatcggaaatggacagcgtgacgcagcaaaacgcctcgctggtagaggaatccgcagcagcagcggcggcgctggaagatcaggctaacgagcttcgtcaggcggtcgccgcgttccgcatccagaaacaacctcgtcgggaggcgtcgccgacgccgttaagcaaaggcttaacgccacagcccgccgcagaacaggcgaactgggaaagcttctaa

SEQ ID NO: 20359 - protein, 547 aa, Salmonella enterica subsp. enterica serovar Typhi
MKNIKVITGVIATLGIFSALLLVTGILFYSAVSSDRLNFQNASALSYQQQELGGSFQTLIETRVTINRVAIRMLKNQRDPASLDAMNTLLTNAGASLNEAEKHFNNYVNSEAIAGKDPALDAQAEASFKQMYDVLQQSIHYLKADNYAAYGNLDAQKAQDDMEQVYDQWLSQNAQLIKLASDQNQSSFTQMQWTLGIILLIVLIVLAFIWLGLQRVLLRPLQRIMAHIQTIADGDLTHEIEAEGRSEMGQLAAGLKTMQQSLIRTVSAVRDNADSIYTGAGEISAGSSDLSSRTEQQASALEETAASMEQLTATVRQNTDNARQATGLAKTASETARKGGRVVDNVVSTMNDIAESSEKIVDITSVIDGIAFQTNILALNAAVEAARAGEQGRGFAVVAGEVRTLASRSAQAAKEIKVLIENSVSRIDTGSTQVREAGETMKEIVNAVTRVTDIMGEIASASDEQSKGIEQVAQAVSEMDSVTQQNASLVEESAAAAAALEDQANELRQAVAAFRIQKQPRREASPTPLSKGLTPQPAAEQANWESF

SEQ ID NO: 20360 - DNA, 1960 bp, Clostridium thermocellum
  CDS (189)..(1862)
gatcgttatatgctcagatggtattataatttaaaatatcagcaaattaattattggtttctcctgcttgcatgtgcagagtgtcgattgtgccttcaacatcaataatatgagccagcgatgccgtactgtatgaaaaacacattggtatcaactatgctgccggtgcttccttgaggtttcagagaatgagatataatactgcaaaacttctggtatatgatgcagaacaggtaagtaaaggtatagaaaaaattcaagaacatgttgaaaatactgaaaaatatttaagtttgtatgaaagtacagttataaacgaaaccgaccgcattcagcttcaagaattaaaggcgttgtgggaaaagtataaatctttggttgacaaagaagttgaacttgttaaatcggggaaaaccgaagaagcaagacagttgcttctttcagatattgatgatattggagatactctgagagactattttgaggcttttgtggaatataatactactgcagcgaaggaaaaagtggatgaaaataagcaagttgcgtcaactgcttcaactgtaatgatagttgtgatatttgtaggcatattaatagctattgctttgggagtgtttatatccaggattatcagcaaacctatcggccagatggtggaagctgccgacaggcttgcccttggagacgtggaagtggatgtcaaggctgaaaccagggatgaaataggaaaactggccgaatctttcaaaagaatgatagaaaatatccgtgaacaggcgtatgtagtagaaagaattgctgcgggagacatgactgtcgatgtaagagtcaaatccgacaaagacttgctgggtaaaaaacttaaggaaatggttgatacaaataatgaagtgctttcaaatatcaatgaagttgctgcacaggtggcagcaggagcaaaacaggtatccgactcaagcatgcagctttcgcaaggagcaactgaacaggcaagctcgatagaagagctgacagcttcccttgaacaggtggcgaaccagacacagcttagtgccaagaatgcgaatcaggccaatgaactggctgaagttgcaaaaaacaatgcagagcaagggaacaagcaaatggctgaaatgctcaatgccatggaggaaatcaataattcttcatcaaatatctccagaattatcaaagtgatagacgaaattgcgttccagaccaatattcttgcactgaatgccgcagttgaggcggcaagggccggacaacacggaaaaggatttgcggttgtggcggaagaagtaagaaacctggcggcaagatcggcgaatgctgcgaaagaaaccacggaacttattgagggaacaatcaagcggactgaaaatggtacaaagatagcccgggaaactgccgaagctctcaacaaaatagttgaaggcatatcaaaggctgctacgctggttaatgatatagctgttgcctccaacgaacaagctgcggcaattactcaaataaatcagggaattgcccaggtatcccaggtggtacagaccaactcggcaacatcggaagaaagtgctgctgcaagtgaagagctgtcaagtcaggctgagcttttgaaacggtccattgcaaaattcaagttaaaaaatatgggaaaaatgacatccaacagatataaggaagttagtcctgaaataatgaggatgcttgaagactatacggaaaacaagcaaccgaaaagttacagtaaggaagaaaatggagaatatagtgatggaaaggaaacagctgagaaggatgttggaggtttaaaacagaagatattgttgtctgacagtgagttcggtaaatactaggaaaacgtaaaataaaaatacgtaaagcagagtgaattttgacatttactctgcttttttaaaataccaaaaaaggcatgtccgaaaaatttttgaaa

SEQ ID NO: 20361 - protein, 557 aa, Clostridium thermocellum
MRYNTAKLLVYDAEQVSKGIEKIQEHVENTEKYLSLYESTVINETDRIQLQELKALWEKYKSLVDKEVELVKSGKTEEARQLLLSDIDDIGDTLRDYFEAFVEYNTTAAKEKVDENKQVASTASTVMIVVIFVGILIAIALGVFISRIISKPIGQMVEAADRLALGDVEVDVKAETRDEIGKLAESFKRMIENIREQAYVVERIAAGDMTVDVRVKSDKDLLGKKLKEMVDTNNEVLSNINEVAAQVAAGAKQVSDSSMQLSQGATEQASSIEELTASLEQVANQTQLSAKNANQANELAEVAKNNAEQGNKQMAEMLNAMEEINNSSSNISRIIKVIDEIAFQTNILALNAAVEAARAGQHGKGFAVVAEEVRNLAARSANAAKETTELIEGTIKRTENGTKIARETAEALNKIVEGISKAATLVNDIAVASNEQAAAITQINQGIAQVSQVVQTNSATSEESAAASEELSSQAELLKRSIAKFKLKNMGKMTSNRYKEVSPEIMRMLEDYTENKQPKSYSKEENGEYSDGKETAEKDVGGLKQKILLSDSEFGKY

SEQ ID NO: 20362 - DNA, 1674 bp, Enterobacter aerogenes
  CDS (1)..(1674)
atgtttaatcgtattaaggtcgtcaccagtctcttattagtgctggtgctatttggcgcattgcagctgatttcaggcggtctgtttttttcgtcgctgaaaggcgataaagagaactttaccgtcctgcaaaccatccgtcagcagcagttgctgctgagtgaaagtcgggtcgatctgctgcaggcgcgtaactccctgaaccgcgcagggatccgctacatgatggataccaacaaaatcggcagcggcgcgactatcgacgagctgctggcgaaagcggaaaaagaaaagctggcgcgcgccgagcgcaactacaccgcctatgaaaaaatcccgcaggacccgcgtcaggatcctcaggcgacggaaaagcttaagcagcagtatggcatcctgtacggcgcgctgtcggagctgatccagctgctgggcggagggtgtaaaatcaacgccttcttcgaccagccgacgcaaaaataccaggacgatttcgagcagacctataacgcctatctgcagcaaaacggcaagctgtatcaaatcgccgttgacgctagcaacagctcgtatagctcggcgatctggaccttaattgtggtcatcatcgtggtgctggcggcgatcgtcggcgtgtggatgggtatccaccatatcctggtgcgcccgctgaaccgcatgatagaacacatcaaacggatcgcgtccggcgatctgacccagcctattccggtgaccagccgtaatgaaatcggcgtgctggccgccagcctcaagcacatgcagaacgagcttatcgaaacggtaagcggcgtgcgtcagggggcggatcgatctattgacggcgcatcggaaagcgccgccgggaataacgatctctcttcgcgcaccgaacagcaggcggcagcgctggaagagaccgccgccagtatggaacagctgacagcgacggtgaaacagaacgccgaaaacgcgcgtcaggccagccagctggcgctgagcgcctccgaaactgcgcagaagggcggcaaagtggtggctaacgtggtcgaaaccatgcacgacatcgccagcagctcgcagaaaattgccgatatcaccggcgttatcgacgtaatcgccttccagaccaacatcctggcgcttaacgccgcggtagaagcggcgcgtgcgggtgaacaaggtcgcgcgttcgcggtcgtggcgggcgaagtccgcaacctggcgcagcgcagcgcccaggcggccaaagagatcaaagcgctgatcgaagactcggtcaaccgtgtggatatgggctcggtactggtggaaagcgccggcgacaccatgggcgatatcgtcaatgcggtcacccgcgtgaccgacatcatgggtgaaatcgcctctgcttccgatgaacagagccgcggtatcgaccaggtcggccaggcggtacgggaaatggatcgcgtcacccagcagaacgcctcgctggtggaggagtcggcctcggccgccgcgctggaagagcaggccagcctgctgacgcagtcggttgccgtcttccgcctgaagtcggaagggcaggaagagtataaagcgccggtcagcaataaaaccgcgcctgccgccatcgctacgcataaaaaaaccagcgccagcgactaccaggataactgggagacgttctaa

SEQ ID NO: 20363 - protein, 557 aa, Enterobacter aerogenes
MFNRIKVVTSLLLVLVLFGALQLISGGLFFSSLKGDKENFTVLQTIRQQQLLLSESRVDLLQARNSLNRAGIRYMMDTNKIGSGATIDELLAKAEKEKLARAERNYTAYEKIPQDPRQDPQATEKLKQQYGILYGALSELIQLLGGGCKINAFFDQPTQKYQDDFEQTYNAYLQQNGKLYQIAVDASNSSYSSAIWTLIVVIIVVLAAIVGVWMGIHHILVRPLNRMIEHIKRIASGDLTQPIPVTSRNEIGVLAASLKHMQNELIETVSGVRQGADRSIDGASESAAGNNDLSSRTEQQAAALEETAASMEQLTATVKQNAENARQASQLALSASETAQKGGKVVANVVETMHDIASSSQKIADITGVIDVIAFQTNILALNAAVEAARAGEQGRAFAVVAGEVRNLAQRSAQAAKEIKALIEDSVNRVDMGSVLVESAGDTMGDIVNAVTRVTDIMGEIASASDEQSRGIDQVGQAVREMDRVTQQNASLVEESASAAALEEQASLLTQSVAVFRLKSEGQEEYKAPVSNKTAPAAIATHKKTSASDYQDNWETF

SEQ ID NO: 20364 - DNA, 1614 bp, Caulobacter crescentus
  CDS (1)..(1614)
atggggaccgccatgaaccaggactacgcgatcggtgaacggaccgcgttcatgggcatcgacgacaaggcgcgatcggcgctgcgcgacctgcgccctgttattcgggccgagatcggcaaggcgctcgacaacttctacggcaaggtccgggcgacccccgagacgcgcaagttcttcagtgacgaccgacatatgaacgcggcgagttcgcggcagcaggcgcactggggcgtgatcgccgaaggacagttcagcgacgactacgtgcaggcggtgcgagcgatcggccagacccatgcccgcatcggcctggagccgcgctggtacatcggcggctatgccgtcgtcggcgaccatctggttcgcgcagtgatcgactcgatgtggcccagggggctgctggccaagggcggctctgaccgcgcgggcgaggcggtcgccgccctgatgaaggcgatcttcctggacatggacttcgccatctcgatctatcttgaaaccctggagaacgagcggcaacgcctggaggccgagcagaaggccacccgagcgcgtcaggagcacgtcgtcaccctcctggccgaagcgctggaccgcctcgccgccggcgacttgctggcgaggatcgatggtgaggtctgcagcgaattcgagaagctcaaggccgacttcaaccacgccgtggagcttctggatcaagcgatgtgcggcgtcggcggcgcgacggagggcatccgctccagcaccgaggaaatcagtgtcgcggccgacgacctgtcgcgtcgcaccgaacagcaggccgccagcctcgagcagacggccgccgccttggacgagatcaccgccaccgtccggcgctcagcggccggcgccaaacaggcgcaggaggtcgtggccggcgccaagaccgaagccgagcgatcgggctcggtcgtcaatcaggccgtcgcggcgatgggtgagatcgagacaagctcccgcgagatcggcaacatcatcggggtgatcgacgagatcgccttccagaccaacctcctggccctgaacgcgggggtcgaggcggcccgcgccggcgaggccggcagaggtttcgcggtggtcgctcaggaggttcgggcgttggcgcagcgctcggccgacgcggccaaggagattaaggcgctgatcaatacctcgaccaagcaggtcgaggcgggcgtcgccttggtgggccagacgggggacgcgttgcgcggcatcgtctcgaaggtcgccgagatcgatgagctgatcgcgcagatctccgtctcggcgcaggagcagtctggcggactgcatgaagtcaacaccgccgtgaaccagatggatcaggtgacccagcagaacgcggcgatggtcgagcagaccacggcggcgacccattcgctgaagagtcagacaggagaactggtgaggcaggtggagaccttccggacctccgaggggcgacgttcctctgcggcggcatctccggctcccgtccagatggcgcaaccggctcgctcgccgcgtccgcagagccggccgggcggaccgccgatctcacggggcgctacggcggtcgcggtcaaggaagagtgggaagaattctag

SEQ ID NO: 20365 - protein, 537 aa, Caulobacter crescentus
MGTAMNQDYAIGERTAFMGIDDKARSALRDLRPVIRAEIGKALDNFYGKVRATPETRKFFSDDRHMNAASSRQQAHWGVIAEGQFSDDYVQAVRAIGQTHARIGLEPRWYIGGYAVVGDHLVRAVIDSMWPRGLLAKGGSDRAGEAVAALMKAIFLDMDFAISIYLETLENERQRLEAEQKATRARQEHVVTLLAEALDRLAAGDLLARIDGEVCSEFEKLKADFNHAVELLDQAMCGVGGATEGIRSSTEEISVAADDLSRRTEQQAASLEQTAAALDEITATVRRSAAGAKQAQEVVAGAKTEAERSGSVVNQAVAAMGEIETSSREIGNIIGVIDEIAFQTNLLALNAGVEAARAGEAGRGFAVVAQEVRALAQRSADAAKEIKALINTSTKQVEAGVALVGQTGDALRGIVSKVAEIDELIAQISVSAQEQSGGLHEVNTAVNQMDQVTQQNAAMVEQTTAATHSLKSQTGELVRQVETFRTSEGRRSSAAASPAPVQMAQPARSPRPQSRPGGPPISRGATAVAVKEEWEEF

SEQ ID NO: 20366 - DNA, 1770 bp, Caulobacter crescentus
  CDS (1)..(1770)
atgttttacccgaaattcaccgagacaaatcagcgttatatggacttgggcggtgttccgcctcgcaagacgcacggatcgcggcgaatgatcaaacttctgaacggctccgcgggcgacgccagccagaagatcgacgcactcgacaagtcgctcgcgatgatcgagttcgacgtcaagggaacgatcctcgcggccaacgccaacttctgcaaagccatgggctatgaggcgcgggagatcatcggcaagcaccacagcctgttcgtggatcccgaatacgccgccagccaggcctatcgcgacttttggatgcagctgggccagggccagttcgacgcgcgggagtatctgcgcctgggcaagggcggcagggaagtctggatccaggcctcctacaacccggtcaagaacagcgccggcaaggtgacccggattctgaaggtcgcgaccgacatcacggctcagaaagaggtcgaagccgagcggacggccaagctcgacgccgtggaacgcgtgcaggccacgatcgaattcacggtcgacggcgtcatcctgaacgccaacgagaacttcctggccaccgtcggctatgcgctgtccgagatccagggcaagcatcacagcatgttcgtcgatccggccgaagcgcgctcggaggcctatgccgcattctggcgccggctgaacaccggcgagttcgtcgccgcagagttccggcggataggcaagggcggcaaggaggtctggatccaggcgtcctacaatccggtgttcgacgccaagggtcgggtggtcaaggtcgtcaagttcgcgaccgacgtgaccggccgcgtcgatgcggtcaatcagatcgcccaggccctggcgcgtctcgccgccaacgatctgagctatcggatggcggcgcagatcgacgcccagttcgcctctgtccgcgacgacttcaacgacgccgtggccgcgcttgatgaaacgattggagcggtcgcctcggccacacggaacgtcgccaccggcgccaatgaaatctcgaccgcgtcggacaatctctcgcggcgtacggagcagcaggccgccagtcttgaagaaaccgctgcggcgctggatgagatcaccgccacggtcagccgcagcgccgacggcgccaagcgcgcgtcggtggcggcctccgatgcgcgcgttgacgcggccaagtccggagagatcgtcggagaagcggtctcggcgatggatggcatcgagtcgagctccaaccagatcaaccagatcatcagcgtgatcgacgagatcgccttccagactaaccttctggccctgaacgccggcgtcgaggccgcgcgcgcaggcgaggcgggccgaggcttcgccgtggtggctcaggaagtgcgcgccctggcgcaacgctcggccgaagccgccaaggagatcaaggtcctgatcgccaacagctcaacccaggtcgaacgcggggtgaaactggtcggcgaaaccggccgcgccttgcaatcgatcgtcagcaaggtgagcgagatcgacaccctgatcagcgagatcgcccagtcgtcgcgggagcaggcgacagggctgggcgaggtcaatgtggccgtcaaccagatggaccaggtcacccagcagaacgcggccatggtggaggaagcgacggcggcggcggcgagcctgcgccacgaagccgacgaactcgacaagctgatcgcgcgcttccatgtgacggcgcgcgcggcccgtcgtccccggctggtggcgtag

SEQ ID NO: 20367 - protein, 589 aa, Caulobacter crescentus
MFYPKFTETNQRYMDLGGVPPRKTHGSRRMIKLLNGSAGDASQKIDALDKSLAMIEFDVKGTILAANANFCKAMGYEAREIIGKHHSLFVDPEYAASQAYRDFWMQLGQGQFDAREYLRLGKGGREVWIQASYNPVKNSAGKVTRILKVATDITAQKEVEAERTAKLDAVERVQATIEFTVDGVILNANENFLATVGYALSEIQGKHHSMFVDPAEARSEAYAAFWRRLNTGEFVAAEFRRIGKGGKEVWIQASYNPVFDAKGRVVKVVKFATDVTGRVDAVNQIAQALARLAANDLSYRMAAQIDAQFASVRDDFNDAVAALDETIGAVASATRNVATGANEISTASDNLSRRTEQQAASLEETAAALDEITATVSRSADGAKRASVAASDARVDAAKSGEIVGEAVSAMDGIESSSNQINQIISVIDEIAFQTNLLALNAGVEAARAGEAGRGFAVVAQEVRALAQRSAEAAKEIKVLIANSSTQVERGVKLVGETGRALQSIVSKVSEIDTLISEIAQSSREQATGLGEVNVAVNQMDQVTQQNAAMVEEATAAAASLRHEADELDKLIARFHVTARAARRPRLVA

SEQ ID NO: 20368 - DNA, 1818 bp, Agrobacterium tumefaciens
  CDS (1)..(1818)
atgggtgcggcgagccgcccgtggaccgatatttgggggacgttaatgctggggttaggaaaaagcgcagacaatcgaaatatgctcgatgcgatatccagatcgcaggcggtcatagaattcgatctcaagggtaatattctcaccgcaaaccgcaatttctgcatggcgctgggttatgatctcgcagaaatcgtcggcaagcaccatcgcatcttctgcgaccgggagattgccgcatcgcacgcctatcaggagttctgggaatctcttgcgcgcggcgaatttcaggcgaaggagtatcgccgcatccgcaaggatggatcagccgtctggatcgaagcatcctacaatcctgtcttccgttcgggcaaaccctacaaagtcgtcaagatcgcgaccgacatcaccgccaagaggatcaaggccgtcgaagatgcaggcaagctggaggcgttatcccgctctcaggccaccatcgagtttttccccgacggtacgatcatcaccgccaatccgaacttctgcgcaacggtgaactacgacctgaaggaaatcgagggcaaacaccatcgcatgttctgtgatccggcctatacggcatccgcggcttacgccaatttctggcagcggctggcatcgggagagttcatttcggacgaatttgtccgctatggaaagaacggcaaggaaatatggatccaggccgcctacaacccggtcctggatgaggcgggaaaagtcgtgaaagtggtgaaattcgccaccgacgtgaccccgcgcatgagcgccattactgtgcttgccgatgctttgcaggcgctggccgcgggcgacctcgtgcagcgcctcgacaccagcttcgtgcccagcatggagaagctgcgtgcggactttaatgaggtcgtcggcaagctacaggccaccatgcagacgatctcccacaatgcctcgacaatcgcctccggctcgggcgaaatccgcatcgccgccgatcaactttcgcaacgcaccgaacaacaggcggcctcgctggaagaaactgcggccgctctcgaagaaatcaccaccaccgtgaccgatgccagccagcgtgccgccgaggcgggcaagctggtgttgcggacgagggaacatgccgaacattccggcgacgtcgttcagcaggcgatttccgccatggacgcgatttcgcgttcctccggcgaaatcaccaatatcatcggcgtgatcgacgacatcgccttccagaccaatcttctggcgctgaatgcaggggtcgaagccgcccgcgccggggaggccggcaagggttttgccgttgtggcgcaggaagttcgcgagctggcgcaacgctccgccgtcgcggccaaggaaatcaaatcgcttatcaacacctcccgcgaacaggtcgccaacggcgtcgatctcgtcggcagaaccggtggggccttgcgggatattcagtcgcagatgggcgaaatcgatatcaatgtctcggcaatcgtcgaggcatcgcgcgaacaggcgaacgggctgaaggaaatcaatcaggccgtcaacgtcatggatcaggcgacccagaaaaatgccgccatggtggaagaaaccactgccgccagccacggcctcgccagtgaggccgacaacctctatgtattgctgcgacagttcaaaatatccggcgacggacagatatcatctgcccagcccatcgataaaaaagccgccagcatatcccggctaccgacacctcagccgcgatatgccacggcaagggcgcatggcaatgcggcagccgaatgggcggaattctaa

SEQ ID NO: 20369 - protein, 605 aa, Agrobacterium tumefaciens
MGAASRPWTDIWGTLMLGLGKSADNRNMLDAISRSQAVIEFDLKGNILTANRNFCMALGYDLAEIVGKHHRIFCDREIAASHAYQEFWESLARGEFQAKEYRRIRKDGSAVWIEASYNPVFRSGKPYKVVKIATDITAKRIKAVEDAGKLEALSRSQATIEFFPDGTIITANPNFCATVNYDLKEIEGKHHRMFCDPAYTASAAYANFWQRLASGEFISDEFVRYGKNGKEIWIQAAYNPVLDEAGKVVKVVKFATDVTPRMSAITVLADALQALAAGDLVQRLDTSFVPSMEKLRADFNEVVGKLQATMQTISHNASTIASGSGEIRIAADQLSQRTEQQAASLEETAAALEEITTTVTDASQRAAEAGKLVLRTREHAEHSGDVVQQAISAMDAISRSSGEITNIIGVIDDIAFQTNLLALNAGVEAARAGEAGKGFAVVAQEVRELAQRSAVAAKEIKSLINTSREQVANGVDLVGRTGGALRDIQSQMGEIDINVSAIVEASREQANGLKEINQAVNVMDQATQKNAAMVEETTAASHGLASEADNLYVLLRQFKISGDGQISSAQPIDKKAASISRLPTPQPRYATARAHGNAAAEWAEF

SEQ ID NO: 20370 - DNA, 1752 bp, Agrobacterium tumefaciens
  CDS (1)..(1752)
atgggcatcggcatatgggccgcggacacgctcaataccaacagcgccgaggtatcgcgttccgccgaaatccttcacaaccacatgcgcgccgacatgatgcatgacgcgttgcggtcggatgtgttggcggcaatattgtcggcaaacgacaaagtcggcatctcctacgaggccgtaaagacagaccttgcggaacatgaagcgatcttcctcggggcgctgaaggacaacgaagttttgtccgaggggacggcggccaaagaggttatcgagggcgtagagaaaccgctgctgtcttatatcgacatcgcgaaaaaggttgtttctcttgcaaacaccgatccagatgctgcggtcaagctggtgccggacttcgtgcggcaattcagcgctctcgaaacgacgatggaaaaagccagcgaacagatcgatgctctttcaagtgcaactctggccgaaagtgaaaaggcgaaaagcagtatcgatcttcttttgagaggactgttgctgctctcaacgcttttctgtgtgggtctcttcctcctcacccgtaaatcggtcattacgcctttgctgcacctgtcgaagaacatggaaacgcttgctggcggcgacacgacgcaggttccctccggcaccggtcgcaaagacgagatcgggttgatgtcccgtgccgtggagattttccggcaggcggccatcgcaaataaagcgctggaagcacaggctgaagacgcccgtcaacgggcacaggcggatcaggaagccgcaaggcgcgaagcggaagccgacgccgcggaaagactgcgggccgcaacatcaggacttgcggcagggctgaagcgcctggcgtccggagacctcgccttccagctagaccaacccttttctccagatttcgaagcgctacgccatgacttcaacagctcagtgaggcagctcgcggagaccctggtttccatctcggcaggtattggaacaatcgacagtaacagccaggagattgcgtcgggtgcaggcgaactgtcccgccgtaccgaaaatcaggcagcctcgcttgagcagacggcagctgcgcttgaggaaatcacggtcaacgtggccaacgcaaatacacgcgccaccgaagcgcgactggccgccaccgacgccaatcagcgcgcattgcgttcggtcgaggtcgtcagtcacgctgaagaggcgatgcgccggatagaagatgcctcaaaacagattgctggcatcatcagcgttattgatgaaatcgccttccagaccaatcttctggcactgaatgccggtgtggaggcagcgcgggcgggtgaggcgggcaagggttttgccgtggtggcgcaggaggtcagggatctcgcccagcgctctgccaaggcagccagtgaaattagagggcacatccgccagtccagttcggaagtcgaaggcggggtcaaactcgtgctcgatacgggagcggcgctcaaggacatcagcgagcggatcgccggcatagaccgacacatgaatgccatcgccacctcggcatccgaacaatccacgggtcttgccgaaatcaatgcagcggtgaattccatggatcaaagcacacagcagaacgccgcaatggtacagcaatcgaccgacgcctcggcaatgctcgccagcgaaacggccaagctgcgcgcgctggtttcccggtttcgccttgaaaccgaagatgaaagccgcgggcggatgcgccgtgtggcgtag

SEQ ID NO: 20371 - protein, 583 aa, Agrobacterium tumefaciens
MGIGIWAADTLNTNSAEVSRSAEILHNHMRADMMHDALRSDVLAAILSANDKVGISYEAVKTDLAEHEAIFLGALKDNEVLSEGTAAKEVIEGVEKPLLSYIDIAKKVVSLANTDPDAAVKLVPDFVRQFSALETTMEKASEQIDALSSATLAESEKAKSSIDLLLRGLLLLSTLFCVGLFLLTRKSVITPLLHLSKNMETLAGGDTTQVPSGTGRKDEIGLMSRAVEIFRQAAIANKALEAQAEDARQRAQADQEAARREAEADAAERLRAATSGLAAGLKRLASGDLAFQLDQPFSPDFEALRHDFNSSVRQLAETLVSISAGIGTIDSNSQEIASGAGELSRRTENQAASLEQTAAALEEITVNVANANTRATEARLAATDANQRALRSVEVVSHAEEAMRRIEDASKQIAGIISVIDEIAFQTNLLALNAGVEAARAGEAGKGFAVVAQEVRDLAQRSAKAASEIRGHIRQSSSEVEGGVKLVLDTGAALKDISERIAGIDRHMNAIATSASEQSTGLAEINAAVNSMDQSTQQNAAMVQQSTDASAMLASETAKLRALVSRFRLETEDESRGRMRRVA

SEQ ID NO: 20372 - DNA, 1539 bp, Enterobacter aerogenes
  CDS (1)..(1539)
atgtttaaccgaatccgtatctctaccagtcttttcctgctgctgatctccttttgcatcatgcaactgatcagcaccgggctctcttacgtccggtacgcgccgacaaccacaatcttgaacgtattaccgtcagtagccagcacggatgcgcttagcctgagctgggtatcgctgttacaggcgagaaatacccttaaccgcgccggtacccgcggcgctgaaggtgccgcaggagcaggtggaagtgcgctgatggcggcgcccgcagctcgctgcaaaaagccgatctctattttaaccagttcctcgacacgcctcgcgcggatgagcaggaacagcagttggccgatgccacgcgtgatagctacgagaatctacgcgctgcgcgaactgatcgtgttcctcgaaaatcgcaacctgcaggcctttatggaccagccgacgcagaaaatacaggaccgctttgaggccgactttgtgcaatatctgcagctggcgaaggcgacgaccgatgaagccagcgcctccagccagcaggcctacgcgttggttccaatctggttggttgccggggcggtgctgatgctcttggtagtcaccctcagcgcgatgtggtggctgcgaaccatgctggtgcagccgctgaatattattcgcggccatttcgaacgtatcgccagcggcgatctttccgcaccgattgaggtctatgggcgtaacgaaatcagccagctatttgccagcctgcagcgcatgcaacagtcgctgattggtaccgtcggcgcggtgcgcgacggcgcggagtcgattcttatcggcctgcaggagattgccgaaggcaacaacgatctctcctcgcgcaccgaacaacaggaccgttcgctggaagagaccgccgccagtatggagcagctaacggcgacggtaaaacagaatgccgataacgcccgccaggcatcgcagctggcgcgtgatgcctcctccaccgccgccaaacggacgctggcggatgacgtggtcaccacgatgcacgatatcgccaacagttcgcaaaaaatcggcgcgattaccagcgtcatcgacggcatcgctttccagaccaatattctggcgcttaacgcggcggtggaggcggcgcgcgccggtgaacaggggcgcggctttgcggtggtggccggtgaagtgcgcaacctggccagccgcagcgcccaggcggcaaaagaaatcaagctgctgatcgatgaatccgtcagccgcgtcaaacacggctcggtgctggtggaaaattccggcgccaccatgcaggacatcgtgcgctcggtcacccgggtcaccgacatcatgggcgaaatcgcctccgcctccgatgagcagagccgcggcatcgagcaggtgacgcaggcgttacccagatatcaggtcacgcaacagaacgccgccctggtggtggaatcggcttccgccgccgctgcgctggaagagcaggcgattaccctcgccgatgcagtggcggtattccgtctggcggacgactaa

SEQ ID NO: 20373 - protein, 512 aa, Enterobacter aerogenes
MFNRIRISTSLFLLLISFCIMQLISTGLSYVRYAPTTTILNVLPSVASTDALSLSWVSLLQARNTLNRAGTRGAEGAAGAGGSALMAAPAARCKKPISILTSSSTRLARMSRNSSWPMPRVIATRIYALRELIVFLENRNLQAFMDQPTQKIQDRFEADFVQYLQLAKATTDEASASSQQAYALVPIWLVAGAVLMLLVVTLSAMWWLRTMLVQPLNIIRGHFERIASGDLSAPIEVYGRNEISQLFASLQRMQQSLIGTVGAVRDGAESILIGLQEIAEGNNDLSSRTEQQDRSLEETAASMEQLTATVKQNADNARQASQLARDASSTAAKRTLADDVVTTMHDIANSSQKIGAITSVIDGIAFQTNILALNAAVEAARAGEQGRGFAVVAGEVRNLASRSAQAAKEIKLLIDESVSRVKHGSVLVENSGATMQDIVRSVTRVTDIMGEIASASDEQSRGIEQVTQALPRYQVTQQNAALVVESASAAAALEEQAITLADAVAVFRLADD

SEQ ID NO: 20374 - DNA, 1668 bp, Caulobacter crescentus
  CDS (1)..(1668)
atggcgaagattgggagacggtgcggccacggggcgcatcgcgccaaacttcaatcttggttaacagattccgttcaccaacatggtcaaccaattcttaccagcgagtcggagtcccctggcatgagcgccaacgccaagcttgatcagcgcatggccttcatgcgttttgacgagcggtctcgcgcccatctgcgagcgatcaagcccgtcattgacgccgagatcggggccgctctgggccagttctacagccaggtgcggttgttccccgacacgcgcgtgaagttccgcgacgacggccacatggccggcgccgaacgcgcccaggcggcgcactggcgccgcatcgctgaggccggctacggcgaaagctacgtccgcgacgtcgagcgcatcggccgctcccatgccgacgccgacattgcgccgcaatggtatatcggcggctacgcggttgtggtcgaggaagtgatgcgagccctcgtggccaagcgggccaaggggctgttcaacagcgccaagtcggacgccgaactggccgacgggctgtcggcgctgatcaaggccgcgttcctcgacatggatctgtcggtctccacctacatcgatgttctgctggaggagcgcgaagcccttgagcgtgaacgcgaggaagccgagcatcgccaggctgcggcggtcaaggccgtgggggaggcgctggcgcgcctggccgcaggcgatctttcggcgcgggtcgagggcgatctgtcgccggagttccacggcctgaaggctgacttcgagcaggccacctccgccctgaccgaagccatgagcgccgttgagcgcgctgctggcggtatccgcgccggggcggacggtatcgcccatagcgccgaggatttgtcgcagcgcaccgagcagcaagccgcaacgcttgagcagaccgcagcggcggtggaggagctgaccagcgcggtgggcaagaccgcccgcggcgcgcgcgaagtctcctcacgggtcagcgaggcctccgcagaggtcgaacgttccggcgatatcgtcacgcgcgccgccgaggccatgacgaagatcgaggctcagtcgcagcaggtgaaccagatcctgggcatgatcgacgaaatcgccttccagaccaacctgctggccctgaacgccggggtcgaggctgcgcgcgctggcgactcgggcaagggcttcgcggtggtcgctcaggaagtgcgggccctggcccagcgttcggcgcaagccgccagcgatatcaagtctctgatcacccagagcagccgtcaggtcagcgagggcgtggacctggtcggccagacgggcgaagcgcttcgtggcatccacgagaaggtcggcggcatcgacgaactggtgaacgccatcgcggcgtccgccagcgaacaggccacggccctcggccaagtgaacgccgccgtgacccagctcgaccaggtgacccagcgcaacgccgccatggtttcgcaatcgaccgacgccacccacgcgctccgtgtcgaggcggccgatctgtcgaaccgcgtcggagctttccgcctgggggctcggtcacagccgacccatcaggaacagcccgccgagaatcccgtgcacgccgcccgcgcgcgcgtcgccgctttcgcccgtcccgggcgctga

SEQ ID NO: 20375 - protein, 555 aa, Caulobacter crescentus
MAKIGRRCGHGAHRAKLQSWLTDSVHQHGQPILTSESESPGMSANAKLDQRMAFMRFDERSRAHLRAIKPVIDAEIGAALGQFYSQVRLFPDTRVKFRDDGHMAGAERAQAAHWRRIAEAGYGESYVRDVERIGRSHADADIAPQWYIGGYAVVVEEVMRALVAKRAKGLFNSAKSDAELADGLSALIKAAFLDMDLSVSTYIDVLLEEREALEREREEAEHRQAAAVKAVGEALARLAAGDLSARVEGDLSPEFHGLKADFEQATSALTEAMSAVERAAGGIRAGADGIAHSAEDLSQRTEQQAATLEQTAAAVEELTSAVGKTARGAREVSSRVSEASAEVERSGDIVTRAAEAMTKIEAQSQQVNQILGMIDEIAFQTNLLALNAGVEAARAGDSGKGFAVVAQEVRALAQRSAQAASDIKSLITQSSRQVSEGVDLVGQTGEALRGIHEKVGGIDELVNAIAASASEQATALGQVNAAVTQLDQVTQRNAAMVSQSTDATHALRVEAADLSNRVGAFRLGARSQPTHQEQPAENPVHAARARVAAFARPGR

SEQ ID NO: 20376 - DNA, 750 bp, Caulobacter crescentus
  CDS (1)..(750)
atggtcaagcgtacggccgccggcgctcaggaggcgagccgggtcgtcaatgccgccaaggacgatgctgaaaccggcggtcaggtggtcgccgatgctgttgcggccatgggcgaaattgagaagtcctcagagcagatcggcagcatcataagcgtgatcgacgagattgcctttcaaactaacctcctggccctcaacgcgggcgttgaggctgctcgcgccggcgaagccggtcgcggctttgcggttgtcgcgcaagaagtccgcgccttggcccagcggtcagccgaggccgcccgcgagatcaaggccctgatcctcgcctcgacccagcaagtcgacgccggcgtggtgcttgtcggcaagaccggcgatgcgctggaccgcattgtctctcaggtcgtcaaaatcaatgaggtcgtcagggagattgcggtgtcagctcagaaccaggcgacgggactcgagcaggtcaatacggccttgaaccagatggatcagatcacccaacagaacgctgcgatggttgaggaagcgactgcagccagtcatgctttggccatggaggctgacaacctgaccgtactgatggggcagtttcggatcggagaaactccagaagcgcagtccaatcgcagggacttaagcaaaggcgccggcgtcccgtctaatttgcgaccgatagcgcaaagccacgctcgtgcgggatccgcagccgcaaagattgatggctgggacgagttctaa

SEQ ID NO: 20377 - protein, 249 aa, Caulobacter crescentus
MVKRTAAGAQEASRVVNAAKDDAETGGQVVADAVAAMGEIEKSSEQIGSIISVIDEIAFQTNLLALNAGVEAARAGEAGRGFAVVAQEVRALAQRSAEAAREIKALILASTQQVDAGVVLVGKTGDALDRIVSQVVKINEVVREIAVSAQNQATGLEQVNTALNQMDQITQQNAAMVEEATAASHALAMEADNLTVLMGQFRIGETPEAQSNRRDLSKGAGVPSNLRPIAQSHARAGSAAAKIDGWDEF

SEQ ID NO: 20378 - DNA, 1794 bp, Caulobacter crescentus
  CDS (1)..(1794)
atgctgcgcctcaacgccttcctgaaactgctgaccgtcgcgttgatggtcggcacaatccttgccatcgccgcagcgacgttcggccttttgcatctgcgggtcggcggaccgatcgccaaccgtcaagccgccgccttcgatctcgtcgccgacatcctgccgccgccggcctatctggtcgagagcatgctggtggtcgagcagggcagccaggaccccagcgccgccgaagccaccctggtcaaactggccgcgctgcgcgccgactatgaggcccgcgtagcttactggcgaaaatccgacattcccgaggacgccaaggttgcgctcgatcgcctggacgtcagtggtcgcgccttctggcgtgaggtggaccagtcctatgctccggccctgcggtcgggcgacgtgatcgctgtgaacatggcggcggccaagctggatggccactatcgccgtcaccgcgtgggcgttgacgaactgacgatcaaggcgcgcgccatggtggccgccgccgccagggaatcgcaggacgcctccctcaccgtgttcgccggcctgggcgtggtggcggtcgcgatgctcgggatgatccttctgggggtcggggcgcttcgcaaacgcatcattcagcccctcgcgggaatgaccgcctatatgggccggctggccgaaggggactattcccaggagccgcccatgcgcgagcgcaaggacgaggtcggcgagatggccgccgccgtctcggtgttccgcgccgccgcgatcgaacgtcgccaggccgtccagctggagaaggaccgcgaggcggcggcgcgcgaagaggcttttgtggcggccgaggccgaagcccggggccggcgctcgttcgtggtggacgccctcgacgaaggtctgcgccgcctagctcagggcgacctttcgcagcggatcgacgcggcgttccccgaggagttcgaacgcctgcgtcgcaatttcaacgactcgatcgtcaccctgcgggaaaccatccaccaggtcgtctccagcgccagcgccgtcggcggcggggcgcggcagatcacggtggcggccgacgacctcgcgcggcgcaccgagcagcaggccgccggactggaacagaccgccgcggcgctcgacgaggtgacagcgacgatcaagaccaccgccatcaacgcccggaccgcctacaacgaggtggcggtcagtcgcgacctgatcggcgcgtccagcgccgtggccagcgaggccggggtggccatggagcggatcgacacctcgtcgcgcaagatcggccagatcattaccgtggtcgacgaaatcgccttccagaccaacctgctggctctgaacgccggggtcgaggccgcccgtgcgggtgaggccggtcgcggcttcgccgtcgtggccatggaggtgcgggccctggcccagcgctcggccgacgcggccaaggagatcaagaccctggtcgaggaagccggccgcagcgtcgaaaacggcgtcgagctggtcggccgggtcgggaacgagctcaccggcgtcgtcgcccagttcggtaagatccagacgctcgtcgagggcatcgcccaggccgcccacgatcaggccacgggcctgggcgaggtcaacagcgccgtcggccaaatggatcaggtcacccagcagaacgccgccatggtcgaggagaccaccgccgccagccacagcctgaccaacgaggcccggcaactggcgcagctgatggatcggttcaagaccgagggcggcgcggccaccctggcggcgtag

SEQ ID NO: 20379 - protein, 597 aa, Caulobacter crescentus
MLRLNAFLKLLTVALMVGTILAIAAATFGLLHLRVGGPIANRQAAAFDLVADILPPPAYLVESMLVVEQGSQDPSAAEATLVKLAALRADYEARVAYWRKSDIPEDAKVALDRLDVSGRAFWREVDQSYAPALRSGDVIAVNMAAAKLDGHYRRHRVGVDELTIKARAMVAAAARESQDASLTVFAGLGVVAVAMLGMILLGVGALRKRIIQPLAGMTAYMGRLAEGDYSQEPPMRERKDEVGEMAAAVSVFRAAAIERRQAVQLEKDREAAAREEAFVAAEAEARGRRSFVVDALDEGLRRLAQGDLSQRIDAAFPEEFERLRRNFNDSIVTLRETIHQVVSSASAVGGGARQITVAADDLARRTEQQAAGLEQTAAALDEVTATIKTTAINARTAYNEVAVSRDLIGASSAVASEAGVAMERIDTSSRKIGQIITVVDEIAFQTNLLALNAGVEAARAGEAGRGFAVVAMEVRALAQRSADAAKEIKTLVEEAGRSVENGVELVGRVGNELTGVVAQFGKIQTLVEGIAQAAHDQATGLGEVNSAVGQMDQVTQQNAAMVEETTAASHSLTNEARQLAQLMDRFKTEGGAATLAA

SEQ ID NO: 20380 - DNA, 1869 bp, Agrobacterium tumefaciens
  CDS (1)..(1869)
atggctttggggaactgtttcatgcacaaccggctctttaagtccgttgctggcaaggtcgtcgcgctgacgatcggcctgatcacgctcagcgtggcggcagttggtttttcgacctacattcgcttgaaggacaacatcatcaccaccgcgctgcgtgatacgcacggcgcgatgcggggcatggccatcctttacgagatgaaggttggcggcgttgccctcgaaatggtggatggtgacctgaagagtgtaggccgtgccagcatcggcacgatgcgcgacaacgatctcgtagaccgcacggctgcgggcaacggcggtatcgccacggttttcgaagccaaggccggcgaattcattcgactgaccaccaatctgaagaatgaaaagggtgagagagcggcaggcaccaagcttgccaccgatcatccggctttcgaaaaagtctccaagggcgaggcctatttcggcactgccacgctgttcggcaccagctacatgaccggttatatgccggtcacgaacaagaccggcgcaaccgtcggcatcctgttcgtgggtgtgcccatggatttctacaatgcgcagatatacagcctgcgtgatatgatggtggtttgcggcgcgcttgccatgcttggcgttggattactcgcctatttcgtcataaagcgcacgcttcaaccgcttagcaagctgacagatgccgtgaaatcgctttcggacggcgatctcgaaacgccgatcccctacgccaccaacaccaatgaattcggcaatatcgcccgcgctctggtgattttccgcgagaatgcgattgagaagctggcgatcgagggcaaaagtgcgcaggaacgctccgcggccgagtccgagcgacaccgcaacgatgccgagaagcaggaactggacggccagatcgagtttgcagtgggcgagatcgcctccggcctcggcaggctttcgcgtggcgatctgagccgcacgatcgagacgccctttgcaggccgcctcgaccggctgcgcacggatttcaacgaatccttgctcaaccttcgcgatgcgctggggcagatccgtgagcgcacgctcatcattcagaatagtggcatcgaaatcgaacagtcttcggtcgatctgtcgaaacgcacggaaaatcaggccgcctcgctggaggagaccgccgctgccgtggaggagatcaccgctaccgtgagatcgtcggccgagcgggcacgggaggcaaatgaggccgtacgcgtcaccaagcagagcgccgacagttccggttcggttgtcagcaatgccgtcgacgccatgagccgtatcgaaggcgcctcgcgcaagatcgagcagatcatcgaggtcatcgacgacatcgccttccagaccaatcttctcgctctcaatgccggcattgaagcggcgcgcgcgggtgaggcgggcaagggttttgccgtcgtggcgcaggaagtgcgcgaacttgcccagcgctctgccgacgcagcccgtgaaatcaagcagctcatcaaccagtcgacccatgaggtcagctccggttcgaagctggtgcaggaggcgggcaccgttctctccgccatcagccggcagatcgtgactgtcagccagcatgtcgaaaccatcgcgacggcgacgcaggaccagtcctcagcccttcacaacgtcaacggctccgttaaccagatggaccagatgacgcagcagaatgcagcgctggccgaacagtcgagcgcggccagccgggtactttccggcgaagtggaggcgctgctcgatctggtacagcggttccagatggagcaggggtctgctgccggttcgggtcgattgaaccgggcggcctga

SEQ ID NO: 20381 - protein, 622 aa, Agrobacterium tumefaciens
MALGNCFMHNRLFKSVAGKVVALTIGLITLSVAAVGFSTYIRLKDNIITTALRDTHGAMRGMAILYEMKVGGVALEMVDGDLKSVGRASIGTMRDNDLVDRTAAGNGGIATVFEAKAGEFIRLTTNLKNEKGERAAGTKLATDHPAFEKVSKGEAYFGTATLFGTSYMTGYMPVTNKTGATVGILFVGVPMDFYNAQIYSLRDMMVVCGALAMLGVGLLAYFVIKRTLQPLSKLTDAVKSLSDGDLETPIPYATNTNEFGNIARALVIFRENAIEKLAIEGKSAQERSAAESERHRNDAEKQELDGQIEFAVGEIASGLGRLSRGDLSRTIETPFAGRLDRLRTDFNESLLNLRDALGQIRERTLIIQNSGIEIEQSSVDLSKRTENQAASLEETAAAVEEITATVRSSAERAREANEAVRVTKQSADSSGSVVSNAVDAMSRIEGASRKIEQIIEVIDDIAFQTNLLALNAGIEAARAGEAGKGFAVVAQEVRELAQRSADAAREIKQLINQSTHEVSSGSKLVQEAGTVLSAISRQIVTVSQHVETIATATQDQSSALHNVNGSVNQMDQMTQQNAALAEQSSAASRVLSGEVEALLDLVQRFQMEQGSAAGSGRLNRAA

SEQ ID NO: 20382 - DNA, 2307 bp, Agrobacterium tumefaciens
  CDS (1)..(2307)
atgccaccgtgcgacaacgtttttttggggggaggaaacaggatgccgggtgtaaatccgactgctgtcaaagctaaatcattgtcaatcaaggccaaattcgcggcgctcgtcacgggcgcgacgctggtctcctgcctgtccgtggggttgttgtcctacgagatgggcaagtcgggccttatcgacgccagcgaaatcaggctcgaaacggttgcaagcaaccaatccaagcagcttgacgcctatactttgcgtgtcgaacaaagcatcaccgaactgtcgcagaatgccgcaatcgcccaggcgctggaaacgatgaccactgtcgtgccgacggaaaaggatgccatcatccaggctttccgccgtgaaggcgtctccgaggaggagcgcgcttccttcaacggcgaagggttgcgactgctttatgccattcgccacgcgaccatcaacgccgccatcgccagcgtctggcgcaatacccgcgtcagcgatatctatgtcatcgacaagaacggcctcattatctattccgtgaccaagggaaagaacttcctgaccaacgtgacggaaccgcagaacgccgcgatcaaggacctgttccagcgcatcgaagccggcaaggatggtgtcgtcagcaccaccggtttcagtggcggcgatagtgattcggccatgatcggcatgccgctcgcggtctcaaactggggccagctgcagcgcaagggcgccgtcatcatgcgcgttgccgccgaccgtatcggcgcagtcgtcacacccgaagaaaccggcaagaccattgatgacgccgttcttctgagcgcggagggcaaacgccgcgccggcgtgctctcgggcggcgcggatgctgccatttccgaaaatctcgcggccctttcgggcgcaagcgaccctggaatggtgctggcacagacgcctgccggcaacatcttctatgcctatcgcccggtcaccgtgtttggccagaagcatcttctggccatcggccagcaggagagcaaggtgctggccgccgccaacgatcttgccttctgggcggccgttgcgacccttgccgttcttgcgatcatgacgctgatcggcatctttgtatccgcaagcctcaccaagccgttgaccggtcttgccggattgatggagcgcctcaacggcggtgacaacaatatcgagatcaaggcggtttcccgcggcgatgagatcggcaccatggcgcgcgcgctggaatccttccgccagggcattctggacaagcagcgcatggaagccgaatcccatcgcaagggcgaggaactggatgaggaacgcgcccagcgtgaaatggaaaaggccagaagcgccaaggaactggaagaggccgtcgatgcactcgcgaccggtcttgccaatctggccgccggcagacttgatcgtcgcatcgaaaaatccttcgtgccgtcgctcgatcatctgcgcgtcgacttcaacaactccatggccgggctggaagcgacgatctccaatatcggcgaaagcgccaatgccatccgctccggctccggcgaactgaagagcgcatcggaagacctgtcgcggcgcaccgaacgtcaggccgcagcccttgaggaagcggctgcagcgctcggagagatgacgcaggccgtcgatctctccctgtcgcgctgcaatgttgctgtcgaggcgacggcaggcacgatgcaggacgcccacaagtctacggctgtggtgaaagaagcgatcgtcgccatggaacgcatcgagacctcttcgtccaagatccgccagatcatcgacgtcatcgaccagatcgccttccagaccaacctgctggccctgaatgccggcgtggaagccgcacgcgccggtgaagccggaaagggctttgccgttgtggcgcaggaagtccgcgaactggcccagaaatcggccgccgccgcgcgtgacatcacgacgctgatcgccacctcggcgggcgatgtggaaagcggtgtcgcgctggtgctgaagactggcgaaagcctggagcagatccagaaacgcatccagtcggtcaacgaccagatcggcgaaatcgccaccgcatcgcgcgaacagtccggccgcctcagcgaaatcaacgcctccgtcaacgaactcgaccatgtcacgcagcagaatgcggcgatggtggaacaaaccacggcttcggccttctcattggcaagtgaggcggatggcctgaccgaacaggtcgggcagttctcagtgggcgagacccggcacgcggaccagcgttacgcggcataa

SEQ ID NO: 20383 - protein, 768 aa, Agrobacterium tumefaciens
MPPCDNVFLGGGNRMPGVNPTAVKAKSLSIKAKFAALVTGATLVSCLSVGLLSYEMGKSGLIDASEIRLETVASNQSKQLDAYTLRVEQSITELSQNAAIAQALETMTTVVPTEKDAIIQAFRREGVSEEERASFNGEGLRLLYAIRHATINAAIASVWRNTRVSDIYVIDKNGLIIYSVTKGKNFLTNVTEPQNAAIKDLFQRIEAGKDGVVSTTGFSGGDSDSAMIGMPLAVSNWGQLQRKGAVIMRVAADRIGAVVTPEETGKTIDDAVLLSAEGKRRAGVLSGGADAAISENLAALSGASDPGMVLAQTPAGNIFYAYRPVTVFGQKHLLAIGQQESKVLAAANDLAFWAAVATLAVLAIMTLIGIFVSASLTKPLTGLAGLMERLNGGDNNIEIKAVSRGDEIGTMARALESFRQGILDKQRMEAESHRKGEELDEERAQREMEKARSAKELEEAVDALATGLANLAAGRLDRRIEKSFVPSLDHLRVDFNNSMAGLEATISNIGESANAIRSGSGELKSASEDLSRRTERQAAALEEAAAALGEMTQAVDLSLSRCNVAVEATAGTMQDAHKSTAVVKEAIVAMERIETSSSKIRQIIDVIDQIAFQTNLLALNAGVEAARAGEAGKGFAVVAQEVRELAQKSAAAARDITTLIATSAGDVESGVALVLKTGESLEQIQKRIQSVNDQIGEIATASREQSGRLSEINASVNELDHVTQQNAAMVEQTTASAFSLASEADGLTEQVGQFSVGETRHADQRYAA

SEQ ID NO: 20384 - DNA, 1506 bp, Caulobacter crescentus
  CDS (1)..(1506)
atggctctgttctctattggccgcgacacgggcgaccaagccaatcgtatttgcgaacttgaaggcattgtcgccgccattcagcgttcccaggctgtgattgagttcaatctcgacgggtcgatcatcacggcaaacgacaacttcctgcgcgctgtcggttacggcttgggcgagatccaggggcgccaccacagcctgttcgtcgatccggccttcgccgccggtgcggagtatcgcgacttctggcaacgcctaaaggccggtgagttcctgacgggaaaatacaagcgcgtcggtaagggcggccgtgagatctggatccaggccacgtacaatcccgtgttcgaccggcacggcaagctggccaaggtcatcaagttcgcggctgacgtcaccgccgccgagaccgagcggcttgaaagcgaacgcgagcgggacgccatgcggcaggagcaggacgagatcgtctcagccctcgccaacagcctccagagactggcccaaggcgacctcaccgtccggatcgacgcgcatttcgacgcgcgccacgaccggctaaaagcggacttcaacgcggccgtcgacagcctcaaggacgccatgggcgcgatcgccgaggccgccggcggcatggagagcggcgcggtcgagatcgccagcgcctccaacgacctctccaagcggaccgaacaacaggccgccagcctggaagagaccgccgcggcgctcgacgagatcactgcgaccgtcaagcgcagcgccgatggcgccaagcaggcttcggccgccgcttcctcggccagccgcgaggccgaccgctccggcgaggtcgtccgtgaggcggtctccgccatgggcgagatcgagaagtcctcgggccagatcacccagatcatcggggtcatcgacgagatcgccttccagaccaaccttctggccctgaacgccggcgtcgaggccgcccgcgccggtgacgccggccggggcttcgcggtcgtcgctcaggaggtccgcgctctggcccaacgctccgccgaagcggccaaggagatcaagcaactgatcgccagcagcaccgcccaggtcgagcgcggggttcgcctcgtcggcgacacgggccaggcgctgaccgccatcgtggccaaggtcggcgagatcgacaccctcatccgcgagatcgccgagtccgcccaggagcaggcgacgggcctgaacgaggtcaactccgccgtcaaccagatggaccaggtcacccagcagaacgccgcgatggtcgaacaggccacgacgtcggcggcccagctgcgcggcgaggcccaggatctggcgcggcaggtctcgcggttccagacgggcgcgagctatgtcgcccaacgcccgcaagccgcagcgccgcgccccgagcccaccatggccgcgccgcgcgcccgaatccaggcttccgcgcgccccggctccgccgccgttgcggtcgcgccgtccagcgattgggaagaattctga

SEQ ID NO: 20385 - protein, 501 aa, Caulobacter crescentus
MALFSIGRDTGDQANRICELEGIVAAIQRSQAVIEFNLDGSIITANDNFLRAVGYGLGEIQGRHHSLFVDPAFAAGAEYRDFWQRLKAGEFLTGKYKRVGKGGREIWIQATYNPVFDRHGKLAKVIKFAADVTAAETERLESERERDAMRQEQDEIVSALANSLQRLAQGDLTVRIDAHFDARHDRLKADFNAAVDSLKDAMGAIAEAAGGMESGAVEIASASNDLSKRTEQQAASLEETAAALDEITATVKRSADGAKQASAAASSASREADRSGEVVREAVSAMGEIEKSSGQITQIIGVIDEIAFQTNLLALNAGVEAARAGDAGRGFAVVAQEVRALAQRSAEAAKEIKQLIASSTAQVERGVRLVGDTGQALTAIVAKVGEIDTLIREIAESAQEQATGLNEVNSAVNQMDQVTQQNAAMVEQATTSAAQLRGEAQDLARQVSRFQTGASYVAQRPQAAAPRPEPTMAAPRARIQASARPGSAAVAVAPSSDWEEF

SEQ ID NO: 20386 - DNA, 2352 bp, Agrobacterium tumefaciens
  CDS (1)..(2352)
atgacaatttccattggggccaagatgttcaatttcaaagtgaagtcgcttgcgacgaagctcatcctcgtgaccggctgcgccatcaccacggttcttatcgcatcgaattccttcctcatttcccagaccagtgaacgtgtccatgccctgaccatggatcaggccaataccgaggcgcgcgccatcgccaacgtcattgccgccgatgtcggcgaactcggcagcgcggcgcgctcaatggccggtgtcatcggccgtgcgcatcaggctaagtcgatggaccggcctggtatcgtcaatatcctcaaagcgaatgtcgagcagaatacgttcgccttcggcagctggttctgcgagcagctcggcctttttgacggccagtcgacggagatcgctaaccggctcgatctcggcaccaataaaagcggtgcttttgccccttattggtcaaagacccagaagggcgatatccagttttcgaccttcgacaacgactatgcggccgaatggtacgcgctagcctccaaatccggcaagggagccatcacccagccttacctcgcccagggcacggaagtgcccaccaccatgacctcgctcgcctatcccgtcatgtcggatggcaagatgatcggcgtggcaggtgtcgatatttcgctcgcctcgctcacccagaaactgcaggctctgcatccttttgaaaccggccgcgtgacgctcgtttcccagggtgggcagtggctggtgccgccgacccccgagcagaatatgaaggcttacgacggagaaggcgcaagcaccgttcaggctgccatcacctccggcaaacagggcctcatcgaaaatctcggcctcgacaccgacgcgccctataaccgtctcgtttatcccttcgccgttccaggcctcaacgcgacgtgggtcgttctggtggatatcccccatcaggcgttgaatgctccggtacaggagcagacctttatgatgatcatcggtgcgatcgtcattctcgccgccgttattgccgcgctttattttgcggttcgctatttcgttcgcaacccgctcgcgtcccttgttgccgatgtcaggacgctcagtgagggtcgctacgatgtgccggtgtccggtcaggaacgtcaggacgaaactggagccgtggcgtctgctctcgaaggtttccgcgcaaagcttgccggcatccgcgagatggaagctgaagccgccgcccagcgtggccatgcggagacggaacgccagcgatcggagttcgagcgtagcgagaatagccgcatgcagcagcacattgtcggcgtgcttggtgccggcctcaatgcgctttcgcaaggcaatctgacctaccgtatcgaggatgaattcccaggcgaatatgcaaagctgcgcgctgatttcaactcggcgctcgaaagcctcgaggaaacggtgtcaaccgtcaacgccaccgtcgtcagtatcggcaatggtaccggcgagatcacccgcgccgccagcgatctctcgcatcgcacggaacagcaggctgcaagtctggaggaaaccgccgcggccctcaacgagttgaccgcacaggtcaattccagcgcggaaaacgccgcagaggcggccggtgccgtcagccatgcctgcgatgacgccggcaagtcaggcgaggtcgtgcagcaggccgtgaactccatgcagggcatcgcgcaatcctcggcggaaatctcccgtatcatcggggtgatcgacgagatcgccttccagaccaatctgctggcgctgaatgccggtgttgaagcggctcgcgcaggcgatgcgggcaagggctttgcggtcgtcgcgcaggaagtgcgtgaactcgcgcaacgctccgccactgccgccaaggaaatcaagggcctgataaacacgtcggccacgcaggtgggcgagggtgtccagctggtcggcaaggccggcgagacaatgaaaaagatcgccgatcaggttctgcagatcaaccagctgatacggcagatctccgcctcggccagcgagcaggcggtaggactgaaggaaatcaactccgccgtgacccagatggatcaggtcacccagcagaatgcggcgatggtggaggaaaccactgcagctagcgtgacgctgaacagcgaagccgaaaccctgaaatcgctcgttgccggtttcgcggtgtccggcggccatgcgagccagcaattgcgcgccacggcagcgacaatgcgtgcaccggccgctccggcaagggcgcaggccgcggctcctcgtgcccgtccgagaaccagcggcgcaaacgcgctggcgcaggatgactggacggaattctga

SEQ ID NO: 20387 - protein, 783 aa, Agrobacterium tumefaciens
MTISIGAKMFNFKVKSLATKLILVTGCAITTVLIASNSFLISQTSERVHALTMDQANTEARAIANVIAADVGELGSAARSMAGVIGRAHQAKSMDRPGIVNILKANVEQNTFAFGSWFCEQLGLFDGQSTEIANRLDLGTNKSGAFAPYWSKTQKGDIQFSTFDNDYAAEWYALASKSGKGAITQPYLAQGTEVPTTMTSLAYPVMSDGKMIGVAGVDISLASLTQKLQALHPFETGRVTLVSQGGQWLVPPTPEQNMKAYDGEGASTVQAAITSGKQGLIENLGLDTDAPYNRLVYPFAVPGLNATWVVLVDIPHQALNAPVQEQTFMMIIGAIVILAAVIAALYFAVRYFVRNPLASLVADVRTLSEGRYDVPVSGQERQDETGAVASALEGFRAKLAGIREMEAEAAAQRGHAETERQRSEFERSENSRMQQHIVGVLGAGLNALSQGNLTYRIEDEFPGEYAKLRADFNSALESLEETVSTVNATVVSIGNGTGEITRAASDLSHRTEQQAASLEETAAALNELTAQVNSSAENAAEAAGAVSHACDDAGKSGEVVQQAVNSMQGIAQSSAEISRIIGVIDEIAFQTNLLALNAGVEAARAGDAGKGFAVVAQEVRELAQRSATAAKEIKGLINTSATQVGEGVQLVGKAGETMKKIADQVLQINQLIRQISASASEQAVGLKEINSAVTQMDQVTQQNAAMVEETTAASVTLNSEAETLKSLVAGFAVSGGHASQQLRATAATMRAPAAPARAQAAAPRARPRTSGANALAQDDWTEF

SEQ ID NO: 20388 - DNA, 2154 bp, Agrobacterium tumefaciens
  CDS (1)..(2154)
atgtttcccccatcaatgttaaagatgacctcgacggtacatccggcttcaaggatccgtagcttgccaaagaaaaccaatcttatgacgcgcattctggttgcagcgtcatctcttgtcgttgcagcctttgcaggcttttcctattacatcgacagcctccagcatcgggttactaccgaagcagtcgcggaaaacattgattcttccggcaagcaggctgcgcaaagcatcgccaactggctgaacggtcgcatcatgctgacacaaacggtggcggcaaccctggccaagcttccggatgacgaggcaaagctgcgttttctggaaaatgacgtgctgacggcacagttcatgtcgacctatttcggcaatgccgagacaggcaccttcaccaccttcccgaagacaccgctgccggaaggttacgatccgcgcaagcgtccgtggtatctggatgcggtgaaagccggcaagacggttctgacggaaccctataatgacgcctcgaccggaggccttatcatcaccgccgctattcccgtttccatcgatggcaagcttgccggtgtgacaggcagcgatttctcgctggattcgctggtgaagatgatcaagtcggtggatgccggcacggatggctacgcgttcctcgtcagcaaggacggcaaaatcctcattcatccggatccaaaattcgtcgacaagccgctggccgatctcttcaaggtcgatacgccggcgatttcctccgcgatttcccagaccgaaatcgacggcaagggcaagatcaccagcttcatcccggttgcgggcctgccttcggtcgactggtatctcggtttcgtcgtggattccgacgtcgcctacagcgcgatcggccagttccgcctggcggcgaccatcgcaacggttctcgccgccgcgatcatgattggcctgctggcgaccgtgctgtcccgcttcatcgtccgccctgtcacgcagatgacctctgccatggaaggtcttgccgccggtaatctcgatgtcggcattcccggccaggaacgcaccgaccagatcggctccatggctgcagccgtcgccgtgttccgctcgaacgcaatggagcgcctacgccttgagggcgatgccgaacagaaccgcacgctttccgaacaggagcgcaacgagcgcgaaagaaccgcagcaaaagacgcggcggatatccagttcgcggtcgactcgcttgccaagggtctggcgcatctttccgatggcgatctcaactatcgcatcgacacgcctttcgtgacccgcatcgatcgccttcgtaacgatttcaacaattccgttgcgaagctgaatgcggcgctcagcacggtcggccagaatgcgctcgccatcgacgccggagccggcgaaatccgccagtccgccgacgatctggcacgccgcaccgagcagcaggcggcctccgtcgaggaaaccgccgcagcactcgaagagatcaccacgacggtgaaggattccgcccgccgtgccgaagaagtcggccgtctggtcgatcgcgcccgcggcaatgccgaacagtccggcgtcattgtggaagatgccgtgcgtgccatggaaggcatcgaaaaatcctcgtcggagatcagcaacatcatcggcgtaatcgacgagatcgccttccagaccaacctcctggcgctgaatgccggtgtcgaagccgcccgcgccggtgaggccggcaagggttttgccgtcgtcgcacaggaagtgcgcgaactcgcccagcgctccgccaatgccgccaaagcgatcaagacattgatcaacgcctcgacatcgcaggtgcagtccggcgtcgaactcgtcggcaatgccggcaaggcgctggaaaccatcgttcgcgaagtgcaggagatcaaccgccacatcgatgccatcgtgacatcgtcgcgcgaacagtcgaccggacttcaggaaatcaacaccgccatcaacaccatcgatcagggcacgcagcagaatgccgccatggtcgaggaacagacggcggcaagccacggccttgcctcggaagcggcggcgctcaacgagttgcttgcacagttccagctcgccgccgccacgcggcggcaggcggaatatggtcgggctgcttaa

SEQ ID NO: 20389 - protein, 717 aa, Agrobacterium tumefaciens
MFPPSMLKMTSTVHPASRIRSLPKKTNLMTRILVAASSLVVAAFAGFSYYIDSLQHRVTTEAVAENIDSSGKQAAQSIANWLNGRIMLTQTVAATLAKLPDDEAKLRFLENDVLTAQFMSTYFGNAETGTFTTFPKTPLPEGYDPRKRPWYLDAVKAGKTVLTEPYNDASTGGLIITAAIPVSIDGKLAGVTGSDFSLDSLVKMIKSVDAGTDGYAFLVSKDGKILIHPDPKFVDKPLADLFKVDTPAISSAISQTEIDGKGKITSFIPVAGLPSVDWYLGFVVDSDVAYSAIGQFRLAATIATVLAAAIMIGLLATVLSRFIVRPVTQMTSAMEGLAAGNLDVGIPGQERTDQIGSMAAAVAVFRSNAMERLRLEGDAEQNRTLSEQERNERERTAAKDAADIQFAVDSLAKGLAHLSDGDLNYRIDTPFVTRIDRLRNDFNNSVAKLNAALSTVGQNALAIDAGAGEIRQSADDLARRTEQQAASVEETAAALEEITTTVKDSARRAEEVGRLVDRARGNAEQSGVIVEDAVRAMEGIEKSSSEISNIIGVIDEIAFQTNLLALNAGVEAARAGEAGKGFAVVAQEVRELAQRSANAAKAIKTLINASTSQVQSGVELVGNAGKALETIVREVQEINRHIDAIVTSSREQSTGLQEINTAINTIDQGTQQNAAMVEEQTAASHGLASEAAALNELLAQFQLAAATRRQAEYGRAA

SEQ ID NO: 20390 - DNA, 2004 bp, Caulobacter crescentus
  CDS (1)..(2004)
atgaagctcgacgacctgaaaatttcgaccaaggtcgccctgccggcggtcgcgctgaccatcgtcagcctggcgctggtaggcgtttcgttcgtcgagtcgcggaaggccgaagctatccgctcgatgctcatcaatgagcgcgcgcccgccgaactcgaggcgtccgagttcaaccgtcgcgttgtgaccatcggctatgcggcctatcgcgtcgttgcgagccaggggacctccaaggaagccaatgaagccagcgctgaactggacgccgcttacaagaccgccaaggacaagctgcgcggcatcaacaccgtggatccgaccgccgaaaaggtcaccaaggactttggcgcgcgcctggacaagatctacaccagcgcgcggcagggggctgatcttggcctgcaggacgtggacgaagccggcatgatggtcatggcggtgctcgatcccgaaatcgtcagcctcaagaccgacgtcgagaagtacaccaccggccacgccgcagagaccgaggccctggtaaccaggctcgatcgcgaggtcagccagggacgcatcatcagcctcgtcttcggccttctagcgatcgccagcgccctggccttcgcactgtggatcggctcacggaagatcgccgcgccgctgatcgccaccgccaagaccatggacttcctggcccagggctcagtcgacgtcgacgtgcgcggcgccgagcgcaaggacgaggtcggtgccatggcccgctcggtccaggtgttcaaggacaacgccgtggccctgcgcaccgccgaggccgcgcagcagcgcgccaatgccgaggtcgaggccgagcgtcgtcgcaatcaggaactggccgaggccgccgccaaggaacaggccttggtcatggaggccatcgccggtggtctcgcccgcctgtcagacggcgacctgacctatcgcctggatcagcagttccccgaggcttacaagcgcctgcagagcgacttcaacggcgccatcgcccagctggaagaggccatgggcaccatcgtccacgccgccagcagcatcggcgccggctcggatgaaatcgcctcggccgccgacgacctgtcgcgccgcagcgagcagcaggccgccagcctggaagaaaccgccgccgctctggatgagatcaccgccacggtgcggcgttcgtcggccggggcccaggaagcctccaaggtggtcggctcgacccgttccgacgccgaacgctccagcgtcgtggtgcgcaacgccgtcgacgccatgaaccagatcgagaagtcctcgcagtcgatcagccagatcatcggcgtcatcgacgagatcgccttccagaccaaccttttggcgctgaacgccggcgttgaagccgcccgcgcgggcgaagctggccgcggctttgcggtcgtcgcccaggaagtgcgggccctcgcccaacgttcggccgatgcggccaaggagatcaagaccctgatctcgacctcgtcgcagcaggtcaatcaaggcgtcgcgatggtcggccagaccggcgaggctctacaaaccatcgtggcgaaggtgggcgagatcgacgccctggtcagcgagatcgccgcctcgggccaagagcaggccaccggcctcaacgaggtcaacgccgccgtcaaccagatggaccagaccgtccagcagaacgccgccatggtcgagcagtcgaccgccgcctcccacgcgctcaagagcgaggccggcaatctgatgcagatgatctcgcggttccgggtccagggctcggcgtctgctgcggccaccggcggctccaagcgcgccagccgctccgccgccccgccgccggcggcgcaccgcccctcggcgcccgtccatgtttcgcccggcccgacgctcgccagcgcggcgagccgtccgggcgccaatccggtcgccgccgctcaggccaagctggccaaggccgtcggcgcgtcgtccagcgacgactgggaagagttctaa

SEQ ID NO: 20391 - protein, 667 aa, Caulobacter crescentus
MKLDDLKISTKVALPAVALTIVSLALVGVSFVESRKAEAIRSMLINERAPAELEASEFNRRVVTIGYAAYRVVASQGTSKEANEASAELDAAYKTAKDKLRGINTVDPTAEKVTKDFGARLDKIYTSARQGADLGLQDVDEAGMMVMAVLDPEIVSLKTDVEKYTTGHAAETEALVTRLDREVSQGRIISLVFGLLAIASALAFALWIGSRKIAAPLIATAKTMDFLAQGSVDVDVRGAERKDEVGAMARSVQVFKDNAVALRTAEAAQQRANAEVEAERRRNQELAEAAAKEQALVMEAIAGGLARLSDGDLTYRLDQQFPEAYKRLQSDFNGAIAQLEEAMGTIVHAASSIGAGSDEIASAADDLSRRSEQQAASLEETAAALDEITATVRRSSAGAQEASKVVGSTRSDAERSSVVVRNAVDAMNQIEKSSQSISQIIGVIDEIAFQTNLLALNAGVEAARAGEAGRGFAVVAQEVRALAQRSADAAKEIKTLISTSSQQVNQGVAMVGQTGEALQTIVAKVGEIDALVSEIAASGQEQATGLNEVNAAVNQMDQTVQQNAAMVEQSTAASHALKSEAGNLMQMISRFRVQGSASAAATGGSKRASRSAAPPPAAHRPSAPVHVSPGPTLASAASRPGANPVAAAQAKLAKAVGASSSDDWEEF

SEQ ID NO: 20392 - DNA, 1668 bp, Clostridium acetobutylicum
  CDS (1)..(1668)
atgagatggtatgatgatatgaagattagttccaaaattttagttggttttgttgttataatatttatttctgcagtttcaggtgtttttggaattttgaatttaaataaggttaataattcaaacacggagacctacgagaaaatgttagtacctacaggagaattggtttcaatatcaaatgattttggaactatgcgtgcaagagttagagatgttgtaatagaaactcaaatggataaaatggataagttttcaagtgattttaatgcagcaagtagcgattttgataaagtattggaatcattttcgcaaactattttaactgcagatggaaagactattttaagtgaaataaaggatgctaagaaagaatatgtacaatatgctcagcaggcaatggaattaagcaaacaaaataaaaatgtagaagctatggctatagttagaaatcagcttacagtagcacatgataaacttgcaacttctataaaaaatgttacagatatgaaaaaagaattagctaaagagtccacagatcaaaattctgcaacagccaagacatcaattattgaaacaatcattcttgtgattttaggggctggacttggtgtagctatggctgttttaacatctcgttcaataggaaatcctatgaaaaagataactgaggtatctgaaaaaatagcagatggtgaattagatgttgagcttaaaactgacagaaaagatgaaattggggttcttatgaatacctttaataaaatggtttctaaccttaacctagttatgtccagcatgaatacggctgcagatcaggtcgctattggttctaagcaagtatctgattcaagtataatgctttctcaaggttcttcagatcaagctagtgctgtagaagaattgacttcatcaatggaagaaatagcttcacaaacaaaggtaaatgctaataatgcaactgaagctagtgaacttggtaatgaagttaaaagtaatgctgaaaaaggcaataatcaaatgaagcaaatgttaaatagcatggatgatataaatgctgcatcaaagaatatatcaaaaataataaaagttatagatgacattgctttccagacaaatattctttcattaaacgcagcagttgaggcagcaagagctggccaatatggaaagggctttgcagttgttgcagaagaggttagaaatttagcagctaaatcagctaatgcagcaagagaaacaacagaaatgatagaaaactccattagaaaagtagaaactggaactgagtttgctaaagaaacagcagctgcacttgatgaaatagttcaaggaatatctaaatcagcacaattactggataacatagcaagttcatctaatgagcaagcaatcgcaattgatcaaataaataagggaatagtacaagtatctagcgttgttcaagataattcagcaacttcagaggaaacagcagcagctagtgaagaacttgcaagccaagctagtcttcttaagaatgaaatttcaaagtttaagctaaaaggaaaaggtggatttaattatggcgaaaactatggaatggagcatgcagcaactaaaggtggctcaaaaacatatgaaatgtctaatatggatatgtacggaagcgactttggaaaatattaa

SEQ ID NO: 20393 - protein, 555 aa, Clostridium acetobutylicum
MRWYDDMKISSKILVGFVVIIFISAVSGVFGILNLNKVNNSNTETYEKMLVPTGELVSISNDFGTMRARVRDVVIETQMDKMDKFSSDFNAASSDFDKVLESFSQTILTADGKTILSEIKDAKKEYVQYAQQAMELSKQNKNVEAMAIVRNQLTVAHDKLATSIKNVTDMKKELAKESTDQNSATAKTSIIETIILVILGAGLGVAMAVLTSRSIGNPMKKITEVSEKIADGELDVELKTDRKDEIGVLMNTFNKMVSNLNLVMSSMNTAADQVAIGSKQVSDSSIMLSQGSSDQASAVEELTSSMEEIASQTKVNANNATEASELGNEVKSNAEKGNNQMKQMLNSMDDINAASKNISKIIKVIDDIAFQTNILSLNAAVEAARAGQYGKGFAVVAEEVRNLAAKSANAARETTEMIENSIRKVETGTEFAKETAAALDEIVQGISKSAQLLDNIASSSNEQAIAIDQINKGIVQVSSVVQDNSATSEETAAASEELASQASLLKNEISKFKLKGKGGFNYGENYGMEHAATKGGSKTYEMSNMDMYGSDFGKY

SEQ ID NO: 20394 - DNA, 2358 bp, Agrobacterium tumefaciens
  CDS (1)..(2358)
atgtctttcagcattcgtaatatacttgttggttttttcctcaccatcagccttgcacttgccggtttcgtcggcacgcaatcgtggcgctcggtcaatcgcgccagcgccttttccgaggtcgcgcagctcgtctcgctggacaagcttcttttcaacgcactcctgaatttccgcagtgaacgtggcgacagcgccacggcgctgacgctcgatccatcgaagtcggctggcagcatcgccagtgttgcggcggcacgccagaaggtggatgccgccatgacggcattcctcacacagtcttcgtcgcttgaagatgccaggctgcaagggccgctcaaacgcgtaaaggatgtctacgcacagttcgttgaactgcgaaagaaggtcgacgccaatgtctcgcagccgctcgaccggcgcgagggcggtctcgacaagaccgtcatgacgctcggtggcgatttcctcgcctcgctggaagcgggttcgacggcgctggagggggctgtccgctctctcgatcagggccagaccggtctcatccagctgcgctcttacggctggtccgcccgtgcgcttggcggcagcgccaccgttgtcctcaacgccgccgtggcgcagaaccggccgctcaccgcccaggaaatgcagcagctcggtgccttcgatgccggcgcggcatttgcgtggaaggcgacgggtgatctcgtcgcgcatgaatcaacgccgcaatcgctcaaggacatctacgccactgcggacaagacctatttcaagggcgatttcaacactcagcgcaccaagctcatcgaagacctcaacaatggccgcacgccgacctttaccttggacagctggcgcaccaccgttacggaaaatctcggcacgattgccaagatcgcctctgccgccatggatgtcctcgatgccaatgccgaaaaggcaaaacaggacgcctttatcggttcggtggtctatctggcggtcttcatagccacactggcgctctgcattgtctcgctcgccgtcatcgtcggccgcgtcacccggccgatcagccgcctgaccaatgcgatgatggcgctttcgggcggcaatcttgcaatcgatatcgccggcgcaaagcgcggcgacgagatcggcgagatggcccgtgccgtggaagtcttccgcgaggcggccatccgcaaccggcagctggaggcggacgccgtcgccaaccgggagcaggccgaacgcgaccgcatcgagctgcagcagcgcgctgaggccgaggccgaagaacggctcaaccaggccacgggttcgctggcgggcggtcttcgccgtctcgcctccggtgacatggtctgcgagatcgccacgccgttcgcaccgcaattcgaagcgctgcggcacgatttcaacagctccgtgcatcagctgcgtgaggcgctgacgagtgtcggccagtccgtgcagacggtgaatggcggcgcccacgaggtttcctcggcctccgacgatctttcccgccgcaccgaacagcaggccgcttcgcttgaagagactgcggcggcactggaagagatcaccgccaatgtctccgccacctccaagcgggctggcgaggcccgggacacggtgcgggaagcaaggaccaaggccgatctttccggcaaggtggtgcgcgatgctgtcgccgccatggaacgcatcgaacattcctcgcgccagatcggccagatcatcggcgtcatcgacgaaatcgccttccagaccaaccttctggcgctgaatgcgggcgtcgaggcggcaagggcgggcgatgccggcaagggctttgccgtcgttgcgcaggaagttcgcgaactggcgcagcgttccgccaatgcggcgaaggaaatcaagcagctcatcaacacctcagccgttgcggtaggtgagggcgtgaagctggttgccgataccggcgtcgggctttccgaaatcgagcagctggtgctgtccgtcaacagccatatggacgccatcgccacggcggcgcaggaacagtctgccggtctctccgaggtcaataccgccgtcaaccacatggatcaggccacgcagcagaacgccgccatggtcgaggaaatgaatgcggccggtgccggtctcgcgcaggaatgcgccaatctccaggccctgcttgcgcagttccagctcggccagcaggcctcggcattgcgggagacggcacggcatatgcaacgcgtcgcaaacccttcgcgcgctccggccgcacccgtcgcagcaccgccacgggcccgtcccgttgccacgcgcggcaacgcggcgctagccgtgaagggtgatgactggacggagttctga

SEQ ID NO: 20395 - protein, 785 aa, Agrobacterium tumefaciens
MSFSIRNILVGFFLTISLALAGFVGTQSWRSVNRASAFSEVAQLVSLDKLLFNALLNFRSERGDSATALTLDPSKSAGSIASVAAARQKVDAAMTAFLTQSSSLEDARLQGPLKRVKDVYAQFVELRKKVDANVSQPLDRREGGLDKTVMTLGGDFLASLEAGSTALEGAVRSLDQGQTGLIQLRSYGWSARALGGSATVVLNAAVAQNRPLTAQEMQQLGAFDAGAAFAWKATGDLVAHESTPQSLKDIYATADKTYFKGDFNTQRTKLIEDLNNGRTPTFTLDSWRTTVTENLGTIAKIASAAMDVLDANAEKAKQDAFIGSVVYLAVFIATLALCIVSLAVIVGRVTRPISRLTNAMMALSGGNLAIDIAGAKRGDEIGEMARAVEVFREAAIRNRQLEADAVANREQAERDRIELQQRAEAEAEERLNQATGSLAGGLRRLASGDMVCEIATPFAPQFEALRHDFNSSVHQLREALTSVGQSVQTVNGGAHEVSSASDDLSRRTEQQAASLEETAAALEEITANVSATSKRAGEARDTVREARTKADLSGKVVRDAVAAMERIEHSSRQIGQIIGVIDEIAFQTNLLALNAGVEAARAGDAGKGFAVVAQEVRELAQRSANAAKEIKQLINTSAVAVGEGVKLVADTGVGLSEIEQLVLSVNSHMDAIATAAQEQSAGLSEVNTAVNHMDQATQQNAAMVEEMNAAGAGLAQECANLQALLAQFQLGQQASALRETARHMQRVANPSRAPAAPVAAPPRARPVATRGNAALAVKGDDWTEF

SEQ ID NO: 20396 - DNA, 2367 bp, Agrobacterium tumefaciens
  CDS (1)..(2367)
atggcgccattcatgcatggcgtgggaactgatccggcattgagggctgcatcggccatgctaaaccgttttcattccatatccaccaaggtcctcgtcattttcctggcgttgatggcgatctcgaccggggctctgacgcttctcggctatcagagcagcagcggcgttctcgaggagcaggcgtcgaaatccatggagagcattctcgttttccgcggtgacatgcttcaggagcgcctggagcagctgaagacgcaggcggattccattgccaagatcgaatccctgcagatggctgtcgtctccatgcgcagcggctgggccacggtgcagaagaactccggtgacgcgaaggcggaattgcagcgcgtcttcatcaaggaaaaccccttcggcgacagggaaaagctgatcaagccggaaagccccagtggcttttattattccacccatgaaaagactcagacggatatcgccggttatctcaagggaacgccgttcaacgacgtgctcttcatcgatcccgccggtgcggtctattattcctatctcaaaggaccggctttcggagaaaccgtaacctctggcgtctggacggaaagcggccttggcgcagccttcgcgcgcggcgcggcgaatgccgaaaaagcggtcaacgatgtcgcgcagaccagcttctccgggctgcggatcgatgctgcgacaaaggaggccgggatttatttcggcgttccggtcgtgaagtttggcgcgttcaagggcatcgttctcttccgcgtcaaggtggacgttttcggccagattctgacgaaaggcattgcggccggcagctcggagcaatcagccatcatcgcggctgatggcaaggttctcggcgtggacggcgaaaagctcgtcagcctcgacccggccatttacggtttccatggcgaagccctgaacgcgacgggcatgaccattgccaagatcaaccgcgcggatggcgaagccaatgcctatgcccgccccttttccttcgccggtgagaaatatctcgcggtggaaagcatgctgcgcagcgagttgaacgcaggctccatctcgatcgccggcacgctggccgtgatcggcctctgtgttcttgctgccatgtgtgcagcgacagcattttttgcacggcgcctgttcgccccgctggagaagctggctgggctgaccggcgaagtcgccgccggccgtctcgatgccgaaatcggcaatcaggaccggaacgacgagatcggcaggatggcgcgtgcgctcggcagtttccgtgaaaaactcatcctgcagcgggacatggaagagaccgcttcgcgcacgcgggaggaggccgagatggcccggcgcgcgcatcttgccgagcgcgaggccgaggccggcaccctgcagatggtcgtgcagtctctggatgaggggcttgaccggctggcgaacggcaacctcgcctatcgcatagagaccattttccccgaggatctggaaagcctgcgccagaacttcaatacggcacttgcccggctcagcgagaccatggaggcgattggcggcaactccgccgccgttcgtggcggctccgaggaaatgcgggtgggggccgaccaactggcggaacgcaccgagcggcaggcggcttccatcaccgaaacggcaagcgccatcaaggcgattaccgaggccgtgcgcgaccagatcgaacgcgccgaacaggcaacccggatcgcgcgcgacgccagcacggaggcaacggcctccagccgcgtgatggagcagaccatcgctgccatggaggcgatccagacctcatcgcgccagatcaaccagatcatcggcgtcatcgatgaaatcgccttccagaccaacctgctcgctttgaacgcaggtgtagaggccgcccgcgcgggcgacgcaggcaggggttttgccgtcgtggcgcaggaagtgcgcgaactggcgcaacgttcggccgctgccgcgaaagaaatcagcagccttttgaaacgctccaccgacgaggtttccgccggcgtggtcctggtggaaaaagccggcgcttctttgaccggcatcggcaaacatgtgcagaccatcagcacgcgcatcgaggagatcatggaatccacccgcgaggaagcgcatacgctctcggaaatcaacagcaccgtcaccagcctcgataccatgacccagcagaatgccgccatggtggaagagacgacggcggccatccacaatctcgcttccgaagccggtgaaatggacggcaggctcggagagttcgtgctggcttcagaaaacgaaacagtgcggtatcacgaaaagacacaattccggcgggcgggctga

SEQ ID NO: 20397 - protein, 788 aa, Agrobacterium tumefaciens
MAPFMHGVGTDPALRAASAMLNRFHSISTKVLVIFLALMAISTGALTLLGYQSSSGVLEEQASKSMESILVFRGDMLQERLEQLKTQADSIAKIESLQMAVVSMRSGWATVQKNSGDAKAELQRVFIKENPFGDREKLIKPESPSGFYYSTHEKTQTDIAGYLKGTPFNDVLFIDPAGAVYYSYLKGPAFGETVTSGVWTESGLGAAFARGAANAEKAVNDVAQTSFSGLRIDAATKEAGIYFGVPVVKFGAFKGIVLFRVKVDVFGQILTKGIAAGSSEQSAIIAADGKVLGVDGEKLVSLDPAIYGFHGEALNATGMTIAKINRADGEANAYARPFSFAGEKYLAVESMLRSELNAGSISIAGTLAVIGLCVLAAMCAATAFFARRLFAPLEKLAGLTGEVAAGRLDAEIGNQDRNDEIGRMARALGSFREKLILQRDMEETASRTREEAEMARRAHLAEREAEAGTLQMVVQSLDEGLDRLANGNLAYRIETIFPEDLESLRQNFNTALARLSETMEAIGGNSAAVRGGSEEMRVGADQLAERTERQAASITETASAIKAITEAVRDQIERAEQATRIARDASTEATASSRVMEQTIAAMEAIQTSSRQINQIIGVIDEIAFQTNLLALNAGVEAARAGDAGRGFAVVAQEVRELAQRSAAAAKEISSLLKRSTDEVSAGVVLVEKAGASLTGIGKHVQTISTRIEEIMESTREEAHTLSEINSTVTSLDTMTQQNAAMVEETTAAIHNLASEAGEMDGRLGEFVLASENETVRYHEKTQFRRAG

SEQ ID NO: 20398 - DNA, 1980 bp, Vibrio cholerae
  CDS (1)..(1980)
atgggtttattggcacgtcttttctctacagcaccacatcatccgacgcaaccagcggaggttaagccagacccgctgatgcaatctccggtaaccaccgagacgacggcattacagccagaaccacaggttgcgccttatcaaactgaccttgcgctcaccacgccagagtcagacctcacaccccaagtcaatcaagcttttgttcaggtgattcgtgaacatctggcactgttggaatgtgagcccaacggcacgatttgctatgccagtgatgcgtttgctcatctctgtcgggtatcggctgaagcgatggtcggagcggattttgcgaacttatggcgcactcatcagcagccatctgtgcagcgcttgctgcaggatgctaaaaaaggacaccctgtttctgccgaattacagctcagccgctcgcaagaggcaatctggataaaagcggatctgtatcccatcaaggcgataaacggtcaattacaaaacgtggtggtactgttgcaagatatcactgcggccaagctggaaaaaattgaccgtagtggtcaaatgaatgcggtcaatctcacccaagccgtgattgaatttacgctcgatggcaccattctgactgcaaatcagaattttctgcaaacggtgggctatcagttggatgagatccaagggcggcaccacagcatgtttgttgatgagcagtataaacagagtcaagagtaccaacatttctggcagcgtttgcgctccggcgaattctttgtcgacgaatacaaacgtttcggcaaaggggggaaagagatctggatccaagccagctataacccgattatggacagcgagggtaaaccgtataaggttgtcaaatatgccaccaacgtgactcagcgtaagatggtggtcaatgaagtcaaacgcgtcatgacggcgctctccagcggcgatctcagtgcacaactcacgcatccttttgaaggtgaatttgctgagctcggtgaggtgatcagtcaattcattgtcacattgcgtcaaatcattactgacatcaacagcgtcgccgcgaccatcaagctagcagcgacggagatttccaatggcaataccgacctctctagccgaaccgagcaacaagcctccaatctggagcaaacggcctccagcatggaagagctaaacagcacggtgcgacaaaactcggataacgccatgcaggcgaacatccttgcgggtaaagccacggaaatcgccgccagcggtggagaactgattgagcaagtggtagtgactatggcctcgattaacgaatccgcgcaaaagatcgccgatattataggtgtgatcgatggtattgctttccaaaccaatattctggcactcaatgctgcggtagaggccgctagagccggtgaacaaggccgcggattttccgtagtcgcctccgaagtacgctcactcgcacagcgctcagccaatgcagcgaaagatattaaggcgctcatctcagattccgtgagtaaaatcagcaatgggaatgaattggtggatcgctccggcagcaccatgaaagacatagtcgtgtcgatcaagcgagtccatgatttgatggccgatatcgcctcagcgtcagccgagcaggcaacggggatcaatgaagtgaaccaagcagtcaatcagatggatgagatgacccaacaaaatgccgcactcgtcgaagaggcagccgcggcttcagaaagcctattagcacaggccgagcagctctatgaccatgtcgctatgttcagattgccagatcaggacacgagcgccccatcactgttgaaagcggtcaataagcgcccgcaatccgcaccagtgactcgacatccggccagccacatcgctaaaacgccagcaaaaatcacggccaaagccagctcgagggcacaacccgttatgcaggtcgcgcacgatgaagaatgggagagtttttga

SEQ ID NO: 20399 - protein, 659 aa, Vibrio cholerae
MGLLARLFSTAPHHPTQPAEVKPDPLMQSPVTTETTALQPEPQVAPYQTDLALTTPESDLTPQVNQAFVQVIREHLALLECEPNGTICYASDAFAHLCRVSAEAMVGADFANLWRTHQQPSVQRLLQDAKKGHPVSAELQLSRSQEAIWIKADLYPIKAINGQLQNVVVLLQDITAAKLEKIDRSGQMNAVNLTQAVIEFTLDGTILTANQNFLQTVGYQLDEIQGRHHSMFVDEQYKQSQEYQHFWQRLRSGEFFVDEYKRFGKGGKEIWIQASYNPIMDSEGKPYKVVKYATNVTQRKMVVNEVKRVMTALSSGDLSAQLTHPFEGEFAELGEVISQFIVTLRQIITDINSVAATIKLAATEISNGNTDLSSRTEQQASNLEQTASSMEELNSTVRQNSDNAMQANILAGKATEIAASGGELIEQVVVTMASINESAQKIADIIGVIDGIAFQTNILALNAAVEAARAGEQGRGFSVVASEVRSLAQRSANAAKDIKALISDSVSKISNGNELVDRSGSTMKDIVVSIKRVHDLMADIASASAEQATGINEVNQAVNQMDEMTQQNAALVEEAAAASESLLAQAEQLYDHVAMFRLPDQDTSAPSLLKAVNKRPQSAPVTRHPASHIAKTPAKITAKASSRAQPVMQVAHDEEWESF

SEQ ID NO: 20400 - DNA, 1869 bp, Caulobacter crescentus
  CDS (1)..(1869)
atggaacaacgttttccttgcgttaagaatcgacgcgcatctttccttaaggggagtatgcaaacgatgtcattgcgcatttcgggaaccttgaacctcttcgcgatcgtcttgatcgcggccttcgccttggcgacaggcacggcgacctacgccttgatgacgctgcgtgtcggagggccgctgtcgaagcagcagatggaggtcgacgccctggtggcggacatcatgccgccgccgctcttcatcgtagaagcgctgctcacggcgcaccgtggcccggacgaactggacatgggcgcggagatcgaccgcgacctgaccacgctccatgccagctatgaagaccgtcatgcgcactgggcgacacggccgctgacgcccgaggtcaaggacggcctcgcggcgtcggacatccaggtccgcaagttctgggatatcgccgaaaagcagttcagacccgcccttcgcgccggcgatgtcgcggccatgaacaccgcgcttgacgccatgacgatcgcctaccgcgagcaccgtcgggtgatcaccgaactgacgccgctggtggtgggactctcgaaggccaaggtcgaggccgcggaggcgcaatcccagcgtatcttcatcgcggtggggctggccacggcgctgatgctgatcgtggccgccgggggcgtctggatcctgcgcaggaagatggtcaggccgctgctcggcatgaccggctatatgggcgcgctcgccgacggtaactatgacaaggacgtcccctatcaggggcgtgccgacgaactgggggacatggcccgctctgtcggtgtgttccggaccgccgttctggagcgccgcgccgcccgcgaacagcagctggcggcggatgcgcgggccatggacgcccagcagcgtcaggccgctcagtcgcaggccgatgctcgtgcgcgggatctggtcgtgtcggccttggatcgcggcttgaacggcctggcgcgcggtgagctgcaacaacggatcgatgagccgttcccggccgaattcgaacagctgcggatcaacttcaacgcctcggttcagatgctggaagcgaccctcgccaaggtgatcgctctggcgggctcggtcggtggcggcgcgggagagatttcttcggcggccgacgatctgtcccggcgcacggagcagcaagccgccagcctggaagagaccgctgcggccctgcaggaagtcacctcgacgatccgtcagagcgccgagcgcgccgccatggctcagcaagccacctcgcgtagccgatcctccgtcacgcagtcggccgacctggccggcgaggcgatcggggccatggagcggatcgacacatcctcgcgccagatcaaccagatcatcggcgtgatcgacgagatcgccttccagaccaacctcctggcgctgaatgcgggggtcgaggccgcccgcgccggtgaggcggggcgtggcttcgccgtggtcgccatggaagtccgggccctggcccagcgttctgccgacgcggccaaggagatcaagggcctgatcgcggaagcctcctccagcgtggacagcggcgtgggcctggtcgggcgggtcgggcaggcgctgggcgcggtcgttgacgagttctccggcatcgaggccttggtcaacgacatcgcgacgacggccaaggaacaggccaccggccttggccagatcaacaccgccgtcagccagatggatcaggtcacccagcagaacgccgccatggtggaagagaccacagcggccagccacagcctcaagcgggaagcttcggacctgatgaacctggtccgggccttctcgctgagcgaggatgtgcgccagaaggcggcctag

SEQ ID NO: 20401 - protein, 622 aa, Caulobacter crescentus
MEQRFPCVKNRRASFLKGSMQTMSLRISGTLNLFAIVLIAAFALATGTATYALMTLRVGGPLSKQQMEVDALVADIMPPPLFIVEALLTAHRGPDELDMGAEIDRDLTTLHASYEDRHAHWATRPLTPEVKDGLAASDIQVRKFWDIAEKQFRPALRAGDVAAMNTALDAMTIAYREHRRVITELTPLVVGLSKAKVEAAEAQSQRIFIAVGLATALMLIVAAGGVWILRRKMVRPLLGMTGYMGALADGNYDKDVPYQGRADELGDMARSVGVFRTAVLERRAAREQQLAADARAMDAQQRQAAQSQADARARDLVVSALDRGLNGLARGELQQRIDEPFPAEFEQLRINFNASVQMLEATLAKVIALAGSVGGGAGEISSAADDLSRRTEQQAASLEETAAALQEVTSTIRQSAERAAMAQQATSRSRSSVTQSADLAGEAIGAMERIDTSSRQINQIIGVIDEIAFQTNLLALNAGVEAARAGEAGRGFAVVAMEVRALAQRSADAAKEIKGLIAEASSSVDSGVGLVGRVGQALGAVVDEFSGIEALVNDIATTAKEQATGLGQINTAVSQMDQVTQQNAAMVEETTAASHSLKREASDLMNLVRAFSLSEDVRQKAA

SEQ ID NO: 20402 - DNA, 1827 bp, Caulobacter crescentus
  CDS (1)..(1827)
atgacgaccgccatgaacattcccaagaagctcagcctgtcgttcgtcttcatctgcgtttccgcagccatcatgatggtcgtcttcctggcgacgatcctgatgatccgcgcctcgacggaaagcagcaatcacagccaacagatccacgcggacgcgctggcgctcgagacggccattctgcgccagaacagccagttccgcggctatctcgtcaccggcgacagcacgtacctgaagtcttactacgagggccgggatgagtacgatcaggtctcggcgaagctggcctcgacgctcaccgatcccgagatgctcaagcacatcgaagactcgcgcgtggcgaccctcgcctggcgcaaggagtggggcgatcgcctgatcgaggtggttaaggccggccagcgcgacgccgcgcagcaggaagtccgtgacgcgggcaagaaggtgctggtcagcgccgcagtgctgccgctgcgcgagatccgcaacgccgaggtcaagaacatcgcccagaacggcgcgcgtcagcagaccgccatcgtcacggcgatcacggccctgatcatcggcggcatcgccctgatcaccattgcgatgatggcctcgcgcatcctcagccgctcgatcgcccgcccgatcacgactctgaccgccgccatgacgcagctcgcgcgcggcgacaatgaaatctccgtcgacgccaaccgcggcgacgagctgggcgacatggcccgcgccgtgctcgtgttccgcgacgccgccctggccaaggccgaagccgaccgcgccaaggaagaggccgatcgcgccaaggccgaggccgaccgcgccaagctgggcgccgaggcggcccagcgccgcgtggtcgagaccctggacacggccctggcggcgctggcgtccggcgacctgacccacatcatcagcaacccgttcgagcctgagtacgagcgcctgcgccagtcgttcaacagcgccgtggaagggctcgagcagagcatttccggcgtcgcccgctcggccaagagcgtgcgttcgggcgccgctgagatctacacggcctccgaagacctctcgcgccgcaccgaacagcaggcctcgcgcctgcaagagacgaccaccgcgacccagcaggtcaccgtcatggtcggcgagacggcgcaacgcgccgccgacgcccggaccgccatcgaggtcgcgaacggcaacgccgccgacggcggtgcgatcgtcaacgaagcgatctcggcgatggacgccatccagaccagctcggaagagatcagccagatcatcaacctgatcgacagcatcaccttccagaccaacctgctggcgctgaacgccggtgtcgaagccgcacgagccggcgacgcgggcaagggcttcgccgtcgtggcctcggaagtgcgcgccctggctcagcgctcggccgacgccgcgcgggatatcaagaccctcatccacacgtcctcggagcaggtggccagcggcgttcgccgggtcggcgacaccggccagatgctgacgctcatcggctcgaagatcgtcgacaccaacacgctcatcaatgagatcgcgctgaacaccgagacccaagccgacaatctgaagcaggtcagcagcgccgtcgccagcatggacagcatgacccagcaaaacgcgtcgatggtgaaggaagcgacggcggccgcacgcagcctcgccggcgaagccgacgagctggccaccctggtcgcgcgcttccggctgcgctcggcggatttcggccaggccgcggcgcccgccgcgcgctccctgagggctgcaggcggtcggggctaa

SEQ ID NO: 20403 - protein, 608 aa, Caulobacter crescentus
MTTAMNIPKKLSLSFVFICVSAAIMMVVFLATILMIRASTESSNHSQQIHADALALETAILRQNSQFRGYLVTGDSTYLKSYYEGRDEYDQVSAKLASTLTDPEMLKHIEDSRVATLAWRKEWGDRLIEVVKAGQRDAAQQEVRDAGKKVLVSAAVLPLREIRNAEVKNIAQNGARQQTAIVTAITALIIGGIALITIAMMASRILSRSIARPITTLTAAMTQLARGDNEISVDANRGDELGDMARAVLVFRDAALAKAEADRAKEEADRAKAEADRAKLGAEAAQRRVVETLDTALAALASGDLTHIISNPFEPEYERLRQSFNSAVEGLEQSISGVARSAKSVRSGAAEIYTASEDLSRRTEQQASRLQETTTATQQVTVMVGETAQRAADARTAIEVANGNAADGGAIVNEAISAMDAIQTSSEEISQIINLIDSITFQTNLLALNAGVEAARAGDAGKGFAVVASEVRALAQRSADAARDIKTLIHTSSEQVASGVRRVGDTGQMLTLIGSKIVDTNTLINEIALNTETQADNLKQVSSAVASMDSMTQQNASMVKEATAAARSLAGEADELATLVARFRLRSADFGQAAAPAARSLRAAGGRG

SEQ ID NO: 20404 - DNA, 2037 bp, Vibrio cholerae
  CDS (1)..(2037)
atggcattttggaatcgtaaacaacaggttgtgccccagtttgttgagccagccaaggagagcgccacgagcgaatttgacgagtcggagacccaaagcggtttatctaactatcaattgctttccgcactcaatgcggcacaaacagcactgatgatgatagatcgcgactttcggatcacctacttcaataatcaaacgctcaagctgctaaaacaacacgaaacgttgtttcgtagcgtctggcctgattttcgtgccgaggccgattttttacatggctactgcattgaccattttcatcttaaccctcgccatcagcgcaccatgctcgcggatccgagccatttaccctacaccaccgtcatcaacatcaaaggagtaaaaatcgagctgattgtaggcgcgattattgatgatcgtggttcttacattggcaataccttggaatggcgtgatgtgaccgaagagctcttgcgtgatcagcaaataggtcgtttagcttcggcggtcgaaggcatgacgacgaatttgatgatggcggataaagaggggattattcaatatcttaaccccgcactgttacaactgttgacccaccgtgaaccagaactcgcgcaggcctttcccggctttaaagccgcggagttggtggggaaaaatatcgacattttccataaaaatcctgcacatcagcgttcgatcattagtaacccagaacgcttgcctttcacctccatgatcaaagtgggctctttagagtttaatctgacttgtattgcgatgcgcgatacaaaaggcgaatacataggtcctgcgttgcaatgggtagatatcaccgagcagcgtgatggccagcgccaagtggagtctttgatccaaaaagcgattaaaggtgacctgcatgaccggatcaataccagtggctacaacggttttatgcgtgagttgggagatggcatcaataacttgcttaacacgctggtggaaccattgggccagtgtattacggtgatgagccgagtggctgaaggcgatctcaataccagcatgtctgaagagtaccaaggcgaatttggtcgattagccagtgcggtcaacgcttcgattgtgaacctacgcaatatggtcgacaaaattaccgtttcttctgctcgagttgcgaccgcttctacagagatagcggatggcaataacgatctcagccagcgtgtggaagctcaggcttctaacttggaagaaactgccgccagtatggaagagataacagcaaccgtgcgtcaaaatgcggataacgcgaaagatgccaatctacttgcgaccgatgcggcgaaaaaagctgcccgaggcggagaagtggttggtgaagccatcagcgcgatgggggcaatcaataccgccagtaagaaaattgcggacatcattagcgtgattgatgaaatcgctttccaaaccaacttgttggctctgaatgctgcggtagaagcggcgcgggccggtgaacaagggcgtggctttgccgtggttgccggagaagtgcgtaatctcgcgcagcgtagtgccggagcggcgaaagagattaaaggtttgattaacgatagtgtcgataaggtgaatgaaggctcacgcttagtcaatgaatcgggatcgacacttaaagaaattgttgaagcggtagtgagagtctcggatctgattgcacagatcgccgcttccagtgtggagcaatccacgggcattgatgaaatcaaccgagcgattgctgctatggatgaaatgacccagcagaacgcttcactggtggaagaaacatcagcggcgagtcagtcactcaaagatgaaggaaaagagctgcttaatttgatgaatttctttgtcaccgaaaataatgtcaccacttttgagcgcaaacctcgccaatcaacgccacccaaaaccaagcctgtggttagcatgcataaagcaccgataaatcaggccgtacataaaatgccagctcgggcggcagaagaaggtgacgaatgggaagaattctaa

SEQ ID NO: 20405 - protein, 678 aa, Vibrio cholerae
MAFWNRKQQVVPQFVEPAKESATSEFDESETQSGLSNYQLLSALNAAQTALMMIDRDFRITYFNNQTLKLLKQHETLFRSVWPDFRAEADFLHGYCIDHFHLNPRHQRTMLADPSHLPYTTVINIKGVKIELIVGAIIDDRGSYIGNTLEWRDVTEELLRDQQIGRLASAVEGMTTNLMMADKEGIIQYLNPALLQLLTHREPELAQAFPGFKAAELVGKNIDIFHKNPAHQRSIISNPERLPFTSMIKVGSLEFNLTCIAMRDTKGEYIGPALQWVDITEQRDGQRQVESLIQKAIKGDLHDRINTSGYNGFMRELGDGINNLLNTLVEPLGQCITVMSRVAEGDLNTSMSEEYQGEFGRLASAVNASIVNLRNMVDKITVSSARVATASTEIADGNNDLSQRVEAQASNLEETAASMEEITATVRQNADNAKDANLLATDAAKKAARGGEVVGEAISAMGAINTASKKIADIISVIDEIAFQTNLLALNAAVEAARAGEQGRGFAVVAGEVRNLAQRSAGAAKEIKGLINDSVDKVNEGSRLVNESGSTLKEIVEAVVRVSDLIAQIAASSVEQSTGIDEINRAIAAMDEMTQQNASLVEETSAASQSLKDEGKELLNLMNFFVTENNVTTFERKPRQSTPPKTKPVVSMHKAPINQAVHKMPARAAEEGDEWEEF

SEQ ID NO: 20406 - DNA, 1608 bp, Pseudomonas aeruginosa
  CDS (1)..(1608)
atgaacattcggcagagaatcctcgcttcgggcgccatcggcatcgtggctgtggtgctgctaggcggggtcggcttctgggggcaattgcggttgggcaaggcgctgtcggagaacgagctgagcgtcaatgcgctgcgcaaccacatggaaggcgacatgatgcacgacgccttgcgcgccgacgtcctggcggcgttcgtggtccagcccggcgacggcgcggcggccgagcaggtccgccaggacctgcaggagcacagccagtggtttcgcaaggtggtcgagcagaaccaggggctgcctctcaacgacgccatccaccaggcgctggtcgagttgcggcccgacctggaagcctacatcggcgccgccgagagcatcgtcggcaaggcgttgcttgatcccgtggcggcgcgggccgagctgccgcagttcgtccaggccttcaaggagctggaagggcgcaacgaagcgctcagcagcctgatcgagaaacacgtcgagcagaccaaccgggcgcgcgaagacagcatgcgctattccgcctggatgctcgcgggcggcatcctggtcgcctgcctggtccttggacagctctgtcgccagttgctgcgcgccgtcctgcagccgctgcgcaaactggtctcatcggcccgggtgatcgcccagggcaacctgcaggagccgatcggcgtcgacagcaatgacgaggccggccagttgcagcgggcgttgggcgagatgcaggagaacctgcggcagatgatcaccatcatccgccaggaaagcgaagaactccacgacacctcccaatccatcggccagacctcgcagtcgatcgtccacggcgccagccaacaggccgacagcgccaccagcatggccgcgagcatggaagagatgatcaccaatatctcgcagatttccgaccacgccgacaacgccagggtgatctcggccaagtccgaggagctggccagcagtggcgggcaggtgatcctcaacgtggtggaagggatgagccgcatcgccgacgtggtcaaccagtcctccaccagcatcaccgctctcggccagtcgtcggacgagatccattcgatcatccaggtgatcaaggggatcgccgagcagaccaacctgctggcgttgaacgccgccatcgaggcggcgcgggccggagaggccgggcgcggtttcgccgtggtcgccgacgaggtacgcgggctggcggcgcggaccacccagtcgacccaggagatcaccgcgatgatcgagcgcatccgcgccagcacggggcaagcgatcaacagcatggaggccggcgtgagccgggtcaacgagggggtgtcgttcgcccgccaggcaggggtgtcgatcaacgagattctcgatggaacccgtcatgccgcgtcggtggtcgatgagatttcccagaccatccgcgagcagtcgcgcgccagtgatgaaatcgcccagcgcgtggaactcatcgcccagcgttcgcagcagaacacccaggcgatgcacgagatggccgccaccgccaggcgcctgaacgaggttgcagcgaccatgcgctcgtcggtggagcgcttcaagatctga

SEQ ID NO: 20407 - protein, 535 aa, Pseudomonas aeruginosa
MNIRQRILASGAIGIVAVVLLGGVGFWGQLRLGKALSENELSVNALRNHMEGDMMHDALRADVLAAFVVQPGDGAAAEQVRQDLQEHSQWFRKVVEQNQGLPLNDAIHQALVELRPDLEAYIGAAESIVGKALLDPVAARAELPQFVQAFKELEGRNEALSSLIEKHVEQTNRAREDSMRYSAWMLAGGILVACLVLGQLCRQLLRAVLQPLRKLVSSARVIAQGNLQEPIGVDSNDEAGQLQRALGEMQENLRQMITIIRQESEELHDTSQSIGQTSQSIVHGASQQADSATSMAASMEEMITNISQISDHADNARVISAKSEELASSGGQVILNVVEGMSRIADVVNQSSTSITALGQSSDEIHSIIQVIKGIAEQTNLLALNAAIEAARAGEAGRGFAVVADEVRGLAARTTQSTQEITAMIERIRASTGQAINSMEAGVSRVNEGVSFARQAGVSINEILDGTRHAASVVDEISQTIREQSRASDEIAQRVELIAQRSQQNTQAMHEMAATARRLNEVAATMRSSVERFKI

SEQ ID NO: 20408 - DNA, 1515 bp, Caulobacter crescentus
  CDS (1)..(1515)
atgacgccactggccagtcttgtcgcgggcaacgcggtcgcgaaactggccggaatcgccacggtcctggcgctcgtagcgttcgtggcttaccgggtcgcggcggatcatttcggccagcgcctggtctcagcccttgttctggtcggacaggtcgccctgttcgtgctcgccttcagcggcagtccgctgcagtccgaagcgcgcatggcctttctcgccgcgctggccctgttggtcgcctatggcgattggcggatcatcgccgccggcgcgtttgcggtcgcagcctgtcatggcgctgcggcgctagtctcgccgcatgcgcttggcgggagcggcggtctgatggcgacggccttcgcgatcggggtgacggccgccaccgcctggtcgctgatctggatgacggccggcgtttcgagactgttctcgacggtgtccgtccggacccgtaacgccgagcgtgcggccgaacaggccgaggaggcgcgtgaggcggtcgtggccgaacgcaatgcgcgcgagcagtccgtcgcagagcgcgccgcgctgaaggctgcgatggaagccgaacagaatctggttgtgaccgaactcgacgcggcgatcaccaagcttgccgacggggacctgagttggcggctgcagcagagcttcgccgagcgctatgaagatctgcgggccaacttcaaccgggcgctggagcgactggaagccgccatgggtgacgtgaccacgcgcgcttccaccatgaccgacggcgtcaacgagatgagccgcgcctccgacgagttggcgcgccgaaccgaacagcaggccgccagtctgatccagacggccacggcgctgggcgaggtgaccgtcgcggtgaacgagaccgctgagaacgcccggcaagccaacgctgcggcggagggcgcgcgccaagaggccgagcggtccgaccccgtggtcaccgaggctgtcgaggccatgacccagatcgaaacctcctcgggccagatcggtcggatcatcggcgtgatcgacgagatcgcgttccagacgaacctgctggcgctcaacgccggcgtcgaggccgcacgggccggcgagtcgggcaggggcttcgccgtcgtcgctcaggaagttcgcgccttggcgcagcgctcggccaacgccgccagtgagatcaagactctgatcagcgcttcgacggctcaggtttcggcgggggttgagcgcgttgcgcgcacgcgggaagccttgcagcgtatcgtcgcgcgggtcgccgagatcgacgggcaggtcaatgcgatcgcccgctcggcgaacgatcaggcgcagagcctgcgcgacgtcaacaccaccgtcggcgagatggaccgggtggtgcagcagaacgccgccatggtggaagaaaccactgcggccgctcacgccctgcgctccgaggcgcaagacctcagcgaccgtatcggcttgttcaagatcacgggccgcatcggcggcgcccgccgtcaagcggcttag

SEQ ID NO: 20409 - protein, 504 aa, Caulobacter crescentus
MTPLASLVAGNAVAKLAGIATVLALVAFVAYRVAADHFGQRLVSALVLVGQVALFVLAFSGSPLQSEARMAFLAALALLVAYGDWRIIAAGAFAVAACHGAAALVSPHALGGSGGLMATAFAIGVTAATAWSLIWMTAGVSRLFSTVSVRTRNAERAAEQAEEAREAVVAERNAREQSVAERAALKAAMEAEQNLVVTELDAAITKLADGDLSWRLQQSFAERYEDLRANFNRALERLEAAMGDVTTRASTMTDGVNEMSRASDELARRTEQQAASLIQTATALGEVTVAVNETAENARQANAAAEGARQEAERSDPVVTEAVEAMTQIETSSGQIGRIIGVIDEIAFQTNLLALNAGVEAARAGESGRGFAVVAQEVRALAQRSANAASEIKTLISASTAQVSAGVERVARTREALQRIVARVAEIDGQVNAIARSANDQAQSLRDVNTTVGEMDRVVQQNAAMVEETTAAAHALRSEAQDLSDRIGLFKITGRIGGARRQAA

SEQ ID NO: 20410 - DNA, 2295 bp, Rhodobacter capsulatus
  CDS (1)..(2295)
atgggcctcgtcatcatcgtttgcacggcggccgttttcgccacagtcttttattccgcactcgtcgaccgcagggccgaacagcaaagcctgcagatttcgcggctgagcacggatctggccacgctggaacgaaccttggcttcggcgcgcgacaccgaggcgaagttccgcatcgaccgcaaggaatcccgaatcgcggatcatgccgggcagatcgcccaggcctcggcgcagctcaagacgctggtggcccatgaaaccgacctcggccttgccgaaagcgcaggtcgggcgggcgcgttgcaggatctgctttacagttacgaggaaaacttcgcgctttttgccgatacccgggtggttctggggctcaatgccgattccgggctcgaggggcagctgcgcgcggccgtgcatgccgccgaaaagatggtgggcgcgcttgccctgccgaaggtcgaggtgagtctgctgaagatgcgccgggccgaaaaggacttcatcctgcgcctcgatccggcctatatcgagaagctcgacaaggaaatcgagaccttcaagtcctttcccgaaacgatgttcgtctcgacgcaacaccgggaccggacgctggcgaagctgacggaatatcaggacgccttccaccaatatgccgaccttgcgctgcagatcgattcgatcatccgcgcctgtgacgacagctatgacgcgatgccgctggcgcttgccgcgctacgcgacggccttgcggccgatgtccagcagatgacggcggcgaccgatgcggcgaagatgcgcggctatctcctgatggccctggcgggcgggatcggcatgctggtgctcggcgcctcggcggtgcggctgttccgggccacggtgacgccgctgcgcgcggtgacgacggcggtgcaggaactggccgaggggcggacggacatcaccgtgcccgagacccgggtggccgaggtgcgctcgatcggggcggcgctcgagagtttccggaccacgatcctggaacgacagcggctcgaggcggaaagcgccgccgccgccgagcgggaagccgaggcccggatcgccgccgccgcgcaggaacgcgcggagatggcggaacgggcccgtctggccgaggaagaccgcgccgccgccgccgccgcccaggcgcgcgaacatgccgccgcccaggaaatcgccgccgtggtggccgcctgtgccgagggcgatttctcgcgccggctgcgcaccgacgacaagaccggcatcttcgccgatctctgcgccgggatgaaccggatcggcgaggcggcggatgacgggctgaccgcggtgcgcgtcgcgctggaacgtctggccgaacgcgatctgacccatcgcatgccgacgcggttccacggcgtctttggcgagatcgcggagacgatgaaccgcaccaccgaaagcctaaccggcacgctgggcgacatttcggtgtccgccaccgccgtcgacacgtcggcgcgagaaatcgccggggccggcgacgatctggcgcggcggtcggaacgcaatgcggcgatgctggaacagaccgcctcggcgctggaacagatgtcggccacggtccgttcggcggcgaattcggcgcagaccgcccgcagcgcggtgaccgagatctcgacccgcgccggggccgggcatcaggtggtgtcgcgggccgtctcggcgatggacgagatcaaggcctcgtccgaggcgatcgggcgcatcctgcaggtgatcgacgacatcgccttccagaccaaccttctggcgctgaatgcgggggtggaagcggcgcgggcgggcgatgcggtgcgcggctttgccgtcgtcgcctcggaggtgcgggcgctggcgcagcggtcttcggaagccgcgcgcgagatcgcccggctgatcgagaccgcgtcgaacaacgtcaatcagggcgtcgggctggtgcatgattccggtcaggcgctgcgcgagatcgtcgccggggtcgaggatgtggcgcaaaagatcgccgagatcgtcaccgcctcgcaggaaaccgcgaccgggatcaccgagatctcgaatgcgacgacggaactggaccgcacgacgcagcagaacgccgccgtcttcgaagagaccaatgccgcggtgcgctccctgcagggcgaggcgacggcgctggccgaggccgtggcgaccttccggctgcagcgcgaggaaagctgggcgccgcgcgcgccggtggccgaggagccccgtccggcgctcttcgtgtcgcgccgcagcgcctga

SEQ ID NO: 20411 - protein, 764 aa, Rhodobacter capsulatus
MGLVIIVCTAAVFATVFYSALVDRRAEQQSLQISRLSTDLATLERTLASARDTEAKFRIDRKESRIADHAGQIAQASAQLKTLVAHETDLGLAESAGRAGALQDLLYSYEENFALFADTRVVLGLNADSGLEGQLRAAVHAAEKMVGALALPKVEVSLLKMRRAEKDFILRLDPAYIEKLDKEIETFKSFPETMFVSTQHRDRTLAKLTEYQDAFHQYADLALQIDSIIRACDDSYDAMPLALAALRDGLAADVQQMTAATDAAKMRGYLLMALAGGIGMLVLGASAVRLFRATVTPLRAVTTAVQELAEGRTDITVPETRVAEVRSIGAALESFRTTILERQRLEAESAAAAEREAEARIAAAAQERAEMAERARLAEEDRAAAAAAQAREHAAAQEIAAVVAACAEGDFSRRLRTDDKTGIFADLCAGMNRIGEAADDGLTAVRVALERLAERDLTHRMPTRFHGVFGEIAETMNRTTESLTGTLGDISVSATAVDTSAREIAGAGDDLARRSERNAAMLEQTASALEQMSATVRSAANSAQTARSAVTEISTRAGAGHQVVSRAVSAMDEIKASSEAIGRILQVIDDIAFQTNLLALNAGVEAARAGDAVRGFAVVASEVRALAQRSSEAAREIARLIETASNNVNQGVGLVHDSGQALREIVAGVEDVAQKIAEIVTASQETATGITEISNATTELDRTTQQNAAVFEETNAAVRSLQGEATALAEAVATFRLQREESWAPRAPVAEEPRPALFVSRRSA

SEQ ID NO: 20412 - DNA, 1602 bp, Escherichia coli
  CDS (1)..(1602)
atgtttaatcgtattcgaatttcgaccacgctgtttttaattttgattctctgcgggatcttgcagattggcagtaacggcatgtctttttgggcatttcgcgacgatttgcaacgactgaatcaggtcgagcagagcaatcagcaacgtgcggcattagcgcaaactcgggcggtaatgttacaggccagtaccgcgctgaacaaagcgggcactctgacggcacttagctatccggcggatgacattaaaacgttgatgacgacggcgcgcgccagtctgacgcaatccaccacgctgtttaaaagttttatggcgatgactgcgggcaacgagcacgtcaggggattgcaaaaagagacggagaaaagttttgcccgctggcacaacgatctcgaacatcaggcgacctggcttgaaagtaatcaactttcggatttcctcactgcgccggtgcagggatcacagaatgcgtttgacgttaactttgaggcctggcagctggagatcaaccatgtgctggaagccgccagtgcgcaaagccagcgtaactatcagatttcggcactggtgtttatcagcatgattattgttgcggcgatctacatcagcagtgcgctgtggtggacgcgcaagatgattgttcaaccactggccattatcggtagccattttgacagcattgctgcgggtaatctggcgcgtccgattgcggtatatggtcgtaatgagatcaccgccatttttgccagtctgaagaccatgcagcaggctttgcgtgggacggtaagtgatgtgcgtaagggaagccaggagatgcacattggtatcgcggagattgtcgcaggcaataacgatctctcaagtcgtaccgaacagcaggcggcatcgctggcacaaacggccgccagtatggagcaattaaccgccacggtagggcaaaacgccgataacgcacgacaggcgtcggaactggcaaaaaatgccgcgacaacggcgcaggcgggcggtgttcaggtcagtaccatgactcacaccatgcaggagatcgccaccagctcgcaaaaaattggcgacattatcagcgttatcgacggaattgctttccagaccaatattctggccctgaatgcggcagtggaagcggctcgcgccggagagcaggggcgtggttttgcggtagtggcaggtgaagtgcgcaatcttgccagccgtagcgcgcaggcagcaaaagagatcaaagggctgatcgaagagtcagtcaatcgtgtccagcagggttcgaaactggtgaataacgccgccgcgaccatgatcgatattgtcagttcggtgacccgcgtgaacgacattatgggagaaattgcctctgcgtcggaagaacaacagcgggggattgagcaggttgcacaggctgtcagccagatggatcaggtgactcagcagaacgcctcgctggtagaagaagcggcggtggcaacggaacaactggcgaatcaggccgaccatctttcgtcgcgtgtggcggtatttacccttgaagaacatgaagtagcacgacatgagtcggtgcagttacaaattgcgccagtggtatcctga

SEQ ID NO: 20413 - protein, 533 aa, Escherichia coli
MFNRIRISTTLFLILILCGILQIGSNGMSFWAFRDDLQRLNQVEQSNQQRAALAQTRAVMLQASTALNKAGTLTALSYPADDIKTLMTTARASLTQSTTLFKSFMAMTAGNEHVRGLQKETEKSFARWHNDLEHQATWLESNQLSDFLTAPVQGSQNAFDVNFEAWQLEINHVLEAASAQSQRNYQISALVFISMIIVAAIYISSALWWTRKMIVQPLAIIGSHFDSIAAGNLARPIAVYGRNEITAIFASLKTMQQALRGTVSDVRKGSQEMHIGIAEIVAGNNDLSSRTEQQAASLAQTAASMEQLTATVGQNADNARQASELAKNAATTAQAGGVQVSTMTHTMQEIATSSQKIGDIISVIDGIAFQTNILALNAAVEAARAGEQGRGFAVVAGEVRNLASRSAQAAKEIKGLIEESVNRVQQGSKLVNNAAATMIDIVSSVTRVNDIMGEIASASEEQQRGIEQVAQAVSQMDQVTQQNASLVEEAAVATEQLANQADHLSSRVAVFTLEEHEVARHESVQLQIAPVVS

SEQ ID NO: 20414 - DNA, 1656 bp, Escherichia coli
  CDS (1)..(1656)
atgttaaaacgtatcaaaattgtgaccagcttactgctggttttggccgtttttggccttttacaactgacatcaggcggtctgttctttaatgccttaaagaatgacaaagaaaatttcactgttttacaaaccattcgccagcagcaatccacgctgaatggcagctgggtcgcgttgttgcagacgcgtaacaccctcaaccgcgcgggtatccgctacatgatggatcagaataatattggtagcggttcaaccgttgctgagctgatggagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatccaactgttaggtgcaggcaaaatcaacgagttctttgatcagccgacccagggatatcaggacggtttcgagaagcagtatgtggcttacatggagcaaaacgatcggctccatgatatcgccgtcagcgataacaatgcctcctacagccaggcgatgtggattctggtgggcgtgatgatcgtcgtactggcggtcatcttcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaagcagaacgccgaaaatgcgcgccaggccagccatctggcgttaagtgcttctgaaacggcgcaacgcggcggtaaagtggtagataacgtggtgcagactatgcgcgatatctccaccagttcgcagaaaatcgccgatattatcagcgtaattgacggcattgccttccagaccaatattctggctttgaacgcggcggttgaggctgcgcgtgcgggtgagcaagggcgcggttttgcggtggtcgcgggagaagtgcgtaatctggcccagcgcagcgcccaggcggctcgtgaaattaaaagcctgattgaagactcggtggggaaagtggatgttggctctacgctggtcgaaagcgccggggaaacaatggcggagattgtcagcgccgtgacccgcgtgacggacattatgggcgaaattgcttctgcttctgatgagcagagccgtggtatcgatcaggttggcttagcggttgctgagatggaccgggtaactcaacagaacgccgcgctggtggaagagtctgccgctgccgccgccgcgctggaagagcaggccagtcgcctgaccgaagcagtggcagtgttccggattcagcaacagcagcgtgaaacatcggctgtggtaaaaaccgtgacgccagctgcgccgcgtaaaatggccgtggcagatagcgaggagaactgggaaacattttaa

SEQ ID NO: 20415 - protein, 551 aa, Escherichia coli
MLKRIKIVTSLLLVLAVFGLLQLTSGGLFFNALKNDKENFTVLQTIRQQQSTLNGSWVALLQTRNTLNRAGIRYMMDQNNIGSGSTVAELMESASISLKQAEKNWADYEALPRDPRQSTAAAAEIKRNYDIYHNALAELIQLLGAGKINEFFDQPTQGYQDGFEKQYVAYMEQNDRLHDIAVSDNNASYSQAMWILVGVMIVVLAVIFAVWFGIKASLVAPMNRLIDSIRHIAGGDLVKPIEVDGSNEMGQLAESLRHMQGELMRTVGDVRNGANAIYSGASEIATGNNDLSSRTEQQAASLEETAASMEQLTATVKQNAENARQASHLALSASETAQRGGKVVDNVVQTMRDISTSSQKIADIISVIDGIAFQTNILALNAAVEAARAGEQGRGFAVVAGEVRNLAQRSAQAAREIKSLIEDSVGKVDVGSTLVESAGETMAEIVSAVTRVTDIMGEIASASDEQSRGIDQVGLAVAEMDRVTQQNAALVEESAAAAAALEEQASRLTEAVAVFRIQQQQRETSAVVKTVTPAAPRKMAVADSEENWETF

SEQ ID NO: 20416 - DNA, 2076 bp, Rhodobacter sphaeroides
  CDS (1)..(2076)
atgccggcggatctggccggcgccgagaacctgcaggcccaagcgctgagcgcaatgaccgcgggggctcccgtgaaggccaagggcggcacctccattgccatcccggtcacccgcgagggggacgactctctcgccggcgtctttgccgtgtccctgcccgcgctgaatggctcctacgcattgctgatgccggcaaccgcactggtcgcgggcttgataatctcaatggggattgcgggacatctctggaggcgccggaaagagaccgagcggctgctcatcgagacgacccggcggatcaagaacaaccagaggcccgacgccaccgccatgacgcggatcgagctgtcgatcccaacacttgcgaacgagatcgatgccctgtccgccgctctgcagggcgagcgggagcagttcgaggccgcgcatagccgagccatggcactcgacgccctcccagccccctggatcctcgtcgccagcgatggtcgcgtgctcatgatgaaccaccccgcgcggcaggtggttgcgggcctgccggagccacttctcgaaggtcaaccggttgcaagtcttcaccatgatctcgcacgggcttggccggaccgcacaggcaggacgatgtccctggcgatcgggggacgccaatatcaggtgacccgggctcccgtcggcgcaacgggtgccgaggtccttagtttcaccgaccggactgaagagacacaacttgatctcctcctccaaggggtcattcgcgaagccatcgctgcgacttatgacatcagaggtcagatgataaaggcgagcgacggctttgcgaagctcttcggatcctcgggggcctcgctgcgctccctgctcgaggcaacgccggacagtgccgaactccttgctgcggtcgaacgggaaggcgaagggcgcagtttcctgagcagggagggctatggttcagaccaggtgcaggtcggcatctcgatcctgcgacgaccgggcggcggccacttggtcctagtgacggagatccgccaccagtacgcgcaggcaccgacgactgccgctgcggaccagcctccgccggcacctgagcggctgatttcagcgcttcggcagcttgcccaaggtgatctcggatcccgtctggatcatccgcttcccgaacccttcgaagccctgcgcccggacttcaacagcgccctgcaagggctcgcctctctcgtcgaagacgtgatctctgccgctgagagcatccgcaacgaagcccgagacatcagttccgctgcacaatctctggctcaaagaacggaaagcaccgccgccactctggaagagacagcggcagcgcttgacgggctgacagtttcggtccggtccgctgcggacggcgccgcagaagcagatcgggtggtcgccgacgcgcgggcgaacgccgaggagagcgggcatgtcgtcgttgagacagtggctgcgatggacatgattgccgcctcatccgacaagatcacctcgatcgtgaaagtgatcgacgacatcgcgtttcaaacaaatctgttggcgctcaatgccggcgtagaagccgccagggcaggagacgccggccgcggatttgcggtcgtcgcctccgaagtgcgggcgctcgctcaaaggtcttccgaagctgcgagagagattacggacctcatcctgaagagcggcaatcaggtgcggcgcggcgtggatctggttgggaagacgggtgatgcgctgaagcagatcgtatcctcggtttccgaaatttcgactctggtctcggatatcgccgtgtcctcgaggcagcagtctgtgtctctcgcggagatcaactgcgcggtgaacaacctcgaccagtcaacccagcagaatgcggcgcgtctcgaggaggcgaccgccgcaagcgagtcgcttacgacgagcgccaacgcgctcttcgagacggtgcagcagtttcacctggacgctcctcctaagcgcaaccgccccacaccccccctgacagcggcgacgccacataactccagggcgctcgcgcgggcagagcccggatgggaggacttttga

SEQ ID NO: 20417 - protein, 691 aa, Rhodobacter sphaeroides
MPADLAGAENLQAQALSAMTAGAPVKAKGGTSIAIPVTREGDDSLAGVFAVSLPALNGSYALLMPATALVAGLIISMGIAGHLWRRRKETERLLIETTRRIKNNQRPDATAMTRIELSIPTLANEIDALSAALQGEREQFEAAHSRAMALDALPAPWILVASDGRVLMMNHPARQVVAGLPEPLLEGQPVASLHHDLARAWPDRTGRTMSLAIGGRQYQVTRAPVGATGAEVLSFTDRTEETQLDLLLQGVIREAIAATYDIRGQMIKASDGFAKLFGSSGASLRSLLEATPDSAELLAAVEREGEGRSFLSREGYGSDQVQVGISILRRPGGGHLVLVTEIRHQYAQAPTTAAADQPPPAPERLISALRQLAQGDLGSRLDHPLPEPFEALRPDFNSALQGLASLVEDVISAAESIRNEARDISSAAQSLAQRTESTAATLEETAAALDGLTVSVRSAADGAAEADRVVADARANAEESGHVVVETVAAMDMIAASSDKITSIVKVIDDIAFQTNLLALNAGVEAARAGDAGRGFAVVASEVRALAQRSSEAAREITDLILKSGNQVRRGVDLVGKTGDALKQIVSSVSEISTLVSDIAVSSRQQSVSLAEINCAVNNLDQSTQQNAARLEEATAASESLTTSANALFETVQQFHLDAPPKRNRPTPPLTAATPHNSRALARAEPGWEDF

SEQ ID NO: 20418 - DNA, 1917 bp, Rhodobacter capsulatus
  CDS (1)..(1917)
atgcgactttggggaatctcggcgcgtatctatgccattgtggcgcttgcctctttctcgcttctcgttttgtccgagacgctgctgcatttcgcggtcgggaacgcctacgaaatgcgccagcagcatctgagcgatgtcacggacaccgcggtcagcattctggcagagttgcaaaagcaggtcgaagcgggcgaaatggatctggccgccgcaaaggccgagggcgcgaaacggatttccgggttgcggtttgacgactcgggctatttcttcgtcatcgaccacagcgcgaccgtgcaggcgcatccggtcaaacccgattgggtcggcacttcgaagatcgacctgaccgacccgcaaggcacgaagatctatcaggaaatgatcgccctcgccgagtccgagggcgccgggtcgatccgctacatgttccaaaagcccgacaccgacacgcccgaagaaaagatcggtttcgtgcgcgatttcaccccctggggctggatcgtcggcacggggtcctatgtcagcgacatcgcggcggcgctcgtgcatctgcggcaggtcagcttcatctcgatggggctggtggcgctggtgctggtggcggcggcgaccggtcttgcgcgcagtgtcaccaaacctctggcgcaggtgcatggccggatggagcggatgaccgcgggcgatgccgaaagtgcggtgccctgcaccgatctgcgcagcgaagtgggcgacatggccaaggcgatcgaggtgttccggatctcgctgcatgaaaaggcgcagatggaagagcagcgcaaggcgcaggaagccgcgctggccagggcgcaatccgaagcgcgcgagcgcgaggaagccatgcgcctgcgcgaggccgagctggaacgcgagcgtcttcaggaggaggcgcggcgcctgaccgaacgcgaagagcagcgccgccgcgaagaggccgcgcgtgaagcgcagatggccgagcaaaaccatgtggtcggcacgcttgccgcgggcctgcgcgcgatgtctgcgggcgatctgaccgggcggatcacccagtccttccccgagtcctatgaaaacctgcggcatgatttcaacgccgcgctggcgaagatgtcggggctgatcgcctcgatcgtgcgggcgaccgatgtggtggaactggaaacgcgccatctcagctcggcgtcaagcgagcttggacggcgcaccgagatgcaggcggcctcgctcgaggaaaccgcggcggcgatgaacgagatggcctcgtcggtggaaaattcggtcgccggggcgcggaccgcggcgcaggcggtcagccggacccggaccaccacggcaacggggcgcgatgtggtgcgtcagaccgcgcaggcgatggacgacattgcccgcagctcggaacagatctcgcgcatcaccagcgtcatcgacgacatcgccttccagaccaacctgcttgcgctgaatgcgggcgtcgaggccgcgcgggcgggggagagcgggcgcggctttgccgtcgtcgcctcggaggtgcgggcgctggcgcagcggtcttcggaagcggcgcgggaaatcgcgaccttgatcgatacctcgtcgcggcaggtggcctcgggggtggagctggcctcgcgctcggatacggcgctggaacagatcgaaacccttgtcaccgaactggacgggcttctggtcagcatcgccaatgccgcgaccgagcaatcggcggggatcagcgaggtcaccgcggcggtgaaccagctcgatcaggtcacccagcacaatgccgcgatgttcgaggaaaattcggccgcgacgcaggggcttttgaacgaggcgcgcagcctcaaggagctcagcggcgtgttccgggtcgaggacgaggcggcgcagagccgggcggcctga

SEQ ID NO: 20419 - protein, 638 aa, Rhodobacter capsulatus
MRLWGISARIYAIVALASFSLLVLSETLLHFAVGNAYEMRQQHLSDVTDTAVSILAELQKQVEAGEMDLAAAKAEGAKRISGLRFDDSGYFFVIDHSATVQAHPVKPDWVGTSKIDLTDPQGTKIYQEMIALAESEGAGSIRYMFQKPDTDTPEEKIGFVRDFTPWGWIVGTGSYVSDIAAALVHLRQVSFISMGLVALVLVAAATGLARSVTKPLAQVHGRMERMTAGDAESAVPCTDLRSEVGDMAKAIEVFRISLHEKAQMEEQRKAQEAALARAQSEAREREEAMRLREAELERERLQEEARRLTEREEQRRREEAAREAQMAEQNHVVGTLAAGLRAMSAGDLTGRITQSFPESYENLRHDFNAALAKMSGLIASIVRATDVVELETRHLSSASSELGRRTEMQAASLEETAAAMNEMASSVENSVAGARTAAQAVSRTRTTTATGRDVVRQTAQAMDDIARSSEQISRITSVIDDIAFQTNLLALNAGVEAARAGESGRGFAVVASEVRALAQRSSEAAREIATLIDTSSRQVASGVELASRSDTALEQIETLVTELDGLLVSIANAATEQSAGISEVTAAVNQLDQVTQHNAAMFEENSAATQGLLNEARSLKELSGVFRVEDEAAQSRAA

SEQ ID NO: 20420 - DNA, 3696 bp, Rhizobium leguminosarum
  CDS (482)..(2401)
gaattcgcccggagatgttcaaggtttgtcccgaggccgaggcgttgttcaatgagcagatcccggttgccgaagcgcttggagccgacactttcgtgtttttcgacatcgcctcaccgccggtcaatatcaacgatgctgaggataccgaagactttcccaataagggtaagaaccggcttgtggcgcgtataccaccggcgctgacacctcgacccaatcaggtgctgccattgacagtcgacctggagaaattgcactggttcgacccagtaacgggggctgcgatccgcgactgacagaacgtgcacgaaatatcgccagctgtggtttcaactcttttctcctgccctcccaggaacttggctgtcgtcgattacgaggtcggcggcagccattttttttaaaactcgagacatcaaaccatcagaatctgaacatccatccgccgtaagtgacaccgagcttagaggagtggcccatgaaacacatttccattgtcggtaagttctttatcatcatggccgtctttggcgtcatggcactcggtctgacgttctatcagagccggcaaatgttgaaagttaacgacagctatcaggagcttctcgacaaagatgcatctgcagcacttcgcttgacccagtcgaaccgaagtctggaaatagcgcgtgccagcatcagcgacatggtgatgacgcggtcgaaagaggcgagggcgcgcgcagaatttggcttgaatgacgcacgagaaaacttcgtcaggttcatggatctggcgatcgctgccgttcctgagcagagcgaactgccgaaattgaaggcggatggattctccgtcctgaccgatacgtgtggtgcagccatcgcagttggtcgcggcgcaactagtgaagccgagcttgccatggtgcagcaactctatctcactctttgccaacccgcctttgctgccatctcaccgagattcacatccgtcacggaaaaactcgcttctgacgcagagcaaaagcgtgctgacgtttcaagcgttgtccgtgacacgtccgtgctgagtttgggaacagctattgcggcactcttcgctgtctcgtgtttcggctttctcgcaattcgcgcctggttggtcaaaccgatcaagcagatggttacgacgatgaaggtcatagcccacggcgatctcacttcgactgtcgagggaacgattcgccgcgacgagatcggatcgatggcccgggcagtacagatcttcaaggacaacgaattaagggcgcgcgatctcggaaaggatgcagagacaagtcgtggcgcaaatgagattgaacgtgcgcgtctcgccgagaccgagcgtcagcgagcgcgggatatggcggaggcaacgtccgggcttgcagagggcctaaggcatctcgccgacgggaacctcgtgttcagcctcgacgacaagttcgccgaggacttcgaaccgttgcgggcgaacttcaatgctgctgttgcccaactcgctgagagcttgagagctgtgtcgaacgcaactgaatcgatagatgatggcgctcaggaaatcagtttgagcgcgcaggacctgtcacgccgcacagagcatcaggctgcttcactggagcaaaccgccgccgcgctggatcaaattacccagaacgtcgccagttcctcaaagcgcacagcggaggcgcgacatgttgcgatcgaggcaaacaagtcggcgcgccactccggggaagtggtctccagcgctgtcgcggcaatgcaacgcatcgaacggtcatcctcgcggatctccagtattgtcggggtcatcgacgaaatcgcgtttcagaccaatcttctggcgctcaacgcaggcgtcgaggcggcacgatccggcgaggcaggaaaaggtttcgcagtggttgcccaggaggtgcgggagcttgctcaacgctctgcgcatgcagcaaaagagatcaaggatcttatcctcaattcggttgatgaggtcagcagtggcgtcaagctggtccgcgataccggcgaggcgctcaagatcatcgtggaccagatagtcctgatcaacactcagcttgatgccgtcaccgccgcttccaacgagcagtccgcaaccctttttgaggtcaaccggacagtcaatcaaatggatcaggttacgcagcaaaatgcagccatgtccgaggaatccacggctgcaagtacggcacttgccatcgaggtaaaacagttgcgcgggattgtggcggagtttcagattgacgcgggcgacaagctgcatggcagcgtcattctcttcgatagagagccacccgccgcgatgacgctgacacaggccgacaaagacccttttgacgctccccgtaaagtcggttcatccgtcaaaggtggatagcaaaatagccttcactgataaaatcggcgagtgcggcttgtaataaaagcgatgggtaatgtccggtattacaggcgacccgccttgaacccttcctttatttgtatgctaatggccaaggcagaccgtcagttgccctagacgcccatctttttctacgaccggccttgggccggcgttccgtctatctcgccaagatcgcagccggcttcgacgatgaacattttgtataacgacggattgcttcaaggagcctcgatgagaacgctcgacttttatttcgactatcgcagtccctacagcttcctggccctgtcccaggttcgcaagatggatgtcgagatcgccttccatcctttagaaatcggggacctgatgaaacaggtggggaacgtgccaacgagcatcacctgcgcacccaagggtcgctatgtgatgaccgatattcagcggtgggcggtccattatggggtatcgcttaactggcacccccagctgttggagatcgatgccagccaggctattgcgcgccacgctggtggctgggcaactgggcgctatgcccacggcggtagaagcgatcttcaacgcgatatggtcggctccggcaccgctggcgacggcagcagaggtcgccgccgtgctgggcgccgccggtctcgacgccgaggaacttgcagagcgaatggacgagccggcggcgcaggacctgctggacgaggcaaccgcaaacgcggtgtcgcgcggcgtttttggcgcgccgaccctattcgtgggtgacgagatgttcttcggcaatgaccgcctgcacttcatgcagggtcatctggcgcgcgccgcatggaccgtcgttatcatcaccggggtggggccaggtaccggctcggcaatggttcggcggttccatgacggcggctaccaggtcgccatgctagcccgcacagccgaacgcttgagcgatcttgagagcgaacttccaaacgcttttgcagtcccctgcgatgtggccgaccctgcagcgctcgcagccgcccttgaaaccatcgagcaacgcgccggcgcacccaaggtggtgatccacaacgccgtgggcggggccttcggcaatttcctcgacatcgaaccggaagtccttcagcagaatttccagatcaacgtcatggcactgctacaactggccaggtgggctgcaccgcgaatggaggtggcagggggcggcgccttgctggtgactggcaacaccgcggcaaggccgcctttgccggctttgcgccaagcaaggcggcgcaacgcgt

SEQ ID NO: 20421 - protein, 639 aa, Rhizobium leguminosarum
MKHISIVGKFFIIMAVFGVMALGLTFYQSRQMLKVNDSYQELLDKDASAALRLTQSNRSLEIARASISDMVMTRSKEARARAEFGLNDARENFVRFMDLAIAAVPEQSELPKLKADGFSVLTDTCGAAIAVGRGATSEAELAMVQQLYLTLCQPAFAAISPRFTSVTEKLASDAEQKRADVSSVVRDTSVLSLGTAIAALFAVSCFGFLAIRAWLVKPIKQMVTTMKVIAHGDLTSTVEGTIRRDEIGSMARAVQIFKDNELRARDLGKDAETSRGANEIERARLAETERQRARDMAEATSGLAEGLRHLADGNLVFSLDDKFAEDFEPLRANFNAAVAQLAESLRAVSNATESIDDGAQEISLSAQDLSRRTEHQAASLEQTAAALDQITQNVASSSKRTAEARHVAIEANKSARHSGEVVSSAVAAMQRIERSSSRISSIVGVIDEIAFQTNLLALNAGVEAARSGEAGKGFAVVAQEVRELAQRSAHAAKEIKDLILNSVDEVSSGVKLVRDTGEALKIIVDQIVLINTQLDAVTAASNEQSATLFEVNRTVNQMDQVTQQNAAMSEESTAASTALAIEVKQLRGIVAEFQIDAGDKLHGSVILFDREPPAAMTLTQADKDPFDAPRKVGSSVKGG

SEQ ID NO: 20422 - DNA, 2399 bp, Rhizobium leguminosarum
  CDS (174)..(2321)
cgacgtgaccattctccagagcgctgtcggacagggcgctgccgctgtcgacgccgccgtcaagttgatccgcaaggagaaggtgccgcgcgattacaagggtcccttcgaattcgtcacacctgagaacattgccacttatctgccgaagagccagtgagcataagaggactatgatgttgcatttctggaataaattcggcattcgcgcacagatcacctccggctttgtgccgctgatcctgttgatgagcctgctcacggtcagcgcgatctcgggtatgaacgggctcgcctcgatcttctcgtcctatcgcgccacggccggccaaagtctcgccatctcggactatagcgaccagctgaacgagattcagatgtcggcggaagccttccgctccacgccgacgcaggctgtcgtcgaccgcttccgcgccggcgtgaaggcgttcgacgccgatgacccgcgttttgctggcaacaaggacctgcagtccgttcttgcggcgatccgccaggacatcgccacttatggcaaggctttcgaagaaatagttgccctgcaggccaggcgtgatgccttgatctccaaggtcaccgaattcggcccctggaccagtattgcgctcaacgacgtcgtgcgcagcgcctggcgccagaacgatgtgccgctgctgcagatgacggcggcgacactggaggccttgaaccgcagcctctatttctccgaacgcttcgtgcattccgatgattttgccgcctacgacacggcgcaggcagcactggccgaagcggtcacgctcaacgaagccgccgccaaggccgcgaagaacgagctgcaaaagaagcgcctgatgggcgccggacagctgatgcagaactacaccgcccgtctcggcgacatgaaggacgtgctgcaggcctcgggcaacatccgccagacgcagctcagcgtgctcgcgccgaaaatctcaggcggcttcaaggatctgcaggcgactgttaccggtgcgcagaagacccttgatggttcggtggacgcaacggttgcctccgcgaccagcacgacgctgatcatcagcgggctgctgatcgtcattggcctcgtcctttcctatttcgtcggccggttgatttcctcggcggtgcgcaacatggcccagtccatggagcagcttgcccgtggtgaggaaagaattgtgataacgggcgtcgaacatcgccacgagctgggggccatggcgcgttcgctgaaggttttccaggaaacggggcgcgccaagctgatcgcggaagccaatgccgaacgcgcccgcctggcggccgaagaagagcggctccgccaggaggccgagcggctcagcgacgcgcaggtgatggagcatgccttccgccagatctcagtcgggctggacgcgctctcgaagggcgacctcacggtccgcgtcggcgaagtcgaccatcgctatgtcaggatccgggatcatttcaacaactcggtcgcgagcctcgaggaggcggtcgacgccgtcattcgcgcggtcggcaccatccgctccggccttgcggaaatctccaccgcctccaacgatctcgcccgccgcaccgagcagcaggcagcttcgctggaggagaccgtcgcggcgctgggtgaagtgacccgcggcgtcaatggaacggcggagggcgcaagccgcgcccagggagtcgtggcgaccgcccgcaccaatgcggaaaagggcggcgagatcgttgcccgcgccatcgatgcgatgacggaaattcaaaattcgtcgtccaagatcggcaacatcatcagcgtcatcgacgagattgccttccagaccaacctgctggcgctgaacgccggcgtggaagcggcgcgcgccggcgaggcaggcaagggctttgccgtcgtcgcccaggaagtccgtgaactcgcccagcgctcagccaatgcggcaagggagatcaagcagctgatttctacttcctcggcgcaggtcaagaccggcgtccagctggtgggcgaatccggcctctcgctcgaacagattgtcgagcaggtcaccgccatgaatgcgaccgtggccgagatcgccgttgccgcccgcgagcaggcgacaagcctgcgcgaggtctcggctgccggcgaccagatggacaaggtgacgcagcagaacgccgcgatggtcgaggagaccacggcggccgcccagagcctgacacatgaaaccgaaagccttgccgaattgctgcggcggttcagaacgggcagcggccgggtatcggaacatcgccattacgcgatggcatcctgacgtcctgccgatgcaggcaagaaaacgccgccgcctcgaaagggcggtcggtgagcggtcatcggccagcgtcgcctc

SEQ ID NO: 20423 - protein, 715 aa, Rhizobium leguminosarum
MMLHFWNKFGIRAQITSGFVPLILLMSLLTVSAISGMNGLASIFSSYRATAGQSLAISDYSDQLNEIQMSAEAFRSTPTQAVVDRFRAGVKAFDADDPRFAGNKDLQSVLAAIRQDIATYGKAFEEIVALQARRDALISKVTEFGPWTSIALNDVVRSAWRQNDVPLLQMTAATLEALNRSLYFSERFVHSDDFAAYDTAQAALAEAVTLNEAAAKAAKNELQKKRLMGAGQLMQNYTARLGDMKDVLQASGNIRQTQLSVLAPKISGGFKDLQATVTGAQKTLDGSVDATVASATSTTLIISGLLIVIGLVLSYFVGRLISSAVRNMAQSMEQLARGEERIVITGVEHRHELGAMARSLKVFQETGRAKLIAEANAERARLAAEEERLRQEAERLSDAQVMEHAFRQISVGLDALSKGDLTVRVGEVDHRYVRIRDHFNNSVASLEEAVDAVIRAVGTIRSGLAEISTASNDLARRTEQQAASLEETVAALGEVTRGVNGTAEGASRAQGVVATARTNAEKGGEIVARAIDAMTEIQNSSSKIGNIISVIDEIAFQTNLLALNAGVEAARAGEAGKGFAVVAQEVRELAQRSANAAREIKQLISTSSAQVKTGVQLVGESGLSLEQIVEQVTAMNATVAEIAVAAREQATSLREVSAAGDQMDKVTQQNAAMVEETTAAAQSLTHETESLAELLRRFRTGSGRVSEHRHYAMAS

SEQ ID NO: 20424 - DNA, 2149 bp, Rhizobium leguminosarum
  CDS (202)..(2079)
gtggctgctattctccctgaattttcaagaactcagggttcgtaaaggcgtttaattgatcgcggaagtattggtcaactcagaagatcttcgcaaatgaggcgggaccattgtttagttaatactaaattatggaatccggtgcgagatcttacatcagccggcacgccgctcgtcccagctatcttcgaggagacccgcatgaaacgcccgagtatcaagcaagccctgatcttaaagctgtcgatcatcactctgttcatggttagcctgtcctatgtctcgctgagcacgatttcgacgcttcgtgccaataccgagcagatcgggaccttctggatgcagcggcttgtgacggctcgcgagatcaaggatgacttcctcgacctgaaactggtctatgcccagtacctcctggaggatacggcggaggagcggatgatcggacaacaaaaaatcgaatccgccggcgccgcggtcgagaaagtcgtcaccgaatacgaaaggggtgtccgcaccgagcgtggacgcgaactgatcaaccagatgaagccggaactcgccaaatatcgcgcgctggcagagcaaatgatcgcgcttgaaaatgacgggaagacgcctgaagcaatccgtcttttcaaggaaaatatggagccacaagccgagctggtgaacaaggcggtggcggatctggtcactttcattctcagccaggccgaatgctttgtggccgcgagcggtgcttccgcgcaatccgctttcatgctgacggccgcgatcgcagcgctggccgtgcttcttgccgtagccggaatcttatttgcgatatcgggcatcgccaacccaatccgaagcatcgcctcagccatgaggcgcttgtcggatggcgatcttgacagcgatattccctatgccggtcgcgccgacgaagtcggcgaaatggccggcgcggttgaaatctttcgtcagaatgctctcaacgttgtcaggctcgagaagaatccgctgaatcccgcagcgagagcgatgcagcgcgcgccgcaccccagcagcgcgccgaacgcgaggcgggaacaattgcgcttcgcgaccacgacattgggcgaaggtctccggcggcttgcatcaggtgacatatccttccagctttcggagcaatttgcggccgaatacgaagccttgcgcgaagacttcaacgcttcgctccggcaattgggcgcgacgatcggcgcagtgctccagacggtatacagcatcgataatggtactggtgagattgcatctgccgcgcaggatctttccaagcgtaccgaacaacaagccgcctctctcgaggagacggccgcagccctggaagagatcacgtcgaatgtgacgatggcgaccaaacgcaccgacgaggcgcgcaatgtcgccaaagaagccgatatcagtgctcagcggtcggcagcggtcgtctcgcaggcggaaggggccatgcgacgcatcgaggacagttcacagcagatttcgaacatcatcggtgcaattgatgaaatcgcctttcagacgaacctcctggcgctgaatgccggcgttgaggctgcccgtgcgggtgaggcgggcaagggttttgccgttgtcgcccaggaagtccgtgagctcgcccagcgagccgctcaagcggccaaggaaatcaagggctttatacaaaagtcatcagctgatgtggaaaatggcgtgaaactggttcttgaaaccggaacctcgctcaagtcgatcggtgagtacgttgtccatatcaaccaactcatggatgcgattgccacatcggcgcgtgagcagtcgactggacttgccgagatcaacacggccgtcaatcaaatggaccaggcgacccagcaaaacgcggcaatggtcgagcagtcgacggctgctgttgcctcattgtcctccgaggcgggccgcctgcgggatctggtcaaccagtttcaattggacggcgacaaaagtgccgcggacgggcagcgcagcgggcgggcctttgaaggcaataggccaatccacttggtcgcttcgcggcgcgtgacgcaaagatgacgcgcggctgacgtcaggtcagataccgaaagacattgacctggcgcctgggcgatcatcggctcgatcc

SEQ ID NO: 20425 - protein, 625 aa, Rhizobium leguminosarum
MKRPSIKQALILKLSIITLFMVSLSYVSLSTISTLRANTEQIGTFWMQRLVTAREIKDDFLDLKLVYAQYLLEDTAEERMIGQQKIESAGAAVEKVVTEYERGVRTERGRELINQMKPELAKYRALAEQMIALENDGKTPEAIRLFKENMEPQAELVNKAVADLVTFILSQAECFVAASGASAQSAFMLTAAIAALAVLLAVAGILFAISGIANPIRSIASAMRRLSDGDLDSDIPYAGRADEVGEMAGAVEIFRQNALNVVRLEKNPLNPAARAMQRAPHPSSAPNARREQLRFATTTLGEGLRRLASGDISFQLSEQFAAEYEALREDFNASLRQLGATIGAVLQTVYSIDNGTGEIASAAQDLSKRTEQQAASLEETAAALEEITSNVTMATKRTDEARNVAKEADISAQRSAAVVSQAEGAMRRIEDSSQQISNIIGAIDEIAFQTNLLALNAGVEAARAGEAGKGFAVVAQEVRELAQRAAQAAKEIKGFIQKSSADVENGVKLVLETGTSLKSIGEYVVHINQLMDAIATSAREQSTGLAEINTAVNQMDQATQQNAAMVEQSTAAVASLSSEAGRLRDLVNQFQLDGDKSAADGQRSGRAFEGNRPIHLVASRRVTQR

SEQ ID NO: 20426 - DNA, 2362 bp, Rhizobium leguminosarum
  CDS (326)..(2200)
gcggccgcaagcgccggcatgccgagcccgaagaggccgtggcggaaaatagctgatctccctggcgcgatggaagcacttttcccacagcggttcgcaaagctcgacgcaggcgcgccagactgaaatgacccgcgtgttctccggcataccattctactttatgatttattcacatatcaaatacacactgcgtttgcgcgttttgggttgcaatccggacatgggcatgagggctcgtgatgtgaccgtcagcgcggatgcccgtattgagacgccggtcgggaacatgtccgactgatccgcaattctaggccgccgcggaatgttccaatttttgaaaacgatgcctctgacagccaagctggcggcgattatcgttgccgtcaatctctgcggcatttccgctttcgccacctatacctggatgtacgaaacccgggcattgatcgatggcgccaaggcgaactggtccaaggatgcggagcagtgtgcatctctggccgccggcggcgtgaaatgggggaaggcgaacgccgctcgaaaggcttattcgctctaccgcgacgacccctcgctcgatcttgtgcagtttgccgcattcaacgccgaacctgccgccgtcgatacatggacacgcgacggcatcagcggtttgcccacaccgggagacctggcgacgcgccttagtgcgaagccggaaaaaacgacgattgatgacagtggaatatccgctggcgtggtcacgatcatcgcgccgcttccgctggacaagtcaggcaaggccgccggttacatcgtcacgaattggtctgtcgaaaaaatcgctgccgaagtcaggcagaaggttctcatttcgctgctcacgcagtccgtgatcaccgccttggccgtcatcgccttccttctcgccatgcgcagcctggtcggccggcccatcagggtgatcagcgaacgaatcagcgcgttgcagaaaggcgatctggcctctcctgtcacctataaggaaaatggcgacgagatcggctttctggcgcgcgcgttggaagttttccgtcatgaagcgatcgcgaaggtcgaaagagagcaggccgctgccgagcagagcgcttcgctcgacgccgaacgggcgcgcaacgcattgttcacggaagaggccagcaacacccagcggctggtcatgaccgcccttgcaaactcactggaaaagcttgccgcaggcgacttctcgatacacctggccgatctcggtcctgaattcgataaattgcggcaggatttcaacaacatggtcgaagcggtcgcggctgcgctgacagagatcaagaccgcctcggtcgcggtcgaaggcgggtcgagcgagctggcatcctccgccgatcaactcgctaggcggaccgagcagcaggcggcagcattggaacagaccgccgcggcactggatgaggtgaccaccacggtcagaacatcgtcgcagcgagccgaaaatgccggcaagctggtcgaggaaaccaagcggagcgctcatgtctcggcaacggtggtgcgtgatgcaatcggagcgatggaccggattcagacctcgtcgagtcagatcggccgcatcatcggcgtcatcgacgaaatcgccttccagacgaacctgctggcgctgaatgccggcgtcgaggcggcgcgcgccggtgaggccggcaagggttttgcggttgtcgcgcaggaagtgcgtgaactcgcccagcggtcggcaaatgcggcaaaggaaatcaagaacctgatcaacgtttccggccaggaagttgccgcgggcgtcgggctggtgaacgaaaccggcgacgccttgctgaagatcgaggagcagatcaaccgcatcagcgacagtatcgcttccatcgtccagtcctatcgcgaacaagcgacaggtctgcaggaaatcaacggcgcgatcaaccagatggatcaggcgacacagcagaacgcggcaatggtcgaggaaacgaacgcggcctgccaggaactgctgcagcagggacgccttctgcaggactcggccggcaggttcgtcgtcggcgcgtcttcagccagccagcccagacccatgcaacccgcccgccaatctcctcccgagcccagagccttcgtgcagcggcatgcaggaaatgccgccgtcgccgctgctcccggtgcctgggaggagttctaacgtcatcctcgttcgataagccttatgccgcagcaacccataatcaggaaggaaacactatgaagaaaatcgtgcccgcatttcttttggcctgcaccgcatttgccgtgcccatgggcgcatccatggcacaggatgccaagcttgccccgatcttcgact

SEQ ID NO: 20427 - protein, 624 aa, Rhizobium leguminosarum
MFQFLKTMPLTAKLAAIIVAVNLCGISAFATYTWMYETRALIDGAKANWSKDAEQCASLAAGGVKWGKANAARKAYSLYRDDPSLDLVQFAAFNAEPAAVDTWTRDGISGLPTPGDLATRLSAKPEKTTIDDSGISAGVVTIIAPLPLDKSGKAAGYIVTNWSVEKIAAEVRQKVLISLLTQSVITALAVIAFLLAMRSLVGRPIRVISERISALQKGDLASPVTYKENGDEIGFLARALEVFRHEAIAKVEREQAAAEQSASLDAERARNALFTEEASNTQRLVMTALANSLEKLAAGDFSIHLADLGPEFDKLRQDFNNMVEAVAAALTEIKTASVAVEGGSSELASSADQLARRTEQQAAALEQTAAALDEVTTTVRTSSQRAENAGKLVEETKRSAHVSATVVRDAIGAMDRIQTSSSQIGRIIGVIDEIAFQTNLLALNAGVEAARAGEAGKGFAVVAQEVRELAQRSANAAKEIKNLINVSGQEVAAGVGLVNETGDALLKIEEQINRISDSIASIVQSYREQATGLQEINGAINQMDQATQQNAAMVEETNAACQELLQQGRLLQDSAGRFVVGASSASQPRPMQPARQSPPEPRAFVQRHAGNAAVAAAPGAWEEF

SEQ ID NO: 20428 - DNA, 2220 bp, Agrobacterium tumefaciens
  CDS (1)..(2220)
atgagaaatctgggactggttctaacgaccgcactacgatcgctgatgacgctaacggcgcgggtcggctttctgatcgataggatgttgtcgcgctacacgatccgcacaaaagtacttttgtttgtatttccctttgttctcagcatttcggccgtgggttttgtcggactgttcgcatccgggctactacaagggcggatggagatatccaacagcgttttgcagtcgctgtccgggttcaagaatcttagcgcttcaatggatgggtttttgcgcgccccaagcgagggcgcgcgggacaccctcttatctcaaattaaatcacaagcgtccgatttgattagcctatcgcaggagatcggaagcggaaacgagagccacgccgacctccaaaaagcggcaaaagcgaccgcggatgttgccgctatcgttgaagatctctggacgctgtatgacctggaaacgaaatatcgtgccgcgatcaaatctgctcagagcggcattatctctgttcgcttcaacttaagcgcagttacccaggaaatgcaggattctctgcttggttggaacaacgatgccacagcagttcttcccatgctccagcaaacgcggaatttggaagaatcgatctcttccttgcaactgatcctgggtgagttcacgtccaaggccgatggtgagaatttagttcgtttgcgtcaagagatagccagacttagtaaaagcatcacggcgctcaagcaaaaatcacaagaaaacgatgtggctaccgatatcgaagccgcaatggaggggccagttgcagacttggaggtgaacggctccaagctggtcgagacccttgataagcgtgatctctcttatattgaagcccgcactcagcttgatgagatttggaatcagctcagcacttttgcagagggtgagaaacatcgagccagtggcgaacgtggtcaggcaaattcaatctcgatcattgcaatcatttttggagttgccttctctgtcatcgggggtatcgcattgaccctcacgttgcagcggccaatcggcgagattaccgcggccatgcggcgtatcgccgacggtgcccttgacactagcatttccagccaaaagcgctccgacgaaatcggcgatatggcccgagccctcggcatcttcaaggaaaatgcaatctccaagatccgtatcgaggagcagagcgaggaagagcggagagccgcagatcaggagcggcagcgcaacgacgccgaaaagcacgaattggatcgccagattgaatttgcggtcaacgaacttgcgggcggtctagggcgcatggcgcgaggcgatatttcctcgacaattgacacaccctttatcggtcgcctcgagcaacttcgagaagacttcaatcgatcgatgctccgccttcaggcgaccatgagggatatccgtaacaatgttgaaatgatccagtctaacggcagcgagatggcgcagtccgcaggagatctcgccaaacgcacagagcagcaagcggcgtccctcgaagaaacggccgcagccgtcgaccagattacggtaaccgtccgatcttcagctgaacgcgccaaagatgttgctctcatcgtccgacaggccaaagttagcgccgacgaatccgcggtagtcgtcaccaatgctactgacgcaatgagccgcatagaagacgcctcgcgtcatatcgagcagattatcggcgttatcgacgaaatcgcgtttcagaccaacttgctcgcgctcaacgccggtatcgaagccgctcgggcgggtgagtcaggcaagggatttgcggttgtagccatggaggtccgcgagttggcacagcgctccgctgcagctgcgggtgagataaagggcctgatcaacaaatcgaccagcgaggtcaccacaggttctctattggtccaggaagccggcaaagcactcgccaacatcagcagccaaatcgtcgttatcagtcagcatgtcgagatgattgctcgcgcaagccacgaccagtccagcgccctgcaggaagtcaattccactatcactcagatcgaccagatgacccaccagaatgctgcaatggttgaggagacgacagctgcaagcatggccttggccgccgaagcagacacgctcacgacgctgatttcgcacttccaactcaagggaaatgcaaaatctgtcgccgaccgcgctgcatag

SEQ ID NO: 20429 - protein, 739 aa, Agrobacterium tumefaciens
MRNLGLVLTTALRSLMTLTARVGFLIDRMLSRYTIRTKVLLFVFPFVLSISAVGFVGLFASGLLQGRMEISNSVLQSLSGFKNLSASMDGFLRAPSEGARDTLLSQIKSQASDLISLSQEIGSGNESHADLQKAAKATADVAAIVEDLWTLYDLETKYRAAIKSAQSGIISVRFNLSAVTQEMQDSLLGWNNDATAVLPMLQQTRNLEESISSLQLILGEFTSKADGENLVRLRQEIARLSKSITALKQKSQENDVATDIEAAMEGPVADLEVNGSKLVETLDKRDLSYIEARTQLDEIWNQLSTFAEGEKHRASGERGQANSISIIAIIFGVAFSVIGGIALTLTLQRPIGEITAAMRRIADGALDTSISSQKRSDEIGDMARALGIFKENAISKIRIEEQSEEERRAADQERQRNDAEKHELDRQIEFAVNELAGGLGRMARGDISSTIDTPFIGRLEQLREDFNRSMLRLQATMRDIRNNVEMIQSNGSEMAQSAGDLAKRTEQQAASLEETAAAVDQITVTVRSSAERAKDVALIVRQAKVSADESAVVVTNATDAMSRIEDASRHIEQIIGVIDEIAFQTNLLALNAGIEAARAGESGKGFAVVAMEVRELAQRSAAAAGEIKGLINKSTSEVTTGSLLVQEAGKALANISSQIVVISQHVEMIARASHDQSSALQEVNSTITQIDQMTHQNAAMVEETTAASMALAAEADTLTTLISHFQLKGNAKSVADRAA

SEQ ID NO: 20430 - DNA, 2379 bp, Rhodobacter sphaeroides
  CDS (1)..(2379)
atgaaccgcaccgacccttcgcgcttatggcgcttcaagcagcctctggtgcttctgggtacgcccttgcccatgttgctcggcatcgcaaccgcgctctggctcaaccacgaaggggcgctacgcgcgacggaacaacagacgcaggccttctccaggctgattgcggccgaagggcgcgcggcccttgccttccgcgatggtcatcgtctgtcgcaactgttcggcacggccgccgcaacttatccgggcgaaaccttctcggctctcgcgatggatgtggaggggcgcgtcattgcctcgatgccggcggatctggccggcgccgagaacctgcaggcccaagcgctgagcgcaatgaccgcgggggctcccgtgaaggccaagggcggcacctccattgccatcccggtcacccgcgagggggacgactctctcgccggcgtctttgccgtgtccctgcccgcgctgaatggctcctacgcattgctgatgccggcaaccgcactggtcgcgggcttgataatctcaatggggattgcgggacatctctggaggcgccggaaagagaccgagcggctgctcatcgagacgacccggcggatcaagaacaaccagaggcccgacgccaccgccatgacgcggatcgagctgtcgatcccaacacttgcgaacgagatcgatgccctgtccgccgctctgcagggcgagcgggagcagttcgaggccgcgcatagccgagccatggcactcgacgccctcccagccccctggatcctcgtcgccagcgatggtcgcgtgctcatgatgaaccaccccgcgcggcaggtggttgcgggcctgccggagccacttctcgaaggtcaaccggttgcaagtcttcaccatgatctcgcacgggcttggccggaccgcacaggcaggacgatgtccctggcgatcgggggacgccaatatcaggtgacccgggctcccgtcggcgcaacgggtgccgaggtccttagtttcaccgaccggactgaagagacacaacttgatctcctcctccaaggggtcattcgcgaagccatcgctgcgacttatgacatcagaggtcagatgataaaggcgagcgacggctttgcgaagctcttcggatcctcgggggcctcgctgcgctccctgctcgaggcaacgccggacagtgccgaactccttgctgcggtcgaacgggaaggcgaagggcgcagtttcctgagcagggagggctatggttcagaccaggtgcaggtcggcatctcgatcctgcgacgaccgggcggcggccacttggtcctagtgacggagatccgccaccagtacgcgcaggcaccgacgactgccgctgcggaccagcctccgccggcacctgagcggctgatttcagcgcttcggcagcttgcccaaggtgatctcggatcccgtctggatcatccgcttcccgaacccttcgaagccctgcgcccggacttcaacagcgccctgcaagggctcgcctctctcgtcgaagacgtgatctctgccgctgagagcatccgcaacgaagcccgagacatcagttccgctgcacaatctctggctcaaagaacggaaagcaccgccgccactctggaagagacagcggcagcgcttgacgggctgacagtttcggtccggtccgctgcggacggcgccgcagaagcagatcgggtggtcgccgacgcgcgggcgaacgccgaggagagcgggcatgtcgtcgttgagacagtggctgcgatggacatgattgccgcctcatccgacaagatcacctcgatcgtgaaagtgatcgacgacatcgcgtttcaaacaaatctgttggcgctcaatgccggcgtagaagccgccagggcaggagacgccggccgcggatttgcggtcgtcgcctccgaagtgcgggcgctcgctcaaaggtcttccgaagctgcgagagagattacggacctcatcctgaagagcggcaatcaggtgcggcgcggcgtggatctggttgggaagacgggtgatgcgctgaagcagatcgtatcctcggtttccgaaatttcgactctggtctcggatatcgccgtgtcctcgaggcagcagtctgtgtctctcgcggagatcaactgcgcggtgaacaacctcgaccagtcaacccagcagaatgcggcgcgtctcgaggaggcgaccgccgcaagcgagtcgcttacgacgagcgccaacgcgctcttcgagacggtgcagcagtttcacctggacgctcctcctaagcgcaaccgccccacaccccccctgacagcggcgacgccacataactccagggcgctcgcgcgggcagagcccggatgggaggacttttga

SEQ ID NO: 20431 - protein, 792 aa, Rhodobacter sphaeroides
MNRTDPSRLWRFKQPLVLLGTPLPMLLGIATALWLNHEGALRATEQQTQAFSRLIAAEGRAALAFRDGHRLSQLFGTAAATYPGETFSALAMDVEGRVIASMPADLAGAENLQAQALSAMTAGAPVKAKGGTSIAIPVTREGDDSLAGVFAVSLPALNGSYALLMPATALVAGLIISMGIAGHLWRRRKETERLLIETTRRIKNNQRPDATAMTRIELSIPTLANEIDALSAALQGEREQFEAAHSRAMALDALPAPWILVASDGRVLMMNHPARQVVAGLPEPLLEGQPVASLHHDLARAWPDRTGRTMSLAIGGRQYQVTRAPVGATGAEVLSFTDRTEETQLDLLLQGVIREAIAATYDIRGQMIKASDGFAKLFGSSGASLRSLLEATPDSAELLAAVEREGEGRSFLSREGYGSDQVQVGISILRRPGGGHLVLVTEIRHQYAQAPTTAAADQPPPAPERLISALRQLAQGDLGSRLDHPLPEPFEALRPDFNSALQGLASLVEDVISAAESIRNEARDISSAAQSLAQRTESTAATLEETAAALDGLTVSVRSAADGAAEADRVVADARANAEESGHVVVETVAAMDMIAASSDKITSIVKVIDDIAFQTNLLALNAGVEAARAGDAGRGFAVVASEVRALAQRSSEAAREITDLILKSGNQVRRGVDLVGKTGDALKQIVSSVSEISTLVSDIAVSSRQQSVSLAEINCAVNNLDQSTQQNAARLEEATAASESLTTSANALFETVQQFHLDAPPKRNRPTPPLTAATPHNSRALARAEPGWEDF

SEQ ID NO: 20432 - DNA, 1647 bp, Erwinia carotovora subsp
  CDS (1)..(1647)
atgaagaatatgagtttgggaaaaatgttaggaacaggctttacgctaattatcgttattgggttcttagtcgccatattgggtcgcgttcagctagaaagactaggcggaaacattcagcttctgtcacaaatacgtattaccaatcttctgctaatgcaggaagttaaagacaacgtcaacgacacagcacgcgccatcagaaacatggcgcttctaaacgatcaacagcagatgaagacggaaaaggagcgcattgagaaatccatcgctcgtaataacgatttgctggcgcaaatacgtaaaaacacggtgagcagcgagactaaagtgcaggttgccacgctggaacaggctctccccgcctatatcaacaacatgaaaaaagccattgaactagctatgactaaccagcacgaggcgtttcgcaactttctgctgacggaggtacgcgccgcgcaggcgaacgtattcaccgcattggataaaatggttgagagacagaaagacctcacggtcgagctcgccaatcaatccgagaaggaagcgttaaatgccggtaccttaatgttgattattgctctttgtgcctccttactgggaggtgttgttgcctggtggatcactcggaaaattaaacgccaactgggtggggaacccgcttatacgctggagattacccgtcaggttgcacaagggaatcttgccatcgccattgaacggcgcaatggagataccaccagcgttctcgctgcaatggaggacatgcgccaaagcctgagtaatatcgtcggacaagtccatcaaagcagcgaatctatcgccacgggagccaaccagattgcgatgggcaacaccgatctgagccagcgcacggaagaacaggccgccaaccttcaggaaaccactgcctctatggaagagatgaacaccacggttaaacagaacgccgataccgtgcgcacggctgcacagctcgccaactcagccagtgccgctgctcgtaaaggaggcgatgtcgtcagcaatgttgtacggaccatggaagagatcaccgcaagctcacgtaaaatcggcgatattattggcgtgatagacggcattgctttccagaccaatattctggcactcaacgccgccgtcgaagccgcacgagccggagaacagggacgcgggttcgcggtcgttgccggagaagttcgctcactggctcaacgttccgcttctgcggctcgtgaaatcaaagacctgattggcatcagcgtaggaaaagtcgaaacgggtggtctgctggttaacgaagcaggggtgaccatagcagaagtcgtggatcagtcgcagcgcgtcgccaaccttattaatgagatcggcctgactacgcatgagcaggaacagggcgtttctcaggtcaatgacgcagtgaatcagctcgatcaggtaacccaacaaaatgccgcgctggttgaggaatccgcttctgccgcagacagcctgagccaacaggccagaaatctggttgaattgatgggcgtgttcaaaatcgacggtacccagtcacagcgagccgtaccgcaggtgactacactctccagaccgaaattggcattagccggtaattcgagtaacacaaactgggaaaccttttaa

SEQ ID NO: 20433 - protein, 548 aa, Erwinia carotovora subsp
MKNMSLGKMLGTGFTLIIVIGFLVAILGRVQLERLGGNIQLLSQIRITNLLLMQEVKDNVNDTARAIRNMALLNDQQQMKTEKERIEKSIARNNDLLAQIRKNTVSSETKVQVATLEQALPAYINNMKKAIELAMTNQHEAFRNFLLTEVRAAQANVFTALDKMVERQKDLTVELANQSEKEALNAGTLMLIIALCASLLGGVVAWWITRKIKRQLGGEPAYTLEITRQVAQGNLAIAIERRNGDTTSVLAAMEDMRQSLSNIVGQVHQSSESIATGANQIAMGNTDLSQRTEEQAANLQETTASMEEMNTTVKQNADTVRTAAQLANSASAAARKGGDVVSNVVRTMEEITASSRKIGDIIGVIDGIAFQTNILALNAAVEAARAGEQGRGFAVVAGEVRSLAQRSASAAREIKDLIGISVGKVETGGLLVNEAGVTIAEVVDQSQRVANLINEIGLTTHEQEQGVSQVNDAVNQLDQVTQQNAALVEESASAADSLSQQARNLVELMGVFKIDGTQSQRAVPQVTTLSRPKLALAGNSSNTNWETF

SEQ ID NO: 20434 - DNA, 1671 bp, Erwinia carotovora subsp
  CDS (1)..(1671)
atgcagcgtacaaaaaaaatgaaactgggtacccaggttggttcagggtttgccattgttattattatcggcctattggtggccatcttcggtagaacgcatctggttggcctcgggaatacgactgacaaccttgccaaaaaccatcttgccaatcttatcgtgctgcaagaattgaaagacaacctgaacgtgacgatcaaagccactttgcgcatgcttatcacaacggaaaaaaaggttctggaggacaatcaaaaactgattgaaaccacgagcgccagaaacgcaaagctagtcactcagctggaagaaaatttacaagcaaaagaggttcgcaatattctgggtgaacttcagcaaaatcgtactgaatttgccaccgtgggccgtcagtccgttgccctgtcgctcaacaataaacaggcagaatccatcgagttagtcagaacccagcttgagccgatacaaaccaagctttttaacaacctgaacacgatgattcagttgcagaaagactacaccacgcaaaccgcaaccaatgcgattgaagagtcctactatgatggcaattcactgctgatactggctggcatcgcctcattgatcggtgtgtgcatcgcctggctgattactcgtcacatcaagaagcaattgggtggtgaacccgcctatgccacgcaggtaacacaggaaatcgcgcagggcaatctcgctataccgattgaactggcggcaggcgacacgagcagcctgttgtctgcgatgaatcacatgcgcaaaagtctgggtggtattgttgagcaggtgcgtgaaagcagtgaatctatcgcgaccggtgcaggccagatcgccgcaggcagcaccgatctcagccagcgtacggaagaacaggcggctaacctgcaacaaaccgcagcctccatggaagaaatgagccaaaccgtacgccagaactcagataccgtacgtaacgccgctcagctggcacaggccgcgagcaataccgccgctaaaagcggtgaagctgtcagcaatatcgttgtcaccatgaaagagatcagcgatagctcgcacaaaattggcgacatcatcagcgttatcgacggtatcgccttccagaccaacattctggcgctcaacgccgcagtagaagccgcacgagcaggtgagcaaggccgtggttttgccgtggtagcaggtgaagttcgctcgctggcacagcgctccgcaaccgccgccaaagagattaaagagctgatcggccacagcgttgagaaagtcgaggtgggttccgtactggtcagcgatgcgggaacgacaatcgaagaattggtacgtcaggcgcgccacgttgccgatctgatcaacgaaattggcgtcaccacacaggagcaagaatccggcgtttcgcagattcatgatgccatcactcagctcgatcaggtcacacagcagaatgcggcacttgttgagcaatccacatccgccgccgatagtctgagcgatcaggctgctcatctggtagagctgatgaaagtcttcattgttgaaagcgggtcgtcacagcgcactacgccagagttgaaaagaccctccagtgcaaagctctctctcgcaagccctaaaggcagaacaaaaagcgatagccaaaactgggaaaccttttaa

SEQ ID NO: 20435 - protein, 556 aa, Erwinia carotovora subsp
MQRTKKMKLGTQVGSGFAIVIIIGLLVAIFGRTHLVGLGNTTDNLAKNHLANLIVLQELKDNLNVTIKATLRMLITTEKKVLEDNQKLIETTSARNAKLVTQLEENLQAKEVRNILGELQQNRTEFATVGRQSVALSLNNKQAESIELVRTQLEPIQTKLFNNLNTMIQLQKDYTTQTATNAIEESYYDGNSLLILAGIASLIGVCIAWLITRHIKKQLGGEPAYATQVTQEIAQGNLAIPIELAAGDTSSLLSAMNHMRKSLGGIVEQVRESSESIATGAGQIAAGSTDLSQRTEEQAANLQQTAASMEEMSQTVRQNSDTVRNAAQLAQAASNTAAKSGEAVSNIVVTMKEISDSSHKIGDIISVIDGIAFQTNILALNAAVEAARAGEQGRGFAVVAGEVRSLAQRSATAAKEIKELIGHSVEKVEVGSVLVSDAGTTIEELVRQARHVADLINEIGVTTQEQESGVSQIHDAITQLDQVTQQNAALVEQSTSAADSLSDQAAHLVELMKVFIVESGSSQRTTPELKRPSSAKLSLASPKGRTKSDSQNWETF

SEQ ID NO: 20436 - DNA, 1680 bp, Erwinia carotovora subsp
  CDS (1)..(1680)
atgaattttttagcaaaaatgaagcttggcacgatgctgggttctggcttcgcctctgtcatcatcatcggtttgatggtcgccgttctgggacgcgtgcatctgctcgatctgagcgaagatattgagtcgctgtccgaaaaaaatctgaccagcctgatcctgatacaggatgccaaaagcggttttgatgccgtggctcgttcggtgcggactatcggcctgacaagcgacagcagccgtattcaggaagaaaagcgcttgatcgatcagcaaattgccctcaataccgacatcctgaccaaactgtattctcacctgtctgaaccagaatctcgcgactcgctggaccgcctgacgcaggctcgcccagcctatcgggacgcggtgaataaggccgtagaacttggcgtgtctgaaaacgccgaagaaagagcgcgagccgtgcagctcatggtcaatgaaatgcaaattacgcaggcacccgttttcgccgcgctagacagcatgaccgaattgcagaagaagcggacgatggagatgacgacaagcgccatgcaggaagctcgctcagatggtaacaccctgatcttctacgcagcgattgcggttctcgttggtattctggtttccgtgctgattacccgtaccatcaaaggtttattgggtggagaggtgacctacgccgcacagatcgcccaagcggtcgcacaaggaaatctggcagtaaccgtcaacctgcgtcccggtgatgaccacagtgtgctggcagcaatgaacggtatgcgcaaaagcctaagtagcattgtcgagcaggtgcgcgaaagcagtgaatctatcgcgaccggcgccagccagatcgccgcaggcagcaccgatcttagccaacgcacggaagaacaggcagccaacctgcaacaaactgcagcgtccatggaagagatgagccagaccgtacgccagaactcggataccgtacgtaacgccgctcaactggcacaggccgccagtagtaccgccgctaaaggcggtgaagccgtcagcaatatcgttgtcaccatgaaagaaattaccagcagctcgcaaaaaattggcgacatcatcagcgtcattgacggtatcgctttccagaccaacattctggcgctcaacgccgcggtggaagccgcacgagcgggtgagcagggtcgtggctttgccgtggtagcaggtgaagttcgctcgctggcacagcgctctgcaaccgccgccaaagagattaaagagctgatcggccacagcgtcgagaaagtcgaagtgggttctgcgctggtcagcgatgcgggaacgacgatcgaagaattggtgcgtcaggcgcgcaatgttgccgatctgatcaacgaaattggcgtcaccacgcaggagcaagaatctggcgtctcgcaaattcatgatgccgttaaccaactcgatcaggtcacacagcagaacgccgcactcgttgagcaatccgcttccgctgccgatagtctgagcgatcaggctgcccatctggtagaactgatgaaggtcttcatcgttgaaggcgggtcgtcacagcgtattgcaccaccgctgaaaagaccttccagcgcaaagttctctctcgccaaccctaaaggcagcgcgggaagcaataaccaaaactgggaacagttctga

SEQ ID NO: 20437 - protein, 559 aa, Erwinia carotovora subsp
MNFLAKMKLGTMLGSGFASVIIIGLMVAVLGRVHLLDLSEDIESLSEKNLTSLILIQDAKSGFDAVARSVRTIGLTSDSSRIQEEKRLIDQQIALNTDILTKLYSHLSEPESRDSLDRLTQARPAYRDAVNKAVELGVSENAEERARAVQLMVNEMQITQAPVFAALDSMTELQKKRTMEMTTSAMQEARSDGNTLIFYAAIAVLVGILVSVLITRTIKGLLGGEVTYAAQIAQAVAQGNLAVTVNLRPGDDHSVLAAMNGMRKSLSSIVEQVRESSESIATGASQIAAGSTDLSQRTEEQAANLQQTAASMEEMSQTVRQNSDTVRNAAQLAQAASSTAAKGGEAVSNIVVTMKEITSSSQKIGDIISVIDGIAFQTNILALNAAVEAARAGEQGRGFAVVAGEVRSLAQRSATAAKEIKELIGHSVEKVEVGSALVSDAGTTIEELVRQARNVADLINEIGVTTQEQESGVSQIHDAVNQLDQVTQQNAALVEQSASAADSLSDQAAHLVELMKVFIVEGGSSQRIAPPLKRPSSAKFSLANPKGSAGSNNQNWEQF

SEQ ID NO: 20438 - DNA, 1572 bp, Erwinia carotovora subsp
  CDS (1)..(1572)
atggggttgaaaaatatttctattcgtaccggcttattaacgttgttgctgctaaccaccctgttgctgcttatcgtcagcggcatgggcgtggttgccattaagaaagacagggaaacgctgacagcacaaaaccagattcaaggcattgagctgggcaatctgatgagtggctataaccaaacgctcagcgcgcgcgcctctgcaacgctcgccgtcaggaaaatcgaaatcggcctgctggacgacggcgttaaggaaactgggctcgtagaaaaacatctccgccagtcacaggaagacattcaacgcgtgatcaaatcggccaaggccgatccgaagcagcaagcgctggcgcaggaagtgctgaaaacctatcaggcctattttcagcagggcatgaccccgatgctgaacgcgctgcaaaaacagtataccgacgaatattatgaagtcctggaaaaacagctcggcacgctgagtgaagcctttgatttatcgatccaaaatttccgtcagtatgcccagcagctttccgaacagggtctggcacagtccgaacgtaatgaacgcattatgctgttactgattgcgattgccagcctgttatctatcacactggtcgcattagcctgggtcgcactgcggcacatgctgctcaaaccgctggattatgccattgagcagttggagcaggtcgccgctgggaatctgacgcgccgtctgattcaaggcggagacaacgaactgggccgactcaacgatgccataggccgcatgcagggtgcgctgctggagtcggttagccaagtgcgcgatgccagcacgcaaatcgatctcggtagccgagaactgtttgaagaaaacgtccagctctcccaacgtactgaagaatccgttgcagcactggaacaaaccgcggccagcatggagcaattgagcgcgaccgtgaaactcaatgccgatcacgccgaactggcccatcaactcgccaataacgtctcgaacaccagcagccgcagcaacgaatctgtcggttatgttattgaaaaaatgcaggagatcgctaccagcgccaaacgcatcaatgacatcctcagcgtaattgacggcatcgcgtttcagaccaacattctggcgctgaacgcttctgtcgaatctgcccgcgcaggagaacaaggcagaggctttgccgtcgtcgccggagaagtgcgtaatttggcgcagcacagcgcgaaggcggcgaaagagatccgttcgctgattttggattcccagacgcgcgtatctgaaggacttgagctggcttccaaagcgggtgaaaccatggacgacgtgaccgatgaaatcatccgtattacgcaactgatgcgagacatttctaccgctacgcaagaacagcatcgcggtatcgagttggtgaatgtcgccttcacgcagattgacaaggtcgctcagcacaatgcgcaactcgtcaaagcctcatccgcgactacgcagtcgttggagcagcagtctcaacagctaatgcggtccatggcgctgtttcaggtagaacctcgcctttcctaa

SEQ ID NO: 20439 - protein, 523 aa, Erwinia carotovora subsp
MGLKNISIRTGLLTLLLLTTLLLLIVSGMGVVAIKKDRETLTAQNQIQGIELGNLMSGYNQTLSARASATLAVRKIEIGLLDDGVKETGLVEKHLRQSQEDIQRVIKSAKADPKQQALAQEVLKTYQAYFQQGMTPMLNALQKQYTDEYYEVLEKQLGTLSEAFDLSIQNFRQYAQQLSEQGLAQSERNERIMLLLIAIASLLSITLVALAWVALRHMLLKPLDYAIEQLEQVAAGNLTRRLIQGGDNELGRLNDAIGRMQGALLESVSQVRDASTQIDLGSRELFEENVQLSQRTEESVAALEQTAASMEQLSATVKLNADHAELAHQLANNVSNTSSRSNESVGYVIEKMQEIATSAKRINDILSVIDGIAFQTNILALNASVESARAGEQGRGFAVVAGEVRNLAQHSAKAAKEIRSLILDSQTRVSEGLELASKAGETMDDVTDEIIRITQLMRDISTATQEQHRGIELVNVAFTQIDKVAQHNAQLVKASSATTQSLEQQSQQLMRSMALFQVEPRLS

SEQ ID NO: 20440 - DNA, 1941 bp, Erwinia carotovora subsp
  CDS (1)..(1941)
atgttgggactttcctttaaacactggggtttgggtatcaagttatcaattatcgcctccctgagcgtggcgatattgttcattgccttcactctcacccttacccgctccgcaggcgatcaattgaaagcgttgaccctcaacgacatgcagagtcaggtgaatggagtcactgacatgatcaacatgtacgataccagcctacaagccgaggtcagcaactatacgcggctgctggcgagctttctgccgacacagttttcactggataccgttaaccgcacccctttcagcaacacctctcacccaacactaaaggctggcgatacggtattgaacctcaacaccgacgtgacggatgactttctgagccgtacccacgcgatctcaacgatttttgtccgcgatggagaggattttacgcgtatcaccacttcactgaaaaaagaagatggatcgcgcgcgatgggcaccaaactcgatcgtgaaagcccagcgtatgcactggtgattaaaggtgaaacctacagtgggttagcaacactgttcggcaaacagtacatcacccagtatcaaccgatacacgatggtgaaaataaggttatcggtattctgttcgtcggcgtcgacatcacgaagcaatttaccgagatgcagcaaactattctgaacaagaaaatgggtgagacaggccatttctttgtacttagcgcgaaaaaaggaaaagatgcaggtaactatctttaccaccaaagcaatgccaaccaacgccctgactggtcagaaggtgcgttagagaaagtgctggcaaccggtaatggtacgatcgaatacgacaacaacacgatgaaaggcgaagaaaaaacccggatcatggtgtaccgcagtattccacaatggaactggattgtggcaggtaccatcagcaaagaaagtctgatggcggaggttaaccgcacccgcaatctgtttttgggcggtggcattattctggttctgctcttcgcggcattctttgtcgtgctgacgcgtaaatggctgagccagccgctggttgaaatcgtcaaagtggcggagcaattttctgccggtaacctgacggccacgctttccagcaatcgcggcgatgaagtcggccgcctgatcgatgcgattaacggcatcggacaggggctaacaacgattgtgtcacaggtcagaagctcctccgaagaaatcagtgccagcaccgatgcgctggctgctgatagcgaaaatatcagtgagcagattgcccgtcaggccagtagcgtcgaagaaacatctgccagcatggagcagctctccgccagcgtgaagcagaacgccgataacgtctctgccgccaaagatctggcggagcagagcgcagccgcagcgcgaaacggcagccagaccgtcaccgattcggtctctacgatgagcgacattaaaaactcatctcagcggattgccgatatcacgacggtgatcgaatctatcgctttccagaccaatatcttggcgctcaatgctgcggtagaagccgctcgtgcgggcgaacacggcaggggcttcgccgtcgttgctgctgaagtgcgagcactggcacagcgtagttctaccgcagtgaaagagatcgaaaccttgattgatgaatcgctggaaaagatcgaagcgggctatcatttctcagaaaaaacgcaggctgtaatggacgacttacgtaaccgcatcctgcaggtcagcaccatcgtgaacgatattgatatcgcctcacgcgagcagtccgctgggatcaaccaggtaaacatcgcgatggtacagattggtcaggcaacgcaggaaaacgccattctggtcaacaattcggaagataccgcgcagagtctacgtcagaaaggccaccatctcagcgagctggtcagcgtcttccgtatttaa

SEQ ID NO: 20441 - protein, 646 aa, Erwinia carotovora subsp
MLGLSFKHWGLGIKLSIIASLSVAILFIAFTLTLTRSAGDQLKALTLNDMQSQVNGVTDMINMYDTSLQAEVSNYTRLLASFLPTQFSLDTVNRTPFSNTSHPTLKAGDTVLNLNTDVTDDFLSRTHAISTIFVRDGEDFTRITTSLKKEDGSRAMGTKLDRESPAYALVIKGETYSGLATLFGKQYITQYQPIHDGENKVIGILFVGVDITKQFTEMQQTILNKKMGETGHFFVLSAKKGKDAGNYLYHQSNANQRPDWSEGALEKVLATGNGTIEYDNNTMKGEEKTRIMVYRSIPQWNWIVAGTISKESLMAEVNRTRNLFLGGGIILVLLFAAFFVVLTRKWLSQPLVEIVKVAEQFSAGNLTATLSSNRGDEVGRLIDAINGIGQGLTTIVSQVRSSSEEISASTDALAADSENISEQIARQASSVEETSASMEQLSASVKQNADNVSAAKDLAEQSAAAARNGSQTVTDSVSTMSDIKNSSQRIADITTVIESIAFQTNILALNAAVEAARAGEHGRGFAVVAAEVRALAQRSSTAVKEIETLIDESLEKIEAGYHFSEKTQAVMDDLRNRILQVSTIVNDIDIASREQSAGINQVNIAMVQIGQATQENAILVNNSEDTAQSLRQKGHHLSELVSVFRI

SEQ ID NO: 20442 - DNA, 1536 bp, Erwinia carotovora subsp
  CDS (1)..(1536)
atgagattgaatacacctgtaacacagcaggagtatctgttagacatggacaccatattgatgtccacaacaaatattcacagccacattacctatgccaactctgccttcattaaggttagcggtttttctgaagagcagctcatcaaccagcctcacaatattgtgcgtcatccagatatgcccgttgaagcctatgccgacatgtggtttacgttgaaacaaggtgatagctggactggattagttaaaaatcgtcgtaacaacggcgaccactattgggttcgcgccaacgttacaccggtttaccagcaagagcagcttgcgggctatatctcggtacgtaacacgcccaatgccgaagaaataaaagcggccgaaatgctgtatagcgccgtgcagaaaaaacaggcgggcagccgcaagttctataaagggctggtcgttcgcaccggactcttttctccgctgtcgctcttacaaaaattgtcagtccgttggcgcttgcgtatcgcggtattggctgtggggctgatccctgcactatgtgctttcagtggaatgaatccgctatggctattggcactgacgctgttactcatcgtcatcatggatcagtttctgcaaaagcaaattgcacagccaatcaggatgatactcaagcaggctcagcatgtcgtatccggtcgtaaagtaaaccatacccatatgaatcgggtagacgaaattggcctgctgctacgctccgtcaaccagtttggcttgaacctacactcgcttgtcgatgacgtcagtacgcaggttaacggcatcaccaatgtcagtcacaaactggcagaaaacaatgtcgacctgaatacgcgcacagaagaaacatcagcaaatctgcaacaaaccgccgccgccattgaagaaatcaccgttgccgtacaacaaagtgcagaaacggcggcacaagccacaacaatggcacaagcagccagcagtaccgcccttaaaggtggcaatatcatgaaggaaaccatcggcatgatggattccatctccagcgccagcgataaaatcgttgatatcattggcgtgatagacagtattgccttccagacgaacatccttgcgctgaacgcagcggttgaagccgcccgtgctggcgtgcagggacgggggtttgccgtggtggccgctgaagttcgcaatctggcacagcattccgcctctgcggccaaagagattaaaacgttgattgacaccaacgtagaaagcgtgaaaaaaggcagcacaatggtagagaacgcgggcaaacatatcagcgacatcgttgatgaagtcttgcaggtctccaccatgatcaaagagatcagcaacgcaacgcatgagcaaacttctgcactgggcctgatcaatacctctattgcacagatagaacaaatgacgcagcgcaataccgatatggtcacgcactcaacagaagccgcagaagggctaaacattcaggctaagcgactgaacagcgcgattaacgtgtacggtagttaa

SEQ ID NO: 20443 - protein, 511 aa, Erwinia carotovora subsp
MRLNTPVTQQEYLLDMDTILMSTTNIHSHITYANSAFIKVSGFSEEQLINQPHNIVRHPDMPVEAYADMWFTLKQGDSWTGLVKNRRNNGDHYWVRANVTPVYQQEQLAGYISVRNTPNAEEIKAAEMLYSAVQKKQAGSRKFYKGLVVRTGLFSPLSLLQKLSVRWRLRIAVLAVGLIPALCAFSGMNPLWLLALTLLLIVIMDQFLQKQIAQPIRMILKQAQHVVSGRKVNHTHMNRVDEIGLLLRSVNQFGLNLHSLVDDVSTQVNGITNVSHKLAENNVDLNTRTEETSANLQQTAAAIEEITVAVQQSAETAAQATTMAQAASSTALKGGNIMKETIGMMDSISSASDKIVDIIGVIDSIAFQTNILALNAAVEAARAGVQGRGFAVVAAEVRNLAQHSASAAKEIKTLIDTNVESVKKGSTMVENAGKHISDIVDEVLQVSTMIKEISNATHEQTSALGLINTSIAQIEQMTQRNTDMVTHSTEAAEGLNIQAKRLNSAINVYGS

SEQ ID NO: 20444 - DNA, 1941 bp, Erwinia carotovora subsp
  CDS (1)..(1941)
atgcagcatcttgctagtcgaattcgtaacacaaaaatcgcacataaattgtatgccgggtttgggattattttactacttgtcattattgcgtcatcgcttagcatgaatagattcattgccattcgggatatttatgagaaaacgaaccttatttacaacattaacattgaagttttccaggccaagattaatcgcgttaaatatttctacaccgcagacgaaaaaactaaagacatactcgccgactttgtaaaaagtgcatcaacgttaaccaacagtgccaacacgctttcctggagtgatgaagaattaggttttattaaaaacctgcataataacttagaagatttccaacagtcggttgctgcgatgtctaccgcgacgcaaaaaatggtcggagcacgcgaagccattaatacagaaaatgcaaacacggtcattgataccttccgacaagcgctcagcaatgctctcatcgacggtgaaacctatcatcacgcaagcgatattgcttttctgttaaccgatatgcagcatcggtcctatgagctacagatgaaaggaaccgatagcgccttagccgctctggattcgcgctataaggacgcagaaaaaacctatcagtcattatctccttcattaccagccgacgttaaaacgcaaaccgatacgctatggcgttacattggccaatacatgcagcttaatacggcctattacgcggcattaaatgatgtaaaaaagacagaaaatgacgtgatgaaagcaggtactcggagcagcgccgacatcaaatcactcattactgtcgtaaaagcaaaaaatgatgagctggcctataactctgccaccattacgatgatcatcggtctcatcgccgtcattatcggcatcatcatttccatctacattactcgaattatcaccagacccatcatccataacctgtcgctggcggaacgcatcgccagtggcgacctgaccacgacgattcataccgatcgccacgatgagctgggaaggctcacccacgccatggggacgatgaatgaacagttgcgccacgttatttccgaagtccgggacagcgtcggcagcgtcagccaatcggcgagcaaaattgctacaggcaatagcgatctttcgtcacgcactgagcagcagtcagcggcagtcgttgaaaccgccgccagcatggaagaactcacctcaacggtgaaaaacaatgccgacaacgccaaacatgccagccagatcgctgccgatgcttccaagagcgcgcttaaaggcggcgaggtcgtgaaacaggtggtgacgacgatggacaatatcgcagccagctccagaaaaatcgccgatatcactaccgtcatcaacagcattgccttccagaccaacattctggcgctgaacgccgcggtagaagccgcacgcgccggtgaacaaggacgtggttttgccgttgtcgcgggcgaagtgcgcagtttgtcacaacgtagctctcaggctgccaaagacatcgaagccctgatcgcagaatcggtcgaacgtaccaatgcgggtagccatcttgttgcggttgccggagaaaccatggagcaaatcgtcgattccgtttcccgcgtgaacgacattatgggagaaatttcatccgcctctgaggaacagagtcgaggaattgggcaaatcgcgcaggccatcagcgagctggacaccaccacgcaacagaatgcctcgctggtgatggagtcctccatttccgccaattcgctggaggaacaggcggtgctgttggaaaagttgctggaacacttccgcgtgtcccagtctgacaatcgcgtagcttcacgtgcgtcatcctctataccgcgacacacgctgccaaaaagtgtgtcggcaaaagctgcctcgtcagaaagtgactggacgtcgttttaa

SEQ ID NO: 20445 - protein, 646 aa, Erwinia carotovora subsp
MQHLASRIRNTKIAHKLYAGFGIILLLVIIASSLSMNRFIAIRDIYEKTNLIYNINIEVFQAKINRVKYFYTADEKTKDILADFVKSASTLTNSANTLSWSDEELGFIKNLHNNLEDFQQSVAAMSTATQKMVGAREAINTENANTVIDTFRQALSNALIDGETYHHASDIAFLLTDMQHRSYELQMKGTDSALAALDSRYKDAEKTYQSLSPSLPADVKTQTDTLWRYIGQYMQLNTAYYAALNDVKKTENDVMKAGTRSSADIKSLITVVKAKNDELAYNSATITMIIGLIAVIIGIIISIYITRIITRPIIHNLSLAERIASGDLTTTIHTDRHDELGRLTHAMGTMNEQLRHVISEVRDSVGSVSQSASKIATGNSDLSSRTEQQSAAVVETAASMEELTSTVKNNADNAKHASQIAADASKSALKGGEVVKQVVTTMDNIAASSRKIADITTVINSIAFQTNILALNAAVEAARAGEQGRGFAVVAGEVRSLSQRSSQAAKDIEALIAESVERTNAGSHLVAVAGETMEQIVDSVSRVNDIMGEISSASEEQSRGIGQIAQAISELDTTTQQNASLVMESSISANSLEEQAVLLEKLLEHFRVSQSDNRVASRASSSIPRHTLPKSVSAKAASSESDWTSF

SEQ ID NO: 20446 - DNA, 1935 bp, Erwinia carotovora subsp
  CDS (1)..(1935)
atgttcttagccaaaaaaatcagaaatcttaaaatatcccaaaaactttatcttgggttcggggttatcctgctattggtcatcatagcatcgctactcagcgcagggcgcttcagggaaattcgtgatatctatgagaaaaccaatcttatttacaacatcaacattgaagtctttcaggcaaaaataaaccgtctgaaatatttttactcctatgatgaaaagtcgcgcgaaacgatggcaggcttcgttaaacatgcatcagaattaaccactgaagcgaaaacgctctcatggagcccagaagggttaactctgattaacgacctcagtcagcacctggccgaattccaaagcgcaatcaccgatatgggcaaagctacgcagcgcgtggtagaaaatcgagacaaaatcagcgccgctaacggacagaacataactactgatttctacgccaggctgcgacagcaaccttctgatagcacaacgctatatcaggctgaagatctcgcaacgcaggtttcagaactgaagcaggcgtcctatgaattgcagctcaggcaaaatgccgatgccgcgaaacagttcgatgcggttttaagccgctttgacagcagctatcaggccaccattgcggtgttgacgccggaacagaaagtggctgtagagagcctgcgaagctatgtcaccggctataaaaaactcaataacgactacttccagagtatcaacgacctgaaaaaagcagaagacggcgtgaaggtcggcggggacaaaagtagcgcctccattaaagcaattattactatcgtcaaagagaagaatgacgcgctggcatacggttctgccacgatcacgatgatcattggctttattgctgtggtcatcggcatcatcatctcactgctgattactcgccaaattacccgccctgtcattcataacctctctctggcggaaaaaatcgctgctggcgatctgacctcaacgatcacagtcgaccgcgatgatgagctgggtcagctaacggccgcaatggggagaatgaacgaaaagctgcgccacatgatcagtgatgtgcgtgacagcgtggacagcgtttcaacctctgcggccaagattgccgcgggtaatagcgacctatcctcacgcaccgagcaacaatctgccgccgtagtagaaaccgccgccagcatggaagaactgacatcaaccgttaaaaacaatgctgagaatgccaaacaggcgagccaaatcagtaccgaagcctcacaaaatgcacacaaaggcggcgaagtggtacgaaatgtggtggatacgatgtcgggtatttcagacagttcacggaagattgcggacattaccgccgttatcaacagcattgctttccagaccaatattctggcacttaacgccgcagtagaagccgcgcgagccggggaacaaggtcgtggattcgccgtggtggccagcgaggtacggacgctttctcaacgcacatctcaggctgcgaaagagattgccagcctgatttccgaatcggtggcacggatcaatgtgggaacacagctggtggccaatgcaggaaccgcgatggatcagatcgtttcctccgtctcacgggttaacgacatcatgggggaaatcgcctccgcctccgatgagcaaagccgtggcattgagcaaatttcccgcgccatcagcgagcttgataccaccacgcagcagaatgccgcgctggtgatggaatcctcaatttccgctaactcgctggaagaacagtcggcaatattggaaagtatggtagcgaacttccgtctgtctgagaacgaggggcgtaagccaaaagcgaatatttctggtttgccaccacagcaaaaatatctgccgcctgcagcaaaacaaacgcaggattccggctggacgacattctaa

SEQ ID NO: 20447 - protein, 644 aa, Erwinia carotovora subsp
MFLAKKIRNLKISQKLYLGFGVILLLVIIASLLSAGRFREIRDIYEKTNLIYNINIEVFQAKINRLKYFYSYDEKSRETMAGFVKHASELTTEAKTLSWSPEGLTLINDLSQHLAEFQSAITDMGKATQRVVENRDKISAANGQNITTDFYARLRQQPSDSTTLYQAEDLATQVSELKQASYELQLRQNADAAKQFDAVLSRFDSSYQATIAVLTPEQKVAVESLRSYVTGYKKLNNDYFQSINDLKKAEDGVKVGGDKSSASIKAIITIVKEKNDALAYGSATITMIIGFIAVVIGIIISLLITRQITRPVIHNLSLAEKIAAGDLTSTITVDRDDELGQLTAAMGRMNEKLRHMISDVRDSVDSVSTSAAKIAAGNSDLSSRTEQQSAAVVETAASMEELTSTVKNNAENAKQASQISTEASQNAHKGGEVVRNVVDTMSGISDSSRKIADITAVINSIAFQTNILALNAAVEAARAGEQGRGFAVVASEVRTLSQRTSQAAKEIASLISESVARINVGTQLVANAGTAMDQIVSSVSRVNDIMGEIASASDEQSRGIEQISRAISELDTTTQQNAALVMESSISANSLEEQSAILESMVANFRLSENEGRKPKANISGLPPQQKYLPPAAKQTQDSGWTTF

SEQ ID NO: 20448 - DNA, 1797 bp, Erwinia carotovora subsp
  CDS (1)..(1797)
atgatacaggtcatggttacacgcaaaaaccatggcctcctacccctccgtcaaaagctgaaatattttagtcatttaaccgtgatagtttggccgctattcatctatagagggtcaacaatcatgttaatgcctgcgattttgcgaaacggagttgctactatccgccgccgtcatcgcctcagtattctctctggattgttattgatcattgggttattttctttattgcaattggtttccgtcggcgtcatttctcaaacaatgacccaggttcaacaggatatttctgctaacgagagtctgcgccagcaacaagcgttaatggataaagcgcggatggaagtcatgaatgccagcgacaaacttaaccgcgcaggcatttatctgttggtagacaaagaaaccgggtctgaaggcagctggcacagcctgatggatgaggctgaagtgtctctgaaacaggcaaaagaacattatcagttactggaaacaaccacgacggcggaagcagacacaacagcatttgtcgatctgaaaaagggctacaaccagctttattccgggcttgtcgagttagccgaaggaataaaaaccaccaatcagatcgatattttctttgctgtcccggttcaggcctatcaaagcgattttacccagaagtactcacactatctgcaagataccgatgcgctgcaaaaacagcatggccaacaatttttatcctctctcgatcaagcgaaaacaatctttatcacggtgttggggttattactggcgatcgccattgccgtttggtttggcgttaaccgggtcattattcgtccactggcgcacatcattgcccatttaaaactgatcgcggcgggcgatctttctcattcagtcaatacagagacacgcggaacacgggaagttgaacagctcaataccagcgtcatcctaatgcaggaaggtctggtgaccttggttaatcaggttcgtcagggtgttgatcacatggtgacacaggtcgatcgcgtggctgaggataaccatcgtctttccgagcaggcgaatcgccagtcccacgaactcaaagtgactactgaacacgtcattcaacttagccaacatctcgagcaaaacactcagcatacccagcaggctaatttgcacgcagaagacaccagcaaaatcgccacgcagggtgagacaatgatgaatgacgtcaaggcggcaatgtcagatattgcaggcagaactcgagaaatgacagaagccattgggatgattgaaaatgtagcattccagacgcatatcttgtcattgaacgcagcgattgaagcggcgcgagctggcacgatgggtcgagggtttgccgttgtcgccagagaagttggcaccctggcttcgcaaagcagtcactcagcacaaagtattaatgtgctgattcgtgattcagacaacagcgtaaccgcaggaacacgactggtgaacaaactgaatgacagcctacagaatatcattcagacggcgaaagacacgggcacgttcctgagcgagatctcggagatatcacaccagcagaacgaaagtattcatgaagtgactgcgcgactcagcacgctgaacgacaccgtcagagaaaatgcaggacaggttgaagcctccgctcacaccttcgcctcactgctggagcaaacggaacgcttaaatacttcagtgtcgctgtttatcctgccctcgacagaagctgatgtgaacccgatgattgatcagagagagatgacacagcgcattcccatgatgggatga

SEQ ID NO: 20449 - protein, 598 aa, Erwinia carotovora subsp
MIQVMVTRKNHGLLPLRQKLKYFSHLTVIVWPLFIYRGSTIMLMPAILRNGVATIRRRHRLSILSGLLLIIGLFSLLQLVSVGVISQTMTQVQQDISANESLRQQQALMDKARMEVMNASDKLNRAGIYLLVDKETGSEGSWHSLMDEAEVSLKQAKEHYQLLETTTTAEADTTAFVDLKKGYNQLYSGLVELAEGIKTTNQIDIFFAVPVQAYQSDFTQKYSHYLQDTDALQKQHGQQFLSSLDQAKTIFITVLGLLLAIAIAVWFGVNRVIIRPLAHIIAHLKLIAAGDLSHSVNTETRGTREVEQLNTSVILMQEGLVTLVNQVRQGVDHMVTQVDRVAEDNHRLSEQANRQSHELKVTTEHVIQLSQHLEQNTQHTQQANLHAEDTSKIATQGETMMNDVKAAMSDIAGRTREMTEAIGMIENVAFQTHILSLNAAIEAARAGTMGRGFAVVAREVGTLASQSSHSAQSINVLIRDSDNSVTAGTRLVNKLNDSLQNIIQTAKDTGTFLSEISEISHQQNESIHEVTARLSTLNDTVRENAGQVEASAHTFASLLEQTERLNTSVSLFILPSTEADVNPMIDQREMTQRIPMMG

SEQ ID NO: 20450 - DNA, 1836 bp, Erwinia carotovora subsp
  CDS (1)..(1836)
atggccgaacgctatttacagcaaatagctcaaagcgaagccctgagaattcagcaggaactcaactacgcacgtgatgtagcgcataacctcgggcaagggctggctgctttgccatccgcaggcattaaagaccgcgctgtggtcgataaaatgatggaatatgctctgcgggataatccggaatacctttcgatttcagttatttttgaagagaatgtgtttgacggacgtgatgccgagtttgccgatcaaccgggtcaggcaccgaaaggtcgctacgcctggtttgttgaccgcgatcaggcaggtaattatgccatgcatcctctgctttcttatctgactcccggccaaggcgattactatctgctgccgcaaaagagccagaaagatacgctaatcgaaccctatacctatgcttacaacggcgttccgacgctgctgacatcagtcgccgcaccgattgttagtcaggggaaactgtggggtgtcgtcacttcagacatttctcttgcgtcattgcagcaaaaaattaaccagattaaaccctgggaaggcggtggctacgcgatgttgttatccagcgcgggtaaagtcatctcttatcctgacaaatctcagacgagcaaagcttggcaaggaccgacggacaattttacctcttctgtggtacagcacgacgatgcgattctgggcgagcaagcgctggttacttggcagcccgtcaccattggcaacagcacggagaaatggtatctcgggattgttgtgcccgtgagtcaagtgatggccgcgtctgagcgccagttgattaatgccgtcatcatgatggtgatcagcattctgttggtgagcgcgctgctgggctgggtattcagccgcaaagtgcttaaaccgattggcggcgagccacttgaagccgcaaccattgcactgtctgttgcggaaggacgattgagtaatgtgattgacgtgaaagccaacgatcgcagcagcctgttcttcgcgctgaatacgatgcaatcacagctgcgtcaggtggtgggacagatcaaagacgccagtgattccgtgcgacaaggcgctgcggaaattgccagcggtaacctcaacctcgcctcgcgtacggagcagcaggctgccgcgctggagcaaactgcggcgagcatggaagagattacagccacggtgaaacacaatgccaacaatgcccatcaagccactacgctgacagaaaatgccacgaagatagctctgcgcggtgaatcgctggtcagtcaggtggttcagacgatgtcgcagattgatgatagtgcgaagaagattggcgacattacctccatgattaacagcatcgctttccagaccaatattctggcgctgaacgcagcggtagaggcggcgcgagcgggtgagcagggaagaggattcgccgtcgtggcatcggaagttcgcagtctggcacagcgcagcgctagcgcggtgaaagagattgccgccctgattgaggaatccagccagcgcgttgaaagtggcgttaagctggtgaacgatgcgggtaaaaccatgcaggatatgacgcatgccgtcaactcggtacaaagtattatcggtgaaatagtcaccgcatcggatgagcaagcgaaaggcatcagtcaggtaacgattgctgtcaacgaaatggatggcgtaacgcagcaaaactccgcactggtacagcagatgtctgccgccgccagttcgctggaagatcagtccatgctgttggcgcaaacgatagagcatttccgtctggaacagcagcacgctttacctcatgcgttattgagataa

SEQ ID NO: 20451 - protein, 611 aa, Erwinia carotovora subsp
MAERYLQQIAQSEALRIQQELNYARDVAHNLGQGLAALPSAGIKDRAVVDKMMEYALRDNPEYLSISVIFEENVFDGRDAEFADQPGQAPKGRYAWFVDRDQAGNYAMHPLLSYLTPGQGDYYLLPQKSQKDTLIEPYTYAYNGVPTLLTSVAAPIVSQGKLWGVVTSDISLASLQQKINQIKPWEGGGYAMLLSSAGKVISYPDKSQTSKAWQGPTDNFTSSVVQHDDAILGEQALVTWQPVTIGNSTEKWYLGIVVPVSQVMAASERQLINAVIMMVISILLVSALLGWVFSRKVLKPIGGEPLEAATIALSVAEGRLSNVIDVKANDRSSLFFALNTMQSQLRQVVGQIKDASDSVRQGAAEIASGNLNLASRTEQQAAALEQTAASMEEITATVKHNANNAHQATTLTENATKIALRGESLVSQVVQTMSQIDDSAKKIGDITSMINSIAFQTNILALNAAVEAARAGEQGRGFAVVASEVRSLAQRSASAVKEIAALIEESSQRVESGVKLVNDAGKTMQDMTHAVNSVQSIIGEIVTASDEQAKGISQVTIAVNEMDGVTQQNSALVQQMSAAASSLEDQSMLLAQTIEHFRLEQQHALPHALLR

SEQ ID NO: 20452 - DNA, 1680 bp, Erwinia carotovora subsp
  CDS (1)..(1680)
atggaatttctaagaaacgtcagcataaaaatgatggtgctggtcatagtggcttccctgctagtggcgtggggagtggcatctgggttaagtctttactcgctttatcaggtcactaatttgcttgataaaagcgagactcagcgcaaaacgtattcccatctggtttatggcgccgatcaatattttcgggccgtaacgcggatggaaagaaccatggactatttgcagcgtaacgagccagaaaacgccaaacagacgctggaaatggcacagcgagcaatcaaaaataccaaggattcgctggagaaattccaggcgtcggagcacgttggtgtcaatcaggcaacggttgatgcagttaaaaacacgtggaacaccctgatctcctcttctatcgagccgatgaattcagcattgcaacgcaacgatcctgaagcattccggcaaattttccgatccgtttaccctcccgtcagtctgacattcggggacgatatcaaacgttattcggacggcattaccgcctcatcgttgattccaagtgtgaatgaacacaatgataaaaaccgcaatgtgcttattgtggttatgttgattggggttatcgtgctgattttcaccgagtattatctgagaaattatctggtgataccgattgccgtacttaaatcgcacctgtcgcagctgacagcgggtcgtttaggctgtgaactggcggagttcggcaagaactgtgcagggcgactgattcccgatatcaagcggttgcagaaaagtttgcgggatacggtgaccgtcatccggcaaagcacgacggaaatcaacaatgggacgtccagcattaaggatggcaacgataatctctctagccgcacagagcagcaggcggcggcattgcaagaaaccgccgccagtatggaagagattagctccacggtgcgacagactaccgatcacgtgcatcaggtacgccaactggcgaaggatgcggctgacatggcgcaaaaaggcggaaatatcagcaccaacgtgatggcaacaatggatggtatcagtgccagttcgcgacaaatctccgatatcacctcggttattaacagcattgcgttccagaccaatattctggcactgaatgcggctgttgaggcggcgcgtgcgggggagcaagggcgagggtttgccgtggtggctggggaagttcgaacgttggcgcagcgaagtgcgcaggcggcgaaagagatcgaggcgctgattgcggaatccgtttcacgggttgaaaccggtgcagggcaggtaaggcaatccggcgaggcgatgacggcaattatcgcttccatcgctcatgtgaacgatctgattggtgaaatcgcggcggctacggatgagcaaacgcgcggtattacgcaaattagccaagcggtgcacgaaatggatagcgtcacacagcagaacgcgtcgttggtgatgcaatcggctgaagccgccgcgcgtctggatgaacaaaccagtgaattgtctgccgtagtggacgtgtttaatctggattcggatagcgatcagcaaaccgctttctcccgtccggccattgccgctcctgttcaccgcgcggtcgcgcagagcactacgccgttgttgtcggtgcatggccgtcacggtgagggatgggaaaagttctga

SEQ ID NO: 20453 - protein, 559 aa, Erwinia carotovora subsp
MEFLRNVSIKMMVLVIVASLLVAWGVASGLSLYSLYQVTNLLDKSETQRKTYSHLVYGADQYFRAVTRMERTMDYLQRNEPENAKQTLEMAQRAIKNTKDSLEKFQASEHVGVNQATVDAVKNTWNTLISSSIEPMNSALQRNDPEAFRQIFRSVYPPVSLTFGDDIKRYSDGITASSLIPSVNEHNDKNRNVLIVVMLIGVIVLIFTEYYLRNYLVIPIAVLKSHLSQLTAGRLGCELAEFGKNCAGRLIPDIKRLQKSLRDTVTVIRQSTTEINNGTSSIKDGNDNLSSRTEQQAAALQETAASMEEISSTVRQTTDHVHQVRQLAKDAADMAQKGGNISTNVMATMDGISASSRQISDITSVINSIAFQTNILALNAAVEAARAGEQGRGFAVVAGEVRTLAQRSAQAAKEIEALIAESVSRVETGAGQVRQSGEAMTAIIASIAHVNDLIGEIAAATDEQTRGITQISQAVHEMDSVTQQNASLVMQSAEAAARLDEQTSELSAVVDVFNLDSDSDQQTAFSRPAIAAPVHRAVAQSTTPLLSVHGRHGEGWEKF

SEQ ID NO: 20454 - DNA, 1791 bp, Erwinia carotovora subsp
  CDS (1)..(1791)
atgctgaaaacgacccgttcccgcattcttgcggcctgttcgaccattgttgtactttcgcttgttattaatacctttcttaattacaccatagccaataacgcaaataaggactcgatccagaatacgctagatgcggtagcgactagccatagcatagcggttagcgactgggttgcctctaaaacgctgatgatctctgcactgcatgaccgcgccatacaggatgaagatcctattccgctgttcaaacagattgtggcatctggtgggttcctgaacgtatacatgggctacgccaatggcactgccaagtttgccgatccaggcggtattcctgccgattacaaccctaccatcaggccttggtatcagcaggcagtgaaagaaggtaagccgctagccactgcgccgtacgttgatatggtaacgaatacgctggtcgtttcttttgtcgcccccgtgctggaaggaagtacggttaaaggtgtagtcggcagcgacgtgacgatgaaaagcgtgatcgaaaacgtcaaggctatcaatcctagcccggggagtttcggtgtgttgattgaccgtaacggtacgatcattgcgcacccggatgaaaaactgacgctgaaaaatatcaccgatatcgcccccgcgattaatctgaacgagattctttcagcagataacgcccacgatgtggatttttccggatcgacaaagctggtattagcaaagccgattgctggcacgagctggtatatgctggtggcgttggataaagccgaagccaccgctggcatgcgttctctgctctccacatcggtcatcacactggtcattatcgcgctgttgggaacgctggttatcggcttcatcatcacgtcaacgctcaagcgcctgctgcaaatccgcgacgcaatggatgatatcagcaacggcaacaacgatctgacgcagcgcctgccggatgaagggcatgatgaagtggcgcaaattgcccgctcgtttaatatttttatcgataagattagtcaggtaatgatgcagattcgagatatcagtgcgtcgcttcaggttgcggcggatgaaatctcggcggggaacaatgatctttctgcacgtactgaatctgcggcgtcgagcattcagcaaacagcggcttcgctggaagaaatctctgcggcggtgacgcagtcggcaggatctgcgcaacaggttaacgctaaagcgctgctgctgtcgaaagatgcgggtacaggtggaaaagtggtgtctgatgtgattgtcacgatggaagagatagtggtcgcgtctggcaaaatcggcgacattatcggtgtgatcgatggcattgcgttccagactaacattctggcgcttaacgccgccgtagaggccgcgcgagcgggtgaacaggggcgtggtttcgccgttgtcgccggtgaagttcgcagcctggcacagcgcagcgcgcaggccgcaaaagaaattaaagagctgattgaagcgacggtctccagcgtaacgtctggctcagttcaggttcgtcaggccagcgacacgatgaatgaaattgtcagcggcgtatctacggtgagctcggtgatgtctgaaattacgcatgcagcggatgagcaaatgcgtggcattaacgagatcaacaaagccgtcgcgcagttggattcgatggtgcaacaaaacgccgcgctggtgcaggaatctgccgccgcctcgggtgcgttgcaatcacaggctgaagaactgaattccgttgtcggggcattccgtgtctaa

SEQ ID NO: 20455 - protein, 596 aa, Erwinia carotovora subsp
MLKTTRSRILAACSTIVVLSLVINTFLNYTIANNANKDSIQNTLDAVATSHSIAVSDWVASKTLMISALHDRAIQDEDPIPLFKQIVASGGFLNVYMGYANGTAKFADPGGIPADYNPTIRPWYQQAVKEGKPLATAPYVDMVTNTLVVSFVAPVLEGSTVKGVVGSDVTMKSVIENVKAINPSPGSFGVLIDRNGTIIAHPDEKLTLKNITDIAPAINLNEILSADNAHDVDFSGSTKLVLAKPIAGTSWYMLVALDKAEATAGMRSLLSTSVITLVIIALLGTLVIGFIITSTLKRLLQIRDAMDDISNGNNDLTQRLPDEGHDEVAQIARSFNIFIDKISQVMMQIRDISASLQVAADEISAGNNDLSARTESAASSIQQTAASLEEISAAVTQSAGSAQQVNAKALLLSKDAGTGGKVVSDVIVTMEEIVVASGKIGDIIGVIDGIAFQTNILALNAAVEAARAGEQGRGFAVVAGEVRSLAQRSAQAAKEIKELIEATVSSVTSGSVQVRQASDTMNEIVSGVSTVSSVMSEITHAADEQMRGINEINKAVAQLDSMVQQNAALVQESAAASGALQSQAEELNSVVGAFRV

SEQ ID NO: 20456 - DNA, 1620 bp, Erwinia carotovora subsp
  CDS (1)..(1620)
atgtttcgtaagataaagatccgtactgcactcagcatgatggtgttctcgttagcggcgttactgctttttgtcggcgttttagggctgattgcggttcagtcagggaacaaatcatttgctcgcgtcgatatggaagtgctgccagggttggttgcgctgaatgacagctccgaactgctgttgcgtggtcggttggatttacgtctgtacgaatcattaatgggaaaaggggacctcgaggcggctaaagtcgcgctgggacgcgccagaggcaaggtcgatggtgctagcgaaaaatggcaggaatacctgaaatacccgcagtacgaagaggaaaaagccatttcttcggacatggctgagaagcgcaatgcgctgatgcaggactttatcgatccggcatttgcggcacttaacgcagggaacctggacgaatatcgccagcgtgctgggaaatcgacggtgctgtacgccgcgtttgataaatcctctaaagcgctggttgccttcaagctgaagagcattgatgaagcctatgcggattcaaatgggcgtgtggaactgatggaaaccatcctatacgttgcgattgcctgtgcgttgctgctggcggcactggcctggtctgtgatgaccaacatgatcgtgaaaccgcttaatcaggctatttctgtctttgaccgcattgctgaaggcgacctgcgtgcgcagattgatagcagcgggaaaaatgaaatcgctcacctgtttgccgccgttcagcgcatgcgtgacgggctggaaaacatggtgcgcgtggtgcgtaacggaaccgatgcaatcagcgttggggtagaagaaatcgcatccggtaacatcgatctttccagccgtaccgagcagcaggcagcctcattggatgaaaccgcctcaagcatggaacagatcatgtcgacggtgaaaaataacgaagacaacacacgcaaggcgaatcaactggcgcagaaggcctctgattccgcgtctcgcggcgggaatgttgtctccgaagtggttgataccatgcgttctattaagatgagttctgccaagatctccgacattgttggtgtgatcgacggcattgctttccagaccaacctgctggcgctgaacgctgcggtggaatctgcgcgtgcaggtcagtacggtaaaggttttgcggtagttgcctctgaagtacggatgctggctgcgcgtagcgcgaccgcagcgaaagagatcggcacgatgattgatgcttctctcagccgtattgaaaagggtgccggcctggttgaagtggccggtaacaccatggacgaagtgctgatggatgtgaagaaggtcgtcgatatcatggatgaaatcacgttggcttccagcgagcagagtcgaggcatttcgcagattaatatcgctattaatcagatggatggcgtgactcagcagaatgcgtcattagtagcagaagtggcgacctcagcaaatgcgcttcaggaacaggttattaacctgcaacagtctgtttcccgtttccagatcgcaagagaaaatagggaaatggacaatgtattgcccggcttacgtcagaacattacgctggctgatgcccgctaa

SEQ ID NO: 20457 - protein, 539 aa, Erwinia carotovora subsp
MFRKIKIRTALSMMVFSLAALLLFVGVLGLIAVQSGNKSFARVDMEVLPGLVALNDSSELLLRGRLDLRLYESLMGKGDLEAAKVALGRARGKVDGASEKWQEYLKYPQYEEEKAISSDMAEKRNALMQDFIDPAFAALNAGNLDEYRQRAGKSTVLYAAFDKSSKALVAFKLKSIDEAYADSNGRVELMETILYVAIACALLLAALAWSVMTNMIVKPLNQAISVFDRIAEGDLRAQIDSSGKNEIAHLFAAVQRMRDGLENMVRVVRNGTDAISVGVEEIASGNIDLSSRTEQQAASLDETASSMEQIMSTVKNNEDNTRKANQLAQKASDSASRGGNVVSEVVDTMRSIKMSSAKISDIVGVIDGIAFQTNLLALNAAVESARAGQYGKGFAVVASEVRMLAARSATAAKEIGTMIDASLSRIEKGAGLVEVAGNTMDEVLMDVKKVVDIMDEITLASSEQSRGISQINIAINQMDGVTQQNASLVAEVATSANALQEQVINLQQSVSRFQIARENREMDNVLPGLRQNITLADAR

SEQ ID NO: 20458 - DNA, 1662 bp, Erwinia carotovora subsp
  CDS (1)..(1662)
atgaatttagcaaactggcgtattggttatcgattgggagcgggatttgccatcctgattgtgatgttgttcgtcgtgagtattttttccctgtctaagttatccggctttcaggatagtgccagaagtatcgtgaaagatgtctatccacagacggtggatgctaataatctcatcgataatgtcaccagtattctagttgcttatcagcgactcatgttggtctctgattcggtgcaaattcagacaaacgtcactcgcgtgaatgagtaccgtcaggaaattggccgtctgctggacaaactagagagacaaaccgttgaagagcgttcggtcacccagctacgtgctattcgtgctattcgtaccgagtttctgaaatctggcgataaaatcatcagcgaagtcgtggcgggcaatcgggaagcggcgatcgaggagttcaacaacaacctgaacgtagtccagcggcagtaccgtgatgcagtgaaacaattagtgaattatcaagatgatgcgatggacacctccgttgaagctatggctgaggtatacagcaatacccgcatgattttgttgctcattttagcgctgggtgccgtatttggagcgttgattgcgtggtcgatcacgcgcagcgtaatccggccgatccagcaggctttgcaagtggcagacagagtggcgcagggcgatctgacctctcgcatcacgattaccagcaaagatgaaacaggattactgctgcaatcgttggatcacatgaacaccagcctgagttcgattgtcgggcaggtacgtgacggggcggaaacgatatcgagcgcagcctcgcaaatcgccgcaggtaatcaggatctgtcatcgcgcaccgaagagcaggccagctcactggaagaaacggcagcttcaatggaacagctgacctccaccattaaaaatacggcggaaaacacgcagcaggcgacagacattgcgaataaagcctctagtgctgccaagcaaagtggtgacgtgatggtttccgtcacgcagaaaatgcgcggcattcgtgattcatcccagcgtatggcggagatcattggcgtcattgatggcattgcattccagaccaatattctggcgctgaacgcggcggttgaagcggcgcgcgcgggcgagcaagggcgtggctttgcggtagtggcgggggaagtacgttctctggcacaacgcagtgcgacagccgcgcgtgagattaaggatttgatcgacgattccgtgagcaaaattcaggaagggatgtcgctggtggataacgccgaagaaacgatgagcggtttaacgggctacgtgcgcgatgtgaatgagatcatcagcgaaatttcgcaggccagccgtgaacaaagcgacgggattaaccagatgaacctggcgattgggcaaattgataccacgacccagcagaatgcggctctggttgaagaatctgcctctgcggcactttccctgcaagcacaggcctccgttctggcggaggcggtgagcacctttaaacttctgtcgtatggcaatggcaaaaccgcctcttacgcatcggcaccaacgcgcacgccaacgctatctttagcaccagcagcggcgaaaaaccaaagcaacaacgacaattggacgacgttctaa

SEQ ID NO: 20459 - protein, 553 aa, Erwinia carotovora subsp
MNLANWRIGYRLGAGFAILIVMLFVVSIFSLSKLSGFQDSARSIVKDVYPQTVDANNLIDNVTSILVAYQRLMLVSDSVQIQTNVTRVNEYRQEIGRLLDKLERQTVEERSVTQLRAIRAIRTEFLKSGDKIISEVVAGNREAAIEEFNNNLNVVQRQYRDAVKQLVNYQDDAMDTSVEAMAEVYSNTRMILLLILALGAVFGALIAWSITRSVIRPIQQALQVADRVAQGDLTSRITITSKDETGLLLQSLDHMNTSLSSIVGQVRDGAETISSAASQIAAGNQDLSSRTEEQASSLEETAASMEQLTSTIKNTAENTQQATDIANKASSAAKQSGDVMVSVTQKMRGIRDSSQRMAEIIGVIDGIAFQTNILALNAAVEAARAGEQGRGFAVVAGEVRSLAQRSATAAREIKDLIDDSVSKIQEGMSLVDNAEETMSGLTGYVRDVNEIISEISQASREQSDGINQMNLAIGQIDTTTQQNAALVEESASAALSLQAQASVLAEAVSTFKLLSYGNGKTASYASAPTRTPTLSLAPAAAKNQSNNDNWTTF

SEQ ID NO: 20460 - DNA, 1953 bp, Erwinia carotovora subsp
  CDS (1)..(1953)
atgcatttttttaccaggattatgagtgaactcaaggtttctcataagctgtatggcggtttcggtattgtcctgttgttggtaatgatcgcgtctggcgttggcgctgtacgatttttcatcatccacgatctgtatgttaaaacgacgattttgaatgaaatgaatcattatctcgaccagtcaaaaatggcgagagtaaaatattcattcacctttgcggatgacaatatcaagaaccttaatacctacattagtcaggcaaatcagcaaaaagaaaaagcgaaagcgctaacgtgggaagcggtttatctctctgattttaataatcttgatcaggatttttcgaattatgataccgatctgaatagcatgaaagccgccgcaaacacggtggtcgagacggcaaagaaaatcagccagatgaatgcctctgatgcattaacggcatttatgaccggtctccccgtcgacgcagatgaaagtgcgttgtctatgcagaaggaagccctctcgctgctgtttctgaaactggtcaacagcacctacaccttacaaagagagaatagcgaagccgcgtttactgcacagaaacagatctatggcgaatcgaagacatcctatgatgcgctggcatcgtcggtcactggcgatcgccgtcgcgtagttgattcgttttggcaatcatttgaaaattatcatcaaacggcagagcagtattacgcacggttggggcagttaaaaaccacagatgtgaagttccgggcaaccggagataaaatgacgagcgacatcggcagtattctgcaaaagctcggcgcgaagaatgatgacattatcaatagctctgtactgcaaacgctggttttaggggcgattgccattgtattcggcctactgatcgcatggtctgtcacgcgacaaattacccgatccattatcaccaacctgaagctggcggaacggatcgctggtggcgatctctctgcgaatgtcacggtggaacggcatgatgagctggggcaattaacggcggctatgatggtgatgacggagaaattacgtcatttaatgacggatattcgtcagagcgtgtacagcgttgagagtgcttctgctgatattgcatcgggcaataatgatttgtcatcacgtaccgagcagcaatcggcggcgattgtagaaacggcggccagtatggaagagttaacggccaccgtgaagaacaacgccgagaatgcccggcatgccagccagattgccggagaagcctcaaccaatgccaaccgcggcggggatattattaaccgcgtgattaacaccatgagcgatatttcaggcagctcgaagaagatctctgatattacgagtgtcattaatagcatcgctttccagaccaatattctggcattgaatgcggctgtggaagcggcacgagccggtgaacaaggacggggatttgcggtggtcgccagtgaagttcgtagtcttgctcagcgcagttcacaggccgcaaaagagatcgaaaccctgatctccgaatcggtttctcgcgtggatgctgggactgaactggtttctcgggcgggaacgacgatggatgacattgtcgcttccgtgaaccgtgtgaatgacatcatgggggaaatctcctcagcatcggatgagcagagtcgtggtattgcccaaattggcagtgcggtcgctgaaatggataccaccatccagcagaacgcctcgatggtgagtgaatcttcagctgcggcaaactcgctgcaagaacaagcgtcgaagttggcaacactgatgtcggttttccgcatatccgataaggatgtggcaaggctgcaaggttcgaataccggtaatccaaattcgggtaataaggctacggctcgtctgccgacgcttgcgtcgcgggataatggcaacgataactggacaacgttctga

SEQ ID NO: 20461 - protein, 650 aa, Erwinia carotovora subsp
MHFFTRIMSELKVSHKLYGGFGIVLLLVMIASGVGAVRFFIIHDLYVKTTILNEMNHYLDQSKMARVKYSFTFADDNIKNLNTYISQANQQKEKAKALTWEAVYLSDFNNLDQDFSNYDTDLNSMKAAANTVVETAKKISQMNASDALTAFMTGLPVDADESALSMQKEALSLLFLKLVNSTYTLQRENSEAAFTAQKQIYGESKTSYDALASSVTGDRRRVVDSFWQSFENYHQTAEQYYARLGQLKTTDVKFRATGDKMTSDIGSILQKLGAKNDDIINSSVLQTLVLGAIAIVFGLLIAWSVTRQITRSIITNLKLAERIAGGDLSANVTVERHDELGQLTAAMMVMTEKLRHLMTDIRQSVYSVESASADIASGNNDLSSRTEQQSAAIVETAASMEELTATVKNNAENARHASQIAGEASTNANRGGDIINRVINTMSDISGSSKKISDITSVINSIAFQTNILALNAAVEAARAGEQGRGFAVVASEVRSLAQRSSQAAKEIETLISESVSRVDAGTELVSRAGTTMDDIVASVNRVNDIMGEISSASDEQSRGIAQIGSAVAEMDTTIQQNASMVSESSAAANSLQEQASKLATLMSVFRISDKDVARLQGSNTGNPNSGNKATARLPTLASRDNGNDNWTTF

SEQ ID NO: 20462 - DNA, 2796 bp, Photobacterium profundum
  CDS (1)..(2796)
atgcttcgttttagtgacatcaggatgagacctaagttgatcggcctgtttttgttggtcagtcttattccactagctattgtcgtatctattgcagttaaatcggcagcgaatgcgttgacggctgagtccaatgatcagttgatcgcaatgcgtgaagtcaaaaaggcccagatagaaagttactttgaagagcgccagagcgatcttagtgtcttggttgattccgtcgagaatctgcgtgtcaatacactggactcgctgtacgcagccaaagaaagtaagcgtattcagattgagggttattttcaggaaatgcaggatgatattattatttttgctgaaaatagcgcgatatcagaggcgctgtcgggatttgacacggcgtatcaaaatgaaggcatgcaagtcggcggcgaggcttggctggctgtggataaccagtatgggccgtggttgagtcgctataaagagcattatggcttctatgatctgttcctgattaatgttgatggtgagattgtctactcggttgctcaggaagccgatctggggcagaacatcaaaacgggcacattgcgagacagtggaattggccacctttttagccaggcacaatctgctgtcgcgattgaagatttcgccccttatgccccttctgataatcaacagtcagcatttattggtgcgccagtcatcaagaatggtgagctgaagggtgtgctcattatgcagataccaacagaggagatcgatgccattgtacagcgagatgacaacctcggagagacggtagatacgtatttggcgggcaagcaagacggtaaagtcacattgcggagcaattatgtcaatagtgacggggcagagcgtctgattggtatgccagtgagcgaacgttttgctgatgagacgctgacaggcaagtctattggtgatatttataaagatcgaagtggaaagctaaagctggtatcagcctctccgttggagattcttggcttgagctgggcgctgatctcaaccattgatctggaagaagcgtttattagcaaacatgaaggtgagacgactgattttctggctgtctatagtcagaaatatggttattacgatctgttcctgatccatcctaagggagaggtgttctatagcgtaactcatgaagccgactaccagtccaatatgattgatggcaagtatgcagattctaacttaggtcaactggttcgccaggtattgcaaagccgacaatacgggttggctgattttgccccttatgccccaagtaatggcgagccggctgcgtttatagcacaaccggtgattgagaatggcgagattcagctggttgttgctgttcagcttccgctggaaccgatcaatgccatcatgcagcaacggagcggcatgggagagacgggtgaaacttatctggtcggtatggacaagcggatgcgctccgattcttttcttgaccaggaagggcgctcggtcatggcatcttttgccggtactgttgggcgtaatggtgtcgatacccaggccagtaatgctgccttagccggtgagaccgatattcaacaggtaatagactataacggtaatagcgtattatctgcttatacccgggtaaatatcggtgatacccattgggccctgctggccgaaattgatgaagctgaggtgaatgaacctatttatagcctgcttatgctggtcgggctggttattgcggtcacgattgtagtgattattctggtggctatgctggtcgcttcgagcatcacccgtccgctggcatcggcattacaagttgcagaggcgatggccaatggcgatctgagcagccggatcgaaacgagcagtaaagatgaaactggccagttactacgccgtatggggcatatgagcaacaggttgcgtcagatcgtgggtgatgtaaacaataatgcaaacggtcttgccagtgcttctgaagagatcagtgcaacggcgcagtcactgagtcaggctgccagtgaacaggcggctagtgtggaagaaaccagtgcatctcaggagcaaattgcggcatcggtccagcagaatgccgaaaatgccaaaataaccgatgatcgtgcgactaaagcagcgtcgcaggccaaagagggcggaagcgctgtaagcgaaacggttaccgcaatgaaagagattgctcagaaaatcagcatcattgaagacatcgcttatcaaaccaatttactggcattaaatgcagccattgaagcggcaagagctggtgagcatggtaaagggtttgcggtggttgcggctgaagtgcgaaaacttgccgagcgcagtcaagtcgcagcgcaggagatcagcaaccaggccggaggcagtgttcaggttgccgagcaggcaggccgtttgctggatgagatagtgccgagcatcaccaaaaccgcagagctggtgcaggagattgcggcaacatcagatgagcaggccagtggtgtcactcagatcagtgttgctatgggacaaatagatcaagtgacccagcaaactgcttcttcttcagaagaattggcatcgactgccgaggaaatgagcgcccaggctgagcagttacagcagttgatgagcttctttaaaatagatgagcagcaagccgaagggcctgagtctcattcactgaaggtaatcggaaatcatgcccagtctccgtcagtctcgatgataaaaaaaccggccagaaagctgggaagcaaacatcaggagctgatagaggaggattttgaagttttttag

SEQ ID NO: 20463 - protein, 931 aa, Photobacterium profundum
MLRFSDIRMRPKLIGLFLLVSLIPLAIVVSIAVKSAANALTAESNDQLIAMREVKKAQIESYFEERQSDLSVLVDSVENLRVNTLDSLYAAKESKRIQIEGYFQEMQDDIIIFAENSAISEALSGFDTAYQNEGMQVGGEAWLAVDNQYGPWLSRYKEHYGFYDLFLINVDGEIVYSVAQEADLGQNIKTGTLRDSGIGHLFSQAQSAVAIEDFAPYAPSDNQQSAFIGAPVIKNGELKGVLIMQIPTEEIDAIVQRDDNLGETVDTYLAGKQDGKVTLRSNYVNSDGAERLIGMPVSERFADETLTGKSIGDIYKDRSGKLKLVSASPLEILGLSWALISTIDLEEAFISKHEGETTDFLAVYSQKYGYYDLFLIHPKGEVFYSVTHEADYQSNMIDGKYADSNLGQLVRQVLQSRQYGLADFAPYAPSNGEPAAFIAQPVIENGEIQLVVAVQLPLEPINAIMQQRSGMGETGETYLVGMDKRMRSDSFLDQEGRSVMASFAGTVGRNGVDTQASNAALAGETDIQQVIDYNGNSVLSAYTRVNIGDTHWALLAEIDEAEVNEPIYSLLMLVGLVIAVTIVVIILVAMLVASSITRPLASALQVAEAMANGDLSSRIETSSKDETGQLLRRMGHMSNRLRQIVGDVNNNANGLASASEEISATAQSLSQAASEQAASVEETSASQEQIAASVQQNAENAKITDDRATKAASQAKEGGSAVSETVTAMKEIAQKISIIEDIAYQTNLLALNAAIEAARAGEHGKGFAVVAAEVRKLAERSQVAAQEISNQAGGSVQVAEQAGRLLDEIVPSITKTAELVQEIAATSDEQASGVTQISVAMGQIDQVTQQTASSSEELASTAEEMSAQAEQLQQLMSFFKIDEQQAEGPESHSLKVIGNHAQSPSVSMIKKPARKLGSKHQELIEEDFEVF

SEQ ID NO: 20464 - DNA, 1464 bp, Bdellovibrio bacteriovorus
  CDS (1)..(1464)
atgtctatgaattttaaagcacagtttaagggccttcgtggaaaacttctgggtgtggcggtcttgccgctgatcgctctgtcggtgacagcgtggatcagctttcagggtttcagtcagatcgggaccatgctgaatgaatcttacgaagtgtatgtgccaaatatccgcctgttgggccagctgaatctgaatcgcgccaatatcggctatttcactttcgcagctttggcgaacaaagaggacatgaaaaaccgcgaaaactttgtgggtctgctggatcgttcggtggattcttacaaggcggcgatggccgaatacgaaaagcagaatttcatccagggcgaggccgaggcattccgtgcgatgaaggacaactatccaaagtatcttgaatacaccaaacaggtgcgcgaagctttgctgcgcggaactccggcggactttgaatttgtggtcagccttgtggataagggcggaccttggcaggtgctgcaaatccagatcgatcacacaatcaccaagatttatgagatgtatacggccatcagcaaatccaacaatgaactgcagaaaaaagaacgcgcccaaaaggcgtctttgattgtgggtgtggcattggggtcttccttggtgctgttcctgatcatgttgtggattgcgaaccgcgtttccggttctgtcggccgggttgtcggggcgctgaccgaaatcagtcagaatgtctctggcgcgatttcccagctgtccgtggcgggccaggcattgtccacgtcttccaccgaagcggcggcctctctggaagaaacggtggcttccttggaagaaatgacttcgatggtttcgcgaaattctgacagtgcgaaacaggcttcgtctttggcggatggttcttcgtctgtggccaaagaaggggagcgtgaaatcaacggtctgattgaatccatgtcgcagatttcccgcgattccaaaaaaattgaagagatcatccacgttatcgatgacatcgcctttcagacgaacctgctggcactgaatgccgcggtcgaagcggcccgtgccggtgaacaggggaaaggcttcgccgtcgtggctgaagccgtgcgtgcgctggctcagcggtccgccacagcggccaaagaaatcaacggtctgatcaaggaaagtgtggagcgaacagaaaaaggcagcgtggtggcggataattccggccaggttctgtccagaatcgtgtcttcggttgagcaggttgtggtgttaaatcgcgagatcgcccaggccagcagcgaacagtcacaaggcatttcccagatcagcaaggccatgaaccagctggatcaggcatcgcaaagcaatgcggcgtcttcagaagagatcgccgcaacggcgggggaaatcgaacgtcgtgcccacgaactgcagcagcaggttcagatcctcagctccgaagtgctcggagcctga

SEQ ID NO: 20465 - protein, 487 aa, Bdellovibrio bacteriovorus
MSMNFKAQFKGLRGKLLGVAVLPLIALSVTAWISFQGFSQIGTMLNESYEVYVPNIRLLGQLNLNRANIGYFTFAALANKEDMKNRENFVGLLDRSVDSYKAAMAEYEKQNFIQGEAEAFRAMKDNYPKYLEYTKQVREALLRGTPADFEFVVSLVDKGGPWQVLQIQIDHTITKIYEMYTAISKSNNELQKKERAQKASLIVGVALGSSLVLFLIMLWIANRVSGSVGRVVGALTEISQNVSGAISQLSVAGQALSTSSTEAAASLEETVASLEEMTSMVSRNSDSAKQASSLADGSSSVAKEGEREINGLIESMSQISRDSKKIEEIIHVIDDIAFQTNLLALNAAVEAARAGEQGKGFAVVAEAVRALAQRSATAAKEINGLIKESVERTEKGSVVADNSGQVLSRIVSSVEQVVVLNREIAQASSEQSQGISQISKAMNQLDQASQSNAASSEEIAATAGEIERRAHELQQQVQILSSEVLGA

SEQ ID NO: 20466 - DNA, 1539 bp, Bdellovibrio bacteriovorus
  CDS (1)..(1539)
atgaaatttggcagcaaggtaattctgaatgtggcgatatcctgtgtggtctgcacactggctgcggttggcatctcttcttccaaaatacatgagcaaggacgtgagcagctggtcgacaaatcccaggccatcctgtcccgtcttgaatccatgcgcagttatgtcgccacctccggaaatctgaaagaagacttcgccgcagcggttgaaaaatatccggacggcaatctgcctgaagacgtgcgcaaacaattgctgcgcaaagttcccatcgtggcttccatggctgtgggttttgaaaacgcggaaaaggacggatacaaattccgcgtgttcaccgcggctccgcgccgcgaatcaaacaaggccaccgcatcagaacttgagatcctgaaacgcttcgaagcagatccaaatctgaaagaagttgtcgaaggggacgaccgacaggtggtggtttaccgtcctgtgcgcctgtccgaagcccaaggctgcctgctgtgccacggacacccttccaagagcccgtggggcaatggcaaggacatcctgggtttcccaatggaaaactggggcgacaacaaactgcatggtgtctttgctgtgacctcctccaccgaccgtgtggcggaagccgccatcaacacgacttattcaatcctgttatgggccctgctgatcaccgtggtgattctggccgtgtcctacgtgctgctgcgctcacctctgggcgcactgatggaagccatcggcactcttaatcgcgccggcactcaggtctccaccaccggcaatgaaatcttcagctccagccagagcctgagcaattctgccgtcaaagccgcggcttccatcgaagaaacctcggcgtcaactgaagaagtgtccagcatggtcaagatgaattcccagcacgcctccaaggcccgtgatctggcacacaccgctcaggaaaaagcgcgcatcggagaacgagaggttcagaaactgaccacttcgatggatgaaatcacctccagctccaaaaagatcgaagaaatcatcaccgtgatcgacgacatcgccttccagaccaacctgctggccctgaatgcctcggtcgaggccgcccgtgccggtgagcatggaaaaggttttgccgtcgtcgccgacgcggttcgcagcctggcacaacgaagcgccacttccgccaaagagatctccaatctgatcaacgacagcgttgaaaagattgaatccggccacgaggtcgttcgatccagtgcggaatctttgaaagaaattgtgacaaccattgaaaagctgtcggccctgaacacagaaatttccggagccagctcggagcaggaacaagggatcctacaaatcaacaaagcactgacagacatggataagatcacgcaagccaatgccgcctcggctgaagaatgcgccgccgcttcagaagagctgacacgtcaatcatccgtcatggaagaagcagtccagcaactaaatgttattattagcggaaacacagacaagtccgcatcctga

SEQ ID NO: 20467 - protein, 512 aa, Bdellovibrio bacteriovorus
MKFGSKVILNVAISCVVCTLAAVGISSSKIHEQGREQLVDKSQAILSRLESMRSYVATSGNLKEDFAAAVEKYPDGNLPEDVRKQLLRKVPIVASMAVGFENAEKDGYKFRVFTAAPRRESNKATASELEILKRFEADPNLKEVVEGDDRQVVVYRPVRLSEAQGCLLCHGHPSKSPWGNGKDILGFPMENWGDNKLHGVFAVTSSTDRVAEAAINTTYSILLWALLITVVILAVSYVLLRSPLGALMEAIGTLNRAGTQVSTTGNEIFSSSQSLSNSAVKAAASIEETSASTEEVSSMVKMNSQHASKARDLAHTAQEKARIGEREVQKLTTSMDEITSSSKKIEEIITVIDDIAFQTNLLALNASVEAARAGEHGKGFAVVADAVRSLAQRSATSAKEISNLINDSVEKIESGHEVVRSSAESLKEIVTTIEKLSALNTEISGASSEQEQGILQINKALTDMDKITQANAASAEECAAASEELTRQSSVMEEAVQQLNVIISGNTDKSAS

SEQ ID NO: 20468 - DNA, 1647 bp, Bdellovibrio bacteriovorus
  CDS (1)..(1647)
atggaggatcatacatctatgggcaacatcacatcctggtttcgtggcatcaaaggaaagcttttatttgcagcggcccttcccattgtggccttctgtatggtgggggtcatttccgtcaacggtgtgggccgggtgaacgagcttctgaaaagttcgcacaacgagatcattcccaatattctgattctgacggacatgcgcatttcccgaaacgcctttgggttccgtgcgtactcggctttaagtcttttcaagacaggcaaagagatcgacggcgaactggagttggctgctaaggctttggattcctatcgcaaagattatgaaaaatacatgaagacttctttcactgccgaagaaaaagtcctcttcgacaaagctcaggacaagttcccggcgattcttgccatcatggaggacatcctgaagaacctcaaaagcaaagacgccgcgggcctggaaagggctgaagagcttttgcgaggcgactatacagtcgctggggtgccggtcagcgaatttactgaggcggctttaaaaatctatgaaggcaaagctgccaccgaaggacagctggcgcatgcggccgaggaatctgtgaagatgtggaatattctgacgacaatcgtcggaaacattctgatttcgggcacgttgctgtggatcgcggcgcgcatgtccaaacagatctctgccatttctgagcagctgaccgaagccagtaatcatgtggcgggtgcggtgactcagatgaccagtgcgggctcgagtctgtcccagtcttcgaccgaggcggccgcttcgttggaggaaactgtggcgtctttggaagaactttcctcgatggtgcagatgaactctgacaatgccaagcaggcggccagtctgtcggcctcctcccgtgaagtggcggaaaaaggccagggtgagatttcaaaactgatttcttccatggagcagatttccgcttcctctcgcaagattgaagagatcattcatgtgattgatgatatcgctttccagaccaacttgctggccctgaatgcggcagtggaagcggctcgtgccggagagcaggggaaaggttttgccgtcgtggccgaagccgtgcgggcgctggcacaaagaagtgcctctgccgccaaagacatcacccagctgatcaaacagtccgtgcagcaggtggaagagggcagtcagattgccagttccagcggcctggttctggataatattgtgacctccgttaaaaaagtatctgacctgaacactgaaatcgccacagccagcaccgagcagacggccggtattcagcagatcagcaaagccatgaaccagctggatcaggcggcacaaggcaatgccgcttccgctgaagagatcgctgcttccagcgccgagatcgacacgatggcggcgacatcgcagaagctgacttcacaattgaacgaagtgattcatggcaaaggaagcctgactgccgtggcccctgcggcagcttcggctccggtgaatggagctgctgttgtgaaaacctctcaatcctcaaagcccttgccaaagaaggcagcgaagcaatctgccgccagcgaggtgatcccctttgatgacgatcgccaggtgggcaccattgagggtttttag

SEQ ID NO: 20469 - protein, 548 aa, Bdellovibrio bacteriovorus
MEDHTSMGNITSWFRGIKGKLLFAAALPIVAFCMVGVISVNGVGRVNELLKSSHNEIIPNILILTDMRISRNAFGFRAYSALSLFKTGKEIDGELELAAKALDSYRKDYEKYMKTSFTAEEKVLFDKAQDKFPAILAIMEDILKNLKSKDAAGLERAEELLRGDYTVAGVPVSEFTEAALKIYEGKAATEGQLAHAAEESVKMWNILTTIVGNILISGTLLWIAARMSKQISAISEQLTEASNHVAGAVTQMTSAGSSLSQSSTEAAASLEETVASLEELSSMVQMNSDNAKQAASLSASSREVAEKGQGEISKLISSMEQISASSRKIEEIIHVIDDIAFQTNLLALNAAVEAARAGEQGKGFAVVAEAVRALAQRSASAAKDITQLIKQSVQQVEEGSQIASSSGLVLDNIVTSVKKVSDLNTEIATASTEQTAGIQQISKAMNQLDQAAQGNAASAEEIAASSAEIDTMAATSQKLTSQLNEVIHGKGSLTAVAPAAASAPVNGAAVVKTSQSSKPLPKKAAKQSAASEVIPFDDDRQVGTIEGF

SEQ ID NO: 20470 - DNA, 1449 bp, Bdellovibrio bacteriovorus
  CDS (1)..(1449)
atgaaggcgtggttcaagggtattcggggcaggttgttggcggtggcgcttttgccggttgtgggtttttcagtcgcttcgtgggtgtcctttgatggcatcagtcgcgtcggaagtctgcttgattcggcccatgatcagatcattcccagcaccacggccttggatcgtctgataattgcccggaacagatacggctacagcatctttgtggcattgagttccaccgacaatcccgaactgaagaaagagcgcttggaaattgcccgggaagcgatccgtgactggcgcacgaactttgaaatttaccaaaagaatccgattcattctgaacaggaaaaagagagtcgtcagtttattgaacagaacaaagatcactatctggggcttcttgaaaaagccatcgcgttggtggaaagtggcaaacccgaggaactgaccgaggcgcgcgcccttcttttgggtgaggtctggcagctgggcactttgattggtaaaaacaaccagaccattgccaggacctatgaggaacgggcgcgtcaggaggggcttgagtccgagagcctgcagaaatccgtgtacctgtggaccgggatcatcaacaccacggcaagcatcgtgatcatctcaattattcttttgatttcaaaccgtattgccaggggcatttctttgattgccgaccgtctgtcttcagccagcggggatgtgacttcctctgtgtcccagctcagtgaagcgggcatcacgctgtcgcagtcctcgacggaagcggctgcctctttggaggagacggtggcttcgttggaggagttgacgtccatggtgcaggtcaatgctgacaatgcaagacaggccgcggccatgtcggcaagctcgcgtgaatccgccgaggccggggagcgcgagatccggggcctgattgaatccatgagtgaaatcagcaagtcatccaagaagattgaagagatcatttcggtcattgatgacatcgcctttcagacaaacttgctggccttgaacgctgccgtggaggctgcgcgcgccggggagcagggcaagggttttgccgtggtggcagaggccgtgcgctcgctggcgcagagaagtgcggtggccgccaaggacatcaccgtgctgatcaaagcctcggtggaacaggttgaacaaggcagtgttgttgctgacaacagcggtgtggttttgaaaaacatcgttgaatcagtcaagaaggtcgcggatttgaacaatgaaattgccgcggcctctgtcgaacaaagtgccgggatcgcacagattggcaaagccatgaatcagctggatcaggcatcgcagtccaatgccgcgtccgcggaagaagtcgccgccagcagtggagagatcggggggcttgccggcgtaacccagcagctgaccgtggatcttaacacgatggttctgggggcatga

SEQ ID NO: 20471 - protein, 482 aa, Bdellovibrio bacteriovorus
MKAWFKGIRGRLLAVALLPVVGFSVASWVSFDGISRVGSLLDSAHDQIIPSTTALDRLIIARNRYGYSIFVALSSTDNPELKKERLEIAREAIRDWRTNFEIYQKNPIHSEQEKESRQFIEQNKDHYLGLLEKAIALVESGKPEELTEARALLLGEVWQLGTLIGKNNQTIARTYEERARQEGLESESLQKSVYLWTGIINTTASIVIISIILLISNRIARGISLIADRLSSASGDVTSSVSQLSEAGITLSQSSTEAAASLEETVASLEELTSMVQVNADNARQAAAMSASSRESAEAGEREIRGLIESMSEISKSSKKIEEIISVIDDIAFQTNLLALNAAVEAARAGEQGKGFAVVAEAVRSLAQRSAVAAKDITVLIKASVEQVEQGSVVADNSGVVLKNIVESVKKVADLNNEIAAASVEQSAGIAQIGKAMNQLDQASQSNAASAEEVAASSGEIGGLAGVTQQLTVDLNTMVLGA

SEQ ID NO: 20472 - DNA, 1815 bp, Bdellovibrio bacteriovorus
  CDS (1)..(1815)
atgaagaaagagttctctttacagacgaaaatcgccctgcctattcttacaatcactttcatcgcactggggctgctgacctatttttcagcttcgcgaagttttcaaacggcgcagtcagacgccgaatttaaggtcacaaagtcagcagaggctttcgccaacgcgttcaaagcggacttggatgcaagccttatggtggcgcaacaagtggaagcgtatctggacaccgttagaaagcaaaacaccaaaccgcgggccgaggtgaatgccgttctaaaaaacatgctgacccaggcgccatcggtcttcgggctgtgggccactttcgaacccaatgctttcgacggacaggatgcccactatctggggcagccgggttatgaaaaaatcggcggcttcggaccttactggaatcgctcgggcgaaggcggatccctgacctgggaaaatgatatcaactataatggcgaattttatctggcgccaaaaaatgcgggccgccggattttgaccgagccctactacgacgaagtcaacggacagaatcttttaatgagttcggcagcggcccccctctttgaaggcggaaaactgatgggtgtcgtcggtgtcgatctgctgctttcccaactggacaagcagatttcggcagtgaagccctatgaaacctctgtcggctttctgatttctgaccgctttaactatgtcacaaacccggatccaaacctggtgggaaagccggtttcactgcctttctctcaggaagatttcaaacaggctctgctcgatggtcgtcttttgctgaaaactggcaaggacagccagtccggtgaagaggtgctgaacctgctggttcccgtctccatcccctattcaaaagcattctggggtgtcctgatatccactccggtgaaaactgttctggccaatgcctactctttgctgtggagtcagcttgttgtgttccttgtctgtctgctggtgatgggtgttgcggtggttctgatttcccgacggatctcccagcgattcacaaccctcaccgcaagcctggagcaggcggaaaatgtggtcactgccgcgatcgaccagctaagccgggccggacagaatctggcacaatcggccaccgagtcggcggcctccatcgaggaaaccgtcgccagtctggaagaaatgacctccatggtaaaaatgaatgccaacaacgccaaagaagccgcccgcctgtcctcggactccaatcaaagtgcagagcgcggcaacaccgaaatgagcgcccttgtcagcgccatggatgaaatctcggactcctccaggaaaatcgctgaaatcaatggtgtcatcgacgacctggcattccagacgaaccttctggcactgaatgcttcggtcgaagccgcccgtgccggcgaacacggtaaaggttttgccgtggtggctgaagccgtcagaaccctggcgcaaagatccgccactgccgcaaaagacatcaacagcctgatcaatgactccatcgaaaaagtccaacggggcagccacaaggctgaaagctccaatacaaatttgaaggaaatcgtggattccgtgcgcaaggtcagccatctgaatgttgagatttcttccgccagtgacgaacaatccaccggaattcaacaaatcagcaaagccatgaattccctcgaccaggcaattcagaccaatgccgcctcggccgaagaaatttcagccacggttcaggaaatcctgaaccaggcccatgtgatgaaaaacgtggtgactgaaatgaacacggtggttcacggcagctaa

SEQ ID NO: 20473 - protein, 604 aa, Bdellovibrio bacteriovorus
MKKEFSLQTKIALPILTITFIALGLLTYFSASRSFQTAQSDAEFKVTKSAEAFANAFKADLDASLMVAQQVEAYLDTVRKQNTKPRAEVNAVLKNMLTQAPSVFGLWATFEPNAFDGQDAHYLGQPGYEKIGGFGPYWNRSGEGGSLTWENDINYNGEFYLAPKNAGRRILTEPYYDEVNGQNLLMSSAAAPLFEGGKLMGVVGVDLLLSQLDKQISAVKPYETSVGFLISDRFNYVTNPDPNLVGKPVSLPFSQEDFKQALLDGRLLLKTGKDSQSGEEVLNLLVPVSIPYSKAFWGVLISTPVKTVLANAYSLLWSQLVVFLVCLLVMGVAVVLISRRISQRFTTLTASLEQAENVVTAAIDQLSRAGQNLAQSATESAASIEETVASLEEMTSMVKMNANNAKEAARLSSDSNQSAERGNTEMSALVSAMDEISDSSRKIAEINGVIDDLAFQTNLLALNASVEAARAGEHGKGFAVVAEAVRTLAQRSATAAKDINSLINDSIEKVQRGSHKAESSNTNLKEIVDSVRKVSHLNVEISSASDEQSTGIQQISKAMNSLDQAIQTNAASAEEISATVQEILNQAHVMKNVVTEMNTVVHGS

SEQ ID NO: 20474 - DNA, 1599 bp, Bdellovibrio bacteriovorus
  CDS (1)..(1599)
atgatcgcagcggccatgcccgtcatcgggtttggaatcgtctatgccatttcttatcagggaatgaaagggtttgaagcctatcttgaaaactcccacaaaaacatcattccgaatctgcaggctctggccgaaatgcgccaggcccgcaataaatacggctatcaggtttttgcagcgatgagcgtgaaaaccgaagccaagcgccaagagcgcctggcaatcgccaaagaggctgtcaaagaattcacctcggcaatggatctgtacgcctcaacccccttcactccagaaatggaaaaggccttcgaaccagccaagcaggtccgtgccgaatatgaaaaactgctgatgctggtcattgaagaaatcagcactggcactcctgaaggctttgctctggcagaaagccagttggacggacgtctttgggaaatcggcaccatcatgcacaagatgagttctgaatccatgaagtactacaaccaggccgcagcggatgatgacaaagcggcggatgaagccgtgactcgcatcaacaacctgacgctgtttgtgaccctggcttccacaatctccattctggcgatcctgctttggattgcggcgcgcatttccaactctgtcagctccatcgcctcccgtctgtccaccgctggtggccaggtggcttctgcagtggaacagctgaacgaagccggaaactctttatcacaaagctccaccgaagcggcggcctcgttggaagaaaccgtggcagcccttgaagagatgagctccatggtgcagatgaactcggacaacgccaaacaggcagcggcgctgtccgcgagctctcgtgattcggcggaacatggcgaaaaagaaatccagtccctgatccactccatgaccgaaatctctcagtcgtcgaaaaaaatcgaagagatcatctcggtgattgacgatatcgccttccagacgaacctgctggctctgaatgcggcggtcgaagcggctcgcgccggtgaacagggcaaaggtttcgccgttgtggccgaagcggttcgcgctctggcacaaagaagtgcggcctcagccaaggacatctcctctttgatcaaagactccgtttcccagatcgacacaggcagcgagattgccgacaagtccggggcggttctggccaacatcgtgaactcaatcaagaaggtttctgacctgaacaatgaaattgcagcggccagctctgaacagaccacaggcatccagcaaatcagcaaagccatgaatcaactggatcaggcggctcaaagcaatgcggcctccgcggaagagatcgcggccaccagcggtgagatcaacggcctggcagcaaccaatcagaacctgaccgtagatctgaacacgatcatcctgggcggcggctcggtgatggtcgacgctccggcagcatccccggccaagacttctaaaaaggtgccgacttttgcaaagcccacgtccaaaaagagcaatgtgattgcgatgaaggcgacacctgcacgcaaagaatctcaggatatgattccgtttgatgaagacgaccgtgcaaaggttggaacaacagacggattctag

SEQ ID NO: 20475 - protein, 532 aa, Bdellovibrio bacteriovorus
MIAAAMPVIGFGIVYAISYQGMKGFEAYLENSHKNIIPNLQALAEMRQARNKYGYQVFAAMSVKTEAKRQERLAIAKEAVKEFTSAMDLYASTPFTPEMEKAFEPAKQVRAEYEKLLMLVIEEISTGTPEGFALAESQLDGRLWEIGTIMHKMSSESMKYYNQAAADDDKAADEAVTRINNLTLFVTLASTISILAILLWIAARISNSVSSIASRLSTAGGQVASAVEQLNEAGNSLSQSSTEAAASLEETVAALEEMSSMVQMNSDNAKQAAALSASSRDSAEHGEKEIQSLIHSMTEISQSSKKIEEIISVIDDIAFQTNLLALNAAVEAARAGEQGKGFAVVAEAVRALAQRSAASAKDISSLIKDSVSQIDTGSEIADKSGAVLANIVNSIKKVSDLNNEIAAASSEQTTGIQQISKAMNQLDQAAQSNAASAEEIAATSGEINGLAATNQNLTVDLNTIILGGGSVMVDAPAASPAKTSKKVPTFAKPTSKKSNVIAMKATPARKESQDMIPFDEDDRAKVGTTDGF

SEQ ID NO: 20476 - DNA, 1680 bp, Bdellovibrio bacteriovorus
  CDS (1)..(1680)
atgaagaattttacggagaccctacatatgtcagatttcaaattatcaggatggttcaaaggtattaaaggaaagttgttgatggctgctttcatgcccatgattggctttgcgattctaggctccatcgccatcaacgggatcacaagtgtggttcaccttttggatgtcgccaacgaacaagttatccccaccttcgatatggttggtgaaatgcgccaggcgggcaacaaattccaatacggtgcttgggcagcgatggaacatattgatgagcctgaaaaattgacgtcctatctaaagaccgccaccgaaggcatggacgaattccgcaaggcccaggaaacttatgatccgattccaagaacaccggaagaagacaaggcttaccaaactgccaagcctcttttcccggaatactatgcttccatggaaaaggttatcgccttgattcgttctgcagaccccgccaaagtgaaagaagccgaagtcctgctggatggccgttacaatgaaatcggcaaatccgtgcgcgcctggaatagcgccgtcacagacatctacgcaaagatggccaaagacggcgtcatcgaagccaattcgactgaagcttatgttaaaaatctgatctatctggtttcagctgccacaggtgtgattgtgtttgccgtgctcttgtggattgccgcacgcatttcaaacgccgtgggttctgtcgctgaccgtctgacaacagccggtggccaggtggcttctgcagttgaacaattgaacgaagccggcaattcattgtcccagtcttcgactgaggcggctgcctctcttgaagaaactgtcgccgccctggaagaaatgacctccatggtgcaaatgaactcggacaacgcgaaacaagcggcggctttgtctgcaagctcgcgtgattctgctgaacagggtgaaaaagaaatccagaacctgatcacatccatgacctccatttctcagtcttccaaaaagatcgaagagatcattcatgtgatcgatgatattgccttccagacaaatctgctggctctgaatgcggctgtggaagctgcccgtgccggtgaacaaggcaaaggttttgctgtggtcgcagaggccgtcagaactttggctcaaagaagtgcggcgtccgctaaggacatctcttccctgatcaaagattccgtatctcagatcgaagaaggcagtgctactgcggacaagtccggtgccgttctgaccaacatcgtgaactccatcaaaaaagttgcggatctgaacaacgaaatcgcggcggccagctctgagcagaccaccggtattcaacaaatcggtaaagccatgaaccagttggatcaggccgcacaaagcaacgcggcttcagcagaagaaattgcagcgaccagcggagagatcaacaatctggcaaccacttccctgaacctgactgtggaactgaacgaagtgatcctgggcagcagcgaggtatccaaagcctctgctgcggcagaagctccggtcaaagccaaagcgaaaacatccttcatgccgaaaccgaaaaaatccaatgtgattccaatgaaggctgcggctccgaaaaagtccgcttctcaggatgtgattccatttgatgacgacgaaagagctaaggttgggacgaccgacggattctag

SEQ ID NO: 20477 - protein, 559 aa, Bdellovibrio bacteriovorus
MKNFTETLHMSDFKLSGWFKGIKGKLLMAAFMPMIGFAILGSIAINGITSVVHLLDVANEQVIPTFDMVGEMRQAGNKFQYGAWAAMEHIDEPEKLTSYLKTATEGMDEFRKAQETYDPIPRTPEEDKAYQTAKPLFPEYYASMEKVIALIRSADPAKVKEAEVLLDGRYNEIGKSVRAWNSAVTDIYAKMAKDGVIEANSTEAYVKNLIYLVSAATGVIVFAVLLWIAARISNAVGSVADRLTTAGGQVASAVEQLNEAGNSLSQSSTEAAASLEETVAALEEMTSMVQMNSDNAKQAAALSASSRDSAEQGEKEIQNLITSMTSISQSSKKIEEIIHVIDDIAFQTNLLALNAAVEAARAGEQGKGFAVVAEAVRTLAQRSAASAKDISSLIKDSVSQIEEGSATADKSGAVLTNIVNSIKKVADLNNEIAAASSEQTTGIQQIGKAMNQLDQAAQSNAASAEEIAATSGEINNLATTSLNLTVELNEVILGSSEVSKASAAAEAPVKAKAKTSFMPKPKKSNVIPMKAAAPKKSASQDVIPFDDDERAKVGTTDGF

SEQ ID NO: 20478 - DNA, 1905 bp, Bdellovibrio bacteriovorus
  CDS (1)..(1905)
atgaaaaaaagctactcaattcaggtgaagctcgcagtgccaatcattcttatcgcattgctggtgttgggaacgatgacattcctgatggctcggaacagtcacgttaacgcggaaaaagccgcgaccgaaaagacggtggcaatgggacgtgcctatgccacagaaatgcgtctggaagtggagcgcggcctgggtatttcccgcaacgtcgctcatatccttgaatctttcaaaaaacgcaataacaccggccgatctcaagtggctgaagcattgcgcgaaattctggagaaaaacaaattcgtgatcggagcctggacaggttgggagccaaatgcctgggatggcaaggactctgaatatgtgtctgttcaaggtcacgatgaaacgggtcgttttgttccttacctgaactgggaagggggcaagtcctctttgacgccactggtgggttacgccaagcagggtgagggcgactattacctggtgccaaaacagcgtttgaaagaaaccatggttgagccttatctgtacccgattgatggcgtgcaggtgttgatgacttcggcggtggtgcccatcgtgatcgacggaaagttcgtcggtgtggcgggtgtggatctgcccttgaaggaccttcagaaaaaagcggcagggatcaagccattcgaaacgtctcaggccttcctggtgacggcgcatggcaactgggtttcgcatccggaagaatccatgatcaccaaggcagccgagtatccgtttgaagctgataaattcaaaactgcgatcagaaagggtgaagagctggtgatcaccggtatcgaccctaaagacaaccttgagtatctgtacgtggtgtccccgatgaacgtgggtgcgacggaagagccttgggctttgattgttagaactccgaccaaaactgttctggctgaagccaatgcggcagtgtggactcaggtgatcatttcgttgactggcatctttgtgttgctggtggcagtgatgatgatggcgcgctatatttccaaatctgtcagtggtctttctgaaaagctgcagaactccggcgagctggtgtcttctgcaattcatcagttgtccattgccggtcagtccttgtctgaatcctccagttcttccgcggcttctttggaagaaaccgtggcggctctggaagaaatgacctccatggtgaaaatgaactcggacaatgccaaacaggcggcggcgctttcggcgcagtcctctgagaccgctgttcagggtgaaaaagagatgggcgagctgttgtcttccatgaacgagatttcagcgtcctccaaacagatcgaagaaatcatcaacgtgattgatgatatcgccttccagacgaatttgctggcactgaatgcctctgtcgaagcggcccgagctggtgagcacgggaaaggttttgccgtggttgcggaagccgtgcgcacgctggcacaaagatccgcctcagcagcaaaagacatcactggtttgatcaaagaatcggttgaaaaaattgagcgtggcacgcacaagtcggcaaaatccggcgagatgctgaagaatatcgtaacctccgtcaaaaaggtcgcagatctgaacaatgaaatttccatggccagcgaggagcagtccacgggcatttctcagatctccaaagccatgaatcaactggatcagtccgtgcagtccaatgcggcttcttcagaagagatcgccgggactgcgcaagagatcaacactcaagcggccatcatgaagaatgtggtcgatgaactgaacaatgttgtgtatggcgacagaggtgtacaggtttccgctcaaacaccagcagcaaggacaactgctcattcagaaatggacgaagaaggctggaaagccgcttag

SEQ ID NO: 20479 - protein, 634 aa, Bdellovibrio bacteriovorus
MKKSYSIQVKLAVPIILIALLVLGTMTFLMARNSHVNAEKAATEKTVAMGRAYATEMRLEVERGLGISRNVAHILESFKKRNNTGRSQVAEALREILEKNKFVIGAWTGWEPNAWDGKDSEYVSVQGHDETGRFVPYLNWEGGKSSLTPLVGYAKQGEGDYYLVPKQRLKETMVEPYLYPIDGVQVLMTSAVVPIVIDGKFVGVAGVDLPLKDLQKKAAGIKPFETSQAFLVTAHGNWVSHPEESMITKAAEYPFEADKFKTAIRKGEELVITGIDPKDNLEYLYVVSPMNVGATEEPWALIVRTPTKTVLAEANAAVWTQVIISLTGIFVLLVAVMMMARYISKSVSGLSEKLQNSGELVSSAIHQLSIAGQSLSESSSSSAASLEETVAALEEMTSMVKMNSDNAKQAAALSAQSSETAVQGEKEMGELLSSMNEISASSKQIEEIINVIDDIAFQTNLLALNASVEAARAGEHGKGFAVVAEAVRTLAQRSASAAKDITGLIKESVEKIERGTHKSAKSGEMLKNIVTSVKKVADLNNEISMASEEQSTGISQISKAMNQLDQSVQSNAASSEEIAGTAQEINTQAAIMKNVVDELNNVVYGDRGVQVSAQTPAARTTAHSEMDEEGWKAA

SEQ ID NO: 20480 - DNA, 1536 bp, Bdellovibrio bacteriovorus
  CDS (1)..(1536)
atggggtcgaattttagtttaaaaggcagacttttacttcttggtgctttcatgtccgctattccggtgctggttggaggttttgcattctacgggatgcgagaagtcgcaagcagttatgagaaagttaccgacggagtgcttcccaatattgagtccgcggatcagatgtacatgaattttcgcggtgtcagaatcagtttgcgaagcttgggtttgccggggctgacgacagaacaagaagctgactttatcaaagatgtcgaagccaatattgccgagtatgaagtgcacaaacagcaatatctgcgtgtgaactttaagaaaggcgagcgggagctctatgaaaaggtcgatgctgcgtggttggcatttaaagatcttggtgggaaagtcgttcagtattcccgcactggtaagccagaagaccgtgcaaagatgctggaaatattcctatatgactgtcccaaagcggctaaagtctatgacgacgccatgacaaagcttgtggctttccaaagagccagcggcgttcagtacgtgaaagaggcccgatcgacaacgagaaccacagatggaagcatggcgataattatcgccctgggaatgatcgcaggagtcactataagtgtgatgtttgctctgtctctttcaaaatcaatttcagccgtatcaggggatcttgctgagggggcaagtaatgtgacggacgctgctggacatattgcacattcctctcaatctttgtctcaggcagctttgcaacaggcgtcctcgttggaagagaccgtggcgacgatggaggagctgacggccatggttcgcgttaattcggaaaacgccaagcaggcagcttctctggcatcatcaacccgagagacggccattaaaggcgaaaaagagatcataacgctgattcagtccatccagagcatctcatcggattctaaaaagatcgcggagatcacttcagtaattgacgatattgcctttcaaacgaatctgttggccttgaatgcggctgtggaggccgctcgggctggcgaacagggaaaaggctttgcagttgtggcagaggctgtgcgcagtctggcgcatcgaagtgctgagtctgcaaagagcatcgcatccctgattgatgacagtgttaagaagatcgatgcgggcagccgacaagccaatcagggcggtgaggttctggcggaaatcgtaaatgcagttaaaaaagttgcggatcttaacacggaaattgcgacggccagtgaagagcaatcccatggcattgcccaaatcggtaaagcaatgaatcagctggatcagatcacccagcagaatgctgcggcctcagaggaagcggcagccgcagcggaacagctttctgcggaggctgaatctttgctggggaatgtgcgtgttcttaaaaaggttgtatccggcaaatccgatcaggcagagtccgcggccgcgtcagagggaactgatgaggtcctgaaggcccaagcgctgccgaaaaaacgcactttgcgtgccgcctga

SEQ ID NO: 20481 - protein, 511 aa, Bdellovibrio bacteriovorus
MGSNFSLKGRLLLLGAFMSAIPVLVGGFAFYGMREVASSYEKVTDGVLPNIESADQMYMNFRGVRISLRSLGLPGLTTEQEADFIKDVEANIAEYEVHKQQYLRVNFKKGERELYEKVDAAWLAFKDLGGKVVQYSRTGKPEDRAKMLEIFLYDCPKAAKVYDDAMTKLVAFQRASGVQYVKEARSTTRTTDGSMAIIIALGMIAGVTISVMFALSLSKSISAVSGDLAEGASNVTDAAGHIAHSSQSLSQAALQQASSLEETVATMEELTAMVRVNSENAKQAASLASSTRETAIKGEKEIITLIQSIQSISSDSKKIAEITSVIDDIAFQTNLLALNAAVEAARAGEQGKGFAVVAEAVRSLAHRSAESAKSIASLIDDSVKKIDAGSRQANQGGEVLAEIVNAVKKVADLNTEIATASEEQSHGIAQIGKAMNQLDQITQQNAAASEEAAAAAEQLSAEAESLLGNVRVLKKVVSGKSDQAESAAASEGTDEVLKAQALPKKRTLRAA

SEQ ID NO: 20482 - DNA, 1650 bp, Bdellovibrio bacteriovorus
  CDS (1)..(1650)
atggcaatcagttcttggttcaaaggaattaaaggcaagctctttgtgtgcgctctgatcccgatggcgggctttgcagctcttggttgggtggcctataaagatattaatatcatgggttcgatgttgaacgacgcctatgtcaatatcattccgaacatgaaagcgatgggcgaggttgaaggcagccgtgcgcgcattggtcagtatctgtggggtgctttggccaataaagatgtgccgaagcatcgcgaaagttatgtcagcaaagccaaaacggccatcaaggaatataaagacgccattgcagtctatgaggcggcctccttccagccaggtgaagccgaaatgtatgagccggcaagaaagttgaatgccgactatgcgcaggaagtggagcgcctgatctcggcactggaaaagccggacgcggactttgataagttgcgcgaacagatgaccgaaggcacttatctgaagcattccactgtgatcaaaaaagtcgcgggcgaggttgtggcaatgtatgagaagcttgccggaaccaacaatattctgcaaaaagccgagactcaaaagggcttgatcatgctggcggtcattggtggcgtgtcagcgtttttggtgtttggtcttttgatgtttatcggtatggctttgagccgcacggtgagcaacacggtttcccgtttgtccggtgccggtcatcaggtgaatgaagccatcacacaattgacattggcgggccaggggttgtcccagtcctccacgtctgcagcggcttccttggaagaaacagtggcttcgttggaagaaatgacttccatggtgaagatgaactctgacaacgccaaacaagcggcgtcactttcccaatcctcccgcgcggcggccgaggacggtgagcgcgagatcaaaaatcttgtggagtccatgcacgatatttcccagtcctccaaaaagatcgaagagatcatcaacgtcattgacgatatcgccttccagacgaacttgctggcgctgaatgcggccgtcgaggcggcacgtgctggcgagcaggggaaaggctttgcggttgtcgcggaggcggttcgttcattggcacaaagatccgcgtcggcggccaaggatatcacttccttgatcaaggactcggtggaaaaaatcgaaaatggaacccatattgccgacaagtccggcgatgttttaaataacatcgtgaactcgatcaaaaaggtggcggatctgaataacgagatttccgcagccagcgccgagcagacaacgggcattcagcagatcaataaggccatgaaccagctggatcaaagttctcagtccaatgcggcttcttctgaagagatcgcggcgacgtctgaagagatttcctctcagtccgagcaaatgcagatcatggttcgtgaattgagcaactttgtgaccggatcaacagaggttgaggcgaaggccgaagcaccggcgcgtatgccatctgccaagcctgcaaaaaaacctgaggtaaaatcggcgaaggtgatgaagttcacaccgccgccgaagaaggcagcgcccgcaccggccgcagcagtcattccatttgacacagatgaagatccgcgcgccaaagtgggcaccaccgacggcttctaa

SEQ ID NO: 20483 - protein, 549 aa, Bdellovibrio bacteriovorus
MAISSWFKGIKGKLFVCALIPMAGFAALGWVAYKDINIMGSMLNDAYVNIIPNMKAMGEVEGSRARIGQYLWGALANKDVPKHRESYVSKAKTAIKEYKDAIAVYEAASFQPGEAEMYEPARKLNADYAQEVERLISALEKPDADFDKLREQMTEGTYLKHSTVIKKVAGEVVAMYEKLAGTNNILQKAETQKGLIMLAVIGGVSAFLVFGLLMFIGMALSRTVSNTVSRLSGAGHQVNEAITQLTLAGQGLSQSSTSAAASLEETVASLEEMTSMVKMNSDNAKQAASLSQSSRAAAEDGEREIKNLVESMHDISQSSKKIEEIINVIDDIAFQTNLLALNAAVEAARAGEQGKGFAVVAEAVRSLAQRSASAAKDITSLIKDSVEKIENGTHIADKSGDVLNNIVNSIKKVADLNNEISAASAEQTTGIQQINKAMNQLDQSSQSNAASSEEIAATSEEISSQSEQMQIMVRELSNFVTGSTEVEAKAEAPARMPSAKPAKKPEVKSAKVMKFTPPPKKAAPAPAAAVIPFDTDEDPRAKVGTTDGF

SEQ ID NO: 20484 - DNA, 1950 bp, Rhizobium sp
  CDS (1)..(1950)
atgaaaaactggtcgattattttcaagatgctggtcattctcggcgccttcggtttgttttcgctaggcaccggctactacacctcaactcagatcatgaagatcgatacggcgtattcgaatctgctcgtcgagcaggttcgcgcctcgcagagcatggcctcggcaacccgagccttgcagcgggcaagggcagcaatcgccgacatcatcatgctcaccgatcccaaggcggctgaggtggccaacgccgagctggccgccgccaagaagacgttttcggagctgatggccgtcgccgcccaagccagcccggcgaacccaaagatcccggaattcaggcaggccggcctggacatacttgaaacgcattgcgcgcgtgcactcgatcaaggatcgaagacgacgaatgccatggaaatgatgtcggcagtcaagacgttcgggaccgaatgccaacccggctttccggagctgaccgacaagatcgtcgccgaaacgcgcgatatggaacaggcgatgctgaaggccggcgatgaccttaccggcgtttcgacctcgaccagcaacaataccctttacatcctgatcggtggtctcatcatcgtcctggcggcctcatatttcgctgtaaatgcttgggttgtgaaaccgatcgatgcgcttcgcgaactgatggcggttctcgccggcggcaatctcgatgtgcatgtcgagggaaccgagcggcgcgatgaaatcggcaagatggccgcggctgttcaggtgttcaaggacaatggcctcaaggcgcgcgaactggagggccagtccgaggagatgcgggctgcggccgaacgcaaccgccaggcggagcaggagcggatcgcccgcgaggcggagcaattgcgcgttgccacgtcgacgctcggagacgctctgaagcggcttgcccacggtgacctggcctgcgccatcaataccgctttcgccgccgaatacgagccgctccgctccgacttcaacacgacggtcgatcagttgagcctgaccatcagttccgttgccgtctcggtacacagcatggacaatggcaccagggagatttcgtccggcgcgaacgatctttccaagcgcaccgagcagcaggcggcctcgctggaagaaaccgccgcggccctcgatcagatcaccgcgaatgtcggcaactcgaccaagcgcacggaggaagcccgcaccgtcgccagccgtgccaaccaatcggcggtgcactctgccggggtcgtttcccaggccgaagaggcgatgaagaaaatcgaggagagctcgcagcagatctccaacatcatcggcgtgatcgacgagatcgccttccagaccaatctgctggcgctgaatgccggcgtcgaagctgcccgcgccggcgaggccggcaagggctttgccgtcgtggcccaggaagtccgcgagctcgcccaacgctccgcccaggccgccaaggagatcaagggcctgatccagaattcctccgccgatgtcggcagcggcgtcaaactggtgcgcgacaccggcgaggcactgaagacgatcggcggcttcatcgtcgagatcaacacccatatggaggcgattgcgatctcggcgaaggaacagtcgaccgggcttgccgaaatcaataccgcggtcaaccagatggatcagacgacgcagcagaatgcggcgatggtggaacagtccagtgccgctgccgtctcgctggcgcaggaagcggcgaaactgcgcgacctcgtcagtcagttcaggctggacggcaccgcccagtcggcgccgggccaggcagcgcgcgcagccgcccctgacagcaagccggtcgcttcccccgcccgcgcgcttggccgaaaaatcgccagcgccttcggcggcaaggcgaccgccgcggcggctgccgccgaagattgggaagagttctga

SEQ ID NO: 20485 - protein, 649 aa, Rhizobium sp
MKNWSIIFKMLVILGAFGLFSLGTGYYTSTQIMKIDTAYSNLLVEQVRASQSMASATRALQRARAAIADIIMLTDPKAAEVANAELAAAKKTFSELMAVAAQASPANPKIPEFRQAGLDILETHCARALDQGSKTTNAMEMMSAVKTFGTECQPGFPELTDKIVAETRDMEQAMLKAGDDLTGVSTSTSNNTLYILIGGLIIVLAASYFAVNAWVVKPIDALRELMAVLAGGNLDVHVEGTERRDEIGKMAAAVQVFKDNGLKARELEGQSEEMRAAAERNRQAEQERIAREAEQLRVATSTLGDALKRLAHGDLACAINTAFAAEYEPLRSDFNTTVDQLSLTISSVAVSVHSMDNGTREISSGANDLSKRTEQQAASLEETAAALDQITANVGNSTKRTEEARTVASRANQSAVHSAGVVSQAEEAMKKIEESSQQISNIIGVIDEIAFQTNLLALNAGVEAARAGEAGKGFAVVAQEVRELAQRSAQAAKEIKGLIQNSSADVGSGVKLVRDTGEALKTIGGFIVEINTHMEAIAISAKEQSTGLAEINTAVNQMDQTTQQNAAMVEQSSAAAVSLAQEAAKLRDLVSQFRLDGTAQSAPGQAARAAAPDSKPVASPARALGRKIASAFGGKATAAAAAAEDWEEF

SEQ ID NO: 20486 - DNA, 1959 bp, Desulfovibrio vulgaris
  CDS (1)..(1959)
atgacgcttgccagaaagctaatcgtcggcttcggtgcagtgctgttgctgcttgtgatcatgggtggcgtgtcgttcaatgcgttgtcggaagcggtagacggcttctcggactaccggcgcatggcacggggcagcaaccttgccggtgacatcgtcgaacatgtgttgctgatgcgcgtgaatgccgtttcgttccatgccaatggtgaggaaacggcggccaaggggttcgacaaatcgcggcaggaccttgacgccacgctgaccaaggctgccgagaccatcaagaatcctgaacgcgcacgccacgtgaaagaggcccgggacgcgttcacccagtacgcgcaagcgttcgaggccatgcacaaggtacaggtcgaaggcgagcgtcagaacggcatcatgttcgaccttgggccgaagatgcagcaggtggtgcagcgcatgcgcgaagccgctgcacgcgatgtcgacccttccctgcgggagaaggtctctgatattgccagacttctcaccgagacacggctcatgacggcccgtttcatggtcgtgcgcacaccggagacctatgccgccggcaaggcgggcgttcctgggatcgagtccgtgcttggtcagcttcaggccgcagggggacccggtctgcgtgaaggtgcgcacgaactggcgcagctgttccgtcagtacatgggagcctatgaagtcatgggccctgccatgctcaaggcgggagacctgttcgacggcgcactggcgacgcacgggcccgccatcgcggcatcggcactggccgtgcgcgagtcgtatctgcaggaacagaacgccctcgggcccaaggtgcaggctgccaacgacatggcacgcatggtcgtgggcgtcctcgtcgtcgtggccttgctggtgggcatcggcactgcatggttcctcatccgttcggtgctggcgcagttgggggccgaccctgctgaacttgccggagtggcccgccgcatcgccgatggcgacctcacggtgccgttcgcgggtgagcagcaacgaggggtctacgccgacatgaagctcatggcgggcaacctcgcctcggtcatcggcgaagtgcgtggaggtgcagagaacgtcgccgcaggtagcgaacagctgtccgcctcggcggagagtctctcgcagggggcaacggaacaggcggcctccatcgaggagatatcggcctccatggaagagatgacggccaacatccgccagaacatggagaacgcccgccagaccgagaccatcgccgtgcaggctgccgtggacgccgagtcgggcggcaaggccgtgaccgagacggtggtggccatgcgcgacatcgccgacaagatatccatcatcgaggagattgcccgtcagaccaacctgctggccctcaacgccgccatcgaggctgcgcgtgccggtgagcacggcaagggctttgccgttgtcgcagccgaagtccgcaagctggcggaacgcagcggtgctgccgctgccgagataagcgacctttcggcttccagtaccgccgttgccgaacgcgcgggcgagatgctcaccaagatggtgcccggcatccgtcgcacggccgaacttgtgcaggagattgccgcagccagcaacgagcagaacgccggggccgaacaggtgaacaaggccatcgcccagcttgatcaggtcatccagcagaatgcttcggcgtcggaggagatggcttcgacatcagaggaactctccagtcaggccgagcagctgcaagtgagtgtgggccgtttcaaggtctccgatacggatgccccggcacggcgcagacccgctccggcacgctcgggggcggtcgcccaccagccggccagacctgcgtcggggcgaaagggcgcaggcgctgtttcgctcgaccttgacggggatgacgacagtgatttcgaacggtactga

SEQ ID NO: 20487 - protein, 652 aa, Desulfovibrio vulgaris
MTLARKLIVGFGAVLLLLVIMGGVSFNALSEAVDGFSDYRRMARGSNLAGDIVEHVLLMRVNAVSFHANGEETAAKGFDKSRQDLDATLTKAAETIKNPERARHVKEARDAFTQYAQAFEAMHKVQVEGERQNGIMFDLGPKMQQVVQRMREAAARDVDPSLREKVSDIARLLTETRLMTARFMVVRTPETYAAGKAGVPGIESVLGQLQAAGGPGLREGAHELAQLFRQYMGAYEVMGPAMLKAGDLFDGALATHGPAIAASALAVRESYLQEQNALGPKVQAANDMARMVVGVLVVVALLVGIGTAWFLIRSVLAQLGADPAELAGVARRIADGDLTVPFAGEQQRGVYADMKLMAGNLASVIGEVRGGAENVAAGSEQLSASAESLSQGATEQAASIEEISASMEEMTANIRQNMENARQTETIAVQAAVDAESGGKAVTETVVAMRDIADKISIIEEIARQTNLLALNAAIEAARAGEHGKGFAVVAAEVRKLAERSGAAAAEISDLSASSTAVAERAGEMLTKMVPGIRRTAELVQEIAAASNEQNAGAEQVNKAIAQLDQVIQQNASASEEMASTSEELSSQAEQLQVSVGRFKVSDTDAPARRRPAPARSGAVAHQPARPASGRKGAGAVSLDLDGDDDSDFERY

SEQ ID NO: 20488 - DNA, 1701 bp, Geobacter sulfurreducens
  CDS (1)..(1701)
atgagctggaagaacctgaagctgagtctcaaggtgcttgcgggcatcggtagtgtccttgtgttgctggcggtcatcggcgtctgggcggtgaacggcctgtcaaaggttgtcagggacggccacgaggtaagcgaagggaacaaactgcgggccgagctcctccaacgggaggtggatcacctcaactgggccaagaacgtcagcacgttcctgctggatggcaaggtcagggagctcaccgttcaggtggatcacaccaagtgcaagttcggcgagtggtactacggcgagggacgcaagcaggccgaggccatgcttcccgcgctgaaggacgaactggctgccatcgaggaaccccaccgcaagctccacgagtcggcagggctcatcaagaaggcctacaacaaagagcagggtgagcagggccgcaaggacgcggagatcatcttcgcgagtcagacccagccgaacctgcagctggtgcagaagcacctggccgggctaaatgagacatcccgcaagaatatcctctccgatgaacagatgatcgccaacgccaacagcaccaagaccgccgtgatcgccctgagcattgccgccctggtaatcggcgttgttctggcactgctcatctcccgttccatcagcattccggtcctgaagggggttgaattcgccctgaagatagctgacggcgacctgcggagcaccctcgacattgatcggaaggacgaggtggggcagttggtggcggccctcaacgacatggttgccaagctccgtgacattgtaaccgatgtgaagaactcggccgataacgttgctgccggcagccaggagctctcctccagctccgaggtcatgagtcagggagccaccgagcaggcagccgcggccgaagaggcctccagctccatggagcagatggcggccaatatccggcagaacgcggacaacgcctctcagactgagaagatcgccctgaagagcgccactgatgcccgcgagggtggcaaggctgttgccggcacggtgagtgccatgaaggaaatcgcctccaagatctcgatcatcgaggagatagcccgtcagacgaacctgctggcgttgaacgcagccatcgaagcggcgcgtgccggtgagcacggcaaagggttcgcagtggtagcggccgaggtcagaaagcttgccgaacggagccagaaggcagcgggcgagatcagcgaactgtctgcctccagcgttcaggtagcggaagaggccggcgagatgctggcgcggatggtgccggatatccagcgtaccgcggaactggtgcaggagatcagtgccgcgtgcaaggagcaggactcgggagcggagcagatcaacaaggcgatccagcagcttgaccaagtgatccagcagaacgccagcgccagcgaagagatggcgtccaccagcgaagagctggccgggcaggcggagcatctccagtcgaccatcacatttttcaaaaccgacgagcaggggcgggctgccgggagatctccggccgtgcgtccggccgcggtggcgaagaagcccgctgcgttgcgcctgggccacggcaacgaacgccggacggagcctgtcgcgccgcgaaaggctgtagccggcaagggcgtggacctgaagatggacggcgactacctggatgaccagttcgaaaagttctag

SEQ ID NO: 20489 - protein, 566 aa, Geobacter sulfurreducens
MSWKNLKLSLKVLAGIGSVLVLLAVIGVWAVNGLSKVVRDGHEVSEGNKLRAELLQREVDHLNWAKNVSTFLLDGKVRELTVQVDHTKCKFGEWYYGEGRKQAEAMLPALKDELAAIEEPHRKLHESAGLIKKAYNKEQGEQGRKDAEIIFASQTQPNLQLVQKHLAGLNETSRKNILSDEQMIANANSTKTAVIALSIAALVIGVVLALLISRSISIPVLKGVEFALKIADGDLRSTLDIDRKDEVGQLVAALNDMVAKLRDIVTDVKNSADNVAAGSQELSSSSEVMSQGATEQAAAAEEASSSMEQMAANIRQNADNASQTEKIALKSATDAREGGKAVAGTVSAMKEIASKISIIEEIARQTNLLALNAAIEAARAGEHGKGFAVVAAEVRKLAERSQKAAGEISELSASSVQVAEEAGEMLARMVPDIQRTAELVQEISAACKEQDSGAEQINKAIQQLDQVIQQNASASEEMASTSEELAGQAEHLQSTITFFKTDEQGRAAGRSPAVRPAAVAKKPAALRLGHGNERRTEPVAPRKAVAGKGVDLKMDGDYLDDQFEKF

SEQ ID NO: 20490 - DNA, 1485 bp, Geobacter sulfurreducens
  CDS (1)..(1485)
atgggattgcgcaacatgactatccggtggaagctcattgccatgaccgcgataatcgttgttctgacggcaacggtgatcacagccatttgccttgcgcggttcaaggccgatctgatgagggttgccacggtttcccaggaaacgcggctcaagactctctgggaactgctccgtcagaagggagccaacgcccggatcgacaatggcaggctcatggtcggcgagtacgtggtaaacgacaactttgagattcccgacaaggtgaaggatctttgcggcgggacggcaaccatcttcatgggcgacctgcgggtttccaccaacgtcaagaaggaggacggcagccgcgccatcggcacaaagctccaggggcccgcctatgatacaattttcaagcaagggaaaccttaccgcggcgaagcgaatattctcggcgttccctactttacgtcctatgatccgctccgggatgcgagcggtgcgatcatcggcgtgctgtacgtcggcgtaaagaaaagtgagttcttcgaatcttacgatcgcctcaagctgatcatcgtcggcagcgcagtgggcacggttctgctggcgtgtcttgtggccgggttcgtgtcgggacggctcgtgcgcccgctgcgcgacgcagttgccaccgtagaccggctggccacgggcgatctttccgttgccgttgaagcaaaggggacggatgagatcggtcgcctgcttgccgccatgggcaatatggtgagcaagctcagggaggtagtcaccagtgtcaagtctgcttcggacaacgtggccgccggtgcccgcgagctgtccgtaagcgccgaggagatgagcgagggggccaccgagcaggcggcagcggcagagcaggcgtccggcaacatggaggagatgagcggttctatcagacacactgccgataatgcggtccagaccgagaaaattgccggcaagagcgccgcggatgcccgcgagggaggggaggcggttgccgagaccgtatcggccatgaaggttatcgccggcaagatcgcgatcattgaagagatcgcccgccagacgaatctgctggccctgaacgcggccatcgaggcggcccgggccggcgagcacggcaaggggttcgcggtggtggcctccgaggtgcgcaagctggccgaacggagtcagaaagctgcgggagagatcggtgagttgtccgcatccagcgtgcgaatcgcggagaaggctggagagatgcttgcccgcatgattcccgatattcagcggaccgcagaactggtgcaggagatcagcgcggcgtgcaaggagcaggattccggcgcggaccagattaacagggccatccagcaactggacaacgtgatccagcagaacgcctccaccagcgaggaaatggcgtccaccagcgaagaactggcgagtcaggccgaacagctccaggcaaccatagccttttttaacatctga

SEQ ID NO: 20491 - protein, 494 aa, Geobacter sulfurreducens
MGLRNMTIRWKLIAMTAIIVVLTATVITAICLARFKADLMRVATVSQETRLKTLWELLRQKGANARIDNGRLMVGEYVVNDNFEIPDKVKDLCGGTATIFMGDLRVSTNVKKEDGSRAIGTKLQGPAYDTIFKQGKPYRGEANILGVPYFTSYDPLRDASGAIIGVLYVGVKKSEFFESYDRLKLIIVGSAVGTVLLACLVAGFVSGRLVRPLRDAVATVDRLATGDLSVAVEAKGTDEIGRLLAAMGNMVSKLREVVTSVKSASDNVAAGARELSVSAEEMSEGATEQAAAAEQASGNMEEMSGSIRHTADNAVQTEKIAGKSAADAREGGEAVAETVSAMKVIAGKIAIIEEIARQTNLLALNAAIEAARAGEHGKGFAVVASEVRKLAERSQKAAGEIGELSASSVRIAEKAGEMLARMIPDIQRTAELVQEISAACKEQDSGADQINRAIQQLDNVIQQNASTSEEMASTSEELASQAEQLQATIAFFNI

SEQ ID NO: 20492 - DNA, 1692 bp, Geobacter sulfurreducens
  CDS (1)..(1692)
atgcgtatcggtgatctcaaaattggcgtacggcttggtattggatttggtgttttgctcgtcctactgggtgtcgttaccgtggtcggcatcaatggtatgaaggagattaactcaaagctggatcgcattctcaaggtcaactatgggaagatcaagaatgccaatgaagtctctatggtcgttggcgatttgatgggcaagatcaatgaaataatgctcaaggacgtgaatgagcggcctgcaatcaaacaggaaattgaaaaattgcggagcgattaccgctctgccctggagaggcttgaacaactggagcagacggatcagggcaaacaattgatcgccggtgccaaatccgctattgataatgccaaaaaggccaataacgacatcatcgagctgagtcttgccgggaaaaccgatcaggctctgatagtttacaacaaggaaggcgcccccctatcgcaaaagatcgtgacggcattcaagaatatcgtgaagtatcaggaagagcggatggagctgcgctacgctgaagcgctgaaagcctacggcacctcccgggccgttgcactcggtgttgctttctgcgcagcgatcatcggcattcttatcagcctgtttgcgaccaggagcattacgcgtcccctcgacaaagccgtatcggtatccaatgaactggcagaggggaacctgaccgtaacgatcgaagcgacgagcaaggacgagacgggtcagctgcttgcggcgatgcacaacatggtagagaagctgaagggcgtggtagctgacgtgaagagcgcggcggacaacgttgccgccggcagccaggagctctcctccagctccgaggagatgagccagggagccaccgagcaggcggccgcggccgaagaggcctccagctccatggagcagatgagctccaacatccggcagaacgctgacaacgccacccagaccgagaagatcgccctgaagagcgccacggatgcccgcgagggtggcaaggctgttgccggcacggtgagtgccatgaaggaaatcgcctccaagatctcgatcatcgaggagatagcccgtcagacgaacctgctggcgttgaacgcagccatcgaagcggcgcgtgccggtgagcacggcaaagggttcgcggtggtagcggccgaggtcagaaagcttgccgaacggagccagaaggcagcgggcgagatcagcgagctgtctgcctccagcgttcaggtagcggaagaagccggcgagatgctgacgcgaatcgtgccggacatccagcgtaccgcggaactggtgcaggagatcagcgccgcgtgcaaggagcaggacacgggagcggagcagatcaacaaagctatccagcagcttgaccaggtgatccagcagaacgccagcgccagcgaagagatggcgtccaccagcgaagagctggccagtcaggccgaacagctgcaggccaccatttcattcttccggaccgatgatcgtggcgcgtcaagccggagcgcggtccatcgtcccgttgccaagaaaaaggcagcgatccctcatctgggtcacggcacgtccaacggctaccacgccgaacccgcgacgtcgcggaaagtggcggtgggcggcggggtaaacctgaacctggacagcgatcaccttgacgaccagttcgagaaattctag

SEQ ID NO: 20493 - protein, 563 aa, Geobacter sulfurreducens
MRIGDLKIGVRLGIGFGVLLVLLGVVTVVGINGMKEINSKLDRILKVNYGKIKNANEVSMVVGDLMGKINEIMLKDVNERPAIKQEIEKLRSDYRSALERLEQLEQTDQGKQLIAGAKSAIDNAKKANNDIIELSLAGKTDQALIVYNKEGAPLSQKIVTAFKNIVKYQEERMELRYAEALKAYGTSRAVALGVAFCAAIIGILISLFATRSITRPLDKAVSVSNELAEGNLTVTIEATSKDETGQLLAAMHNMVEKLKGVVADVKSAADNVAAGSQELSSSSEEMSQGATEQAAAAEEASSSMEQMSSNIRQNADNATQTEKIALKSATDAREGGKAVAGTVSAMKEIASKISIIEEIARQTNLLALNAAIEAARAGEHGKGFAVVAAEVRKLAERSQKAAGEISELSASSVQVAEEAGEMLTRIVPDIQRTAELVQEISAACKEQDTGAEQINKAIQQLDQVIQQNASASEEMASTSEELASQAEQLQATISFFRTDDRGASSRSAVHRPVAKKKAAIPHLGHGTSNGYHAEPATSRKVAVGGGVNLNLDSDHLDDQFEKF

SEQ ID NO: 20494 - DNA, 1707 bp, Geobacter sulfurreducens
  CDS (1)..(1707)
atgacgtggttccacaatttaaaaattgcatctaagctgatagttggttttgctcttgttaccctgatagcttgtgttataggagctattgggataacaaaaataatgcagatagaaaaagccgatacagagatgtatgagctaaatgcaaagccaatgggacctatcctgactacagctgtggcttttcagaggatcagggtcaactatcgtgagatagcactggaacagactaatgaaggcaaggtaaagttttccaacagaattaaagagttgcaaaagacaatagatgacaatttgcccgaaatagaaaagtctctgaagtcggaagagactaagaaagcctacgcagatataaaggcagagttggctaagtttgcccctcatcttgacaagattgtggccctggccatggatgggaagaatgaccaggcagtggcctatatgaggagtgactccgtggccgggatcgcccggtccgtggacgactcgattcagaaactcgctgacctgaaaattgatctggccaagaagaaatccgacgccaataccgccgccgccaaggctgcggtggcgatgacgggcatcatcctcgtgctcggtgttgccctggcggtcggactcggcatattcctttcccgcatcatcagccgcccgctcagatcggccgtggacgtttcgaaccgcctgtcggaaggagacctgaccgtaacgatcgaagcgacgagcaaggacgagacgggtcagctgcttgcggcgatgcacaacatggtagagaagctgaagggcgtggtagctgacgtgaagagcgcggcagacaacgttgccgctggcagccaggagctctcctccagctccgaggagatgagccagggagccaccgagcaggcggccgcggccgaagaggcctccagctccatggagcagatgagctccaacatccggcagaacgctgacaacgccacccagaccgagaagatcgccctgaagagcgccgccgatgccaagcagggcggcacggccgtggcagaaaccgtcgtggccatgaaggaaatcgcctccaagatctcgatcatcgaagagatagcccgccagacgaacctgctggcgttgaacgcagccatcgaagcggcgcgtgccggtgagcacggcaaagggttcgcggtggtagcggccgaggtcagaaagcttgccgagcggagccagaaggcggcgggcgagatcagcgagctgtctgcctccagcgttcaggtagcggaagaagccggcgagatgctgacgcggatcgtgccggacatccagcgtaccgcggaattggtgcaggagatcagcgccgcgtgcaaggagcaggacacgggagcggagcagatcaacaaagctatccagcagcttgaccaggtgatccagcagaacgccagcgccagcgaagagatggcgtccaccagcgaagagctggccagccaggccgaacagctgcaggaaacaatcgccttcttcaaaaccggcgaacaggtgggtttggtgcgcaaagcggcagcagtgcgccagttcgcggccaagaaaaaggcagcgatccctcatctgggtcacggcacgtccaacggctaccacgccgaacccgcgacgtcgcggaaagtggcggtgggcggcggggtagacctgaacctggacagcgatcaccttgacgaccagttcgagaaattctag

SEQ ID NO: 20495 - protein, 568 aa, Geobacter sulfurreducens
MTWFHNLKIASKLIVGFALVTLIACVIGAIGITKIMQIEKADTEMYELNAKPMGPILTTAVAFQRIRVNYREIALEQTNEGKVKFSNRIKELQKTIDDNLPEIEKSLKSEETKKAYADIKAELAKFAPHLDKIVALAMDGKNDQAVAYMRSDSVAGIARSVDDSIQKLADLKIDLAKKKSDANTAAAKAAVAMTGIILVLGVALAVGLGIFLSRIISRPLRSAVDVSNRLSEGDLTVTIEATSKDETGQLLAAMHNMVEKLKGVVADVKSAADNVAAGSQELSSSSEEMSQGATEQAAAAEEASSSMEQMSSNIRQNADNATQTEKIALKSAADAKQGGTAVAETVVAMKEIASKISIIEEIARQTNLLALNAAIEAARAGEHGKGFAVVAAEVRKLAERSQKAAGEISELSASSVQVAEEAGEMLTRIVPDIQRTAELVQEISAACKEQDTGAEQINKAIQQLDQVIQQNASASEEMASTSEELASQAEQLQETIAFFKTGEQVGLVRKAAAVRQFAAKKKAAIPHLGHGTSNGYHAEPATSRKVAVGGGVDLNLDSDHLDDQFEKF

SEQ ID NO: 20496 - DNA, 2889 bp, Geobacter sulfurreducens
  CDS (1)..(2889)
atgctacagaacatgcggatcggtttgcggttggggctcgggttcggattagtggttgtgttgatggtgatcctcggcggcatctccatcaatagaatggctaccctgaacacagaccttgacatggttgtcaaggatcgctggcccaaagcggagacaaccttcggaatcagtagccagatcaacgtggtggcgcgggcattgcgcaacgcaatccttctggatgatccagcagaggttcagaaggagattgcgcgaatcaacgaagcttcggtgagcgtcagcaagtcgatggatgaactgtccaagagcatcaccagcgaggaggggaaggccaaactgaaggcggtggaggcctcccgcgccgcataccgggaggatctgctgaagctggttgagtatatcagggccggcaacaagtctgctgcccagaagatgctcttcggcagctaccgcgaaaggcagcgaagctacttcgatgccgttgacgggttgacacagtatcaggccaagctcctggcggtatccggcaaggaggctgagcagaccttcgtttcctccagaaacatcatcgtagcgcttctcgtgctgtcggcccttctcgcatgtgcctgcgcctggctcgtgacccgctccatcaccagacccatcggcgcctgcatggccgctgcgggcaggatcgcctccggcgacaccgacgtgaccctggacgtgacggcgcgtgacgaaaccggcctgctgcaggttgagatgcagaagatggtggaagcaatcagggcgctgattgcggacgccgacatgctctcgcgggccgcggtcgaggggcgtctcgcgacccgggccgatgcggctaagcaccagggcgatttccgcaagatcgtctccggcgtcaacgatacccttgatgcggtcatcaccccactcaatgtggccgccgactacgtggatcgcatctccaggggcgacattccgccccggattaccgatacctacaacggagatttcaatgaggtgaaaaacaacctcaaccggtgtatcgacgcgctcaacggcctgctgagcgacatgaacgagatgtcgaaaatgcacgatctgggcgacatcgacgtggttatgcccgctgacaattaccagggcgcttaccggatcatggccaagggcgtgaacgacatggtgaacggtcacatcagcgtcaagaaaaaagcgatggcctgcgtggccgagttcggcaaagggaatttcgacgccgaactggaaaagtttcccggcaaaaaggcttttatcaacgacacgatcgaggcagtacggagcaatatcaagaacttcatcgccgacatgggacacatgtcccaacagcacgacctgggtgacatcgacgttaaaatgccggaagaccagtaccagggggccttccaggtcatggccaagggtgtgaacaacatggtgggcggtcacatcagcgtcaagaagaaggcgatggcctgcgtggccgagttcggcaaagggaacttcaatgccgacctcgaaaagttccccggcaaaaaggcatttatcaacgagacgatcgagggcgtacggaccaatctcaagtccttcgaagagcaactgggaatcctgatcacggccgctgccgacggccaactggacaagcgagccaacgcggacctcttcgtgggaggctggaaccagcttgcccggggtgtcaacgataccatcaccaatatcgtcgaaccgctgatggttaccgccgattacgtggaccggatcagcaagggcgatatgccgccccttatcaccaaggaataccggggccagtacaacatcatcaaacagaacctgaatacgctcatcgatgccaccaacggcatcgttgcggccgcgaaagaggttgccggcggcaacctgatggtggagctcagggagcgctcggccaaggatgagttgatgcaggccctttccgcaatggtaaagaagctctccgaggtcgtggccgaggtgaagagcgccgccaacaacgtggccgcgggaagtcgcgaaatgagttccggctccgagcagatgagccagggggccaccgagcaggcggctgccgcggaagaggcgtcgtcaagcatggaggaaatgtcttccaatatcaggcagaatgccgataacgcctcccagacggagcggatcgccatcaagagcgcccaggacgcccgcgacggcggcaaggcggtggccgaaaccgtcaccgccatgaaggatatcgcctcgaagatatcgatcatcgaggagattgctcgccagacgaatctcctggcactgaacgcggccatcgaggcggcccgcgccggcgagcacggcaagggattcgcggtggtggcggccgaggtcagaaagcttgccgagcggagccagaaggctgccggcgagatcagtgacctgtcggcctccagcgtggaggtggcggagaaggccggcgagatgctgggtcgaatcgtgcccgacattcagaaaaccgcggaactggtccaggagatcagtgcagccagcaaggaacaggacacaggcgccgagcagatcaaccgggccatccagcaactggaccaggtgatccagcagaatgccagcgcagccgaagaaatggcatccacggcagaagaactgtctgcccaatcggaacagctccagtcgatcatttccttcttccgggtcgatagctcggcgcagtcctccagtgcgattgcggctgcaaagcctgcggcgaaaaagccggcccttgcccacgcgccggccaacgggtaccacaaggcaaatcaggctccggccaagaaggtggcacatgcaggactcaacctcaatcttgaagggggagatcacctggattccgagttcgaaacgttctag

SEQ ID NO: 20497 - protein, 962 aa, Geobacter sulfurreducens
MLQNMRIGLRLGLGFGLVVVLMVILGGISINRMATLNTDLDMVVKDRWPKAETTFGISSQINVVARALRNAILLDDPAEVQKEIARINEASVSVSKSMDELSKSITSEEGKAKLKAVEASRAAYREDLLKLVEYIRAGNKSAAQKMLFGSYRERQRSYFDAVDGLTQYQAKLLAVSGKEAEQTFVSSRNIIVALLVLSALLACACAWLVTRSITRPIGACMAAAGRIASGDTDVTLDVTARDETGLLQVEMQKMVEAIRALIADADMLSRAAVEGRLATRADAAKHQGDFRKIVSGVNDTLDAVITPLNVAADYVDRISRGDIPPRITDTYNGDFNEVKNNLNRCIDALNGLLSDMNEMSKMHDLGDIDVVMPADNYQGAYRIMAKGVNDMVNGHISVKKKAMACVAEFGKGNFDAELEKFPGKKAFINDTIEAVRSNIKNFIADMGHMSQQHDLGDIDVKMPEDQYQGAFQVMAKGVNNMVGGHISVKKKAMACVAEFGKGNFNADLEKFPGKKAFINETIEGVRTNLKSFEEQLGILITAAADGQLDKRANADLFVGGWNQLARGVNDTITNIVEPLMVTADYVDRISKGDMPPLITKEYRGQYNIIKQNLNTLIDATNGIVAAAKEVAGGNLMVELRERSAKDELMQALSAMVKKLSEVVAEVKSAANNVAAGSREMSSGSEQMSQGATEQAAAAEEASSSMEEMSSNIRQNADNASQTERIAIKSAQDARDGGKAVAETVTAMKDIASKISIIEEIARQTNLLALNAAIEAARAGEHGKGFAVVAAEVRKLAERSQKAAGEISDLSASSVEVAEKAGEMLGRIVPDIQKTAELVQEISAASKEQDTGAEQINRAIQQLDQVIQQNASAAEEMASTAEELSAQSEQLQSIISFFRVDSSAQSSSAIAAAKPAAKKPALAHAPANGYHKANQAPAKKVAHAGLNLNLEGGDHLDSEFETF

SEQ ID NO: 20498 - DNA, 1590 bp, Geobacter sulfurreducens
  CDS (1)..(1590)
atgccgagagtgctcagcctctggcagcgttatctcgatctctccgtcaatgccaaattgatgctgtatgtggcctgcttcaccgtctggctcattttggtgggggcggccgggttgtggggcatgggagtgttgagcaccggcatcaaccgcgacgggcttgcattgcggcgtgtgcttctggtgtccgggctcaagaacgatttgctctacttgcgccacgaccttgatcgctattttctcgaaaatggaaatgccgcgagccgtgccatacacgatgccgaacaacggctcaaaaccattgctggtggcatagaggcacttgaacgtcacgagcccgacgcggagcagcgcaggctcctgggggtcttcgcgcaagagtttgcactgtatcgcgaagcagtagtgcggcttattgacctgcaaaagcgagcccttgagacgggagatgtcactgtgcggtcagcggcggcctcctatgcccgagaggatattctgcccctctttttcggggcttccgatgcggtaaccgatctggtggagtttgatcgccagcaggccttgcagaccgtagatgcgaacggcctgcagtatgcccggctttcacgggttctaccggcactgatcgtggcagctgttacactggggctttttttcgggattgtcattgcccgttccattaccaagcctctcgcgcgtattctcgctgcggtcgaatctcttgccaccggcaacctgaacgtggatgctcccgttggtgcgcgagacgatcttggccggttggccgtgggaatcaatgccatggttgggcggttccgggacgttgtgacgtcgatatgcagagatagcgaggctgtggccggagctgcatcccagctgtcgggaaccgcctgccagttgtccgaggccgccacagagcaggctgccgctgcggaagatgcgtcgtcgagcatggaacagataagctccgccatccgggcgaatgtccagaacgcccaaacaacggcagatgttgccaaccggagttccatcgatgctgccgcggggggggaaacggtgacggaaaccgtggcgttgatgaaggagatctccagaaagatcatggtgattgaggagatagctcgtcaaaccaatctgctggcgctcaacgccgccattgaggcggcacgggccggtgaccacgggaaggggtttgccgtggttgccggtgaagtccgtaaactggcggagcggagccagtcggccgcggccgagatcggccggctttcggtaacgagcgtcgaggtggctgagcgggcaggcaccctgttcggcgccattattcccgatatccgccagacggctgagcttgtccagggaatcagctccgcctgccacgagcaggaaaccggcgttggccagatcaatcgggccatacgtcagctagatgccgtgattcagcagaatgcttcggcttccgagcagatggcgtcgacggcgcaggaattgtcatctcaggcggacatgctgcttgatgccgtcagtttctttcgactgggtgagactaaccggtatcaggaatcccgtagcgaactatcgggaatttcctga

SEQ ID NO: 20499 - protein, 529 aa, Geobacter sulfurreducens
MPRVLSLWQRYLDLSVNAKLMLYVACFTVWLILVGAAGLWGMGVLSTGINRDGLALRRVLLVSGLKNDLLYLRHDLDRYFLENGNAASRAIHDAEQRLKTIAGGIEALERHEPDAEQRRLLGVFAQEFALYREAVVRLIDLQKRALETGDVTVRSAAASYAREDILPLFFGASDAVTDLVEFDRQQALQTVDANGLQYARLSRVLPALIVAAVTLGLFFGIVIARSITKPLARILAAVESLATGNLNVDAPVGARDDLGRLAVGINAMVGRFRDVVTSICRDSEAVAGAASQLSGTACQLSEAATEQAAAAEDASSSMEQISSAIRANVQNAQTTADVANRSSIDAAAGGETVTETVALMKEISRKIMVIEEIARQTNLLALNAAIEAARAGDHGKGFAVVAGEVRKLAERSQSAAAEIGRLSVTSVEVAERAGTLFGAIIPDIRQTAELVQGISSACHEQETGVGQINRAIRQLDAVIQQNASASEQMASTAQELSSQADMLLDAVSFFRLGETNRYQESRSELSGIS

SEQ ID NO: 20500 - DNA, 2184 bp, Geobacter sulfurreducens
  CDS (1)..(2184)
atgttcaagaacatgaaggtaggcttaaggctcggtatcggttttggcgtggtggtgactgtgttcatgattgcgatcctagttacacttgtgctgttgcgtgaggtcaatcaggagtcgcgtcaggtcgccgaagagtcgataccattcctcatgagtgcatacgagatggatgtggccttggcggagctgacggagaatctcacagacgtggcagctacccatagtcctgatggtttcaagggggcagaggaggcagctgctattgtaaagcgggaaataacgaagtttcgtgaaatgttccgcaaggagaacgacaccgttgcattgaaggagttggatgatgtggaggctgcgtttaccgcctttcacctcagcggcgtcaagatggccaaggtctatatggagcagggaattggagcgggtaaccctctgatgaaagaattcgataatgcccacgaggtactgatcgaaaaggtcgagaagcttcaaaagagccaggtggatgaggctctaggcaatagccgcgacaatgttgccgcagtcggtaaggtgaccatggtcctaatcggattcgggattgtagccgttttgataggcgtggccgtcgcgtttttcattacccggagcattacgcttccgctcgtccgcgccatggaagccagcaatcgccttgcagagggagatttgaccattgagattgttgctgaccgcgaggatgaggcggggcaactgctgaagtccatgaagaacatgattgattccctgcggtctctggctacaacggcagagcgtgtggcagaaggagatctggcagtcgaggttgttgtccgttcagatcgtgacgttcttgcccgaaacctccacggcatgcttgagacgctcaaagggctgcgtcaggaaacagatgaacttatcggtgcggttcgtgacggcaggttaagcgtgcgcggcaatgcgcgaaccttcagtggaggttggggggagcttctgaccggtatcaaccagttggtggacgcttttgtgcagccgatacaggttactgctacggcgcttaatcgtatcagccgcggtgatataccggagaagataacggcggaatacaaaggagatttcaacgaaatcaagatcaatctcaacagtctcatcgatgctatgaattcaattaccgccctcgcccaagagctctctgccggcaatctgacagttgaggttaaagagcggtctgagcgggacgagttgatgaaggcacttgcgtctatggtgaccaagctgcgcgatgtggtggcggatatcatgatagctgccgacaacgtcacgtcaggcagtcaacaactgtcgtccacgtccgaggagatgagccagggggccaccgagcaggctgcttcggcagaggaggcctcgtcgagcatggaacagatgtcgtccaatatccgccagaatgcggataatgcggcgcagaccgagaggattgccatcaagtctgcggcggacgccatcgagggagggaaggcggtcggcaataccgtgtcagccatgaaggagatcgcatcgaagatttccatcattgaagagattgcacggcagactaacctgctggcgctcaatgcggcgatcgaggcggcgcgtgccggcgaacacgggaaaggattcgccgtggtggcgagtgaggtacgcaagcttgctgagagaagccagaaagcagcgggcgaaatcagtgagctctcttcttcgagcgtagaggttgcagtcagggcaggcgaattgcttgccaccatcgtgcccgatattcagcgaacctctgaactggtgcaggagatcagcgccgcctgccgtgaacaggatacgggtgccgagcagatcaacaaggccatccagcagcttgatcaggtgatccagcagaatgcctcggcggcggaggaaatgtcgtccacggctgaggagctttcgtcgcaggccgagcagcttcaggacacggtcgctttcttcagtattggtggagagatgaaacgtaagattgcgccaaagccgtctcgaccgaacgccaaggcgagcatcaggctccctgcggctcctcacggcacggccaacggttatggccgaacgagtgcttctgttaccggcggctttgccctggatatggcaggccacgatcatctggacaacgagttcgaaaaattctga

SEQ ID NO: 20501 - protein, 727 aa, Geobacter sulfurreducens
MFKNMKVGLRLGIGFGVVVTVFMIAILVTLVLLREVNQESRQVAEESIPFLMSAYEMDVALAELTENLTDVAATHSPDGFKGAEEAAAIVKREITKFREMFRKENDTVALKELDDVEAAFTAFHLSGVKMAKVYMEQGIGAGNPLMKEFDNAHEVLIEKVEKLQKSQVDEALGNSRDNVAAVGKVTMVLIGFGIVAVLIGVAVAFFITRSITLPLVRAMEASNRLAEGDLTIEIVADREDEAGQLLKSMKNMIDSLRSLATTAERVAEGDLAVEVVVRSDRDVLARNLHGMLETLKGLRQETDELIGAVRDGRLSVRGNARTFSGGWGELLTGINQLVDAFVQPIQVTATALNRISRGDIPEKITAEYKGDFNEIKINLNSLIDAMNSITALAQELSAGNLTVEVKERSERDELMKALASMVTKLRDVVADIMIAADNVTSGSQQLSSTSEEMSQGATEQAASAEEASSSMEQMSSNIRQNADNAAQTERIAIKSAADAIEGGKAVGNTVSAMKEIASKISIIEEIARQTNLLALNAAIEAARAGEHGKGFAVVASEVRKLAERSQKAAGEISELSSSSVEVAVRAGELLATIVPDIQRTSELVQEISAACREQDTGAEQINKAIQQLDQVIQQNASAAEEMSSTAEELSSQAEQLQDTVAFFSIGGEMKRKIAPKPSRPNAKASIRLPAAPHGTANGYGRTSASVTGGFALDMAGHDHLDNEFEKF

SEQ ID NO: 20502 - DNA, 1701 bp, Yersinia pestis
  CDS (1)..(1701)
atgaataacatgttttcacgcatgaattatgttgttaaaaaatattttggctacattatgagtaaactttcgctttctgaatctagattgggaatattatttggttttactttagtgattagtctattttctttgttgcagatcttctccataggttatttatctcatattttaaagagtaccaaagcgaatgtagagataacgcaccgtaatcatcaacaagaggcgttgatggatcgtgcgcggatggaactattaattgccagtgacaagcttaatcgtgcgggtatctattatatggaagataaagagaccggctccgaaggcagttggcaaagtcttctcaatgaggcattgcagtcattgcagcaatctcaggacagctatctgcagttgcaggcggtttccgcccaagacagtagacaagaattgaatgaacttaaggagagctaccatcagttgtatcaggggctggctgaaatagcgcaggggttagcgcaaaagcacaatattgacaccttctttgacgtgcctatccagggctttcagagcgacttcaccgagaagtactaccgctatttacaggaaagtgaaaagggcagcactgctatggatgagcagctcttgtcctcactgtcttcagctaaacagatcattattggtgcactggccatattgttggtactggctttctctgcctggctaggcgtcacccgttggatgattgcgcccttaaatcaccttatctcacgtatcaataagattgctgccggggatttatcacaccgtattgaagacacgtcttttgcttgccgagaaattagacaactcacttatagtgtaagacatatgcaagaggggctagttgcattggttagccaggtccgaggtggagctgaggtgatcctgaccggtgtgaaccagattacggctgataaccatcgtctctctgaacaaacgcactcacaaactcaatcattggcggtgacggcgcaaagtatgcagcagcttaccgtcagggttaaacaaaactccatgagtgccgagcaggcgaatcatctggtgaatgaagctagagatacggccagtcagggaggagagatgatgtctaatgtggtgagttcaatggccgatatttccacgggttcacgggagataagcgaaattattacacttattgagtcggttgcttttcagaccaatattttggcattaaatgcagcaattgaagccgctcatgcgggtgaacacggccgtgggttctctgttgtggcacgtgaggtcggtacattggctcaccaaagtggccattcagcacaaaatattaagcgccttattcagcattctgccaactcagtttctacgggggcctcgctggttaatcgttccggtgagaatttacaggctattattgatgtggtgaagaaagtcaccgatttaatggcggaaataactaccgcatcacattatcaaagcaaaggaattgaggagatggccgcgcaggtagagatgattaatggcgcaacaaaacagaatgcagcattggttgagcaatctgcacacgcatcggaagtgttgcaacagcagaccttacagcttaatcagtcggtagcccgctttcatttacctgtagaaaaatactctcctctacgattagcaaaggagagcacgattgctgctattgattcacgcgttagttaa

SEQ ID NO: 20503 - protein, 566 aa, Yersinia pestis
MNNMFSRMNYVVKKYFGYIMSKLSLSESRLGILFGFTLVISLFSLLQIFSIGYLSHILKSTKANVEITHRNHQQEALMDRARMELLIASDKLNRAGIYYMEDKETGSEGSWQSLLNEALQSLQQSQDSYLQLQAVSAQDSRQELNELKESYHQLYQGLAEIAQGLAQKHNIDTFFDVPIQGFQSDFTEKYYRYLQESEKGSTAMDEQLLSSLSSAKQIIIGALAILLVLAFSAWLGVTRWMIAPLNHLISRINKIAAGDLSHRIEDTSFACREIRQLTYSVRHMQEGLVALVSQVRGGAEVILTGVNQITADNHRLSEQTHSQTQSLAVTAQSMQQLTVRVKQNSMSAEQANHLVNEARDTASQGGEMMSNVVSSMADISTGSREISEIITLIESVAFQTNILALNAAIEAAHAGEHGRGFSVVAREVGTLAHQSGHSAQNIKRLIQHSANSVSTGASLVNRSGENLQAIIDVVKKVTDLMAEITTASHYQSKGIEEMAAQVEMINGATKQNAALVEQSAHASEVLQQQTLQLNQSVARFHLPVEKYSPLRLAKESTIAAIDSRVS

SEQ ID NO: 20504 - DNA, 1641 bp, Shigella flexneri
  CDS (1)..(1641)
atgaatacaactccctcacagcgattaggttttttgcatcacatcaggctggttccgttatttgcctgcattcttggcggtatcttagttctattcgcattaagttctgctctggctggctatttcctctggcaggccgatcgcgatcagcgtgatgttactgcggagattgagattcggaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccttcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgccagtggcgatctgacgatgaatgatgaaccggcgggtcgtaatgaaatcggtcgcttaagtcgtcatttacagcaaatgcagcattcactggggatgacagtagggactgttcgacagggcgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaagggcgtggatttgccgttgtcgccagcgaagtacggacactcgcaagccgcagcgctcaggcagcgaaagagattgaaggcttgatcagtgaatcagtcaggttaattgacctggggtcggatgaggtggcaacggcagggaaaaccatgagcactattgttgatgccgtcgcgagtgtcacacatatcatgcaggaaatcgccgccgcctcggatgaacaaagtagaggcataactcaggttagccaggcgatttctgaaatggataaggtgacgcaacagaatgcttctctggtagaagaggcctcagcagcggcggtgtcccttgaagaacaggctgcacgattaactgaggcggtgaacgtattccgtctgaacaaacattctgtgtcggcagaacctcgcggagcgggtgaaccagttagtttcgctacggtgtga

SEQ ID NO: 20505 - protein, 546 aa, Shigella flexneri
MNTTPSQRLGFLHHIRLVPLFACILGGILVLFALSSALAGYFLWQADRDQRDVTAEIEIRTGLANSSDFLRSARINMIQAGAASRIAEMEAMKRNIAQAESEIKQSQQGYRAYQNRPVKTPADEAFDTELNQRFQAYITGMQPMLKYAKNGMFEAIINHESEQIRPLDNAYTDILNKAVKIRSTRANQLAELAHQRTRLGGMFMIGAFVLALVMTLITFMVLRRIVIRPLQHAAQRIEKIASGDLTMNDEPAGRNEIGRLSRHLQQMQHSLGMTVGTVRQGAEEIYRGTSEISAGNADLSSRTEEQAAAIEQTAASMEQLTATVKQNADNAHHASKLAQEASIKASDGGQTVSGVVKTMGAISTSSKKISEITAVINSIAFQTNILALNAAVEAARAGEQGRGFAVVASEVRTLASRSAQAAKEIEGLISESVRLIDLGSDEVATAGKTMSTIVDAVASVTHIMQEIAAASDEQSRGITQVSQAISEMDKVTQQNASLVEEASAAAVSLEEQAARLTEAVNVFRLNKHSVSAEPRGAGEPVSFATV

SEQ ID NO: 20506 - DNA, 1995 bp, Wolinella succinogenes
  CDS (1)..(1995)
atgaatgatatgacactaggggccaaaatcaagctgggctttggactgattcttgccatcactcttctactcggaatgatcggaatctacaacatgaaaggtggcgagcgtattgccaacgaattggctaatattcaagtgcccgaagccaacggggcggtgcaagtcttagtcgcaaccgacgctttgcgctatcacatgaggggatatcttcttggcgataacgccgctgacttaaagcgcgccaaggagagttttgtcgccctccaaaaggctcttgcgggagccaaagcattgggtgaaaaatatcatctctctgagcttctcaaaaaggaggtaaccgcctctgaggccgtaaagcgttttggcttagccaccgaaaagatagaggctctagcgcagagacgctttaatgccgataacgccatggttgagagcgcacgagtcttgaccgaaaatatcgacgcttacaccaaggctcaattccaactcatgcgccaagaattgggcgagggagcctctagggataaaacccaaaaccgcctccaaaaaatccaagagatctctcagatggtcgcctatatcaccaacgccagagttcttggccagcgcgctcaggtgattagagatcctagcgtcctccagactgccgcctcccagtttgcccccgtctatggcttgcttgattccttaaagcgagacacccaccgaatcgagaaccaaagacagctagaaacgattgagcgtgcggccaaaagctatgagcaagccattcgagattttatcgtgatcaaccaagaggtcaccaacgaacgcacagtgatgatcaatttggctgatgaagtggcaaccctctctgaagagattgtgaccacatccctccaagagaccaccagcttaagcaacgagaccgccagctccctcacggtggcttcgagcattatgatctttggcctagtgatcgccatcctccttggcatagccttaagcttctttattgtccgaagcatcaccaaacccatcatcgaagccgtccgcaccatcagcgacgccaactctcaggtggtcagtgcctccgatcaaatcgctgattcttcgacctcgctagccgaaggctctagtgaacaggcaagcgccgtggagcaggtgagcgctacgattgaagagagcaccgccatcaacaaccaaaatgctgagaatggcaaagaggctgatatgcttgccaaatcggccaacgaatcggccaagcgaggcaatgagcgagtccaacagctcatggtcgcgatgaataaaatcaccgattcgagtcaaaaaatcgccaaaatcatcaagaccattgacgagattgctttccaaaccaatcttcttgccctcaatgcagccgttgaagccgccagagcaggtgagcacggcttgggctttgccgtggtcgctgatgaagtgaagaatctcgcccaaagaagcgctgaagccgccaaagagaccgccgccattattgaggatgcgatcgaggaaatcaagggcgggaatcagattgccaaagagaccaatgagagcttcactgagattcttgataaggtgaaaaagacctccgatctcatcggtgagatctctatctccatcagagaacaggccgaggggatgaatcagatcgccacggctatgggccaggttgatcaagtcacccagcaaaatgccgccaattctgaagaagccgcggcggctgccgaagagctcaacgctcaggccatcgctatgatgcagagcacccaaaatatcgccaagatcgtggggctagccatggataatctcttcaccactcacactaaggccgcccccaccaagccctcctcctctataagccccaagctcaaacagattcctcacgctaagactgagctcaaacgaagcgttccctctttccccaaaaaggagcgccgttccaaagaggatgagattttccctttggatgccgatgacctgaaggagttctaa

SEQ ID NO: 20507 - protein, 664 aa, Wolinella succinogenes
MNDMTLGAKIKLGFGLILAITLLLGMIGIYNMKGGERIANELANIQVPEANGAVQVLVATDALRYHMRGYLLGDNAADLKRAKESFVALQKALAGAKALGEKYHLSELLKKEVTASEAVKRFGLATEKIEALAQRRFNADNAMVESARVLTENIDAYTKAQFQLMRQELGEGASRDKTQNRLQKIQEISQMVAYITNARVLGQRAQVIRDPSVLQTAASQFAPVYGLLDSLKRDTHRIENQRQLETIERAAKSYEQAIRDFIVINQEVTNERTVMINLADEVATLSEEIVTTSLQETTSLSNETASSLTVASSIMIFGLVIAILLGIALSFFIVRSITKPIIEAVRTISDANSQVVSASDQIADSSTSLAEGSSEQASAVEQVSATIEESTAINNQNAENGKEADMLAKSANESAKRGNERVQQLMVAMNKITDSSQKIAKIIKTIDEIAFQTNLLALNAAVEAARAGEHGLGFAVVADEVKNLAQRSAEAAKETAAIIEDAIEEIKGGNQIAKETNESFTEILDKVKKTSDLIGEISISIREQAEGMNQIATAMGQVDQVTQQNAANSEEAAAAAEELNAQAIAMMQSTQNIAKIVGLAMDNLFTTHTKAAPTKPSSSISPKLKQIPHAKTELKRSVPSFPKKERRSKEDEIFPLDADDLKEF

SEQ ID NO: 20508 - DNA, 1635 bp, Photorhabdus luminescens
  CDS (1)..(1635)
atgttaggcaggcttcgtatatcaaccagtttatatctgttactgatgatgttttgtgtaatgcagataatctcaagtggtttatcacttggaatcattcacgcagatcaatcttatattgagcagattgatctgggaacacagaagagggataccttagggttgagctgggcagctctgctgcaatcgcgtaatacacttaatcgaatcgctgtagggaaaacgttacaacaatctgaggatcatattggcagtatggttgctaatgttaaggaaaccttagatagggctgagatgcattttgctgagtttattgcgctgcctaaattgaatgacgaggatggtagtagtgtattgctggcctcggtagaaaccagttataaggaatatatcaacgcgcttagagaactctcggcttttttagaaagtggtaattatgatgcattcttagatcagccgacagaaaagtatcagcagcaacttgaatctgatttcaatcattatatgcaatatatcggtgaggtgattacaaccgccgttcaagatggtcgtctttattaccaaatttcagttgccatgtttgtaggtgcgatcttaatggtactggttgttgcttgggcggctcattggtggttgaaaaagaatcttctcagaccttttgccaatatgcgtagtcacttccagaatgttgcggaaggaaaactcaataaagaagtttctgttttcactcaagatgaaattggtgaagtgttcctcaaattacgtgaaatgcaacgttcactggttaattccattacgttggtaaaagagaatactaacttgatgtataacggtattcaggaaattactcagggtaataccgatctctcttcccgcactgaagagcaagctgcatcactggaagaaacggcagccagtatggaacaactgactgcaactgtgcgtcagaatgcggaaaatgctcgccaggccagtgaattggcggtatctgcatcgaaaacagcctctaaaggaggcgaactgaccgttgatgttgtggaaacaatggatgcaattgccaatagctcacagaaaatcagtgccattatcagcgtcattgatggtattgcatttcagaccaacattttggcactgaatgcggcagtagaagctgcacgggcaggtgaacaaggccgaggtttctccgttgttgctggtgaagtgagggatcttgctcagcgaagtgccgaagcagcgaaagagattaagacattaattagtgaatctgttcagcgggtaagccaaggttccgagttggttagtcatgcagggaagaccatgaatgaattggtcgtttctgtaaaccaagtcacggatctgatggctgaaattgctgcggcatctgatgaacaaagtcggggaattcatcaagtagcacaagcggttacacagatggatcaggttactcagcagaatgcggcattggttgaacagtcagcggcggcggcggcggcacttgaagatcaggccgatattttggtgcaaatagtggcacaatttgagttacccaataattcagaaaataagcttgaaaatgaactttcactgacgctgaggtctgcggatagcgaaggggcagtcaatcagactcactga

SEQ ID NO: 20509 - protein, 544 aa, Photorhabdus luminescens
MLGRLRISTSLYLLLMMFCVMQIISSGLSLGIIHADQSYIEQIDLGTQKRDTLGLSWAALLQSRNTLNRIAVGKTLQQSEDHIGSMVANVKETLDRAEMHFAEFIALPKLNDEDGSSVLLASVETSYKEYINALRELSAFLESGNYDAFLDQPTEKYQQQLESDFNHYMQYIGEVITTAVQDGRLYYQISVAMFVGAILMVLVVAWAAHWWLKKNLLRPFANMRSHFQNVAEGKLNKEVSVFTQDEIGEVFLKLREMQRSLVNSITLVKENTNLMYNGIQEITQGNTDLSSRTEEQAASLEETAASMEQLTATVRQNAENARQASELAVSASKTASKGGELTVDVVETMDAIANSSQKISAIISVIDGIAFQTNILALNAAVEAARAGEQGRGFSVVAGEVRDLAQRSAEAAKEIKTLISESVQRVSQGSELVSHAGKTMNELVVSVNQVTDLMAEIAAASDEQSRGIHQVAQAVTQMDQVTQQNAALVEQSAAAAAALEDQADILVQIVAQFELPNNSENKLENELSLTLRSADSEGAVNQTH

SEQ ID NO: 20510 - DNA, 1695 bp, Photorhabdus luminescens
  CDS (1)..(1695)
atgtttaaccgaatgaaaatagtgaccggactgatggcggtcatcatattatttggtgctctgcaatttatatccggaggacttttcttccatgagttgaaaagtaacaaggaaaatctagaaatactggataaaatgcgggaacagcagacatttttgaatgacacttgggttaatttgttacaggcccgtaacaacttgaaccgtgcgggcattcgttacatgatgaaaaaagatgagggagtcgataattactacacactggagcagttactgacagatgccagaagtaacctctctatcgcagagcagcgttttgaacaatacgaacagaccgctaaattgcctattcatgaatcagaaagtcttaatcgccttaaaaaagcctatgatgtttatatttcagcgcttcatgaacttattgttctgcttgaacatgatcgggcggtagagtttttcaaccaaccaacgggcaaatatcagagcgcttttgaggaagaatataacttctatttgacccaaaacgatcatctctattctgatgtggtatttgatgccagtatctcttacagaaatgcggtgattatgttgggtattatcatgctgattctggtttcagccatgatttttagttgggttagcattaagcatagtttgctgaatccgttaaacaaattattggagaatattaaggcactttctaccggtgatttgacacaaaatgtaactgtttcaggcagaaatgagatgagtacgttggctgttggcctgaagcatatgcaaaaagaatttatcactactgtcagtagtgttcgtcaaagcagtgaaagtatttataacggaaccagtgaaattgctgctggaaataatgatctttcttctcgcactgaggaacaggttgcttctttggaagaaaccgccgccagtatggagcaattgacagcaactgtacgccaaaatgcggaaaatgctcgtcaggcaagtaacttagctgatagtgcttctgaagttgcacgccagggtgggaaagtcgtggcgaatgttgtacagacaatgcgtgaaattgccggtagttctcagaagatttccgatattactagtgttattgatgctattgcgttccagactaacattttggcactgaatgccgcagtggaagcagcacgtgctggtgaacatgggcgaggttttgctgttgtggcaggagaagtacgtaaccttgcacagcgtagtgctgaggcagcaaaagagatcaaagcattaatagaagattcagtaagccgcgcagataccggttctgtcttggttgagagcgccggtgaaacaatgaataacattgttagttcagtcacccgtgtcactgacattatgggtgaaattgcatctgcatctgatgaacaaagtagagggataactcaggttggcctggctatctccgaaatggatcgtgtaacacaacaaaatgctgctttagttgagcaatccgcggctgcggcggctgcactggaagatcaagctgctggattgaagaaactagtttctttgttccaattaccgaatcttgacgataaatctcaatccgaaatgaaaattgagcatttgcctgtggctaagactcctcctgcaaaatcgaatccactggtgttgaagaaagccaacaatgtggaagaacaagctaattgggaaacattttaa

SEQ ID NO: 20511 - protein, 564 aa, Photorhabdus luminescens
MFNRMKIVTGLMAVIILFGALQFISGGLFFHELKSNKENLEILDKMREQQTFLNDTWVNLLQARNNLNRAGIRYMMKKDEGVDNYYTLEQLLTDARSNLSIAEQRFEQYEQTAKLPIHESESLNRLKKAYDVYISALHELIVLLEHDRAVEFFNQPTGKYQSAFEEEYNFYLTQNDHLYSDVVFDASISYRNAVIMLGIIMLILVSAMIFSWVSIKHSLLNPLNKLLENIKALSTGDLTQNVTVSGRNEMSTLAVGLKHMQKEFITTVSSVRQSSESIYNGTSEIAAGNNDLSSRTEEQVASLEETAASMEQLTATVRQNAENARQASNLADSASEVARQGGKVVANVVQTMREIAGSSQKISDITSVIDAIAFQTNILALNAAVEAARAGEHGRGFAVVAGEVRNLAQRSAEAAKEIKALIEDSVSRADTGSVLVESAGETMNNIVSSVTRVTDIMGEIASASDEQSRGITQVGLAISEMDRVTQQNAALVEQSAAAAAALEDQAAGLKKLVSLFQLPNLDDKSQSEMKIEHLPVAKTPPAKSNPLVLKKANNVEEQANWETF

SEQ ID NO: 20512 - DNA, 2955 bp, Chromobacterium violaceum
  CDS (1)..(2955)
atgctggccaccgtgttgcgagagcttgccgacggcgaagtgcgcaccgagttccgggtgcggccgggcgacaaagacagcctgttcgcctgtctggccgacgtggttgcgcatacgctggaaaatctgagggtgcgcaacgcgctggacgtctgcaccaccaatgtgatgatcgccgacgacaaccaccaggtggtgtacgcgaaccgggctgtgctggacatgttccagcaggcggaggccgacatccgccaggagctgccgcagttttccgcgcggacgatcctgggcagcagcatagacagttttcaccgcaatccgtcgtaccagcgcggcgtgctgcagcaattgaccggcacccatcgcggcaccatcaaggtgggggggcgcaccttcagcctggtgctgacgccgatacgcgacggccagaaccgcaagctgggcgcggtggtcgagtggctggacaccacccgcgacctggagctgaaggcggcggaagaggcgcggctcgccgccgaccggcgcgcggcggcggaaaacgcgcgcatccgcagcgcgctggacgtctgcaccactaacgtgatgatcgcggacgaggatcatcgcatcatctataccaaccagtcggtgcagaagatgttccagcaggcggaggccgacatccgccgcgacattccccgcttctccgccggcgggctgctgggcagcaatatcgacgatttccacaagaacccgtcctatcagcgcgggctgctgcagcaggtgcgcgagtcccatcgctcgtcgatatccgtcggcggccgcactttcggcctgatcctgacccccattctcggcgccaagggcgagcgcctgggcgacgtggtggagtggcaggacaataccgaaatgctcaggctgcagcgcgaggccgacctgcgcgcggagaaggaaagcaaactggcggcggagaacgcgcgcatccgcagcgcgctcgacgtctgcaccaccaacgtgatgatcgcggacgaaagccaccacatcgtctacgccaaccagtcggtgctgaacatgttccagcaggcggaggccgacatccgccgcgatatcccgcgcttctcggcggccggcctgctgggcggcaagatcgacgatttccacaaaaacccgtcctaccagcatggcctgctgcaacaagccaggggcacgcaccgctcgtccatcgtggtcggcggccgcaccttcggcctgatcctgtcgcccatcttcaacgacaagggcgacaggctgggcgcggtggtcgagtggcaggacaataccgaggcgctgcgcctgaaggccgaggccgacgcccgggccttggaggagagccgcgtcgccggggagaacgccagaatccgcagcgcgctagacaactgcaccaccaatgtgatgatcgccgacaacgatcgcaggatcatctacatgaaccacagcgtgaccgacatgctgcgcggcgccgagtccgatctgcgcaaggccttgcccaacttcgaggtgcggcggctgatcggctccacgatggacgaattccacaagaacccggcccaccagcgcgatctgctggccaatctgcgcagcacttaccgcgccgaaatccaggtagccggccgcactttctcgctggtggccaacccggtgttcgacgccgacggcgagcgcctgggatcggtggtggagtggaaggaccgcaccgccgaggtggagatcgagcgcgaggtgtcggagatcgtccgcgccgcgtcggccggcgaattcggcaaacgcatcgaggtggacggcaagcagggcttcttcaaagtgctgggcgatggcatcaatcagttgctgggcgtcaccagccgcggcctgaacgatatcgccaacgtgctgggcgcgttggccaagggcgatctgaccaagagcataggcgccgattacgacggcctgttcggccagctgaaggccgacagcaacgccacggtcgagcagctcaaggaaatcatcgccaacatcaaggactccaccgacgcgatcaacaccgcggccaaggagatcgccgccggcaactccaatctgtccagccgcaccgagcagcaggcggccagcctggaggagaccgcgtccagcatggaggaaatcaccagcaccgtccggcagaacgccgagaacgccaagaaggcgaattcgctggccaccggcgcctccgacatcgccgcgcgcggcggcaaggtggtcggcgacgtggtgtcgacgatgaacgagatcaacgagagcgccaagaagatcgtcgacatcatcagcgtgatagacggcatcgcgttccagaccaatatcctggcgctgaacgcggcggtggaggccgcgcgcgccggcgagcagggccgcggcttcgcggtggtggccagcgaggtgcgcaatctggcgcagcgctcggccgccgcggccaaggagatcaagtcgctgatcggcaactcggtcgacaaggtggagtccggcagccggctggtggacgaggcgggccgcacgatgaacgagatcgtggtgtccatccgccgggtcgccgacatcatgagcgacatttcggcggcgtcgatggagcagagttccggcatcgagcaggtcaatctcgccgtcacccagatggacgagaacacccagaagaacgccgcgctggtcgaggaggccgccgccgccgcggaatcgctggaggagcaggcgcgctatctggcggacgcggtggcggtgttcaagctggatgacaagccgtcgcacggcaagccgcccgcaggcaagcccgcgccacgcctcggggccgcggccgtgccgcagatcgcgctggccggggcgctggcgcacaagaccagccatcacccgggcagctatcaggtcaagcccagggcgatagagcccattcagccgccgggagacggcgaggacggctgggaggagttctga

SEQ ID NO: 20513 - protein, 984 aa, Chromobacterium violaceum
MLATVLRELADGEVRTEFRVRPGDKDSLFACLADVVAHTLENLRVRNALDVCTTNVMIADDNHQVVYANRAVLDMFQQAEADIRQELPQFSARTILGSSIDSFHRNPSYQRGVLQQLTGTHRGTIKVGGRTFSLVLTPIRDGQNRKLGAVVEWLDTTRDLELKAAEEARLAADRRAAAENARIRSALDVCTTNVMIADEDHRIIYTNQSVQKMFQQAEADIRRDIPRFSAGGLLGSNIDDFHKNPSYQRGLLQQVRESHRSSISVGGRTFGLILTPILGAKGERLGDVVEWQDNTEMLRLQREADLRAEKESKLAAENARIRSALDVCTTNVMIADESHHIVYANQSVLNMFQQAEADIRRDIPRFSAAGLLGGKIDDFHKNPSYQHGLLQQARGTHRSSIVVGGRTFGLILSPIFNDKGDRLGAVVEWQDNTEALRLKAEADARALEESRVAGENARIRSALDNCTTNVMIADNDRRIIYMNHSVTDMLRGAESDLRKALPNFEVRRLIGSTMDEFHKNPAHQRDLLANLRSTYRAEIQVAGRTFSLVANPVFDADGERLGSVVEWKDRTAEVEIEREVSEIVRAASAGEFGKRIEVDGKQGFFKVLGDGINQLLGVTSRGLNDIANVLGALAKGDLTKSIGADYDGLFGQLKADSNATVEQLKEIIANIKDSTDAINTAAKEIAAGNSNLSSRTEQQAASLEETASSMEEITSTVRQNAENAKKANSLATGASDIAARGGKVVGDVVSTMNEINESAKKIVDIISVIDGIAFQTNILALNAAVEAARAGEQGRGFAVVASEVRNLAQRSAAAAKEIKSLIGNSVDKVESGSRLVDEAGRTMNEIVVSIRRVADIMSDISAASMEQSSGIEQVNLAVTQMDENTQKNAALVEEAAAAAESLEEQARYLADAVAVFKLDDKPSHGKPPAGKPAPRLGAAAVPQIALAGALAHKTSHHPGSYQVKPRAIEPIQPPGDGEDGWEEF

SEQ ID NO: 20514 - DNA, 1620 bp, Chromobacterium violaceum
  CDS (1)..(1620)
atgaaaacattcaccgtccgccggcaattcgtcctgctggccgcctgcgcgctgctgggactgggaggactgaccctcaccgcctggcagggcctgcgcaccgtgatgatcaacggcgcgatgtaccaccagatggtgatcggcaaggacttcatcaacgacctggatccccctacccagcagctgatctccagcttcctgctggtcaaccagctgcgcaacaccaacgatgcgtcgatgcgccagcaactggcgaaccagctgcagaaacagcgcgccgtgttctacgacggccagcggaaatggggcaacagcgagttgccccaggcgatgcgcgacatgctgacgcagaaagtgaagccgccggcggacgccttcttccaggaaatcgacagccactacctgccggcgctggaggcccacgaccagctggcgatcaaccaatcgttcgaccgcctgtccgcgcaatacgatctcaacgatcaggcgatgcaacccctgatcgccaagaccatggagatgcagaagcagatggaaggcgaggcgcagcgcatcacttcgcagaccttcgccgccgtggccgcggtcagcgccttggtgctgctgctgctggtcggctcgctggtcctgatctaccgccagttgatccgcggcctgggcggagaaccccacgaggtggcccggatcaccggcgaagtggccgccggccggctggacgtcgagatgccgcccgcgccgccgggcagcctgtccgactcggtgcagcagatgtgccggcagctgctggccatcatcgccgaggtgaagaacagctcggacggcatcgcctgcgccgcgcagcagatcagttccaccgcgatggcgctgtcgcagggcgccagcacctcggccgccggcctgcagcaaagctcggcctcgatcgagcaggtatcggcgtccatcacccagaccagcgacaactcccgcaccaccgaagccatcgcggagaaggcctccgacgaggccacccagggcggcgaggcggtgcagcagacggtgacggcgatgcggcagatcgccgagaagataagcatcatcgacgacatcgcctatcagaccaatctgctggcgctgaacgccgccatcgaggccgcccgcgccggcaagcacggcgccggcttcgccgtggtggcggccgaggtccgcaagctggccgagcgcagccaggtggcggcccaggagatcggcgagctggcggagcgcagcgtcaccgtctccgagcaggccggccggctgctgaaggaaatcgtgcgctccagcggccgcaccgccgacctggtacaggaaatcgccgccgccacccgggaacaggccggcggcatcggccagatcagccacgcggtccagcacctgaaccactcgacccagcagaatgccgccgccagtgaggaattggcgtccaccgccgaggaaatgagccaccaggcagaaaggctgcagcaggcgatggcctttttcaggctgggcgcggaagccgcgcgcgcatcgcccccgcccgcgccgcccaaacccgtggcgcccggcggggccatccgggccgcgtccgagccggacgaactggaggacatgttccgcttctga

SEQ ID NO: 20515 - protein, 539 aa, Chromobacterium violaceum
MKTFTVRRQFVLLAACALLGLGGLTLTAWQGLRTVMINGAMYHQMVIGKDFINDLDPPTQQLISSFLLVNQLRNTNDASMRQQLANQLQKQRAVFYDGQRKWGNSELPQAMRDMLTQKVKPPADAFFQEIDSHYLPALEAHDQLAINQSFDRLSAQYDLNDQAMQPLIAKTMEMQKQMEGEAQRITSQTFAAVAAVSALVLLLLVGSLVLIYRQLIRGLGGEPHEVARITGEVAAGRLDVEMPPAPPGSLSDSVQQMCRQLLAIIAEVKNSSDGIACAAQQISSTAMALSQGASTSAAGLQQSSASIEQVSASITQTSDNSRTTEAIAEKASDEATQGGEAVQQTVTAMRQIAEKISIIDDIAYQTNLLALNAAIEAARAGKHGAGFAVVAAEVRKLAERSQVAAQEIGELAERSVTVSEQAGRLLKEIVRSSGRTADLVQEIAAATREQAGGIGQISHAVQHLNHSTQQNAAASEELASTAEEMSHQAERLQQAMAFFRLGAEAARASPPPAPPKPVAPGGAIRAASEPDELEDMFRF

SEQ ID NO: 20516 - DNA, 1542 bp, Bordetella pertussis
  CDS (1)..(1542)
atgcccatgcttgaaaggatcaaggtccgcaccgcgatggtggcggtattcgcgtgcttcctggcggtgctgatgctgtcgggcgccctgacgtggcgcaacgcgggcaggagcgccgccgagatcgaggggctgaaccaggtcgccgtcaaccaggtcgacccgctgttcgaggccagcggcgcggcgcagcgccaggcggccacgcaattccagcgctacgtggacgtgcccaaggagccggccgcggccgagctggccgcgaccctgcagacgcgctggcgcgcctaccagtcggtgctggacgagctggccgccgccgtcgacgccggccaggccgagcccgccctggccgccatgcatcgcgcgcagcaggccgaacatgcattccagcgcgacatggaagcctttctggccagggtacaggcgcacagcgacgaagtgcgcagcggcgccgaggacacccatgtcgtggcccgctggagcgccatcgcgctgaccacgctgggcgtgctgctgaccctggccggctggctgttcgtgcgccgcgcggtgctgcgccccttgctggaggccggccatcatttcgaccgcatcgccgacggcgacctcaccgcgcgcatcgaggtgcgctcggccaatgaaatcggcgcgctgttcgcggcgctcaagcgcatgcaggaaggcctgacgcgcaccatcgccgtcatgcggcgcggcgtcgacgaaatcaacgtcggcgcggccgagatctcggccggcaacgccaacctgtccagccgcacggaggagcaggccgccgccctggaagagaccgcggccaccatggaggaactggccaccacggtcaagcagaacgccgacaatgccgcgcaggccaatcagctggccgccgtcagcatgcaggtggcgcagcgcggcggcgagtcggtcgcgcaggtggtgcagaccatgcacggcatctccgcgagctcgcgccagatcgccgacatcgtcaccgtgatcgacggcatcgccttccagaccaatatcctggcgctgaacgccgcggtcgaggcggcgcgcgccggcgaacagggcaagggcttcgcggtggtggcgggcgaggtgcgcagcctggcccagcgcgccgcgcaggcggccaaggagatcaaggccctgatcgagagctcggtggcgacggtgcgcgccggctcgcaacaggtcgccagcgccggcggcaccatggacgaggtggtggcctcggtacagcgcgtggccgacatcatgggggagatctcggccgcctcggcccagcaggccagcggcatcgaccaggtcagcctggcgatttcgcaaatggacgaaaccacccagcagaatgccgcgctggtcgaacaggccgcggcggcggccacggccatggaagaacaggcccgccacctggcggccgcggcggcggtcttcaggacgcagggcggcgccttcatcgacgtcgccgccgcgccgctggccgggccggcgggcggccatgccgccctgccgccggccgcggcccactga

SEQ ID NO: 20517 - protein, 513 aa, Bordetella pertussis
MPMLERIKVRTAMVAVFACFLAVLMLSGALTWRNAGRSAAEIEGLNQVAVNQVDPLFEASGAAQRQAATQFQRYVDVPKEPAAAELAATLQTRWRAYQSVLDELAAAVDAGQAEPALAAMHRAQQAEHAFQRDMEAFLARVQAHSDEVRSGAEDTHVVARWSAIALTTLGVLLTLAGWLFVRRAVLRPLLEAGHHFDRIADGDLTARIEVRSANEIGALFAALKRMQEGLTRTIAVMRRGVDEINVGAAEISAGNANLSSRTEEQAAALEETAATMEELATTVKQNADNAAQANQLAAVSMQVAQRGGESVAQVVQTMHGISASSRQIADIVTVIDGIAFQTNILALNAAVEAARAGEQGKGFAVVAGEVRSLAQRAAQAAKEIKALIESSVATVRAGSQQVASAGGTMDEVVASVQRVADIMGEISAASAQQASGIDQVSLAISQMDETTQQNAALVEQAAAAATAMEEQARHLAAAAAVFRTQGGAFIDVAAAPLAGPAGGHAALPPAAAH

SEQ ID NO: 20518 - DNA, 1620 bp, Bordetella pertussis
  CDS (1)..(1620)
atgttcgcgaatctgaaagtgcgtaccgggctgttgttggcgctagtggcgctggcattggcggcattggtttccatcgcgttggggtgggaaagcgtccgggagggctcgcgctccctgcatgcgctcgatagcgtgagcgtgcagcagggcagcctgctcaaggacgcctatgcgcagatgttgcgggccacgattcgcgcggacatcgcggcggtgcagcggcgcggcgacgccgccggcacgctggagaacgagcgcaccgtcaagcaattgatgggcgaagccaaggccaggatcgaagcgtttcgcaaagttcccaagctgtccgagctgggccgttccatggaaaccggcctgaccagcagcttcggcagcttcgccgcctccctggatgaaatgatggcggcgctggagcgcaacgacgacgcggcctacctgcagctgaagaatgtgaaggcagggcaggccagcgccgccttcgccgcccggctgggcgaattctcgaccaacctggacaagctgagcagcgagacgctggccgcgcacgagacgcgcgaaaccatcatgctttatgtgtacgcggccttgctgctgttgatcgtgggcgtgatcgcgggcagctatctgtacatgacgcgcgcggtggtgcgtccgctgcaacgcgccagccagcaattcgagcgcatggccgccggcgacttgagcgcgcgcatcgaaggcaactcccgcaatgagatcggagccttgctgacggcgctgcgccatatgcaggagagcctgacgcgtaccgtcgcggcggtgcgccgcggggtggacgagatcaacgtgggttcgcgcgagatttcggccggcaacacggacctgtccagccgcaccgaagagcaggcggcctcgctggaagagaccgcggcctcgatggagcagctggcctcgacggtcaagcagaacgccgacaacgcgcgccaggccaatcagctggcggccagcgcctcggacgtggccgagagcggcggttcggcggtgtccgaagtcgtcagcacgatggacgggatttcggccagttcgcgcaagatctccgagatcgtgtcggtgatcgacgggatcgcgttccagaccaacatcctggcgctgaacgcggcggtggaagcggcgcgcgcgggcgagcagggcaagggtttcgcggtggtggcgggcgaggtgcgctcgctggcgcagcgcagcgcccaggcagccaaggagatcaaggtgttgatcgaggactcggtcgacaaggtgggcacgggctcgcagcaggtcgagcgcgccggggcgacgatgcaggagatcgtggcctcggtcaagcgggtgacggacatcatgggcgagatctcggcggcctcggaagagcagtccagcgggatcgagcaggtcaaccgcgcggtgtcgcagatggacgaggtgacgcagcagaacgcggcgctggtggaagaggcggccgcggcggccggttcgctgcaggagcaggcgcagcgcctggccgaggcggtctcggtgttcaagatcaataccggcgaagtgatcgaagtgccggcgcaccaattgtccggctacgcggcgcccctggtcgcgcagtcctga

SEQ ID NO: 20519 - protein, 539 aa, Bordetella pertussis
MFANLKVRTGLLLALVALALAALVSIALGWESVREGSRSLHALDSVSVQQGSLLKDAYAQMLRATIRADIAAVQRRGDAAGTLENERTVKQLMGEAKARIEAFRKVPKLSELGRSMETGLTSSFGSFAASLDEMMAALERNDDAAYLQLKNVKAGQASAAFAARLGEFSTNLDKLSSETLAAHETRETIMLYVYAALLLLIVGVIAGSYLYMTRAVVRPLQRASQQFERMAAGDLSARIEGNSRNEIGALLTALRHMQESLTRTVAAVRRGVDEINVGSREISAGNTDLSSRTEEQAASLEETAASMEQLASTVKQNADNARQANQLAASASDVAESGGSAVSEVVSTMDGISASSRKISEIVSVIDGIAFQTNILALNAAVEAARAGEQGKGFAVVAGEVRSLAQRSAQAAKEIKVLIEDSVDKVGTGSQQVERAGATMQEIVASVKRVTDIMGEISAASEEQSSGIEQVNRAVSQMDEVTQQNAALVEEAAAAAGSLQEQAQRLAEAVSVFKINTGEVIEVPAHQLSGYAAPLVAQS

SEQ ID NO: 20520 - DNA, 1821 bp, Bordetella pertussis
  CDS (1)..(1821)
atgtggtcgaatttgaaggtacgcacctgcatcaccctggtgctgggcctgtttctggtggcaatgctggtgtccaacggaatggcctggctgggcatgagctcgagcaacgacaagctggagcgcgtcaataacgcgtattcgaaccaggccgtgccggcctacgacgcctacgtcatgctgttgcgggcgcggctgaacatagtctcgtcgatgatggacctgcaggaagggcggttgaaggagtcggccgatacgctggcgcatgcgcagcgccaggccggcgaagcgcgcgagcgcttcgaggctttcctggcggtggccaaggcttcgtcgggcgccgaccgggtcggcgcggtggagacggcgttccatgcctacctggaggtggcggcgcgccagatggaggccatgcagaaccagaggttgggcgagttcgtgcagctcaacccgtccgcgcagcgcctgaacaccgctttcgatacggcggcgtcggcgtacctggaccggatcgacacggacaccgacgcgctggtggacgatgcgcgcgccgaacacctgcgcgccaatacggtaaccctggtgttgattgtcctggcgctggcgctgtgcgccggctgcggggtgttcatcggccgcgccgtgctgcgtccgctcaaggaagccggccagcacttcgacaggatcgccgcgggcgacctgaccgcgcgggtggacgtgcgcaacagcaacgagatcggccagctgttcgccggcctcaagcgcatggaggaaagcctgacgcgtaccgtcgcggcggtgcgccgcggggtggacgagatcaacgtgggttcgcgcgagatttcggccggcaacacggacctgtccagccacaccgaagagcaggcggcctcgctggaagagaccgcggcctcgatggagcagctggcctcgacggtcaagcagaacgccgacaacgcgcgccaggccaaccagctggcgggagtcgcctcggacgtggccgagcgtggcggttcggcggtgtccgaggtggtgacgacgatgcaggacatctcggccagctcgcgcaagatctccgagatcgtgtcggtgatcgacgggatcgcgttccagaccaatatcctggcgctgaacgcggcggtggaagcggcgcgcgcgggcgagcagggcaagggtttcgcggtggtggcgggcgaggtgcgctcgctggcgcagcgcagcgcccaggcggccaaggagatcaaggtgctgatcgaggattcggtcggcaaggtcggcacgggttcgcagcaggtcgagcgcgtcggcgcgacgatgcaggagatcgtggcctcggtcaagcgggtgacggacatcatgggcgagatctcggcggcctcggaagagcagtccagcgggatcgagcaggtcaaccgcgcggtgtcgcagatggacgaggcgacgcagcagaacgcggcgctggtggaagaggccgcggcggcggccggctcgctgcaggagcaggcgcagcgcctggccgaggcggtctcggtgttcaggatcaacgccggcgaggtgatcgacgtatcggcgcgccagctggcgcagcagcgccaggcgccgcgcgtggcggccgcgccggccagcgccgcggcgcccgaggcgccgcccgaaccggcgccgcggctggcgcgtccggctgcgcgcgcggacgtggcggccgaggcggccagcgtgcgccggcccgcccgccggccggccgcgaccgagccggcggcccggacgacggccgcgccgtcgcgccgccgtccgccggccgataatgattgggagtcgttctga

SEQ ID NO: 20521 - protein, 606 aa, Bordetella pertussis
MWSNLKVRTCITLVLGLFLVAMLVSNGMAWLGMSSSNDKLERVNNAYSNQAVPAYDAYVMLLRARLNIVSSMMDLQEGRLKESADTLAHAQRQAGEARERFEAFLAVAKASSGADRVGAVETAFHAYLEVAARQMEAMQNQRLGEFVQLNPSAQRLNTAFDTAASAYLDRIDTDTDALVDDARAEHLRANTVTLVLIVLALALCAGCGVFIGRAVLRPLKEAGQHFDRIAAGDLTARVDVRNSNEIGQLFAGLKRMEESLTRTVAAVRRGVDEINVGSREISAGNTDLSSHTEEQAASLEETAASMEQLASTVKQNADNARQANQLAGVASDVAERGGSAVSEVVTTMQDISASSRKISEIVSVIDGIAFQTNILALNAAVEAARAGEQGKGFAVVAGEVRSLAQRSAQAAKEIKVLIEDSVGKVGTGSQQVERVGATMQEIVASVKRVTDIMGEISAASEEQSSGIEQVNRAVSQMDEATQQNAALVEEAAAAAGSLQEQAQRLAEAVSVFRINAGEVIDVSARQLAQQRQAPRVAAAPASAAAPEAPPEPAPRLARPAARADVAAEAASVRRPARRPAATEPAARTTAAPSRRRPPADNDWESF

SEQ ID NO: 20522 - DNA, 1707 bp, Bordetella pertussis
  CDS (1)..(1707)
atgcgcaagttcctcgcgaacctgtcgatacgcggcagcctgttgggcgtgctggcgttcttctctttcatgctggtcgtcggcgccgccctgggcgtgctgtcgctgcgggtcagcaacgacacgttgcagggagtcaaacagacccaggatgtcgccgacgcgatggatcgcgtcgtcaacagctacaaggacgcgctcaacggcctgggccgcgccgcggcgtcgcactatggcgcgatcgtgagcgccatcggccagccggtgcaggtcgaacagggcctgggcagcgaggcggcgggcttgctgcagcgcgccaaggcttcgctcaaccgcgccgagaccgaatacgagtactacaagggcctggcccggccggccagcgccgccgacagcctgaaagaagtcgagaacgccttcgaggcgctggtcggccaggggctccatccgctggccgccgcgttggagaagggcgacatggccggctaccagtcgcatgcgcagaacgtccttgacgcgctggaagggcgtttctcgggcgccatcgccgcgttcgacttctggcgcgccagcgagctgctcgacgcccacgaagtggccgagacgcgctatcgcttcgtgctggcggccgtggccgcgggcggggtgctggccgcgctgctggtgttttcgacctatctgttcctgcgccgccgcgtgctgcagccgctgcgcgaagtgggccagcatttcgacaagatcgccgcgggcgacctgaccgcgcgggtggacgtgcgcaacagcaacgagatcggccagctgttcgccggcctcaagcgcatggaggaaagcctgacgcgtaccgtcgcggcggtgcgccgcggggtggacgagatcaacgtgggttcgcgcgagatttcggccggcaacacggacctgtccagccgcaccgaagagcaggcggcctcgctggaagagaccgcggcctcgatggagcagctggcctcgacggtcaagcagaacgccgacaacgcgcgccaggccaaccagctggcgggagtcgcctcggacgtggccgagcgtggcggttcggcggtgtccgaggtggtgacgacgatgcaggacatctcggccagctcgcgcaagatctccgagatcgtgtcggtgatcgacgggatcgcgttccagaccaatatcctggcgctgaacgcggcggtggaagcggcgcgcgcgggcgagcagggcaagggtttcgcggtggtggcgggcgaggtgcgctcgctggcgcagcgcagcgcccaggcggccaaggagatcaaggtgctgatcgaggactcggtcgacaaggtgggcacgggctcgcagcaggtcgagcgcgccggggcgacgatgcaggagatcgtggcctcggtcaagcgggtgacggacatcatgggcgagatttcggcggcctcggaagagcagtccagcgggatcgagcaggtcaaccgcgcggtgtcgcagatggacgaggtgacgcagcagaacgcggcgctggtggaagaggcggccgcggcggccggctcgctgcaggagcaggcgcagcgcctggccgaggcggtcgcggtgttcaagatcaataccggcgaagtgatcgaagtgccggcgcaccaactgggatcgaggcaggcgccgggtgcgcgcgaggcggcgctggcgcgcgatgacgcgctggcgctggggcactga

SEQ ID NO: 20523 - protein, 568 aa, Bordetella pertussis
MRKFLANLSIRGSLLGVLAFFSFMLVVGAALGVLSLRVSNDTLQGVKQTQDVADAMDRVVNSYKDALNGLGRAAASHYGAIVSAIGQPVQVEQGLGSEAAGLLQRAKASLNRAETEYEYYKGLARPASAADSLKEVENAFEALVGQGLHPLAAALEKGDMAGYQSHAQNVLDALEGRFSGAIAAFDFWRASELLDAHEVAETRYRFVLAAVAAGGVLAALLVFSTYLFLRRRVLQPLREVGQHFDKIAAGDLTARVDVRNSNEIGQLFAGLKRMEESLTRTVAAVRRGVDEINVGSREISAGNTDLSSRTEEQAASLEETAASMEQLASTVKQNADNARQANQLAGVASDVAERGGSAVSEVVTTMQDISASSRKISEIVSVIDGIAFQTNILALNAAVEAARAGEQGKGFAVVAGEVRSLAQRSAQAAKEIKVLIEDSVDKVGTGSQQVERAGATMQEIVASVKRVTDIMGEISAASEEQSSGIEQVNRAVSQMDEVTQQNAALVEEAAAAAGSLQEQAQRLAEAVAVFKINTGEVIEVPAHQLGSRQAPGAREAALARDDALALGH

SEQ ID NO: 20524 - DNA, 1638 bp, Bordetella parapertussis
  CDS (1)..(1638)
atgcccatgcttgaaaggatcaaggtccgcaccgcgatggtggcggtattcgcctgcttcctggcggtgctgatgctgtcgggcgccctgacgtggcgcaacgcgggcaggagcgccgccgagatcgaggggctgaaccaggtcgccgtcaaccaggtcgacccgctgttcgaggccagcggcgcggcgctgcgcgcccgcgtcgccctgctggaggccctggccaacctgcaggccaatcacctggacccggtggcgaccctgcaccagcaggccggcgcggcgcagcgccaggcggccacgcaattccagcgctacgtggacgtgcccaaggagccggccgcggccgagctggccgcgaccctgcagacgcgctggcgcgcctaccagtcggtgctggacgagctggccgccgccgtcgacgccggccaggccgagcccgccctggccgccatgaatcgcgcgcagcaggccgaacatgcattccagcgcgacatggaagcctttctggccagggtacaggcgcacagcgacgaagtgcgcagcggcgccgaagacacccatgtcgtggcccgctggagcgccatcgcgctggccgcgctgggcgtgctgctgaccctggccggctggctgttcgtgcgccgcgcggtgctgcgccccttgctggaggccggccatcacttcgaccgcatcgccgacggcgacctcaccgcgcgcatcgaggtgcgctcggccaatgaaatcggcgcgctgttcgcggcgctcaagcgcatgcaggaaggcctgacgcgcaccatcgccgtcatgcggcgcggcgtcgacgaaatcaacgtcggcgcggccgagatctcggccggcaacgccaacctgtccagccgcacggaggaacaggccgccgccctggaagagaccgcggccaccatggaggaactggccaccacggtcaagcagaacgccgacaatgccgcgcaggccaatcagctggccgccgtcagcatgcaggtggcgcagcgcggcggcgagtcggtcgcgcaggtggtgcagaccatgcacggcatctccgcgagctcgcgccagatcgccgacatcgtcaccgtgatcgacggcatcgccttccagaccaatatcctggcgctgaatgccgcggtcgaggcggcgcgcgccggcgaacagggcaagggcttcgcggtggtggcgggcgaggtgcgcagcctggcccagcgcgccgcgcaggcggccaaggagatcaaggccctgatcgagagttcggtggcgacggtgcgcgccggctcgcaacaggtcgccagcgccggcggcaccatggacgaggtggtggcctcggtacagcgcgtggccgacatcatgggggaaatctcggccgcctcggcccagcaggccagcggcatcgaccaggtcagcctggcgatttcgcaaatggacgaaaccacccagcaaaataccgcgctggtcgaacaggccgcggcggcggccacggccatggaagaacaggcccgccacctggcggccgcggcggcggtcttcaggacgcagggcggcgccatcatcgacgtcgccgccgcgccgctggccgggccggcgggcggccatgccgccctgccgccggccgcggcccgctga

SEQ ID NO: 20525 - protein, 545 aa, Bordetella parapertussis
MPMLERIKVRTAMVAVFACFLAVLMLSGALTWRNAGRSAAEIEGLNQVAVNQVDPLFEASGAALRARVALLEALANLQANHLDPVATLHQQAGAAQRQAATQFQRYVDVPKEPAAAELAATLQTRWRAYQSVLDELAAAVDAGQAEPALAAMNRAQQAEHAFQRDMEAFLARVQAHSDEVRSGAEDTHVVARWSAIALAALGVLLTLAGWLFVRRAVLRPLLEAGHHFDRIADGDLTARIEVRSANEIGALFAALKRMQEGLTRTIAVMRRGVDEINVGAAEISAGNANLSSRTEEQAAALEETAATMEELATTVKQNADNAAQANQLAAVSMQVAQRGGESVAQVVQTMHGISASSRQIADIVTVIDGIAFQTNILALNAAVEAARAGEQGKGFAVVAGEVRSLAQRAAQAAKEIKALIESSVATVRAGSQQVASAGGTMDEVVASVQRVADIMGEISAASAQQASGIDQVSLAISQMDETTQQNTALVEQAAAAATAMEEQARHLAAAAAVFRTQGGAIIDVAAAPLAGPAGGHAALPPAAAR

SEQ ID NO: 20526 - DNA, 1668 bp, Bordetella parapertussis
  CDS (1)..(1668)
atggcgcgcgctcccctcgaggagcgcgtgttcgatggaaagcggataaacatgtggtcgaatttgaaggtacgcacctgcatcaccctggtgctgggcctgtttctggtggcaatgctggtgtccaacgcaatggcctggctgggcatgagctcgagcaacgacaagctggagcgcgtcaataacgcgtattcgaaccaggccgtgccggcctacgaggcctacgtcatgctgctgcgggcgcggctgaacatggtctcgtcgatgatggacctgcaggaagggcggttgaaggagtcggccgatacgctggcgcacgcgcagcgccaggccggcgaagcgcgcgagcgcttcgaggccttcctggcggtggccaaggcttcgtcgggcgccgaccgggtcggcgcggtggagacggcgttccatgcctacctggaggtggcggcgcgccagatggaggccatgcagaaccagaagctgggcgagttcgtgcagctcaacccgtccgcgcagcgcctgaacactgctttcgatacggcggcgtcggcgtacctggaccggatcgacacggacaccgacgcgctggtggacgatgcgcgcgccgaacacctgcgcgccaatacggtaaccctggtgttgattgtcctggcgctggcgctgtgcgccggctgcggggtgttcatcggccgcgccgtgctgcgcccgctcaaggaagccggccagcacttcgacaggatcgccgcgggcgacctgaccgcgcgggtggatgtgcgcagcaccaatgagatcggccagctgttcgccgcgctgaagcgcatgcaggagagcctgacgcgtaccgtcgcggcggtgcgccgcggggtggacgagatcaacgtgggttcgcgcgagatctcggccggcaacacggacctgtccagccgcaccgaggagcaggcggcctcgctggaggagaccgcggcctcgatggagcagctggcctcgacggtcaagcagaatgccgacaacgcgcgccaggccaatcagctggcggccagcgcctcggacgtggccgagcgcggcggttcggcggtgtccgaggtggtgacgacgatgcaggacatctcggccagctcgcgcaagatttccgagattgtgtcggtgatcgacgggatcgcgttccagaccaacatcctggcgctgaacgcggcggtggaagcggcgcgcgcgggcgagcagggcaagggtttcgcggtggtggcgggcgaagtgcgctcgctggcgcagcgcagcgcccaggcggccaaggagatcaaggtgctgatcgaggactcggtcgacaaggtgggcacgggttcgcagcaggtcgagcgcgccggtgcgacgatgcaggagatcgtggcctcggtcaagcgggtgacggacatcatgggcgagatttcggcggcctcggaagagcagtccagcgggatcgagcaggtcaaccgcgcggtgtcgcagatggacgaggtaacgcagcagaacgcggcgctggtggaagaggcggccgcggcggccggctcgctgcaggagcaggcgcagcgcctggccgaggcggtagcggtgttcaagatcaataccggcgaagtgatcgaagtgccggcgcaccaattgtccggctacgcggcgcccctggtcgcgcagtcctga

SEQ ID NO: 20527 - protein, 555 aa, Bordetella parapertussis
MARAPLEERVFDGKRINMWSNLKVRTCITLVLGLFLVAMLVSNAMAWLGMSSSNDKLERVNNAYSNQAVPAYEAYVMLLRARLNMVSSMMDLQEGRLKESADTLAHAQRQAGEARERFEAFLAVAKASSGADRVGAVETAFHAYLEVAARQMEAMQNQKLGEFVQLNPSAQRLNTAFDTAASAYLDRIDTDTDALVDDARAEHLRANTVTLVLIVLALALCAGCGVFIGRAVLRPLKEAGQHFDRIAAGDLTARVDVRSTNEIGQLFAALKRMQESLTRTVAAVRRGVDEINVGSREISAGNTDLSSRTEEQAASLEETAASMEQLASTVKQNADNARQANQLAASASDVAERGGSAVSEVVTTMQDISASSRKISEIVSVIDGIAFQTNILALNAAVEAARAGEQGKGFAVVAGEVRSLAQRSAQAAKEIKVLIEDSVDKVGTGSQQVERAGATMQEIVASVKRVTDIMGEISAASEEQSSGIEQVNRAVSQMDEVTQQNAALVEEAAAAAGSLQEQAQRLAEAVAVFKINTGEVIEVPAHQLSGYAAPLVAQS

SEQ ID NO: 20528 - DNA, 1497 bp, Bordetella parapertussis
  CDS (1)..(1497)
atgcgcaccgcaagccgtttgctggaagactcgtatcgccgggccgaccgggcgatgttgccgctgctctgggtgctggtcatcgtcggtctttgcatggcgccgcagtacggccgatggacggccgctgtcacggtaggcgtattggcggccggcctgcccacgctgttgatcctctggcgtcccggcaagctgtcgactcgcctggccgtcgcctgtggactgatggcgttggcggggctgcacatccacctcatgtcgggcatgaccgaaatccacttcggcatcttcgtgctgctctcgctgcttctggcatatcgggactggcggaccattctgtgcgcggccgtggtgatcgcggtgcatcacctgtcgttcaattttctccagcaatggggatatggcgcgatctgcttcaccgagcccagcctggggatggtgttcttgcatgcggcctatgtcgtggtgcaggccgcggcgctgggatggctggcctggcggatggagcgcgccgccgtggccgccgaagagctggcccggctcagcgcacggatcggccgcgagcctggggtcttcgacctgcgattcggcggctcggagatggaaagcgggctcggccgcgcgttcaagaccaccatggacgcggtgcatcggaccatgagcgaagtgcgggagacggcgacggcgctgtcgggggcctcgcgcgacatgatgcagggcaacctggagctggaggagcgctcgcgcgcacaggccgagtcgctggcgcggaccgtggcgtcgatgcgcgacctggccgccaatgtccatgccaatgcggcgcatgccctgcaggctgggcaactgaccgaccaggcccgccagagcgtcggcacgggcagcgcggcagtcgctggcgtcgcgaccgtgatgggagagatccagcaggaggcgcagaaaatctcggaaatcatcggcgtgatcgacagcatcgcgtttcagaccaacatcctggccctgaacgcggcggtggaggcggcccgcgcgggcgaaagcggcaagggctttgcggtggtggccttcgaggtccgcgcgctggccgaacgcagcgccggcgcggcgcgcgagatccgcggccttatcgagggctcgctggagaagaccggcaagggttttcggcaggcggataacgccgcgggcatgatccgtgaagtcgttgccagcattgacgaggtcgccggcgtggtcggccagatcggcgacgcgggccgtgcccaaggcacggatatcgaggaggtgaaccgggtcgtggccaggatggacgaactcacccggcagaccgccgacctggtcgcgcaggccgccagcgcctcgacggccttgcaaggccaggccgcccaattgctgcaggcggttggcgtgttccgcttgcaagacggccggcggtccgatgagcccgtggcgtcgacaggggctgagtcgtttcggccggccgcgccggcgttggccggttcatga

SEQ ID NO: 20529 - protein, 498 aa, Bordetella parapertussis
MRTASRLLEDSYRRADRAMLPLLWVLVIVGLCMAPQYGRWTAAVTVGVLAAGLPTLLILWRPGKLSTRLAVACGLMALAGLHIHLMSGMTEIHFGIFVLLSLLLAYRDWRTILCAAVVIAVHHLSFNFLQQWGYGAICFTEPSLGMVFLHAAYVVVQAAALGWLAWRMERAAVAAEELARLSARIGREPGVFDLRFGGSEMESGLGRAFKTTMDAVHRTMSEVRETATALSGASRDMMQGNLELEERSRAQAESLARTVASMRDLAANVHANAAHALQAGQLTDQARQSVGTGSAAVAGVATVMGEIQQEAQKISEIIGVIDSIAFQTNILALNAAVEAARAGESGKGFAVVAFEVRALAERSAGAAREIRGLIEGSLEKTGKGFRQADNAAGMIREVVASIDEVAGVVGQIGDAGRAQGTDIEEVNRVVARMDELTRQTADLVAQAASASTALQGQAAQLLQAVGVFRLQDGRRSDEPVASTGAESFRPAAPALAGS

SEQ ID NO: 20530 - DNA, 1659 bp, Bordetella bronchiseptica
  CDS (1)..(1659)
atgcgcaggaatttgcccgtcaccgggcacgagttcgtattgcaggatgaccagtatctcatttccaagacggacttgaaggggcgcatcacctactgcaacccggcctttatcgccatcagcggattctcgcgcgaagagctgctgggccagccgcataacatcgttcgccacccggacatgcccgaagacgtgttcgcggacatgtgggccacgctgcaggcgcgcaagccctggctggcggtggtgaagaaccggcacaagtccggcggcttctactgggtgctcgccaacgcgatgcccgtgatcgaggcgggcaacgtgacgggctatgcctcggtgcgggtcaaggccacgcaggcgcagatcgaggccgccgagcacttctatgcccaggtggaaagcggccggatgggcggccatggattgcgccacggtcaacgcgtgccgcgcggctggcggcgcgccgcccgcgcgctggcgtttccgttgcgcaagggcgtgcggcctgccttgctgcggctggcggccgccatgtgcggcctggcggccattcccacctacttcgccatcggcgccatgccgccggaggccgcgccgtatggctggggcgcctatgcgctgggtgcgctgggcgcggtgctggccgcgatggcgctgggcggccggttcggcaggcaactgcgcaatgccgaggaggtggcgcgccagatcgcggccggcaacctggtcaacgaggtggactcgggcgtcggcggcgagatgcgcaatctctatttctacctggacatcatgcgcaagagcctgatcggcatctccaccgaggtcatcggcaagacgtccgagcatgtgcataccatctcgcgcctgcgcgaggacagccagggcctggccgcgcgcaccgaggcgcagtcggcggcgctgcaggacaccgccagcagcgtggagcaactggccgagacagtcacccgcaacgccgaaagcgccggggtggcggcccggctgacccaggaaagcagcgaggtggccgcgcaaggcggcgccgtggtcggcgaactggtggcgaccatgcaggggctggacgcgagttcgcgcaagatggccgagatcgtatccgtgatcgaagggattgccttccagaccaatatcctggcgctgaacgccgccgtcgaggcggcgcgggccggcgagcagggcaagggcttcgcggtcgtcgcggccgaggtccgcagcctggcgcagcgcaccgctcaggccgccaaggaagtcaaagtgctgatcgacgattcggtggggcgcatgtccaccggctcggcccaggcgggccgggcgggcgagacgatgcgcgagctggtgcagtcggtcgagcgcgtgaccgccttgatggccgagatttccaccgcctcgggcgagcaatcgaccggcgtggcgcagatcagttccgccgtgcaccgcatggaggaggtggtgcagcagaacgtctccatggtgggcgaactgacccacgtcgccgagcacctgggccaggagtcggggtcgctggtcgaggccatcggcgtattccgcacccccggcgcgggcgcgcgcgcgatcggcatgccggagcaggcgccacggcgcgcgcctgtgcgcaccctgttgctggccgagcacccctga

SEQ ID NO: 20531 - protein, 552 aa, Bordetella bronchiseptica
MRRNLPVTGHEFVLQDDQYLISKTDLKGRITYCNPAFIAISGFSREELLGQPHNIVRHPDMPEDVFADMWATLQARKPWLAVVKNRHKSGGFYWVLANAMPVIEAGNVTGYASVRVKATQAQIEAAEHFYAQVESGRMGGHGLRHGQRVPRGWRRAARALAFPLRKGVRPALLRLAAAMCGLAAIPTYFAIGAMPPEAAPYGWGAYALGALGAVLAAMALGGRFGRQLRNAEEVARQIAAGNLVNEVDSGVGGEMRNLYFYLDIMRKSLIGISTEVIGKTSEHVHTISRLREDSQGLAARTEAQSAALQDTASSVEQLAETVTRNAESAGVAARLTQESSEVAAQGGAVVGELVATMQGLDASSRKMAEIVSVIEGIAFQTNILALNAAVEAARAGEQGKGFAVVAAEVRSLAQRTAQAAKEVKVLIDDSVGRMSTGSAQAGRAGETMRELVQSVERVTALMAEISTASGEQSTGVAQISSAVHRMEEVVQQNVSMVGELTHVAEHLGQESGSLVEAIGVFRTPGAGARAIGMPEQAPRRAPVRTLLLAEHP

SEQ ID NO: 20532 - DNA, 1740 bp, Bordetella bronchiseptica
  CDS (1)..(1740)
atggcggcgacgccgccatgcgcggctcagcctcacttgcggatcccgatgcgaaagaaactcaaacttgcggccgcgctgtcggccacgctggcatttttcgtgctgttgttcgccgcggcggccggcgcgggcgtggcggtgctgcgcgacaaccaggctgccatcgaagccctgggccgcggcaatatcgaacgcgccagcgacctgggcgatacgaccagctggctgttccaggcccgcgccgtgctggccgacgccaagacgtatatggaaggcgggctggaggagcagcgcgacgcggccctggcgcaggcggccacgctgctggagcaggcccgcgccagccaggagcgcctgcgcgccaaccccgagatggccgcgcagggcgcgtccttgtatgacgaggtgctggccggctacgacgcgctggcggtccaggcgctggcgccgctgcatgccgcgctcaagggctggaacggcatcgaggccaaccggctggccgaacgcgcgctgccgcaggcggccgagcgctacatcgaggcggtcgatgccttccagggctatgcgagggagcaggggcgcgccgccgtggccgatgccgcgcgcgtgctcgaacgcatggtgctgggcgcggcggccttgctggcgctggtggccgtcctggccgtcgtgatccggctgggctttcgccgcgcgatgctgcggcccttgaccgaggccggccgccatttcgaccgcatcgccgatggcgacctgaccgccgcgatcgcggcgcgcggcgacaacgagatcggcgtgctgtattcggcgatgcgacgcatgcagggcgggctgacccgcgcggtcgaatcggtacgccatggcgtggaggagatccacaccggttcgggcgagatcgccgccggcggcgtggagatgtccggccgcacggcgcgccaggcgggcgcgctgcaggaggccgccgccagcatggcggagctggccggcacggtacgcgccaccgccgagcacgccgaccaggccagccggcaggcggccggcgccaccgagctggcgcgccagggcggaacggcggtcgcgcaggtggtcgccagcatgcgcgacatcgcaagcggcgcgcagcgcatcgccgagatcgtggggctggtcgacagcctggcgttccagaccaatgtgctggccttgaacgcggcggtggaggcggcgcgggccgggccgcagggcaggggtttcgccgtcgtggccggggaagtccggtcgctggcccagcgcagcgcccaggcggcgcgcgagatcaagggcttaatcgacgattcgtcggcgcgcgtggccagcggggtgcagcaggtcaacctggcgggcgccaccatgggcgagatcgtgcaatcgatcgaccgtgtgacgcaactggtggccggtatttcggaggccagcgccacgcaggccgcgggcattgcctcggtcaacctggccgtggcggacgccgagcgcgccacgcaggagaatgccgccatggccgagcagaccgcggcggcggcggcctcgctggaagcgcaggcgcaggccttgcgccaggcggtggcggtgttccggttggccggcgcggcgccgcgttcaggcggcgcgggcgggcagttggtagcgctggaccagcagcgccaggttgccgtgcttgacctgctgcttgacgcgggcggcggccgaggcgaggtcctccgggcgaacgtggctgcctag

SEQ ID NO: 20533 - protein, 579 aa, Bordetella bronchiseptica
MAATPPCAAQPHLRIPMRKKLKLAAALSATLAFFVLLFAAAAGAGVAVLRDNQAAIEALGRGNIERASDLGDTTSWLFQARAVLADAKTYMEGGLEEQRDAALAQAATLLEQARASQERLRANPEMAAQGASLYDEVLAGYDALAVQALAPLHAALKGWNGIEANRLAERALPQAAERYIEAVDAFQGYAREQGRAAVADAARVLERMVLGAAALLALVAVLAVVIRLGFRRAMLRPLTEAGRHFDRIADGDLTAAIAARGDNEIGVLYSAMRRMQGGLTRAVESVRHGVEEIHTGSGEIAAGGVEMSGRTARQAGALQEAAASMAELAGTVRATAEHADQASRQAAGATELARQGGTAVAQVVASMRDIASGAQRIAEIVGLVDSLAFQTNVLALNAAVEAARAGPQGRGFAVVAGEVRSLAQRSAQAAREIKGLIDDSSARVASGVQQVNLAGATMGEIVQSIDRVTQLVAGISEASATQAAGIASVNLAVADAERATQENAAMAEQTAAAAASLEAQAQALRQAVAVFRLAGAAPRSGGAGGQLVALDQQRQVAVLDLLLDAGGGRGEVLRANVAA

SEQ ID NO: 20534 - DNA, 1599 bp, Bordetella bronchiseptica
  CDS (1)..(1599)
atgcgcgttaacctcccgatatatgacgtagagaccaagctgcgcgaggaccaatacctgatctcgcgcaccgacaccaaggggcggatcgtctatgcgaaccccgccttcgtcgaggtcagcggcttcgagcgcgacgaattgatcggcaaggcgcacaacctggtacggcatcccgacatgccgccccaggcgtacgaggacctgtggcgcaccctgcaggctgggcagtcctggctgggagtggtgaagaaccgccgcaaggacggcggtttctattgggtgctggccaatgccacgcccatctatgaggatggcgaggtggtcgcctattcgtcggtgcgcgtcaaggccagcgacgagcagatcgaggccgccgaagccgcctatgcgcagttgcgcgccggcacgctgcgtggccggcgcctgtggcgcggccaggtggtgtccaccggctggcggcgggtgctggccgccgccgcgtttccgttgcgcggcggtctgagcgcgcgcatgctgcgccagtcgctgctggcggcgctggccgtggccggcgcgggcgccgccgcgctggcgccctggtggccgcaatggagcggcgcgcaggccggcgccgcgagcgcggccgtggcgctggcggcgctgggcgtgctcgcgatgcagtggcggctgcgcggcgcggtgctgcgcaccatggaaggcgcggccgacatggcgcgccaggtggccgccggcaacctcacgacgcagatcggcagcgacgccaacgacgaggtcggcaagctggcgttctcgctggacgtgatgcgcaagagcctggtcggcatcgcgcgcgacgtgtacggcggcatcgagggcaccacccaggctgccctgggcatcgcgcgcggcaaccaggagctgtcggcccgcaccgacgaccagagcgcctcgctgcagaacacggcggccagcatggaagagctgacctccaccgtgcgccagaacgccgacaacgcccgccaggccaatgacctggccgcgcgcagcatggacgtggcgcgccgcggcggcgacgccgtcggacgggtggtcgataccatgcacggcatctcggacagctcgcgcaagatcgccgacatcgtcaatatcatcgagggcatcgccttccagaccaacatcctggcgctgaacgcggcggtggaagcggcgcgcgccggcgagtccggcaagggcttcgccgtggtcgccggcgaagtgcgcagcctggcccagaagagcgcccaggccgcgcgcgagatcaaggacctgatcgaggactcggtcagccgcgtcaccgaaggttccctgcaggccgagcaggccggcgccaccatgcaggagatcgtcgacgcggtgcgcggcgtcaccgacatcatcggcgaaatctcggtggcctcgcagcagcaggccagcggcatcgaacaggtcgacgaggccgtctcgcagatggatggcatgaccgtgcagaactccggcctggtgcagcaactgggcaacaccgtggcgcaactcggccagcagtcggccgcgctgcgcgaaacgatacgcgtgttccggatggcgcgcgaacaggggtga

SEQ ID NO: 20535 - protein, 532 aa, Bordetella bronchiseptica
MRVNLPIYDVETKLREDQYLISRTDTKGRIVYANPAFVEVSGFERDELIGKAHNLVRHPDMPPQAYEDLWRTLQAGQSWLGVVKNRRKDGGFYWVLANATPIYEDGEVVAYSSVRVKASDEQIEAAEAAYAQLRAGTLRGRRLWRGQVVSTGWRRVLAAAAFPLRGGLSARMLRQSLLAALAVAGAGAAALAPWWPQWSGAQAGAASAAVALAALGVLAMQWRLRGAVLRTMEGAADMARQVAAGNLTTQIGSDANDEVGKLAFSLDVMRKSLVGIARDVYGGIEGTTQAALGIARGNQELSARTDDQSASLQNTAASMEELTSTVRQNADNARQANDLAARSMDVARRGGDAVGRVVDTMHGISDSSRKIADIVNIIEGIAFQTNILALNAAVEAARAGESGKGFAVVAGEVRSLAQKSAQAAREIKDLIEDSVSRVTEGSLQAEQAGATMQEIVDAVRGVTDIIGEISVASQQQASGIEQVDEAVSQMDGMTVQNSGLVQQLGNTVAQLGQQSAALRETIRVFRMAREQG

SEQ ID NO: 20536 - DNA, 1611 bp, Bordetella bronchiseptica
  CDS (1)..(1611)
atgtgggtgctgggcgtgttcgcgctcatgattgccggcgtcggtgcgatggccgcgtatttcctgcaacagaattaccagtcggtgggggagatcaacgccctgaccgatcgggtcgcccaggtggaaatcatcaatagcgacatgctgcgtgcgcgcgtttcgctgatggtgtcggcgcgccagctgcaggaatcgggctggggcagtggcgcaaacgccgcccaggccgctgccgcttcgctgaaggacgccaccgatctgctcgcgggtgttcgcacccgctttgccgatttccagaagaacatgctggaagacgataccggccgccagctgtcgatgaacctggtgcggcgctaccgctcgtatatcgacgatggcgtggacaccatggtcgaagccctgcgcagcgaggactactcgaccttctacatggtcaacaatgaatacggcacgccgcgcagcgccgccttcattgccgccatcggcgacttcagcaagtacatcaacgaacagcagcaagccaccatggaagcggcgcgcaccaacttcgaccgcgccctgatggcggtgacggcggccgtggtgctggccttggtccttatgctggtggcgcgcacggtgttcggccgcctggtggtgcgtccgctcaaggaggccggccagcacttcgacaggatcgccgccggcgacctgaccgcgcgggtggaggtacgcaacagcaacgagatcggccagctgttcgccgcgttgaagcgcatgcaggagagcctgacgcgcaccgtggcgacggtgcgccgtggcgtggacgagatcaacgtgggttcgcgcgagatctcggccggcaacacggacctgtccagccgcaccgaagagcaggcggcctcgctggaagagaccgcggcctcgatggaggagttggcctcgaccgtcaagcagaacgccgacaacgcgcgccaggccaatcagctggcggccagcgcctcggacgtggccgagcgcggcggttcggcggtgtccgaagtcgtcagcacgatggacgggatttcggccagttcgcgcaagatctccgagatcgtgtcggtgatcgacgggatcgcgttccagaccaacatcctggcgctgaacgcggcggtggaagcggcgcgcgcgggcgagcagggcaagggtttcgcggtggtggcgggcgaagtgcgctcgctggcgcagcgcagcgcccaggcggccaaggagatcaaggtgctgatcgaggactcggtggacaaggtgggcacgggttcgcagcaggtcgagcgcgccggtgcgacgatgcaggagatcgtggcctcggtcaagcgggtgacggacatcatgggcgagatctcggcggcctcggaagagcagtccagcgggatcgagcaggtcaaccgcgcggtgtcgcagatggacgaggtgacgcagcagaacgcggcgctggtggaagaggcggccgcggcggccggttcgctgcaggagcaggcgcagcgcctggccgaggcggtcgcggtgttcaagatcaataccggcgaagtgatcgaagtgccggcgcaccaattgtccggctacgcggcgcccctggtcgcgcagtcctga

SEQ ID NO: 20537 - protein, 536 aa, Bordetella bronchiseptica
MWVLGVFALMIAGVGAMAAYFLQQNYQSVGEINALTDRVAQVEIINSDMLRARVSLMVSARQLQESGWGSGANAAQAAAASLKDATDLLAGVRTRFADFQKNMLEDDTGRQLSMNLVRRYRSYIDDGVDTMVEALRSEDYSTFYMVNNEYGTPRSAAFIAAIGDFSKYINEQQQATMEAARTNFDRALMAVTAAVVLALVLMLVARTVFGRLVVRPLKEAGQHFDRIAAGDLTARVEVRNSNEIGQLFAALKRMQESLTRTVATVRRGVDEINVGSREISAGNTDLSSRTEEQAASLEETAASMEELASTVKQNADNARQANQLAASASDVAERGGSAVSEVVSTMDGISASSRKISEIVSVIDGIAFQTNILALNAAVEAARAGEQGKGFAVVAGEVRSLAQRSAQAAKEIKVLIEDSVDKVGTGSQQVERAGATMQEIVASVKRVTDIMGEISAASEEQSSGIEQVNRAVSQMDEVTQQNAALVEEAAAAAGSLQEQAQRLAEAVAVFKINTGEVIEVPAHQLSGYAAPLVAQS

SEQ ID NO: 20538 - DNA, 1842 bp, Treponema hyodysenteriae
  CDS (1)..(1842)
atgagtagatttcatagtctatcatttaaaatgcctattactattagtttaatgtctgttttaatgttaggttttttattaagtgcctctgtgtttttttcaaataaaggaataacacaaagtatagatacaggctttaaaaatacggtagaaggatacgcaaatttatttgattctatattggatgcacaagtaatggtaaataaggcctatacaagcagtgccaatattaagaattttctatcagatatgagtaattcctatactagaaatgttaatctagatataacttcatttatagaaaacaataattttattgaaaatatttctataatgaatactaatggtgtaatagtttttgataaaaattctaaactaataggcagaaattttatggaacttagaccagatatgatgcaaaaattgattgctggagctgatgttgctttcggaaatgaaattaaagaatcggcagctacaggagagcttacaatatctttaggcttgagaatacttgattataataatcaattaataggatatttagtttccataataaaaataatggttatatatgacaattatttcagcaatatacaattaggaagaagcggaagaatagtaactgtaaatgataaatctatggttataatggatactgatccaaaagaaataaataagaaggctccaagtgaatatgataatataataaaaagcggttctgtatcaggggatatacgttatagtgccaataatcatattagagagggcttttataaaaaaatgactgttcagccttggatagtagcttatgctatggatcaggaagaaatttatgagataaataaatctatagttataactagtgttattataggcataatatctatgcttcttatgacattagttgttttcctatttactagaagtataataaaacctttaaacattgtagttgaagaagctaaagaaatagcatctggaaggcttgaagctttgaatagaaaattaaatagaaaagatgaacttggagaattatctcattctttccatgatatgaaaattaaacttatagaagtaatagaaacaactttacataatgcagataaaatgtctcaggctgctaatagtctggctataggtaataaagatttgtctcatagatcagaaaatacagcagctaaccttgaagaaacagcttcttctatggaagaaatagcttcagctatatctatggctacaaataattctgtaaaaggtaatgagatgatgactcactgtagagcatcaatagagaatgcaacatctatagtttctgaaacagttagaagtatgaatgaagttaatgctgatagtgaaaagattaaagatattattaaagttatagaaggtatagctttccaaactaatatattagctttgaatgcggcagtagaggcagcaagagccggagatcaaggtaaaggttttgctgtagtagccagcgaagtaagaagtttggcacaaagcagtcaggattcagcaaaagatataacagaattggtaaatcaagtatatgaaaaaattaataaagctaataagatagtagaaagtcaggaagagctttttatgagtattaaaggcgaaatagatgaaacagcaaatattattaaagatattagttcagcagcattggaacagcaatcaggagtatcacaagtaaataaagctgtaatggaaatggattctattacacaggagaatgctgccttagttgaacagtccacagcttcttcgcttgctttatatgatgatgctaaagagcttcagtctgttatgagtttctttagaatagaaaaataa

SEQ ID NO: 20539 - protein, 613 aa, Treponema hyodysenteriae
MSRFHSLSFKMPITISLMSVLMLGFLLSASVFFSNKGITQSIDTGFKNTVEGYANLFDSILDAQVMVNKAYTSSANIKNFLSDMSNSYTRNVNLDITSFIENNNFIENISIMNTNGVIVFDKNSKLIGRNFMELRPDMMQKLIAGADVAFGNEIKESAATGELTISLGLRILDYNNQLIGYLVSIIKIMVIYDNYFSNIQLGRSGRIVTVNDKSMVIMDTDPKEINKKAPSEYDNIIKSGSVSGDIRYSANNHIREGFYKKMTVQPWIVAYAMDQEEIYEINKSIVITSVIIGIISMLLMTLVVFLFTRSIIKPLNIVVEEAKEIASGRLEALNRKLNRKDELGELSHSFHDMKIKLIEVIETTLHNADKMSQAANSLAIGNKDLSHRSENTAANLEETASSMEEIASAISMATNNSVKGNEMMTHCRASIENATSIVSETVRSMNEVNADSEKIKDIIKVIEGIAFQTNILALNAAVEAARAGDQGKGFAVVASEVRSLAQSSQDSAKDITELVNQVYEKINKANKIVESQEELFMSIKGEIDETANIIKDISSAALEQQSGVSQVNKAVMEMDSITQENAALVEQSTASSLALYDDAKELQSVMSFFRIEK

SEQ ID NO: 20540 - DNA, 1557 bp, Erwinia sp
  CDS (1)..(1557)
atgaacagatggacagttaagataaagttatcaatgtcaatcgcaatgataataatatccttcttaatactgacttcatttttactatcccgtctgacagccaccacgtcagaattacagaatttatatgaacgagactaccagtctgcctcgataatcggtcgggtcgatggtctgctcacccgtgtggatatcaatattctgcggatgatcgccatcggtgacccggcatcgattgccggctggaaaaaacaaaacaccgagaattttgacaaagttaacgaactgttaaataagcttaaacccacgattgatgccacaatgacgtcgtcctttaacggattaatatcatcgtatgtgttaatgcgtaaggggatggagcatcaggtgcaggccgttgagtctggcgacataaaaaaggccagtgaaatcaacagaaatgaagtaaaagcgtatgcagataaaacatttggtgcattatcctctctaaaaaaacatcaggacgaagttgcagaaaataaggtcgttgatcagaaacataaggatttcaggacgctcattatttcacttctcgctgccggggttgttgcgctgatatcggctgtactgggaacggtgatcctgcgcagtttacttcgacagttgggcggagagcctctggcagcagcacaggaggtcaggctgatggcaggaggcgacctttcccatccgatccttgtgaagcagcacgatcgtgtcagcctgctggcccagctgaaagatatgcagtcatctctttccgggctggtgaccaacgtgcgcagcaatgcagaaagcctggcgaccgccagtacccagatatctcagggcaaccaggatctcagccagcgaacggaagaacaagccagctcgctgcagcagacatctgccaccatggaacaactgggttccaccgtcagcaataacgctgaaaacgcacatcaggccagccagctggcttccggtgcctcaacgctggcagtagagggggagctgatggtcgggcgcgttatctccaccatgaaagttatcaatgacagctcgaagaaaatttccgaaatcatcaatgtgatcgatggcatcgcctttcagacgaatattctggcgctgaatgcggcggtggaagccgcacgggccggcgaacagggtcgtggattcgccgttgttgccgccgaagtgcgcagcctggcacaacgcagcgccaatgccgccaaagaaatcagcacattaattaccaacagcgtcgggcaggtagagcagggctgtctgttggtggatgaaacaggtgcaaccatgacgcggattatggaggcgatcaaccaagtgaaatatatcgtgtctgaaatcagtgctgcgagcctggaacaaagctcaggggtgaaacaggtgggacaagccatcactcagatcgacatggttacacagcaaaacgcggctttggtggaagaaagcgccgccgccgcagaaaacctgaaagagcaggctgagcaacttgtccaggctgtcgccgtatttcaggtgagggcaaccgccgtttag

SEQ ID NO: 20541 - protein, 518 aa, Erwinia sp
MNRWTVKIKLSMSIAMIIISFLILTSFLLSRLTATTSELQNLYERDYQSASIIGRVDGLLTRVDINILRMIAIGDPASIAGWKKQNTENFDKVNELLNKLKPTIDATMTSSFNGLISSYVLMRKGMEHQVQAVESGDIKKASEINRNEVKAYADKTFGALSSLKKHQDEVAENKVVDQKHKDFRTLIISLLAAGVVALISAVLGTVILRSLLRQLGGEPLAAAQEVRLMAGGDLSHPILVKQHDRVSLLAQLKDMQSSLSGLVTNVRSNAESLATASTQISQGNQDLSQRTEEQASSLQQTSATMEQLGSTVSNNAENAHQASQLASGASTLAVEGELMVGRVISTMKVINDSSKKISEIINVIDGIAFQTNILALNAAVEAARAGEQGRGFAVVAAEVRSLAQRSANAAKEISTLITNSVGQVEQGCLLVDETGATMTRIMEAINQVKYIVSEISAASLEQSSGVKQVGQAITQIDMVTQQNAALVEESAAAAENLKEQAEQLVQAVAVFQVRATAV

SEQ ID NO: 20542 - DNA, 2259 bp, Nitrosomonas europaea
  CDS (1)..(2259)
atgttgcagaacatgacgatcaaatcacggctgatttttatagtcggcctgctgtctttggcactgatcagtgtgggatccgtcgggttgtacggcctgtatcaatccaagacaaagctggaaacgatttatcaggatagggtggtggtgcttggtcatttctcgcaaatactggacagcctgctgcaagtgcgcatgtatgcgttactggtaaccaatttgcgcgataccggcgttgccaggcagcgtgccgcgcaggtagtcgacgaggatgccaaaatcaacgaattgtggcgaaaattcacccagacctacatgaccccggaagaacagtcactggccggacgttttactgaacaatggaaggtttaccaggcagcgcgcaaccagacgctcaatcatgcgatcaatggcaatttcgatgcagcggtagaagttaccctgcaggacgctggccccaaatatgaggcagtacatggctcattgatgcaactgatcggtctgcaggaaagcgtgacggcacaggaatatgaacagttacaggcaatgacttctattatttttgccaccacgattaccctgaccgtgctgggaattctgctggcgggcggggtgggattcgtgctgatccgtggcgtcagccgttcgatcaatcaggcgatggaggtagcggatggcattgccaacggccggctggatcagcgcatcgaagtgactggccgtgatgaaatttccaggttgctgcaatcgatgacgaagatggtggaagtgctgaacggtttcatgtctgcccagcaaaaaatgagtcagcagcatgacgccggggcgatcagttaccgtattccggcaagtcagtttcccggcagttacggtgaaatagccaattcgatcaatgaactggtgaaagcgcacatcgccgtcaaaatgcgggtggttgaagtcgttgcacgctatgcgcagggtgatctatcagtggatatggacaggttacctggtgagaaggcaaaagttacggaaacgatggataaggtcaaagccagtttgcaggcgatcaacggtgaaatcaaatacctggtggaaggggcgacggcgggtgatttttcccggcgtggcaaggccgataaataccagcatgatttccatgccatggttagcaacctcaaccagttgatgcagacttgcgaaactagtctggaggatgttatccgtatcatggatgcgctggcggagggtgatctgacgcagaagatcacacgagagtaccagggaatgtttgccacgatgaaggatgatgccaatatcaccgtgggacagcttgccagtatcgtcagacagatcaaggatgcaaccggactgatttccaccgcatcgaaagagattgccgacggtaattcggatctttcacaacgcacggaagagcaggcggccaatctggaagaaactgctgccagcatggaagagctgacttcgacggtgaaacagaatgcggacaatgcccgtcaggccaaccagctggcggcttcggcttccgatgtggccgtgaaaggcggcgaggtcgtcagtcaggtggtacagaccatgagcgcgatcaacgacagttccaagaagatcgtcgacatcatcagtgtgatcgacggcattgccttccagaccaatattctggcactgaatgcggcggtggaagcggcgcgtgccggtgaacagggacgcgggtttgccgtggtggcaaccgaagtacgcacgctggcacaacgctctgcggcagcggcgcgggaaatcaaggaactgatcagcaattcggtgcacaaggtggaagatggcacccagctggttgatcaggccggcaggacgatggaagaagtggtgctatcagtcaagcgcgtgacggacatcatgggcgagatttcggctgcttcgcaggaacagagtctgggaatcgaacaggtcaatcaggccatttcacaaatggacgagatcacgcaacagaatgcggcgctggtggaagaagcggctgcggcttccgaatccatgcgcgaacaggcggatcaactatcccgtgcagtggcagcattcaagctcgagcacggaatggctgcagctcatacggacagccagccattcgtcgagcggcgcggccccaaccgggcaaccaacgtcgaacgcctgccgcaacaagtaaaaggccacaggaaaactgcttccccgggtgcatcctcctccattccaaccggtacggatggtgactgggaagagttctga

SEQ ID NO: 20543 - protein, 752 aa, Nitrosomonas europaea
MLQNMTIKSRLIFIVGLLSLALISVGSVGLYGLYQSKTKLETIYQDRVVVLGHFSQILDSLLQVRMYALLVTNLRDTGVARQRAAQVVDEDAKINELWRKFTQTYMTPEEQSLAGRFTEQWKVYQAARNQTLNHAINGNFDAAVEVTLQDAGPKYEAVHGSLMQLIGLQESVTAQEYEQLQAMTSIIFATTITLTVLGILLAGGVGFVLIRGVSRSINQAMEVADGIANGRLDQRIEVTGRDEISRLLQSMTKMVEVLNGFMSAQQKMSQQHDAGAISYRIPASQFPGSYGEIANSINELVKAHIAVKMRVVEVVARYAQGDLSVDMDRLPGEKAKVTETMDKVKASLQAINGEIKYLVEGATAGDFSRRGKADKYQHDFHAMVSNLNQLMQTCETSLEDVIRIMDALAEGDLTQKITREYQGMFATMKDDANITVGQLASIVRQIKDATGLISTASKEIADGNSDLSQRTEEQAANLEETAASMEELTSTVKQNADNARQANQLAASASDVAVKGGEVVSQVVQTMSAINDSSKKIVDIISVIDGIAFQTNILALNAAVEAARAGEQGRGFAVVATEVRTLAQRSAAAAREIKELISNSVHKVEDGTQLVDQAGRTMEEVVLSVKRVTDIMGEISAASQEQSLGIEQVNQAISQMDEITQQNAALVEEAAAASESMREQADQLSRAVAAFKLEHGMAAAHTDSQPFVERRGPNRATNVERLPQQVKGHRKTASPGASSSIPTGTDGDWEEF

SEQ ID NO: 20544 - DNA, 2331 bp, Nitrosomonas europaea
  CDS (1)..(2331)
atgcgagtcaatatgccagttaccaatgtggaacgggaaatgcgggatggagagtttctcgtttccaaaaccacggccaagggggtcattacttatatcaatgagcccttcatccgaatgagcggctttacagagcaggaattggtcggacaggcgcataacatcatccgccatccggatatgccgccggaagcctttgcagatttctggaatacgctcaaacggggcaggccgtggagcggtatggtcaaaaatcgttccaaggatggcagctgttactgggtatatgccaatgtgacacccatcagggaacatggcaaggtgaccggacacatgtctgtgcgcagcaaaccaacgcgtgatcagattcaggcagccgagacgctctatcgccagatgcgtgagggtacggcaaaggtgcagatcgttgccggagagatagttgcaaatagctggctggggtcattgcgcgagaaattccgccatctcagcctgaaaacccggatcaccgggtttggtgcggtacctttgctggtcatggcgggttctgcctggctgatgatgcagggccagctgaatctggcgtttgccgggatggggttgagtgtctgtctggcaggtggaatgggtgtgctgctgtatcgctgtattcgccagccggtggataccatgattcatcacctggataaaatggcgcagggtgattacaccagccagatcctcctcgagcgtaatgatgaaatcgggcggctgaccgaagcactcaaatccatgcagattcgtgcgggaatcgatttcaccgaaaccaagcggatgaacatcgagaatctgcgggtacgtaatgcgctggatatcgcaacttctgcggtcatgattgctgataacaccggaacgatcattttcatgaaccggatggtgcaggaaattctggtcaatgaagccaatgaagtggatgtatgcgaatcattgcaaagtcgattgagagatctggccgggcagcaacagatcgataacgtcagaatcggagagcggacgtattcactgctgttgatgccggttaccagcgaatcgggtgaacgggcaggtgctgtggttgaatggcgtgaccgtactcaggagctgacagtcgaaaaggaagtcatggaaatcgttcaggcgggtgtggcgggtgacttcagcaagcgtttggtgttggctggtaaggaaggtttttttcggcaactggcagaaggaatcaatcggctgatggagagcacttcacaagggttagatgagatggctaccatgctggaggctctggcacagggtaacctgaccatgcacattacccatgactatcaaggtatgttgggcaagttgaaagatgattcgaattcgaccgtggatcaacttgccagcattgtcagacagatcaaggatgcagccggactgatcaccacagcttcgaaagagattgccgatgggaataccgatctttcacaacgtaccgaacagcaggcagccaacctggagaagaccgctgccagcatggaggaactgacttcgacggtaaaacagaacgcggacaatgctcgccaggccaaccagctggcggcttcggcttccgatgtggccgtgaaaggcggtgaggtcgtcagtcaggtggtacagaccatgagcgcgatcaacgacagctcgaagaagattgtcgacatcatcagcgtgatcgacggcattgccttccagaccaatattctggcactgaatgcggcggtggaagcagcgcgtgccggtgaacagggacgcgggtttgccgtagtggcgactgaagtacgcaccctggcacaacgttctgcggcagcggcgcgggaaatcaagggactgatcagcaattcggtgcacaaggtggaagacggcacccagctggtggatcaggctggcaggacgatggaagaagtggtgctgtcagtcaagcgtgtgaccgacatcatgggcgagatttcggctgcttcccatgagcagagcttggggatcgaacaggtcaatcaggccatttcacaaatggatgagatcacgcaacagaatgcggcgctggtggaagaggcggcagctgcatccgaatccatgcgcgaacaggcagaacaactgtcgcgtgcagtagcggcgttcaagctggagcatggaatggctgcagctcatacggacaacccgccatccgtcgaacggcgcagccctaaccgggcaaccaacgtcgagcgcttgccacaaacccgaaaccggaagaaagcagctaccagaagctctgttgcatcggtttccgccggcaccgaagggggatgggaagaattttga

SEQ ID NO: 20545 - protein, 776 aa, Nitrosomonas europaea
MRVNMPVTNVEREMRDGEFLVSKTTAKGVITYINEPFIRMSGFTEQELVGQAHNIIRHPDMPPEAFADFWNTLKRGRPWSGMVKNRSKDGSCYWVYANVTPIREHGKVTGHMSVRSKPTRDQIQAAETLYRQMREGTAKVQIVAGEIVANSWLGSLREKFRHLSLKTRITGFGAVPLLVMAGSAWLMMQGQLNLAFAGMGLSVCLAGGMGVLLYRCIRQPVDTMIHHLDKMAQGDYTSQILLERNDEIGRLTEALKSMQIRAGIDFTETKRMNIENLRVRNALDIATSAVMIADNTGTIIFMNRMVQEILVNEANEVDVCESLQSRLRDLAGQQQIDNVRIGERTYSLLLMPVTSESGERAGAVVEWRDRTQELTVEKEVMEIVQAGVAGDFSKRLVLAGKEGFFRQLAEGINRLMESTSQGLDEMATMLEALAQGNLTMHITHDYQGMLGKLKDDSNSTVDQLASIVRQIKDAAGLITTASKEIADGNTDLSQRTEQQAANLEKTAASMEELTSTVKQNADNARQANQLAASASDVAVKGGEVVSQVVQTMSAINDSSKKIVDIISVIDGIAFQTNILALNAAVEAARAGEQGRGFAVVATEVRTLAQRSAAAAREIKGLISNSVHKVEDGTQLVDQAGRTMEEVVLSVKRVTDIMGEISAASHEQSLGIEQVNQAISQMDEITQQNAALVEEAAAASESMREQAEQLSRAVAAFKLEHGMAAAHTDNPPSVERRSPNRATNVERLPQTRNRKKAATRSSVASVSAGTEGGWEEF

SEQ ID NO: 20546 - DNA, 1863 bp, Erwinia chrysanthemi
  CDS (1)..(1863)
atggacgttaacagatggttactctctgttgcctgcgttggcaacgtactcagctctgtaggaaacctttatgaatactattctgcatacctatacaatctgaagggtggtagtaaattggcgatagggttcggcctcgattttaatcatgtcccgcctttatcatgctctcgggtgtcaatgggtttcgtaatggtgacgcttatgtcaataaaatccattatcagcaacaacattaataataatctgaacgatgcccgacgtgcccgccttaattttcagtatactcacgactacaacgcgattaataccgtcggcgacctgatgaaaaaagtaggtcagtcgttgaatcaggccggtcagctcacctggagtcccgaggcacagaaattactggatcagctcaatgacgcctataaaacttatcttcccgggcgtgacgcgttgatcaaagccagccagcagcgcgatgccgtggcgcaaaaattcaatcaggataccagcgccggcgtcattgccacgttgcgtacccagttcggcaacagttcgttgacgccggaattaacgctggaatttgccaggctgcttgaacaactgtctgacatccgtgacctgacgcatcagttgctgctgcaaccctctgaacaaatcgaatccactctgcgcaaaaccattggcaacgctcaggtcgtattcaatcaagcgctgcctaaattcagcgcggaacaacaagagtggttgaatcaaagctggcgtttcttttctgcctataacggctaccttgccgattacatggctgctttccgggatgaaaatattgcgaccaaaaccatgaccggtgcggcaaccattctggataacgcttccaatgatttatacaacagccagttggcgctggtcagcaccacgacagcccactcacagtggcaattactgattaccggtctggtgatcatcgcgatcgggatactgatggcgtggtgtattacgttgttgattactcgccctctgcaccagagcctgtcgctggcggagcaaattgctcagggtgacctgacctcttccatcgaagtcaaccgccgcgatgagctgggccagttgatggtggcgatgaatcagatgaaccataaactgcgtgagacgatcggcaccattcgtgagggtgtcagcaatgtagcgctagccgcatcggaaatcgccgccggcaacaccgatctctcctcccgcaccgagcagcagtcagagaacgccgacaacgcccatcacgcctcgcaactggctgccgatgcctcggctaacgccactcgcggcggtgagattgtcaccaatgtcgtcagcaccatgaacgagatcgccgtcagttcccgacgcatctctgaaatcacctccgtcatcaatggcatcgcgttccagaccaacattctggcgctgaacgcaagcgggcaaagcagcacgcgccgggtaaagcaggcccgcggctttgcggtggtggcaggcgaagtccgtaatttggcccagcgcagcgcccaggccgccaaagagattgaaacgttgatcggtgaatccgtcacccgtgtgaacaccggttctacactggtggaagatgccggtaaaacgatggatgaaatcatccgctctatctctcacatcaaccagatttccaccgccgtcaccgaaatggacgccaccacccagcagaacgccgcgctggtggaagaatcgtctgccgccgctaactcgctggaagaacaggcacaaatgctggaacaagcggtatcggtattccgtctgggtaatgacaacgcagcgccgcaggtaaaaccacgcgccgccatcggcacgaaaaagcctgatgctgaataa

SEQ ID NO: 20547 - protein, 620 aa, Erwinia chrysanthemi
MDVNRWLLSVACVGNVLSSVGNLYEYYSAYLYNLKGGSKLAIGFGLDFNHVPPLSCSRVSMGFVMVTLMSIKSIISNNINNNLNDARRARLNFQYTHDYNAINTVGDLMKKVGQSLNQAGQLTWSPEAQKLLDQLNDAYKTYLPGRDALIKASQQRDAVAQKFNQDTSAGVIATLRTQFGNSSLTPELTLEFARLLEQLSDIRDLTHQLLLQPSEQIESTLRKTIGNAQVVFNQALPKFSAEQQEWLNQSWRFFSAYNGYLADYMAAFRDENIATKTMTGAATILDNASNDLYNSQLALVSTTTAHSQWQLLITGLVIIAIGILMAWCITLLITRPLHQSLSLAEQIAQGDLTSSIEVNRRDELGQLMVAMNQMNHKLRETIGTIREGVSNVALAASEIAAGNTDLSSRTEQQSENADNAHHASQLAADASANATRGGEIVTNVVSTMNEIAVSSRRISEITSVINGIAFQTNILALNASGQSSTRRVKQARGFAVVAGEVRNLAQRSAQAAKEIETLIGESVTRVNTGSTLVEDAGKTMDEIIRSISHINQISTAVTEMDATTQQNAALVEESSAAANSLEEQAQMLEQAVSVFRLGNDNAAPQVKPRAAIGTKKPDAE

SEQ ID NO: 20548 - DNA, 1533 bp, Janthinobacterium sp
  CDS (1)..(1533)
atggtgttgatggtcataattggcaatggacttaacgcgaaaaataagcaaaagctccttcatgaactagaggtatccaacaagaaagcaattcgccttggtgtgatgaagagcgcgttgactgagaaaagtgtagttatgcgcatgatcagccggcagtctgacatcgagaacgttcaaaacatgaacgctcgggttgccgaagaaaatattcgctactccgttgcaaatgatgagttaattgcgcttggtctaaatgaacgcgaaaagtcgataattgaccatattagtcaacttgacaccgaagcccttagctattttgagaaggttacaaagcagattcttgcgtctgacgtcgaaggcgcagagaaaaccatttctacaaacatcgaagggttggtgcaaagtgcgtgggccgagatggacaaacttgtagctttgcagttttcctcagcttctgacatattggcggcctcggtggttgatgacgatcgtctcatggtaataacggcttttattggaacgatttgtttacttatcggctgcgctttcgcctggattattacgcgtagcattactaaacccctagatgacgctgtcaaatttgcaagccttgtcgcgactggggatttgactgcgaaaattgacgagcgtagcgaagatgaaattggtcagctttccaatgctctacgccagatgaatgaaagtttgtcgaaaatcgttcatagtgtccgaaccggtacggaaagctttgcgacagcttcgcgccagattgcatcgggcaataccgatctgtcttcccgcactgaatcccaggctagttcgttgcaggaaaccgcttcttcaatggaagagttaacatcagctgttcgaatgaatgatgcaaatgctcgtcaagccaagctgcttgtccattcagcatcgaccgtagccatacgcggcggcgatctggtagaacaagtagtacaaaatatggggtctatcaaggaaagctcgcgcaagattgttgacattatcggtgtaattgatggcatttctttccagacaaatattctagcgctgaacgctgcggtagaggctgcatgcgccggggagcaaggcaaaggttttgcagtcgttgcaactgaagtgcttgagttatcgagacgctcgtctgatgcagctaagcaaattagagagctgattaatgactcagtcgaaaaggtagctgccggtagcaaactggtagacgaagccggtaaaaccatgggagagatcgttacatcagtcaagcatgtcgcgcatatcatgacggaaattactactgctagcagcgaacaacgcgatggcattgagcaaatcaaccaggctatctcgcagatggatgagatgacgcagcaaaactctgcactcgtggacgaagccgcggctgccgcagtaagccttcagcatgagtccattaggctagcggaggcagtctcagtctttaagttgaatacctttaaaccggttcccgtgggttggtcgttaaatcgtcaatccttgcctcattag

SEQ ID NO: 20549 - protein, 510 aa, Janthinobacterium sp
MVLMVIIGNGLNAKNKQKLLHELEVSNKKAIRLGVMKSALTEKSVVMRMISRQSDIENVQNMNARVAEENIRYSVANDELIALGLNEREKSIIDHISQLDTEALSYFEKVTKQILASDVEGAEKTISTNIEGLVQSAWAEMDKLVALQFSSASDILAASVVDDDRLMVITAFIGTICLLIGCAFAWIITRSITKPLDDAVKFASLVATGDLTAKIDERSEDEIGQLSNALRQMNESLSKIVHSVRTGTESFATASRQIASGNTDLSSRTESQASSLQETASSMEELTSAVRMNDANARQAKLLVHSASTVAIRGGDLVEQVVQNMGSIKESSRKIVDIIGVIDGISFQTNILALNAAVEAACAGEQGKGFAVVATEVLELSRRSSDAAKQIRELINDSVEKVAAGSKLVDEAGKTMGEIVTSVKHVAHIMTEITTASSEQRDGIEQINQAISQMDEMTQQNSALVDEAAAAAVSLQHESIRLAEAVSVFKLNTFKPVPVGWSLNRQSLPH

SEQ ID NO: 20550 - DNA, 1656 bp, Pseudomonas syringae
  CDS (1)..(1656)
atgaaatggttctacgatctgaagatttccaccaagttgattacctcgtttctggtggttctgttgttgaccgcagccatgggagttttcgcgatcatccagcttggccaggtgaatcaggccgctcaggacataaaagaaaactggatgccgtccatgcgagctgcttcgggcatgcgcttttacgcagccaattaccggctgaaggaaaaccgtcatattgccgctgatgccgctccggaaaaagcccagatggagcaggaagctgctgaggcgcgcagccagtttgaaacacggctggcaacgtacgacaagttgatcatcagcgaccaggatcgtcagatgttcagcgccgtcagtgcgtcatggtccgcttacctgaaagtcagcactaatctgttcgaactctcccgtcagggccaggagaccgaggcacgtgcattgctgcgaggagagtccaaactgcacttcgatgaagtgaccagccagttgcaaaaaatggtcgaactcaacgacgccggcgcaactgccgccggagacaaaggctcgcaactgtacgaaaccgcccgcatctcgatcatcgtggtactgattgcagccttgttggtcggtctggggctggcgctgttcatcgcccggatcatttctcgtccgctcaaggaagcagcgactgccgccgagcagttggcagaaggcaacctgaacgcctacatcgggcacggctcgaaagacgaaaccggcatggtgctcaatgccatgcgcaacatggtcggcaaactggcgcacatcatcggcgaggtgcgtaacgcagccgacaacctggccagcgcttcggaagaagtcagcgccaccgcgcagtcgatgagccaggccaccagcgaacaggccgccagcgtcgaagaaaccagcgcgtcggtcgaacagatgagcgccagcatcaaccagaacaccgagaacgccaaagtgaccgacggcatggccagcaaggccgccaaggaagccaccgatggcggcgaatcggtgcagcagactgtcgtggcgatgaagaagatcgcccaacgcatcagcatcattgatgacatcgcctaccaaaccaacctgctcgcgctcaacgcggccatcgaagcggcccgtgccggtgaacatggcaaaggtttcgcagtggtggccgctgaagttcgcaagctggccgagcgcagccaggttgcagcgcaggagatcggcgagctgtcttccagcagtgtggaaatggccgagaaagccggcaagttgctggacgagatggtcccctcgatcaacaagacctctgatctggtgcaggaaatcagcgccgcttccgaagagcaggcggccggtgtggcgcaaatcaacaccgccatgacccagctcaatcaggtcacccagcaaaacgcatcgagcagtgaagagctggccgcaacggctgaagagatgagcagccaggccgagcaactgcaacagtccatgagctttttcacccttgattcgtcgccaaagcccacaacgtcaggcagcagtatcgatcaccgcagcagcccgagccgccagccaccccgcacggtgcaaccgccggcgcgcaaggcatttgcccacagcatggcgagcgccccggacgaatcggaattcacccgtttctga

SEQ ID NO: 20551 - protein, 551 aa, Pseudomonas syringae
MKWFYDLKISTKLITSFLVVLLLTAAMGVFAIIQLGQVNQAAQDIKENWMPSMRAASGMRFYAANYRLKENRHIAADAAPEKAQMEQEAAEARSQFETRLATYDKLIISDQDRQMFSAVSASWSAYLKVSTNLFELSRQGQETEARALLRGESKLHFDEVTSQLQKMVELNDAGATAAGDKGSQLYETARISIIVVLIAALLVGLGLALFIARIISRPLKEAATAAEQLAEGNLNAYIGHGSKDETGMVLNAMRNMVGKLAHIIGEVRNAADNLASASEEVSATAQSMSQATSEQAASVEETSASVEQMSASINQNTENAKVTDGMASKAAKEATDGGESVQQTVVAMKKIAQRISIIDDIAYQTNLLALNAAIEAARAGEHGKGFAVVAAEVRKLAERSQVAAQEIGELSSSSVEMAEKAGKLLDEMVPSINKTSDLVQEISAASEEQAAGVAQINTAMTQLNQVTQQNASSSEELAATAEEMSSQAEQLQQSMSFFTLDSSPKPTTSGSSIDHRSSPSRQPPRTVQPPARKAFAHSMASAPDESEFTRF

SEQ ID NO: 20552 - DNA, 1815 bp, Yersinia pestis
  CDS (1)..(1815)
atgttttcctttctattaggacactctatgcttgattccattcgctcacgtattttggcagcctgtattatcatcgttgcgggttcgctcgccattaacaccttcctcaactattccgttgccaataaatataataacagcgccatcgataataccctgacggcactcactgttagccacagtgtcagcattgctgaatgggtggcatccaaaacacaaatgattatgtcgctcaaagacagcgcattgaccgccgatccactcgcagcactaaagcaagtggctgcagcaggcggctttattaatgtctatattggctatgccgataaaacggctattttttccaacccggatggcattcctgccgattatgaccccaccggacgcccgtggtatctacaagccgtgaatgcaggcaagccagtggtgacacctccgtatatcgatgcggggacccagcagttagtcgtcacatttgcatggtccatcgttcaggatggggttcttaaaggcgtgatcgctgccgatgtcactatgggaagtgtcattgccaatgtaaatgctatacacccaaccgataatagcttcggaatgctaatcggggctgatggcacaatcatcgcccatcctgagacgctgctgacccttaagccattggccgatatcgcgccgaacctgaatttacaaaccctgctgacggcaacggtacctgtttcaacggatattagcggcagcagcaaattattgctcgcccaggcggtccctggaacccagtggtttaccgtcgttgcgctggataaatctcaagcaactgcgggaatacattcattattaacgacatcattagtaacattggtgataattatcttcatctcggcgggggtgatagcgctgatcacccaacgcgccctgacaccattaacacatattcagcaagcgatggatgctatcagttccggctcggcagacctcactcaacgcctcccgatcgaaggccgtgatgaagtagcacagattgcccgttcatttaatcagtttgcggataagctcagtctggttatggctcaaatccgtggtaccagcgagtctgtccgggtagcagcgaatgaaatcgcagcaggcaaccaagacttatcgggtagaacagaatcagccgccgccagtttgcagcaaacctcagcagcgctggaacaaatttcggcaaccgtcgctcaatcagccagtgccgcacggcaagctaacaacgcggtattttctgcctctgaggatgcttctcgcggtggcgacgttatcactaaagtcatcacaacgatggagtcaattgaaaaggcctcgggaaaaattggcgatatcactagcgtcattgatggcattgctttccaaacaaatattctggcactgaatgctgccgtcgaggccgctcgagcaggagaacaaggacgaggttttgccgtggttgcaggcgaagtccgtatactggcacaacgcagtgcacaagcggctaaagagataaaagccctgatcgaatcgacggtcagcagtgtggcatccggctccagccaagtgcgccaagccagtaatgccatgaccgatattgtcagtagtgtctctgatgtcacgaccattatgtcggagatcaccaatgccgctgatgaacaaatgcgtggtattcacgaaataaatagtgcagtagcgcaattagatacaatggtgcaacagaatgccgcactggtgcaggagtcaacggccgcttcagccgccttacaagctcaggccgctgatttaactgataccgttaatcaatttaagatctaa

SEQ ID NO: 20553 - protein, 604 aa, Yersinia pestis
MFSFLLGHSMLDSIRSRILAACIIIVAGSLAINTFLNYSVANKYNNSAIDNTLTALTVSHSVSIAEWVASKTQMIMSLKDSALTADPLAALKQVAAAGGFINVYIGYADKTAIFSNPDGIPADYDPTGRPWYLQAVNAGKPVVTPPYIDAGTQQLVVTFAWSIVQDGVLKGVIAADVTMGSVIANVNAIHPTDNSFGMLIGADGTIIAHPETLLTLKPLADIAPNLNLQTLLTATVPVSTDISGSSKLLLAQAVPGTQWFTVVALDKSQATAGIHSLLTTSLVTLVIIIFISAGVIALITQRALTPLTHIQQAMDAISSGSADLTQRLPIEGRDEVAQIARSFNQFADKLSLVMAQIRGTSESVRVAANEIAAGNQDLSGRTESAAASLQQTSAALEQISATVAQSASAARQANNAVFSASEDASRGGDVITKVITTMESIEKASGKIGDITSVIDGIAFQTNILALNAAVEAARAGEQGRGFAVVAGEVRILAQRSAQAAKEIKALIESTVSSVASGSSQVRQASNAMTDIVSSVSDVTTIMSEITNAADEQMRGIHEINSAVAQLDTMVQQNAALVQESTAASAALQAQAADLTDTVNQFKI

SEQ ID NO: 20554 - DNA, 1611 bp, Yersinia pestis
  CDS (1)..(1611)
atgtttggtcaaatccggatttctaccagttttttcctgctgctgatgtttctttgcgccatacagttaatttcaagtggtctatcatttacggcttttcgctcagactaccaaaatttaaatcgagtggagttaagtagtcagcaacgcgatgcattaagcctcagttgggtatctttgcttcaggcacgtaataccttaaaccgtgcggctactcgctcggcgctcaatgttcctcaggagcaagttaacgctttaatggggagtgcgcgcagtgcattgcagaaagctgaactttactttaatcagtttcaggcggtaccgcgccttgatgagagtgagagcagtgggcaattactggatgcgaccaaaaacagttatcaaaaccttcgtagcgcattacgtgagttaattgattttctggaagcgggtgatttacaagcatttatggatcaacccactcagaaaacgcaagatttgtttgaagcggatttcatccagtatttgcaatacgccaatgaggttattgccgatgccggtcagcagaatcagcaggcttatcagctctcaatctggatatttagtggtgcgattctgatggttatcacgatggccatttcgtcgttgatctggttgcgcaacatgtttgttcggccattagcgacgatgcgtgagcattttggccgcattgctcaaggggatttgtctgggcagatctcggtgactggccgtaatgaaatcagccagatgttcgccagcttacgcaccatgcagcagtcgctgatctcaacggtcagcaatgtgcgtgagggtaccgaatcgatgttgaccggtatccaggaaatttccgcaggtaacaacgatttatcggcaagaactgaacagcaagcggcttccttggaacaaactgccgcgagtatggaacaactgaccgccacggtaaaacagaatgcggacaatgcgcatcaggccacggtactggcgcaagaggcttccggtacggcagctaaaggcggagaactgacggcgagtgtcgtcaccaccatgcatgcaatcgctaccagttcgcagaagattggtgcgatcaccagcgttatcgacggtattgccttccaaaccaatattttggcactgaatgcggccgtggaggcggcccgtgcgggtgagcaagggcgtggttttgcggtggttgcgggtgaagtccgtaatttagcacaacgcagtgcgcaagcggccaaagagatcaaagggctgattgatgagtccgtcagccgtgtccgccaggggtctacgctggtcgaaagtgcaggaactaccatggaagagatcgtccgctcggtggcgcgtgtgactgacattatgggggagatcgaatctgcttcggatgaacagagccggggtattgaacaaatatcactcgccgtaacgcaaatggatcaggttactcagcaaaatgcgtcattagtggaagaggccgcggcggcagccaatgcactggaagagcaggccagcatgctctccgatgccgtctctgttttccgtttggggcaggggcacgacgaacagtcagttgcgggcaatagccagcaatcattggccacgcattattag

SEQ ID NO: 20555 - protein, 536 aa, Yersinia pestis
MFGQIRISTSFFLLLMFLCAIQLISSGLSFTAFRSDYQNLNRVELSSQQRDALSLSWVSLLQARNTLNRAATRSALNVPQEQVNALMGSARSALQKAELYFNQFQAVPRLDESESSGQLLDATKNSYQNLRSALRELIDFLEAGDLQAFMDQPTQKTQDLFEADFIQYLQYANEVIADAGQQNQQAYQLSIWIFSGAILMVITMAISSLIWLRNMFVRPLATMREHFGRIAQGDLSGQISVTGRNEISQMFASLRTMQQSLISTVSNVREGTESMLTGIQEISAGNNDLSARTEQQAASLEQTAASMEQLTATVKQNADNAHQATVLAQEASGTAAKGGELTASVVTTMHAIATSSQKIGAITSVIDGIAFQTNILALNAAVEAARAGEQGRGFAVVAGEVRNLAQRSAQAAKEIKGLIDESVSRVRQGSTLVESAGTTMEEIVRSVARVTDIMGEIESASDEQSRGIEQISLAVTQMDQVTQQNASLVEEAAAAANALEEQASMLSDAVSVFRLGQGHDEQSVAGNSQQSLATHY

SEQ ID NO: 20556 - DNA, 1638 bp, Yersinia pestis
  CDS (1)..(1638)
atgaagtataacgggtctattgactaccagggatctcctccctttactgaggttaatatgagagttaacaaacctgtcagccggcaggagtatcccattgagcgcgatatcaccttgcagtccaccactgatattcatggaaatattgcttacgctaatgctgcttttgttcgtgccagtggctttgaatatcaagagttgcagggtcaacctcacaatatggtaaggcaccccgatatgccacccgcggcttttgctgatatgtggcaaacattgaatgccggtctttcttggtcttcattggtgaagaatcgccgtaaaaatggagattattactgggtccgggctaatgcgacgccactgcgccataatggccgtttaaccggttatatttcggtacgtattgcgccaactcgcgatgaggtaaaacaagctgaagcattgtataccgatttcaacaccggtaaggcaaaacggcggcatattgccttgtatcgtgggctgatcgtgcgcacggggtggctctccccactttctttgttccaaactttaccattacgctggcgcctgcggagtgccttgctaagttccgccatcattccaaccgccgccgccagtgtgatggaggtagcgggtcaacctctcttgattctcggctcggtggcattgacctggagcgtattggcttcactgtggttggagcggcagattgcccgccccatcgcggctattttgcaacaggcgcaggacgtttcctccggagaagcaggcgattatgtacaactaaatcgtgtcgatgaaatcggttatttaatgcgtagcgtcaatcaactcggcctgaacctacgttctttaaccgatgatgtcagtggtcaggttgatgggattaataccgccagcaacgaaattgctgctggcaatcgcgaactaaaagtacgaaccgaacaagcaaccgataatctgcaacacattgtcagtgccacagaacaattagctgcgacagtgcagaacagcgctaacagtgccaatgaaacaacatcactcgccgaaatgagcagccatgccgcagaaaaaggcagcgagctcatgcaccaagtcattgaaactatgggcactatcaatgactccagccatcgcattgtagatattatcagtgtgattgaaggcattgcttttcagaccaatattctggcactcaacgcggccgtagaagcggcccgggcgggtgaacaaggtcgtggatttgccgtagttgccagcgaggtacgccatttggcacaacgttcgtcaaccgcagcaaaagagattaaacatttaattgagaccagtgtagagcgggtacgtgacggaagtactttggtgcaaagtgccggtgccactatggacaatattgtcaaacaggcaagccaggtctctacgttgatcagtgaaatcagcacctcgactcatgaacagacacaggcccttggccaaatccggcaatcgatcagtcggctagatcaaatgacttaccagaatgccgcgatggttgagcaatatgctggcgcggcagaagaactggcacatcggacattgcgactaaccgcggcggtccgtatttaccgcccattgaataacgtaggaaagttaagggattag

SEQ ID NO: 20557 - protein, 545 aa, Yersinia pestis
MKYNGSIDYQGSPPFTEVNMRVNKPVSRQEYPIERDITLQSTTDIHGNIAYANAAFVRASGFEYQELQGQPHNMVRHPDMPPAAFADMWQTLNAGLSWSSLVKNRRKNGDYYWVRANATPLRHNGRLTGYISVRIAPTRDEVKQAEALYTDFNTGKAKRRHIALYRGLIVRTGWLSPLSLFQTLPLRWRLRSALLSSAIIPTAAASVMEVAGQPLLILGSVALTWSVLASLWLERQIARPIAAILQQAQDVSSGEAGDYVQLNRVDEIGYLMRSVNQLGLNLRSLTDDVSGQVDGINTASNEIAAGNRELKVRTEQATDNLQHIVSATEQLAATVQNSANSANETTSLAEMSSHAAEKGSELMHQVIETMGTINDSSHRIVDIISVIEGIAFQTNILALNAAVEAARAGEQGRGFAVVASEVRHLAQRSSTAAKEIKHLIETSVERVRDGSTLVQSAGATMDNIVKQASQVSTLISEISTSTHEQTQALGQIRQSISRLDQMTYQNAAMVEQYAGAAEELAHRTLRLTAAVRIYRPLNNVGKLRD

SEQ ID NO: 20558 - DNA, 2424 bp, Vibrio vulnificus
  CDS (1)..(2424)
atggcattttggaatcgtaacaaggaaacgcacaacagctttcgtccgcaaacatctcaccctagagatacgttgttaaacgaggttgaagagcaagaagagttgagtaaagagcagttactctcggcgctgaacacagcgaaaaccgcattgatgatggtggatcgagatttcaaaatcacctacatcaacgaacaatcgatgaccttatttaagcagcatgaagggttatttcgtaagttctggccaagttttagcgccaataaagagtttttgatgggcgcatgcatcgacatgtttcaccgcaaccccgcgcatcaaaggcaactgctttctacccctgcgaacttaccttacagcacggtgattgccattgatgacgtacgcttagagttgaatgtgggagcgatgttggacgcggcgggaaactacgttggcaacaccttagaatggcaagacgtcacggaagagcgccgcaaagaagacagcatcgcccgcttgcaggcggcgatagatcaagcacaaacggcgatggtgatgatcgatcgcgatttcctcatcacttatctcaatgaagaaaccctcaccttgttccgccgccatgaaacggcctttcggggcgtttggtctggttttaccgccagcaaagagtggttaatggggcgctgtattgacgagttccaccgtaatcctgctcatcaacgcaaactgctgagcgacccaaataacctcccttatcgcaccgacattgcggtgggcgacattcgcattgagctcaacgttgcggcggtgaaaaacgccaaaggcgaatacataggcaacagtttggaatggcgcgatgtgacggagcagcgcatcaacgaagaagaagttgggcgacttgcctccgccgttgcagggatgaccaccaacctgatgatggccgataaaaacggcatcattcgctacctcaatcctgcgttggaaaacttactgcgcagccgagagtcggaactgcagaaatccttaccggggtttgattctcgtaatttggtcggcaaaagcattgatgtgttccataaaaatcccgctcaccaacaggcgatcatctcgaatccggatcgcttgccatttagctctgatatcaaagtcggctcgctcgagttcaatctcacttgtattgcgatgcgagatggcagcggcaactacatggggcctgcgctgcaatggattgacatcactgagcaacgagatggtcagcgtcaagtggaaagcttgattcaaaaagcgattgcggggcagctcaaagagcgcattgatacctcggtttacagcggctttatgaaagagttgggagacggcattaatagcctgctcgatacattggtcgaaccgcttgatcagtgcattcaagtgatgagtaaagtggccaacggcgatttgaaaacgaagatgagcgacacccaccaaggcgagtttggtcgtttggccgaagcggtcaacacctcgattctcaatattcgtaacatggtcgacaaaattaccgtctcttcggcgcgcgttgccaccgcctcaacagaaattgccgatggcaataatgaccttagccaacgtgtagaagcgcaagcgtcaaacttagaagaaaccgcagccagtatggagcagatgaccgcaacggtgcgacaaaacgccgacaacgccaaaggtgccaatgagctctctgaagatgccgcgaaaaaagcgcgcaaaggcggcgatgtggtgggccaagcggtggcggcaatggctgaaatcaacactgccagtaagaagatttccgacatcattggcgtgattgatgaaatcgccttccaaaccaatctattggcgctcaatgccgcggtggaagcggcgcgtgcgggcgagcaagggcgcggttttgccgtggttgcaggtgaagtgcgcaatctggcacagcgcagtgctgcggcagcaaaagagatcaaagggctgatcaaagacagcgtcgagaaagtggacgaaggatcgcgcttggtggatgaatcgggggcaacgctcaacgacatcgtcgctgcggtagaaaaagtcacgggcctcatcagtcaaattgcccagtcgagcatcgaacagtcgacaggtattgatgaaattaaccgtgcggtcgcgaccatggatgagatgacgcagcaaaacgcctcactggtggaagagacctctgcggcaagccaatcgctcaaagcggaaggcaaagagctgctcaatctcatgagcttctttagcaccgacagcagcattaccacgttagagacttcacccagtgccgcgccatcggccgcgaaagtgactgcgatgcccacacgcggcaatataagtgaaatgaaaaagccaaaagtagccaattccggttttagaacggaggaaagcgacgaatgggaagagttctaa

SEQ ID NO: 20559 - protein, 807 aa, Vibrio vulnificus
MAFWNRNKETHNSFRPQTSHPRDTLLNEVEEQEELSKEQLLSALNTAKTALMMVDRDFKITYINEQSMTLFKQHEGLFRKFWPSFSANKEFLMGACIDMFHRNPAHQRQLLSTPANLPYSTVIAIDDVRLELNVGAMLDAAGNYVGNTLEWQDVTEERRKEDSIARLQAAIDQAQTAMVMIDRDFLITYLNEETLTLFRRHETAFRGVWSGFTASKEWLMGRCIDEFHRNPAHQRKLLSDPNNLPYRTDIAVGDIRIELNVAAVKNAKGEYIGNSLEWRDVTEQRINEEEVGRLASAVAGMTTNLMMADKNGIIRYLNPALENLLRSRESELQKSLPGFDSRNLVGKSIDVFHKNPAHQQAIISNPDRLPFSSDIKVGSLEFNLTCIAMRDGSGNYMGPALQWIDITEQRDGQRQVESLIQKAIAGQLKERIDTSVYSGFMKELGDGINSLLDTLVEPLDQCIQVMSKVANGDLKTKMSDTHQGEFGRLAEAVNTSILNIRNMVDKITVSSARVATASTEIADGNNDLSQRVEAQASNLEETAASMEQMTATVRQNADNAKGANELSEDAAKKARKGGDVVGQAVAAMAEINTASKKISDIIGVIDEIAFQTNLLALNAAVEAARAGEQGRGFAVVAGEVRNLAQRSAAAAKEIKGLIKDSVEKVDEGSRLVDESGATLNDIVAAVEKVTGLISQIAQSSIEQSTGIDEINRAVATMDEMTQQNASLVEETSAASQSLKAEGKELLNLMSFFSTDSSITTLETSPSAAPSAAKVTAMPTRGNISEMKKPKVANSGFRTEESDEWEEF

SEQ ID NO: 20560 - DNA, 1941 bp, Shewanella oneidensis
  CDS (1)..(1941)
atgtttaaaaaactgacgctcagcatgcagatttctggcggttatgcattggtattattactcttggtcgtaatttcattggccgcctatttcgggctgacgaaagccattaacggctttagtgattatcgtgctctggctcgcgactctaatatggccggtagggtccaagcaaatatgctaacgattcaaatccaagcatatgattatatttttcaaaagaaagaatcagcctacaaagtatttaatgagcgtaacgttatcgttaatgacattattcaaaaggcaatgacagatattaatgatcctgaattaagtcagcaaatttctgatattcgtaaagatattgtcgattacaacagttattttgagtcggtagtgaaattgattaaatctcgaaatgatgaagtcactaacgtgctagtgcctaatggctctgaagttgtaaaactgatttctgacgccatgcatcaatcctttaataaagggcaaattgaggtggcttaccgagcgggttcagtactcgaatcagtgctgagcgctcggttagcggcatcaaaattccttgagacaaatttagatgcggatttacagcaagcgttgatggcgattgatttagcgaagggtgagcggctttctgcattaaaagctgcggcaacagatctcgatacacaatcaaaattagtccaatttacaagcagcattgacaattatgcgtcctcgttaaagtcggtttataacacgattaacgaacgaaacgacattgtcaaaaatcaactcgaccgcatcggtcttgacgtgtctcgccaaacagaagatatcaaattaactatccaaaaaagacaagacgcccttggtcctttagttaaagttcaaaatgaacagaccctcaccaccgtcattagtgtctcaatcgctgctatttttatcggtattttcttagcgtggtttttagtgaagttaattaaaaagccattaggaggtgagccacgtgatatggaaacaatcgctcgtgcaattgctaacggagatttaacgatagagttaaaacaacgtgaacaagcaaccggtgtttataaggcaatgatagatatgatagatagccttacctctgtgatcgctcaagttcgaagtggtgctgataatttgtctagtgcttcgtcacaggttagtagtactgcccaaagtctaagtcaaggcgcaactgagcaggccgccagtgtagaagagacaaccagtgctgtagaggaattaaatgcgtcagtacagcagaattctgaaaatgcgagagtaaccaacaatatggcgacggttgcagcagaagaagcaagacaaggtggaattgcggtagagcaaaccgtggcggcaatgaagcaaatcgccgctaaaattagcttaattgaggatattgcttataaaaccaatctgttaagtctcaatgcggccattgaggctgcccgtgctggagaacatggtaaaggctttacagttgtcgcctctgaagtcagaaaacttgctgaaaacagtagtttaactgctcaagaaattaataaacttgctagtgatagtgtaggaatagctgaaaatgctggccgcctgattgcgaatattgtaccaaatatccaaaaaacatctgatttagttcaggaaataagttcttcctctgaggagcaggcgatagggatcagtcagattaatgactccatgctgcaactggataaagctacgcagcagaatgcatctgcatcggaggagcttgcggcaacatcagaagaacttaatggtcaagctaatcaactgcttgatgctgtggagttttttaagcttgccatcagtagtgaaagacctcatcaaggcaaatcaacacacatgacagcttctgtacgtaaaacggctaaggccaaacagcatgttgaacgtgccgatttcgaacgattctga

SEQ ID NO: 20561 - protein, 646 aa, Shewanella oneidensis
MFKKLTLSMQISGGYALVLLLLVVISLAAYFGLTKAINGFSDYRALARDSNMAGRVQANMLTIQIQAYDYIFQKKESAYKVFNERNVIVNDIIQKAMTDINDPELSQQISDIRKDIVDYNSYFESVVKLIKSRNDEVTNVLVPNGSEVVKLISDAMHQSFNKGQIEVAYRAGSVLESVLSARLAASKFLETNLDADLQQALMAIDLAKGERLSALKAAATDLDTQSKLVQFTSSIDNYASSLKSVYNTINERNDIVKNQLDRIGLDVSRQTEDIKLTIQKRQDALGPLVKVQNEQTLTTVISVSIAAIFIGIFLAWFLVKLIKKPLGGEPRDMETIARAIANGDLTIELKQREQATGVYKAMIDMIDSLTSVIAQVRSGADNLSSASSQVSSTAQSLSQGATEQAASVEETTSAVEELNASVQQNSENARVTNNMATVAAEEARQGGIAVEQTVAAMKQIAAKISLIEDIAYKTNLLSLNAAIEAARAGEHGKGFTVVASEVRKLAENSSLTAQEINKLASDSVGIAENAGRLIANIVPNIQKTSDLVQEISSSSEEQAIGISQINDSMLQLDKATQQNASASEELAATSEELNGQANQLLDAVEFFKLAISSERPHQGKSTHMTASVRKTAKAKQHVERADFERF

SEQ ID NO: 20562 - DNA, 1965 bp, Shewanella oneidensis
  CDS (1)..(1965)
atgggtatcttagatatattcggtaataccgaagagcgccaacaccaagatgaagagcgtcaacgttatttccagttgctcgataatagtcgtaataattttatgattgccgatagcgatcgtaatatcatttatgccaataaggccgtactgaatatgttgtcagaggctgaggcagatatccgtaaacagttaccccaattttcggttgctagggttattggcagtaatatcgatatcttccatgtgaatcctgcccatcagcgcaatatgttagaaagattgacgcaatcccacacggcacaaataagtattggtaagcgtatttttaaattaattttaacgccgattatttcacgtgataataaacatttgggcactggagttgagtggattgaccgtactgaaagcattgatgccgagcgggcaacgcagcggatattagaagcactaaacaataccagtaccaacgtgatgattgctgatgccaatcgaaccattatttatatgaatcgctcggtagaagccatgttacgccgctccgaaagtgaaattcgccaggttttaccccatttttcggtggacaaaatcctcggcagttccatggatattttccatcgcaatccagcgcatcaagccagcttgcttgacaaactcgatcgcaaatatgagtcgcagatccaagtggccagttgtcattttcgtttaaccgccagccctattatcttaacgtctggtgagcgattaggctcggttgttgaatggctcgaccgaactgaagaagtccaagttgagcaagagattgcgcggattgtggcagcggcagcagcgggtgatttttcccagcgtgttgatagtcatggtaaacagggctttttcttgatgcttgccaatagcctcaattcactgattgagacctcggatcgggggctacaggatgtcgctcgagtgctaatggccatggccgaaggggatctgacaactcgtatctataacgagtatgaaggtaccttcaacgatttgaaaaactattcaaatcaaaccgctgaaaagctttcctacatgataagagatattcaaaaagcggctgacaccatcaacactgcatcttcagaaatcgcccaaggcaatgctgacctctccagtcgtactgaggagcaagcctccagtctcgaagaaacttccgcaagcatggaagagttaacgggaaccgtgaaattaaatgccgataatgcaagccaagccaatgcgttagcgtcgaaagcggcggatgtggctgaagacgggggcgagcttatccaacaggttgtgcaaaccatggcatctattaatgaatcggcacgaaaaattgcagatattataggtgtgattgatggtattgctttccaaaccaatatattagcgcttaatgcagcggttgaggctgcaagagcaggtgagcaggggcgcggttttgcggtagtggcttcagaagtgcgaagcttggctcaacgttctgcaaatgccgcgaaagatatcaaggcattgatctctgattcagtcagtaaaattgatagtggtaataatttggttggaaaatccggcgataccatgaaggaaattgtcattgcaatcaagcgagtaaacgacattatggcggaaattgcctccgcgtctaatgagcaagcgattggtatcgatgagattggtaaagccgtcgtacaaatggatgaaatgacacagcagaatgcggctcttgttgaagaagctgctgcggccgctgaaagtatgcaatctcaagcacagcaactggcagatagtgtggcaaatttcaaagtggatgaggaaacgagatcagctcgacatactacagagcttaaaaaaataccccaaaaaataccgacattagcgcgggtaacccccaaacctaaagcgatgacgcctaagctgaataaagcagatcaagatgaatgggaagaattttga

SEQ ID NO: 20563 - protein, 654 aa, Shewanella oneidensis
MGILDIFGNTEERQHQDEERQRYFQLLDNSRNNFMIADSDRNIIYANKAVLNMLSEAEADIRKQLPQFSVARVIGSNIDIFHVNPAHQRNMLERLTQSHTAQISIGKRIFKLILTPIISRDNKHLGTGVEWIDRTESIDAERATQRILEALNNTSTNVMIADANRTIIYMNRSVEAMLRRSESEIRQVLPHFSVDKILGSSMDIFHRNPAHQASLLDKLDRKYESQIQVASCHFRLTASPIILTSGERLGSVVEWLDRTEEVQVEQEIARIVAAAAAGDFSQRVDSHGKQGFFLMLANSLNSLIETSDRGLQDVARVLMAMAEGDLTTRIYNEYEGTFNDLKNYSNQTAEKLSYMIRDIQKAADTINTASSEIAQGNADLSSRTEEQASSLEETSASMEELTGTVKLNADNASQANALASKAADVAEDGGELIQQVVQTMASINESARKIADIIGVIDGIAFQTNILALNAAVEAARAGEQGRGFAVVASEVRSLAQRSANAAKDIKALISDSVSKIDSGNNLVGKSGDTMKEIVIAIKRVNDIMAEIASASNEQAIGIDEIGKAVVQMDEMTQQNAALVEEAAAAAESMQSQAQQLADSVANFKVDEETRSARHTTELKKIPQKIPTLARVTPKPKAMTPKLNKADQDEWEEF

SEQ ID NO: 20564 - DNA, 2931 bp, Leptospira interrogans
  CDS (1)..(2931)
atgtttagaaaaaacttaggtatttggatcgggttagctattacaataaacggatttgtttttttatccattcaaaactttcgaggtcccaatccttcaacggaaacgaacttcgaagaacaactacaatccgttcaacattccagcgaatcctttttaaaaacggaagaatccatttctgaatttttactctatttgtcccttggtaaagaaaaagaaaccttagtttccagtttagaagaaatcgaaaagaatctaaaaaatttacgttcttctttttccgagtccgatcgcaaaaaaaatccagcgatcctaaaattcgataaaaagataggaactcttttttcttcaatcgaagaactaaaagaaaagatctaccgttctaaagatattaaaaaagatacgtctttatttttaaagtccgacttttttacagacctttcttcttttagacgaacaagattagaagcagtaaaggaactttcaaattctgtagaaaccgcatcggttacagttgtttcatccactccaacggaaattcaatttttagttacaattttagaatattctggaatatcaattttacttatctcttttttatggtggtccaatcgttctaatcaaaaaacaattctcaacttagaaatggaatttttaagaatgagaaccgcagtagataatgtgaccacgaatatcatgatggcggatagaaatttcaacatagtttatatgaataaggccatccagatgatgtttaacaaagcggaatcggatattaaaaaacaactctctaatttcaatctatctaatttgatgggaaccaacattgattcgttccataaaaacccggctcatcaaagaggtcttttagataaactttcagatacattccgctcctcgattacaatcggaggtagagaatttgatctgattgcaaatccaatcgtagacgtaaatgggaacaaactcggaaccgttgtagaatggagcgatgttaccgaacaaaacaaaatccaaaaacaaagaaaattagaaaatgaggagctaacacgcgttaaagtagctttagacaatgtgactacgaatattatgatggcggaccgaaatttaaacgttgtctacatgaacaaatccatccgtgctatgtttcactcagcagaagacgacattaaaaaacagtttaacaatttcgatccgtctcgtttaatcggaaccaatattgatatatttcacaaaaatcctgcctatcaacgaggacttctcgacaaactaacggacacatttcgttcttctatcaacattggaggtagaacctttaatctgattgcaaatccaatcatagatgaaacaggagatcgcttaggttccgttgtagaatggagcgacgttacagaacaaaataaaatcgcagaacaaagaaaaatcgaaaacgaagaactaattcgagtaaaagtggctttggataatacttctacaaacatcatgatcgcggataacgaattcaatattcgttatatgaatcaggcggtggttaagatgttcgaaataggagaaggagatattaaaaaacaattcgctcattttaatctcaaaagtttagtaggatcgaacatagatcaattccataaaaacccggcacatcaaagaggagtcttgagtagtttcaccggaattcataaagctacgattaaaatcggtggaagaacttttgaccttatcgccaatccgattttggattcaaacggcaaacgactcggttcggtagttgaatggtcagacgttacaaatgaacttgcggttcaagaggaagtagagggaattgtaagcgccgcagcaaaaggaaattttacaactcgaatttctctggattctaaaaccggtttttttctaaatttaagtcgttctctaaatcaattgttggaagtgagcaatcgaggtttgaacgaagtagtagaagctttggaaagaatttcttctggagacctaactcaaaaaattacaaacgaatatcacggtaccttcggaaagttaaaagaatattctaatattacaatggacaagctgagcgagatcatcggagatattatcgttcgttcctctagtttagttacttctgcgagcgaagtttcttctacggccaattccttgagccaaggcgcgtctgaacaagcagcgagcgttgaagaaactacttcttctttggaagaaatgactgcgtccatcgatcagaacgctcagaattcccgtcagacggaacaaatctcttctaaatcttctcaagacgcagaagaaggtggcgcgtctgtaattgaaaccgtcaaggcgatgaaacagatcgcggaaaaaatcagtatcatcgaagacatagcctaccagaccaacttactcgcgttaaacgccgcgatagaagcggcaagagctggtgaccacggaaaaggttttgcggtagtggcttctgaagttcgtaaactcgcagaaagaagtcaaaaatctgcaaatgaaattagtagtttagcgggaaacagcgttgccattgcggaaaaagccggaaatttaatttctcagattgttccttctatacgaaaaactgcggatcttgttcaggaaatcacggctgcaagcgacgaacaatcctcaggcgtttccgaaatcaacaaggcaatggggcaactcgatcaggtttctcaacaaaatgcttccgcatccgaagaattagccgcaatctcggaagagatgaacgcacaagcagaacaactcaaagagtcggttctattctttaagatttcggacggggataaacgtttaaccaacggcggcggattgcttcatcgagatttttctggaaccggtattatcaaagcgactcccacgactagaaaagatcttcccaagggaatatctcccattaccgaaaaattcgaaaggtattaa

SEQ ID NO: 20565 - protein, 976 aa, Leptospira interrogans
MFRKNLGIWIGLAITINGFVFLSIQNFRGPNPSTETNFEEQLQSVQHSSESFLKTEESISEFLLYLSLGKEKETLVSSLEEIEKNLKNLRSSFSESDRKKNPAILKFDKKIGTLFSSIEELKEKIYRSKDIKKDTSLFLKSDFFTDLSSFRRTRLEAVKELSNSVETASVTVVSSTPTEIQFLVTILEYSGISILLISFLWWSNRSNQKTILNLEMEFLRMRTAVDNVTTNIMMADRNFNIVYMNKAIQMMFNKAESDIKKQLSNFNLSNLMGTNIDSFHKNPAHQRGLLDKLSDTFRSSITIGGREFDLIANPIVDVNGNKLGTVVEWSDVTEQNKIQKQRKLENEELTRVKVALDNVTTNIMMADRNLNVVYMNKSIRAMFHSAEDDIKKQFNNFDPSRLIGTNIDIFHKNPAYQRGLLDKLTDTFRSSINIGGRTFNLIANPIIDETGDRLGSVVEWSDVTEQNKIAEQRKIENEELIRVKVALDNTSTNIMIADNEFNIRYMNQAVVKMFEIGEGDIKKQFAHFNLKSLVGSNIDQFHKNPAHQRGVLSSFTGIHKATIKIGGRTFDLIANPILDSNGKRLGSVVEWSDVTNELAVQEEVEGIVSAAAKGNFTTRISLDSKTGFFLNLSRSLNQLLEVSNRGLNEVVEALERISSGDLTQKITNEYHGTFGKLKEYSNITMDKLSEIIGDIIVRSSSLVTSASEVSSTANSLSQGASEQAASVEETTSSLEEMTASIDQNAQNSRQTEQISSKSSQDAEEGGASVIETVKAMKQIAEKISIIEDIAYQTNLLALNAAIEAARAGDHGKGFAVVASEVRKLAERSQKSANEISSLAGNSVAIAEKAGNLISQIVPSIRKTADLVQEITAASDEQSSGVSEINKAMGQLDQVSQQNASASEELAAISEEMNAQAEQLKESVLFFKISDGDKRLTNGGGLLHRDFSGTGIIKATPTTRKDLPKGISPITEKFERY

SEQ ID NO: 20566 - DNA, 1521 bp, Escherichia coli O6
  CDS (1)..(1521)
atgtcttctcatccgtatgtcacccagcaaaataccccgctggcggacgacaccactctgatgtccactaccgatctgcaaagctatatcactcatgctaatgacacttttgtgcaggtgagcggctataccttgcaggagttacaggggcaaccgcacaacatggtgcgtcacccggatatgccaaaagcggcgtttgcggatatgtggttcaccctgaaaaaaggggagccctggagcggcatcgtgaaaaatcgccgcaaaaatggcgaccattattgggtgcgggccaatgcggtaccgatggtgcgcgagggaaaaatcagtggctatatgtcgattcgtacccgggcgacggatgaagagatcgcggcggtggagccgctgtacaaagcgttgaacgccggacggaccagtaagcgtattcataaaggcctggtggtgcgtaaaggttggttgggaaaactgccttcattaccgcttcgctggcgggcgcgtggagtgatgaccctgatgtttatcttgctggcggccatgctctggtttgttgctgccccggtggtgacgtatatcctctgtgcattagtggtattgttggcaagcgcttgttttgaatggcagattgtccgcccgatagaaaatgtcgcccgtcaggcactgaaggtggcgaccggagagcgtaatagtgttgagcatctgaagcgcagcgatgagctggggctgacattacgtgcggtagggcagcttggcctgatgtgccgttggctaattaatgatgtctcaagccaggtgtccagtgtcagaaacggcagtgagacgctggcgaaaggcaccgatgaactgaacgaacatacccagcagacagttgataacgttcagcaaacggtggcgaccatgaaccaaatggcggcgtcggtgaaacagaactctgccacggcgtcggctgccgataaactttctatcaccgccagtaatgcggcagtgcagggcggggaggcgatgactacggtgatcaagacaatggacgatattgccgacagtacccagcgcattggcaccattacttcgctgattaacgatattgcgtttcagaccaatattctggccctgaatgcggcggtggaagcggcgcgtgccggcgaacagggcaaaggttttgcagtggtggcgggggaagtgcgtcatttagccagccgcagcgccaatgctgccaacgatattcgcaagctgattgatgccagtgctgataaggtgcaatctggttcgcagcaggtacacgccgccggacggacgatggaagatattgtggcgcaggtaaaaaacgtcacccagttgatagctcagattagccattcaacgctggaacaggccgatgggctttccagcctgacccgtgcagtggatgagcttaacctgatcacccagaaaaacgccgagttggtggaagagagtgcgcaggtgtcggcgatggtgaaacaccgcgccagcggactggaagacgcggtgacggtgctgcattaa

SEQ ID NO: 20567 - protein, 506 aa, Escherichia coli O6
MSSHPYVTQQNTPLADDTTLMSTTDLQSYITHANDTFVQVSGYTLQELQGQPHNMVRHPDMPKAAFADMWFTLKKGEPWSGIVKNRRKNGDHYWVRANAVPMVREGKISGYMSIRTRATDEEIAAVEPLYKALNAGRTSKRIHKGLVVRKGWLGKLPSLPLRWRARGVMTLMFILLAAMLWFVAAPVVTYILCALVVLLASACFEWQIVRPIENVARQALKVATGERNSVEHLKRSDELGLTLRAVGQLGLMCRWLINDVSSQVSSVRNGSETLAKGTDELNEHTQQTVDNVQQTVATMNQMAASVKQNSATASAADKLSITASNAAVQGGEAMTTVIKTMDDIADSTQRIGTITSLINDIAFQTNILALNAAVEAARAGEQGKGFAVVAGEVRHLASRSANAANDIRKLIDASADKVQSGSQQVHAAGRTMEDIVAQVKNVTQLIAQISHSTLEQADGLSSLTRAVDELNLITQKNAELVEESAQVSAMVKHRASGLEDAVTVLH

SEQ ID NO: 20568 - DNA, 2010 bp, Rhizobium etli
  CDS (1)..(2010)
atgcccaagtccattagactcgctttatctttgatatttgttctgctctctcttctcgcggcgggccagggcatcgtgagtatcgtcaagctgctgtccattaggagcaatatatccgaagttgccagcaactggctgccatcgatcgatgtgataaatcggatcaatacgatcaccgcggactaccgcatcctgcagttcaggctggtgacaaactcatcagattcgacgagccttgcgcataatatcaccaccttccgccagaagatggaggatctcgcgaatgcccgtggtgaatatgagccgatggtgacatccggcgaggagcgtcaggcctatgacgcgttctccgctttgtggacgcaatatcaggaggatggcgagcggattgttaaactaatgcaggcaggcaagaaggatgaagcatttgctcttctaacgagtgacgccacgacgaaactgtataatgatagcggagcgctccttgaccaggatgtcgcagttaacaagcgtggtggagtcgcggccgtcggaaacacgatgggcgccgtttcatcgacggttttggtcaccattcttgccatggcgctggcaactacgacgggcattatagccctgctttactgcatccggaagattaccgatccgatctcgcggttgactaccacgatgggcgtactggcagatggtaatctcgacactgaggttcctttcgcaatgcgcgccgacgaaatcggcaagatgtcgagagccgttgaggtattcaagcaaaacagcatcaaggcccgcgatctgaacgcgcaggaggccgcgttgcaggccaagagcgccgacttgcagtcgagcattgccgaggtggtgtcagccgccgtagccggtgacttcacccatcgcatcaccaagaaatacggcgatgcggctctcgaccgttttgcaggaagcgtcaacgagctggtcacctctgttgaccggggcatcgccgaaactcgccgagttatctcagcgcttgccgatggggatctgacggaaaacatgtgcggcgagtttcagggagcctttggtgaactgaagagtaatgtcaacgccaccatggcagcccttcgatccgtattaggcgaggttcgctccgccgtcgacacgatcaacggcggagccggcgagatgcgcatcgcctcaggcgacctttcaaagcgcacggaacagcaagccgcggccctggaggagacctcttcggcgcttgaggaaatcacggtggcggtaaaaagctcgacagaaagagccacggaagccagccatatggtcgatgaggcacgcagaagcaccgagcagtcgagcgcggttgtcaaagacgcggtcgccgccatgggccgcatcgagcaggcctcggatgaaatcggccagatcattaacgtcattgacgagatcgccttccagaccaatcttttggcccttaacgccggcgtcgaggcggcgcgtgcgggtgacgctggaaagggtttcgccgttgtggctcaggaggtgcgtgaactggcacagcgctccgccactgccgccaaggatatcaaggcgctgatcaaccggtccggcgacgaggtcaaaactggggtcaggctggtaacggccacaggcgatgcccttggtctaatccgaggccacgtgatcaaggtgaacgagcacgttcatacgatctcgacggcggcacgagagcaatcgaccgggctggcggaagtcagcactgcggtcaaccagatggatcagacgacccagcagaatgcggcgatggtggaagaatcgacggcggccaccaaccggttggcggatgaggcttccaatctggcgcggcttattgcgcgcttcaggctcgacggttcgactgttgtacggcgtgttgcccaccagaacggtaagccggccgcctcgccagcgcgtgccctctcccagaagcttgccggcgccttcggcggacgtactacagccgctgtcgcgactaaggaatgggaagagttttaa

SEQ ID NO: 20569 - protein, 669 aa, Rhizobium etli
MPKSIRLALSLIFVLLSLLAAGQGIVSIVKLLSIRSNISEVASNWLPSIDVINRINTITADYRILQFRLVTNSSDSTSLAHNITTFRQKMEDLANARGEYEPMVTSGEERQAYDAFSALWTQYQEDGERIVKLMQAGKKDEAFALLTSDATTKLYNDSGALLDQDVAVNKRGGVAAVGNTMGAVSSTVLVTILAMALATTTGIIALLYCIRKITDPISRLTTTMGVLADGNLDTEVPFAMRADEIGKMSRAVEVFKQNSIKARDLNAQEAALQAKSADLQSSIAEVVSAAVAGDFTHRITKKYGDAALDRFAGSVNELVTSVDRGIAETRRVISALADGDLTENMCGEFQGAFGELKSNVNATMAALRSVLGEVRSAVDTINGGAGEMRIASGDLSKRTEQQAAALEETSSALEEITVAVKSSTERATEASHMVDEARRSTEQSSAVVKDAVAAMGRIEQASDEIGQIINVIDEIAFQTNLLALNAGVEAARAGDAGKGFAVVAQEVRELAQRSATAAKDIKALINRSGDEVKTGVRLVTATGDALGLIRGHVIKVNEHVHTISTAAREQSTGLAEVSTAVNQMDQTTQQNAAMVEESTAATNRLADEASNLARLIARFRLDGSTVVRRVAHQNGKPAASPARALSQKLAGAFGGRTTAAVATKEWEEF

SEQ ID NO: 20570 - DNA, 2535 bp, Rhizobium etli
  CDS (1)..(2535)
atgagccctttggaggtaagtatgttcgtcgatcgcctgttatccacctttaccataagagcaaaggtgttattggtacttgtacccttgatcctgatattggcggcagttggtggggtcggcttaaaagcaactggcttgcttcagtctcgtcttcggctttcaaatgaggttcttcagaccttgagcgggtttcgaagtgtcgcggaaagcatgaaccgctttttggcgcaaagctcaacggagtaccgagatgaggcgctgacaagtttaaacgggcagaccgcaaccatgcagtcgctccaggaagcggcggcaggtagcgggagcgaaactggtgcgctcgaaaacagtgtatcggcaatgtccgttatctcgggcagcatcggccgcatgtggtctttgcataatgacgaggaatccgttcgcagcgacattgtttccaacttgtcgaagatcaaggaggtcggaggcgcccttaaattggctgcggttgatgtgcgctcacaagtacgcaatcaggagaactccgggaaaaccatgctccgggaggctacccgctcactcgatacggcatcagttatgcaacacatggcggaagacttggtgagcttgccggacggagcgaagcagcctccgactgtcgcccagcaagggcttgtgatcaaaaagtcgctaaaaacagttaagcgggtagtctcgactgctgacgagcaggccgttactaaaattgagaggactatcgccaagctaatcgccaaccccgaatttgtcgacccttccacacggcttgccggctctgacctacagagctttgcgacgaacctgcgagtggatgcgatccagcacatgattgaaggaacaaatgcgatccgggcgttggataaagcgttgacggattccgaaatgcttgttgcgacggcgacaacgatcggccaggacgccgattcgatcgaaatcgaaatcaataacctgttccgtacagccaacgcagagaatcagcagcgcctcgttgagcaacttacaaaattggcgcgtgacaccgtggcagttggaggcgttgccagctcgatatctggcttcgataaaatgcaggaagatctattcgcccaggtggattctatccaagagaacacagagaagctggtcaagatagcggaagcccgccaagcgcaatattctgaggcggacaaaaccggtcaggagatctggaaaaacctcgtaacttttgcagcaactcaggaaaacgatgctcgcaatgaaagcaatcttgcccgcttgctgtcaactatcgccacagtgtccggcgtcttggtagccttggcggctggcgccggcctgatggcgacacttcgcgccccgatcgaacggatcgcgaagcgcatgcaagagctggcaaagggcgatcttcgatcgcagattgtcggacgtgaccggagagacgaaataggtgaaatggctcgcgcactcgaggttttccgtgaaaatgctgtctcgaagatggacatcgagacacgaacggaagccgataggaaaaccgttgaacaggagcggatggatcgtgaacgcgaacgcgctcagatggaggaggaggtcgcaactgccgtcaccattctaggagaggcgttatctcgattggcgcgtggcgacatctctcaagaaattgaccgccaattccatcccaatcttgagccgctgaggcgcgatttcaatcactcgctttcgatcctgagagagacagtgtctcatatcgacgagaataccaatcaaattcaatggggaaccagcgagcttttcaaagcctcagatgatctgtcgcggcgaactgaattgcaagccgcctcactggaggaggctgcggccgccgtcgaacaggtgacggtcacggtcagaaaatcatccgagaatgcctatgaaacccaggctttcgtgtccgttgttaaagaacacgccgagggtgcggcaaccattgtgaccgatgcgatcaacgcaatgggcagaatagaagacgcgtcccacaagatcggccaaatcattggtttgatcgatacgattgcgttccagacaaatcttttggcactaaatgctggtgtcgaggcggctcgtgctggagatgccggaaagggttttgcagtcgtagcccaggaagtgcgcgaacttgcccagaaatcatcagctgcagcccgcgagattcgccacctgatttcggaatcctcttcggaggtggcgatcggctcagattacgtggggaaagcaggtgaggcgttacacaacataacggcgtcgatcttgaagatttccgatcggattgatcaaatcgtcaattcgagccgcgagcaagcggcgtccctcgccgagatcaacaataacgtcaatgtacttgaccagggaacacaacaaaacgctgccatggccgagcagacaaatgccgcggcaaagactctctcggatcagactaacgaactcagcgagcggctcgcttcattcaaattgaccgaagataagtcgacgcgtcgggttaggttagtggcgtaa

SEQ ID NO: 20571 - protein, 844 aa, Rhizobium etli
MSPLEVSMFVDRLLSTFTIRAKVLLVLVPLILILAAVGGVGLKATGLLQSRLRLSNEVLQTLSGFRSVAESMNRFLAQSSTEYRDEALTSLNGQTATMQSLQEAAAGSGSETGALENSVSAMSVISGSIGRMWSLHNDEESVRSDIVSNLSKIKEVGGALKLAAVDVRSQVRNQENSGKTMLREATRSLDTASVMQHMAEDLVSLPDGAKQPPTVAQQGLVIKKSLKTVKRVVSTADEQAVTKIERTIAKLIANPEFVDPSTRLAGSDLQSFATNLRVDAIQHMIEGTNAIRALDKALTDSEMLVATATTIGQDADSIEIEINNLFRTANAENQQRLVEQLTKLARDTVAVGGVASSISGFDKMQEDLFAQVDSIQENTEKLVKIAEARQAQYSEADKTGQEIWKNLVTFAATQENDARNESNLARLLSTIATVSGVLVALAAGAGLMATLRAPIERIAKRMQELAKGDLRSQIVGRDRRDEIGEMARALEVFRENAVSKMDIETRTEADRKTVEQERMDRERERAQMEEEVATAVTILGEALSRLARGDISQEIDRQFHPNLEPLRRDFNHSLSILRETVSHIDENTNQIQWGTSELFKASDDLSRRTELQAASLEEAAAAVEQVTVTVRKSSENAYETQAFVSVVKEHAEGAATIVTDAINAMGRIEDASHKIGQIIGLIDTIAFQTNLLALNAGVEAARAGDAGKGFAVVAQEVRELAQKSSAAAREIRHLISESSSEVAIGSDYVGKAGEALHNITASILKISDRIDQIVNSSREQAASLAEINNNVNVLDQGTQQNAAMAEQTNAAAKTLSDQTNELSERLASFKLTEDKSTRRVRLVA

SEQ ID NO: 20572 - DNA, 2262 bp, Rhizobium etli
  CDS (1)..(2262)
atgtcgagactgccgctatctctacttttaatgattttggcaattatcccgttgacggcgttcgtaatcatcggagtatcaacatcactgggatattaccgagaatactctaccttccgcagcgcacaaacaacgcagcgacttgggcgggaaggcggattcctcgcccaagctatagcggcggaagcgtttgcaggcgccgacgtgcgtcgggcaaagcaagctgcatcggacagggcttttacagcggtcttttccgcttacgactcttggaaaaaggcattcgacgatccggccatagaacgggcggtacagatcattcgtgaaaggcgggacaatatcgatagcttccgccggcgcgtcgatgacggaacggctagcgaggcggagggagctgttgctttgcgcccagctgcccttgcgggcttggagctcgtccgtcgcactggggcgactgtcaatgatttggatttagcacgccaaattaccggttttcacgcgctcatgcagatcacggaagctagtttgctggagatcaggcccggccgagcctacgtcaaaaattcagccatgtccgtcgatctattttcgtccctcttacagtcaaaaaatctaaagcagctttatgtgcctgcgatgcaggaatttctccccgccgatctcgtcaaatcttatgacgacttcgaggccagcgccgcaggcaagttcatcgcgggcgttcgcgatcagatgtatgcaaaccagccgggcgtttccttcccccccgagacgttggatcgatggaatgaaatcacccaacagcgggctgctttgttgaccgcactcattatgcgcaccggcgacgagttggacgagatggcatttcagcgttacgccgatcttcgcaatgcctttatcggctactccggcgccacgcttctgatcatgtctacggtactcattttgtgcatttcggtcgttcggagaatttcaagctccattcggactctgacaagccgaatgaaggcactcgcagaaggcgatacgtcggcgccggtgcccttgacgatccgacgcgacgagatcggggacatggcgcgttgccttgagtttttccgcggcgcggccatacagaaaagtaacctggagacatccgcggaagctgagcgcattcgttctgaccaagagaagctggatattcaggtaagggcggaaaaagaagcagaagagcgcctcatccgagcgacgacggcattggcaaccgggttgaagcggatggcggatggagacttgatttatgaaattgaggagccgttagcgccacagtttgaaagtttgcgcagggatttcaacgcttccattcgtcagctccgggacgtgcttgttaccgtcggccattcagtcgaaacggtcacgaatggcagctcgggcgtctcggccgcatctgaaaatctttcaagacgcacggagcagcaggcggcttcgctcgaggaaactgcagcggcgttggaggagataaccgtcaacgttgcatcgaccacgaagaggacggctgaggcgcgcggagccgtccaacagatgcgagatcatgcggaaatgtccggtcgggttgtacgcgatgctatcggcgccatgaatcgcattgaaaactcctccaagcagatttcccagatcatcagcgtcatcgacgcgatcgccttccaaacgaacctcctggcgctgaacgccggcgtcgaagcagcgcgtgctggcgacgcgggaaaaggctttgcggttgttgcccaggaggtcagggagcttgcacagcgctcagcgacagcggcaaaagaaatcaaggatctcatcggcaattcagctcttgccgtcgacgaaggcgtaaggctcgtgagtgaaaccggatcgggcctgagaacgattgaagagcttgtgcaggatgtaaatcttcatatggacgcaatcgcaacggcctcccaggaacaatcgtcgggcctgcgcgagatcaacggcgcggttaaccatatggaccatgccactcaagaaaatgcgagcatggtcgcggagatgaatactgcaggatcgcacctcgctcaagagagccaaagcctagccgcactgttgaaacatttccacttcaaagacgagagcgggaagccacagaaggtcacgggcgaacttgggaagagcttcccgcccggtcagacaatggttgaccgcggagactatccgatgcgccgtggtaacctggtgctcgcgccttcgaatgatgattggcaagcgttctaa

SEQ ID NO: 20573 - protein, 753 aa, Rhizobium etli
MSRLPLSLLLMILAIIPLTAFVIIGVSTSLGYYREYSTFRSAQTTQRLGREGGFLAQAIAAEAFAGADVRRAKQAASDRAFTAVFSAYDSWKKAFDDPAIERAVQIIRERRDNIDSFRRRVDDGTASEAEGAVALRPAALAGLELVRRTGATVNDLDLARQITGFHALMQITEASLLEIRPGRAYVKNSAMSVDLFSSLLQSKNLKQLYVPAMQEFLPADLVKSYDDFEASAAGKFIAGVRDQMYANQPGVSFPPETLDRWNEITQQRAALLTALIMRTGDELDEMAFQRYADLRNAFIGYSGATLLIMSTVLILCISVVRRISSSIRTLTSRMKALAEGDTSAPVPLTIRRDEIGDMARCLEFFRGAAIQKSNLETSAEAERIRSDQEKLDIQVRAEKEAEERLIRATTALATGLKRMADGDLIYEIEEPLAPQFESLRRDFNASIRQLRDVLVTVGHSVETVTNGSSGVSAASENLSRRTEQQAASLEETAAALEEITVNVASTTKRTAEARGAVQQMRDHAEMSGRVVRDAIGAMNRIENSSKQISQIISVIDAIAFQTNLLALNAGVEAARAGDAGKGFAVVAQEVRELAQRSATAAKEIKDLIGNSALAVDEGVRLVSETGSGLRTIEELVQDVNLHMDAIATASQEQSSGLREINGAVNHMDHATQENASMVAEMNTAGSHLAQESQSLAALLKHFHFKDESGKPQKVTGELGKSFPPGQTMVDRGDYPMRRGNLVLAPSNDDWQAF

SEQ ID NO: 20574 - DNA, 786 bp, Azotobacter vinelandii
  CDS (1)..(786)
atggagcagattaccgctaccgtgcagcagaacgcagccaatgcgaggcacgccagttccttgtcccatatggccgccgaagaggtccaggccaccggctcggcgatgaagtccgtagtgcagagcatggagcggatcagcagcagttccgggaagatcgccgagatcattcgggtcatcgacagcatcgccttccagaccaacattctcgccctcaacgcctcggtggaggccgcccgggctggcgagcacggccgtggtttcgcggtggtcgccagcgaagtgcgcaacctcgccacccggagtgcggccgcggcgcaagatgtgcatgccctgatcgaagtgtcgagccgcgagattcatgccggcgaacagcatgtcggaaaggccgaggtagccatccggcaggtggtcgaggcggtactcgaggtcgacggcatcatgagcgagatcgccgccgcctcggaggaacagacccgtggcatagagcttgtcaaccaggcggtcgcacagatggacgaagtcacccagcgcaacgccgaactggtccagcagtcggccagggatgccgcgaacctggatacccaggtagccgagctgtccaacgtgatttcggcattgagagtcagcggacggggggtggagcatgtgagtcgccaagatcgcttcgctgcccgtgccgcccggcggcgcagcgagcccgaccgcaggggcggcaaggccaccgtgctcctcgagccggggatcgccgtcgccccgccccgggagcgctgggccgagttctga

SEQ ID NO: 20575 - protein, 261 aa, Azotobacter vinelandii
MEQITATVQQNAANARHASSLSHMAAEEVQATGSAMKSVVQSMERISSSSGKIAEIIRVIDSIAFQTNILALNASVEAARAGEHGRGFAVVASEVRNLATRSAAAAQDVHALIEVSSREIHAGEQHVGKAEVAIRQVVEAVLEVDGIMSEIAAASEEQTRGIELVNQAVAQMDEVTQRNAELVQQSARDAANLDTQVAELSNVISALRVSGRGVEHVSRQDRFAARAARRRSEPDRRGGKATVLLEPGIAVAPPRERWAEF

SEQ ID NO: 20576 - DNA, 1953 bp, Xanthomonas campestris
  CDS (1)..(1953)
atgcagcactacgccgacaaggtgaaggccggcgagctgagcaagcaacaagccatggaagcggcgcgtaccacgctggcggatatgcgcaccaatgacggcgtggattacttcttcatcgtcgacccgcagatgcgcatcctgatgcatcccaagcggccggtcggcacggacatgtccgattacaagagtgacgccgggcagtacgtctaccgcgatatcaagaccgccatcgacagcggcgatggcttcagctactacgacgcgcccaagcccggcaagagagagcagttgcccaagatcagctatgccaaggtgtttccggcctggaactgggtgctggtgatgggcgtgtacgccgaagacatccaggtgcaggcgtggggattcacccgcacgctgacgctgatcggcggcgcgctggtagccatggtgatcggcctgtgctggttgattgcctcggccatggctgcaccgctgcgtgctgcaacgcgcaccgccgaggcgatcgcttcgggccggttcgacaacgacatccgcgtcgagtcgcgcgatgaaaccggccagctgatgcacagcatggcgcagatgcaaacccagctgcagcgcttcaatggcgagatgcagaccatgatccgcctgcagcagggggaaaacatcgcgcaccgcatcccggaagacttccccggcgattacggcagcctggcgcatggcgtgaacacagtggtcttcgagcacctggacgccatcaacgaagcgatggatgtgatgagcgactatggccgcggcgatctgcgccgcgacatgcgccgcctgcccggccagcgcgcagcgctgcatgaggcgctggacacggtgaagaccaatctgtcggcgatcaatggcgatatcgcgcggcttgccgatgccgccgcgcgcggcgatttctccgcacgtggcgaccaggcgcgctatcagttcgccttcgcggaaatggtgcaggcgctcaaccgtttgatgcagcaggccgacgccggcctggacgatgtcggccgcatcatggccgcgatcgccgacggcgatttgtcgcagcgggtggaatcgcattacgaaggtgcgttcgggcgcctggccaatgcggccaaccgcaccgcgatccagctcactactatcgtgcaaggcatccagcagtcggcagagatgatcaacactgcggccggtgagatcgccagcggcaattccgacctgtccacgcgcaccgagcatcaggctgccaacctcgaagaaaccgctgcctccatggaggaactcacctccaccgtgcgccagaacgccgacaacgcgcgccaggccaatcaactggtcaagggcaccggtgacgtagccgaaagcggcggccgcgtggtgcaggaagtggtcagcaccatgctggcgatcacgcaatcgtccgcacgcatttccgacatcatcggggtgatcgacggcatcgctttccagaccaatatccttgcgttgaacgccgcggtggaagccgcacgtgccggcgaacagggccgcgggtttgcggtggtggccagcgaagtacgtgcgttggcgcagcgttcggctggcgcggcaaaggaaatcaagcagctgatttccgactcggtggaaaaggtcgagcaaggctcgggcctggtggaacaggccggcagcacgatgaccgaggtggtgagttcggtgaagcgggtgaccgacatcatggccgagatcaccgccgccagtaccgaacagagcgctggcatcgagcaggtcagcaccacggtgatgcaactggatgaaatgacccagcaaaacgcagcgctggtagaagaagccaccgccgcagcgcgcagcctggaagatcaggccgccgagctgacgcgcgcggtgtcggtgttccgcttggtgccggcacaggccgagcagcggcagcggcacgtacaggccgcctga

SEQ ID NO: 20577 - protein, 650 aa, Xanthomonas campestris
MQHYADKVKAGELSKQQAMEAARTTLADMRTNDGVDYFFIVDPQMRILMHPKRPVGTDMSDYKSDAGQYVYRDIKTAIDSGDGFSYYDAPKPGKREQLPKISYAKVFPAWNWVLVMGVYAEDIQVQAWGFTRTLTLIGGALVAMVIGLCWLIASAMAAPLRAATRTAEAIASGRFDNDIRVESRDETGQLMHSMAQMQTQLQRFNGEMQTMIRLQQGENIAHRIPEDFPGDYGSLAHGVNTVVFEHLDAINEAMDVMSDYGRGDLRRDMRRLPGQRAALHEALDTVKTNLSAINGDIARLADAAARGDFSARGDQARYQFAFAEMVQALNRLMQQADAGLDDVGRIMAAIADGDLSQRVESHYEGAFGRLANAANRTAIQLTTIVQGIQQSAEMINTAAGEIASGNSDLSTRTEHQAANLEETAASMEELTSTVRQNADNARQANQLVKGTGDVAESGGRVVQEVVSTMLAITQSSARISDIIGVIDGIAFQTNILALNAAVEAARAGEQGRGFAVVASEVRALAQRSAGAAKEIKQLISDSVEKVEQGSGLVEQAGSTMTEVVSSVKRVTDIMAEITAASTEQSAGIEQVSTTVMQLDEMTQQNAALVEEATAAARSLEDQAAELTRAVSVFRLVPAQAEQRQRHVQAA

SEQ ID NO: 20578 - DNA, 1869 bp, Xanthomonas campestris
  CDS (1)..(1869)
atgttgcctaccctcgatgccgcacccgcctctcctccgcccaccggccggaacgttgcgcgtgccacctggacagcctggttgccggccgcggcgcaggccgcgttgctgatcctgcttgccgtctacgccgccacggccatgcccggcggcttctggcacaccctgggcacgctgctaccggcattactggtgctcggcgccgccagtgcggggctgtggtggtggtcgcgccggcgcactgccacccagctcgaccaggcagtcaccgccattgccgccatcggcgaaggccgcttccagcgcctggacgcgcgcagcgccagcggcgaactcgcgccgttgctgcgcaccctgcaagccacccaggacaagctcgccctccgcctcgacgtgatggagcaaggcttgcgccacggccagttcgtgatcaaggcgctggacgatctggacaccatgatccgcatcgccgatgacgacggccaggtgctgttcgccaaccgcaaactgctcaagatgctcaagctgatcgagccggacgtgcagagcttccgccccagcttccatgccgaaggtttcgtcggcggcagcatcggcgacatctatccggacagccaggccgccatcgaccgtatgcgtgcgctcaccgcctccaaggccgtgcgtgcgccgttcttcggccgccagatcgacttcgtctacagcccgatcatcgccgccgacggcaccaagctcggcaccatcgcgcagtggatggacgtcaccgcgcaggtcaacgccgagcaggcgctgatcgagatcatcgatgccgctgccgctggcgatttcagccgccgcatgcagatggacggcatggacggcgtgctgctgtcgctggcgcaaggcatcaaccgcatttacgactcggtggaaacgcatctggctgcattggcgcgcgtgatcagcgcgctggccgagggcgacctcacccagcgcgtggatggcgatgcgcatggcattttcgcgcgcctgcgtgacgacaccaaccagaccgtgatccgcctgaccgaaatcatcggcggcatccagaccgcgtcggacaccattcgccgcgctgcggtggaaatcgctgccggcaacaccgatctgtccgaacgcaccgagcaacaggccgcgagcctggaagaaaccgccagctccatggaagaactcacctccaccgtgaagcagaatgccgacagcgcgcagcaggccaacaagctggtgctgggcaccggcgaagtggcgcagaacggtggccaggtgatggacgatgtggtgtccaccatgagccagatcagcactgcctcgcgcaggatcggcgagatcatcggcgtcatcgacggcatcgcgttccagaccaacatcctggcgctcaacgccgcggtggaagcagcgcgcgccggcgaacagggccgcggcttcgcggtggtggcctcggaagtgcgcgccctggcgcgacgttcggccgatgcagccaaggagatcaaatcgttgatcgccgactccaccgacaaggtggaactgggctcgggtctggtgcaccgcgccggcgcgaccatgcgcgagatcgtcggctcggtgaagcacgtcaccgacatcatgagcgagatcacctcggccagcgccgaacagtccagcggcatcgagcaggtgaaccgcaccgtggcgcagctggacgaagtgacccagcgcaacgccgccctggtggaagaagccaccgccgccgcgcgcagcctggaagaacaggcagtggaactggccgatgcggtgtccatcttccgcctgcaatcagacacccgcggtagctcgaacgtggtacgcggcagttttggaagcgcggcggcgtaa

SEQ ID NO: 20579 - protein, 622 aa, Xanthomonas campestris
MLPTLDAAPASPPPTGRNVARATWTAWLPAAAQAALLILLAVYAATAMPGGFWHTLGTLLPALLVLGAASAGLWWWSRRRTATQLDQAVTAIAAIGEGRFQRLDARSASGELAPLLRTLQATQDKLALRLDVMEQGLRHGQFVIKALDDLDTMIRIADDDGQVLFANRKLLKMLKLIEPDVQSFRPSFHAEGFVGGSIGDIYPDSQAAIDRMRALTASKAVRAPFFGRQIDFVYSPIIAADGTKLGTIAQWMDVTAQVNAEQALIEIIDAAAAGDFSRRMQMDGMDGVLLSLAQGINRIYDSVETHLAALARVISALAEGDLTQRVDGDAHGIFARLRDDTNQTVIRLTEIIGGIQTASDTIRRAAVEIAAGNTDLSERTEQQAASLEETASSMEELTSTVKQNADSAQQANKLVLGTGEVAQNGGQVMDDVVSTMSQISTASRRIGEIIGVIDGIAFQTNILALNAAVEAARAGEQGRGFAVVASEVRALARRSADAAKEIKSLIADSTDKVELGSGLVHRAGATMREIVGSVKHVTDIMSEITSASAEQSSGIEQVNRTVAQLDEVTQRNAALVEEATAAARSLEEQAVELADAVSIFRLQSDTRGSSNVVRGSFGSAAA

SEQ ID NO: 20580 - DNA, 1659 bp, Xanthomonas campestris
  CDS (1)..(1659)
atgttaggcaacctcaaaatcggaacccggctgatcgtggcgtttctgatcgtttcggcgatcggcgcttgcattggctgggtggggtactccaactccggccggctcaatgacctgtccaccacgttgtacgagcgcgaattgctgggcttgtccaacgtgaaggaagccaacatcaatctgatctacgccggccgtgcacgcgcaaacctgctgctggccagcagcgcggaagagcgccagtcgcacgtgcagaacatcgacaagtacaccgcaaaagtggtcgattacatgacacgtgcgcgggccagcttcgaaaccgacgagggcaagaccaagctggcgcagtttgatcgcgcctggcagaaatacctggatgagcgcggccgcttcatcgaggccgccaaccgcgaagcactgcgcgaggccaaccccgaattggccgagctgtcacgcgcggtgcgcgccagctcggatgaggtcgataccttgatgaccgacctgagcagcttgcgcgaacgcagcgcggcgtcggcgaacgccgaaaccggtgcaatccacagcagcagttccaaattgctgatggccattatctgcggtggcgtgctgttgggcggggtgctcggtgtcgtgatcagccgcagcgtcaccggcccgatccgccgtgcggtggaagtggcaaacgggctgtccgaaggcgatttgaccatgcgcatcgaggtgcatggtcgcgacgaagccgcgcagctgctcgaggcgatgcgcaccatggtgcagaagctgtcgcaggtggtaggcgaggtcaacaccagtgccgaaaccctggccagcgcctcggaagaagtcagtgccactgcgcagagcatttcgcaggctgccagcgagcaagcggctggcgtggaagaaaccagcgcctcgctggagcagatgaccgcatcgatcagccagaacaccgaaaacgcacgcatcaccgacggcatggccacccaggccgcgaaggagaccattgaaggtggcgaggcggtcgtggccaccacgcaggcgatgaagcagatcgcacagaagatcggcatcatcgacgacatcgcatatcagaccaatctgctggcactcaatgctgccatcgaagctgcacgcgccggcgagcacggcaagggctttgcggtggttgctgccgaagtgcgcaagctggccgaacgcagccaggtggcggcgcaggaaattggtgaggtcgccagttccagcgtcgagctcgccgaccgcgccggccgcttgctggacaccatcgtgcccagcatcaagcgcacctccgatctggtacaggaaatttctgccgcctctgaagaacagtcctccggcgtcagccagatcaactcggcggtagtgcagttgagccagaccacccagcagaatgccagcgcctccgaagaactcgcggccaccgctgaagagatgagcgcgcaggccgagcagctgcagcagagcatggcgttcttccggctaggcgggcaggcgccggccagtacgccgcccaagcgcggcaaggccgtggccgcgcgcgcaacccgcagcagtggcgcacggacctggcgcggcactgccgcaccggcctacgccatgtccgagggcccggacgagggccagttcgcacgattctga

SEQ ID NO: 20581 - protein, 552 aa, Xanthomonas campestris
MLGNLKIGTRLIVAFLIVSAIGACIGWVGYSNSGRLNDLSTTLYERELLGLSNVKEANINLIYAGRARANLLLASSAEERQSHVQNIDKYTAKVVDYMTRARASFETDEGKTKLAQFDRAWQKYLDERGRFIEAANREALREANPELAELSRAVRASSDEVDTLMTDLSSLRERSAASANAETGAIHSSSSKLLMAIICGGVLLGGVLGVVISRSVTGPIRRAVEVANGLSEGDLTMRIEVHGRDEAAQLLEAMRTMVQKLSQVVGEVNTSAETLASASEEVSATAQSISQAASEQAAGVEETSASLEQMTASISQNTENARITDGMATQAAKETIEGGEAVVATTQAMKQIAQKIGIIDDIAYQTNLLALNAAIEAARAGEHGKGFAVVAAEVRKLAERSQVAAQEIGEVASSSVELADRAGRLLDTIVPSIKRTSDLVQEISAASEEQSSGVSQINSAVVQLSQTTQQNASASEELAATAEEMSAQAEQLQQSMAFFRLGGQAPASTPPKRGKAVAARATRSSGARTWRGTAAPAYAMSEGPDEGQFARF

SEQ ID NO: 20582 - DNA, 2040 bp, Xanthomonas campestris
  CDS (1)..(2040)
atggtgatgctcacggtggtgggcatccagcgcgtacgcgcgattgaccaacggctgacgcaaatcaatgacgtcaacagcgtcaagcaacgctacgcgatcaacttccgcggcagtgtgcacgaccgtgccatcgccctgcgcgacgtggtgctgatgaacaccaccgcagaccgccaggctgccgagcatgccatcgacaagctcgccgccgactacgcccgctcggcgcagccgctggatgcattgctggccacctcgtcggaccagaaagagaaggacatcctgcagtcgatcaaggcgatcgagcagcgctccatgccgctgatcgcgcaggtacgctcgctgcgcgatgcgggcgaccgcctgcatgcggaagaagacctgttgaagcaggcgcgcccggccttcatcgactggcttgccagcatcaatgccttcatcgacctgcaggaggccaagaaccgtgaggcggccgaagaagccgtcgccactgcgcgcggcttcgccatgctcatggtggtgtccaccatcgttgccctgctgctgggcgcggccattgccttgctgctgacgcgcagcgtggtgctgccattacgtcaggcgcttgggctcgccgagcgcatcagcgcgggcgatctgagcagccgcgatgtggcggcaggcgcggacgaatccggccagttgctgcgtgcgatgcaacagatgcaggcgcgcctgcaggccgtgatttccgcccagcgcgaaatggccgcgcgccacgacgcgggcgcgatcagttatcgcaccgatgcggagcggtttcccggcgactacgggcacatggtgcaggacaccaatgcgctggtcgatgcgcatgtgcgcacgcagctgcgcatgaccgaggtcatggggcgctacgcggttggtgatcttgcgcaagacatcgagcagtatcccggcgagaaggctgccattaccgccacgatgtcgcaggccaagcagaacctgcacgcaatcaatgcgcagatccaggaactcaccgaggccgcttgcgcgggcaacttcagccgccgcggtcaggccgaccgattcgagcatgcatttgcgcgcatggtggacaacctcaacaccatgatgtcgacctccgacaccaccctgtccaggttctcgtcactgctgcgcgccattgcccagggtgacctgacggttcgcatgcatggcaacttccagggcgtgttcgccctgatgcgcgacgatgccaacagcaccgtggcgcggctcaccgaaatcgttgccggcatccaggagagttccaacaacatcggtttcgccgccgaggacatcaccgccggcaatcaggcgctggccagccgcagcgcgcagcaggccgccaacctcgaagagaccgcagcatcgatggaagagctgacctccaccgtcaagcagaacgccgacaatgcccgccgtgccaatgcgcttgcgctgggcgcggccaccgtggcgtcggaaggccgcgatgtggtcagccaggtggtggagacgatgtcgggtattgaagtctcatccaggcggatcgcagacatcgtgtctgtcatcgatgggattgcgttccagaccaacatcctggccttgaatgccgccgtggaagccgcacgcgccggcgagcaaggccgtggtttcgcggtggtggcatcggaggtgcgcacgctctcgcaccggtcgtcggatgcagcgaaggaaatcaagatcctgatcgcgcattcggtccagcaagtggcggacggtgcggtgctggtgcacaaggcaggcgccacgatgggcggcatcgtggatagcgtgcagcatgtcaccgacatcatgggccagatcgccgcagcgtcgcaggaacaggccagcggcatcgagcaagtgaaccagaccatcacccagatggacgagaccacgcaacagaacgtcgccctggtggaagccgccaacgccgccgcgcgttcgctggagcagcagtccgcgcagctggtgcaggcggttgacgtgttcaaggttgccgcgctgcactga

SEQ ID NO: 20583 - protein, 679 aa, Xanthomonas campestris
MVMLTVVGIQRVRAIDQRLTQINDVNSVKQRYAINFRGSVHDRAIALRDVVLMNTTADRQAAEHAIDKLAADYARSAQPLDALLATSSDQKEKDILQSIKAIEQRSMPLIAQVRSLRDAGDRLHAEEDLLKQARPAFIDWLASINAFIDLQEAKNREAAEEAVATARGFAMLMVVSTIVALLLGAAIALLLTRSVVLPLRQALGLAERISAGDLSSRDVAAGADESGQLLRAMQQMQARLQAVISAQREMAARHDAGAISYRTDAERFPGDYGHMVQDTNALVDAHVRTQLRMTEVMGRYAVGDLAQDIEQYPGEKAAITATMSQAKQNLHAINAQIQELTEAACAGNFSRRGQADRFEHAFARMVDNLNTMMSTSDTTLSRFSSLLRAIAQGDLTVRMHGNFQGVFALMRDDANSTVARLTEIVAGIQESSNNIGFAAEDITAGNQALASRSAQQAANLEETAASMEELTSTVKQNADNARRANALALGAATVASEGRDVVSQVVETMSGIEVSSRRIADIVSVIDGIAFQTNILALNAAVEAARAGEQGRGFAVVASEVRTLSHRSSDAAKEIKILIAHSVQQVADGAVLVHKAGATMGGIVDSVQHVTDIMGQIAAASQEQASGIEQVNQTITQMDETTQQNVALVEAANAAARSLEQQSAQLVQAVDVFKVAALH

SEQ ID NO: 20584 - DNA, 1638 bp, Xanthomonas campestris
  CDS (1)..(1638)
atgatcggcaccggcgtgtacctggacgacacccagtcgcaggcgctggtattcaccggcatcgtggctttcgccggcggtgtgctggtcctggtcaacctgctggtgggctggctgatcggcaactcgatcctggagccggtggcgcgcgcattggccgcgatcaagggcgtggcacgcggcgatttgagcgtgcgcaccgccgagcacggcaacgacgaaatcggccagatgctcaaggccaccgacgacatggtgcacacgctggagcgcttctccgcgcagaccaaggtgatgatgcacaagcatgccggcgaagacatcagccaccgcatgccgaccgattttccgggcgtatacggcgaactggccggtggcatcaacaccatgatcttcgaacacctggatgccatcgtcgctgcggttggcatcctcaacgaatacgcacagggcgatttgtcgcgcgatgccacgcgcctgcccggcacccgcgcggtgctgcacgaagccatggacgcggccaaggccagcctgttggcgatcaacaccgagatcaagcgcctggcgcaggccgcggccaatggcgacttcagccagcgtggcgatgcaacccgcttcaagcacgactccgcgcgcatgatcaacgacctcaacgcgatgatggacgtcagcgaccgcaacctgggcaagctgtccgagctgctggccgcactggccgaaggcgacctcaccgcgcgcatggaaggcgatttccacggcgtgttcgcacgcatgcgtgacgatgccaataccaccgcattgcagttgtcaggcatcgtggggcgtatccagcaggctgcacagtcgatcaccggctcggccagcgagatcgccgccggcaacaacgatctgtcgcagcgcaccgaacagcaggccgccaacctggaagaaaccgctgcctcgatggaggaactcacctccaccgtcaagcagaacgccgaaagcgcccgccaggccaaccagctggccatcggcgcggccggtgtcgcctcgcagggcggccatgtcgtgagccaggtggtggacaccatgtccggcatccagacctcgtcgaagaagatcgccgagatcatcagcgtcatcgacggtatcgcgttccagaccaacatcctggccttgaacgcggcggtggaagcggcgcgcgccggcgaacagggccgtgggtttgcggtcgtcgcctcggaagtgcgcacgcttgcccagcgctcggctggtgcagcgaaagagatcaagcacctcatcgacgattcggtgggcaaggtcacccagggcgcggcactggtcgaccaagccggcaagaccatggccgacatcgtgtcttcggtgcagcgcgtgaccgacatcatgggcgagatctccgccgcctcgcaggaacagtccgccggcatcgagcaggtcaacctcaccatcacccagatggatgagagcacccagcagaacgcggcgctggtggaagaagccaccgctgcggccaatgcgatgcagcagcaggcgcagcagctggacgatgcggtgtcttcgttccgcgtcaccgccaccgtgccgtcgctgcgcgcacgcgccgcacagcacaccgacgccctgctggccagttattga

SEQ ID NO: 20585 - protein, 545 aa, Xanthomonas campestris
MIGTGVYLDDTQSQALVFTGIVAFAGGVLVLVNLLVGWLIGNSILEPVARALAAIKGVARGDLSVRTAEHGNDEIGQMLKATDDMVHTLERFSAQTKVMMHKHAGEDISHRMPTDFPGVYGELAGGINTMIFEHLDAIVAAVGILNEYAQGDLSRDATRLPGTRAVLHEAMDAAKASLLAINTEIKRLAQAAANGDFSQRGDATRFKHDSARMINDLNAMMDVSDRNLGKLSELLAALAEGDLTARMEGDFHGVFARMRDDANTTALQLSGIVGRIQQAAQSITGSASEIAAGNNDLSQRTEQQAANLEETAASMEELTSTVKQNAESARQANQLAIGAAGVASQGGHVVSQVVDTMSGIQTSSKKIAEIISVIDGIAFQTNILALNAAVEAARAGEQGRGFAVVASEVRTLAQRSAGAAKEIKHLIDDSVGKVTQGAALVDQAGKTMADIVSSVQRVTDIMGEISAASQEQSAGIEQVNLTITQMDESTQQNAALVEEATAAANAMQQQAQQLDDAVSSFRVTATVPSLRARAAQHTDALLASY

SEQ ID NO: 20586 - DNA, 2058 bp, Xanthomonas campestris
  CDS (1)..(2058)
atgctggcctcgcgcgacaccgcgcggattggcaagacctttgccgacgcgcgtcatcgcgccgtgctcgatgccatcaaggccggcaaggacgcggtcgatttcgtgcctgatgagaacggcgcggtgagcgcctatgtaccgctgcagatcggccaggcgcaggaacgcttcgcactgggcgtggtggtgccgtacgccacgatcatgcagcaggcgcatcgcctgctgtggacgattctgctggtgggcctgggctcggcactggtgctcagcatcgcgttgtttgcgctgctgcgccgccaggtggtgcgcccgctcgatgccgccgcacgcgtggccgatgccattgcctcgggcaagctggacaaccagatcgccgttcggcgccaggacgaagtgggccgcctgctgagcgccatgcagcgcatgcagagtgatctgcgccagcgcatcgaacgcgacacccagatcgccaacgagaacctgcgcatccgtaccgcgctggagcactcggagatggaagtgctgctggccgacgaacaccacaccgcggtattcatcaccgaggcgctgcacacctccttaaaacacggcgaagccgccttccacgccaagggccagaccggcttcagcgccgatgcggtggtcggccagccgttggagtacgtgttcggcagcgatgccgacagcaaggcgcgcacgcagcgcctgcagcaactcactgccaccgtctccgagcgctacaccttcggcccggtgacgctggacctcaccatgaccccgctgtatgccggcgatggccgccgcagcggcagcatgctgctgtggcgcaatgtcagcgccgaggtaagcgtgcaaaacgaagtggccgccctggtgcagtcggcgttgctgggcgacttcactcagcggttggcgctgcaggacaagcacggcttctatctggaattcggccgccagctcaacgacctggtggacaccactgcgcaagggctggaacgcatctcgcgcctgctcagcgcgctggccgagggcgacctcaccgtgcgcatggatggcgacttccagggcgtgtttgcgcgcatgcgcgacgacgccaatgccaccgtggcccagctcaccggcatcgtttccggcatccagacttcggccacgcagatcaatgcggctgccagcgaaatcgcggctggcaataacgacctgtcgcagcgcaccgaacaacaggcggccaacctggaagaaaccgccgcatcgatggaggagctcacctccaccgtcaagcagaacgccgaaagcgcgcgccaggccaaccagctcgcaatcggcgcggccagcgtcgcctcgcatggcggcgaggtggtggcgcaagtggtcaccaccatgtccggcatcgaagtgtcttcgaagaagatcgccgagatcatcagcgtcatcgacggcatcgcgtttcaaaccaatatcctggcgctgaacgcagcggtagaagccgcgcgtgcgggcgaacagggccgcgggtttgccgtggtcgcctcggaagtgcgtaccctcgcccagcgctcggccggtgcagccaaagagatcaagcacctgatcgacgattcggtgagcaaggtggcgcagggctcctcgctggtgcaccaggccggcaccaccatggccgagatcgtggccagcgtgcagcgcgtcaccgacatcatgggtgagatttccgccgcctcgcaagaacagtctgcggggatcgagcaggtcaacctcaccgtcacccagatggacgaggctacccagcaaaacgccgccctggtggaagaagccactgccgccgcccgtgcgatggaagaacaggccggccagctcagcgatgcggtggccgtgttcaaactgggcactaccgcgacgacgactgcgcctgtttctttgccgcgtcgcgcagcggtctctccggcaacggcggcgcgcgcatcggcatccgtcaagcacgcacgcacacccgcagcagagccggccaaagcgtcagccgcatgccaaagcaacaaggaacagtggcagaacttctga

SEQ ID NO: 20587 - protein, 685 aa, Xanthomonas campestris
MLASRDTARIGKTFADARHRAVLDAIKAGKDAVDFVPDENGAVSAYVPLQIGQAQERFALGVVVPYATIMQQAHRLLWTILLVGLGSALVLSIALFALLRRQVVRPLDAAARVADAIASGKLDNQIAVRRQDEVGRLLSAMQRMQSDLRQRIERDTQIANENLRIRTALEHSEMEVLLADEHHTAVFITEALHTSLKHGEAAFHAKGQTGFSADAVVGQPLEYVFGSDADSKARTQRLQQLTATVSERYTFGPVTLDLTMTPLYAGDGRRSGSMLLWRNVSAEVSVQNEVAALVQSALLGDFTQRLALQDKHGFYLEFGRQLNDLVDTTAQGLERISRLLSALAEGDLTVRMDGDFQGVFARMRDDANATVAQLTGIVSGIQTSATQINAAASEIAAGNNDLSQRTEQQAANLEETAASMEELTSTVKQNAESARQANQLAIGAASVASHGGEVVAQVVTTMSGIEVSSKKIAEIISVIDGIAFQTNILALNAAVEAARAGEQGRGFAVVASEVRTLAQRSAGAAKEIKHLIDDSVSKVAQGSSLVHQAGTTMAEIVASVQRVTDIMGEISAASQEQSAGIEQVNLTVTQMDEATQQNAALVEEATAAARAMEEQAGQLSDAVAVFKLGTTATTTAPVSLPRRAAVSPATAARASASVKHARTPAAEPAKASAACQSNKEQWQNF

SEQ ID NO: 20588 - DNA, 2259 bp, Xanthomonas campestris
  CDS (1)..(2259)
atgaacaagttcaacgattggccgatccgccgcaagctgatgatcgccttctgcctgagtgccgtgctgaccgccctgctgggtggactcggcttttcacgcatgaagcagatgcagcaggaaaccaccctgatcaaccaggacgtggtgcccgtgctcagccggctctccgaactgcgtggcttcgcgggcgaattccgcgtctacgaagtgggccagttcgtcaacctggacgatcccgagcgctatgcgtatttcttcaagcgcatggacgagatccaggccaagtacgccgaaacccagaaggcgctggacgccaagatcggcgccgcctcgccgttgaaggccgaatacgccaagctcgccgatgccagcacgcgctacttcgccgccaacctgaagctgcgtgagctgtatccgcagccggaccgtgcagccgcaatggaattctcgcgcaagcagtccggcgagatccgcaaggaactgtttgcctcggtccacaagatgtacgcgcagcagtccaaggcactcggcgacatggtcaccgccagcgccgcatcgttcaagttcaccagtgcggtgctgctgctcggcacgctgctgatggccgcgctgtcggtcaccttcggttggctgatcgcccgcagcatcaccaccccgctgtccaaggcgctgggcgccatccaggcggtttcgcgtggcgatttgagcgtgcaggtcggcaagaccagcaacgatgaaatcggccagatgctcgaggccaccggccgcatgacccagatgctgcgccgcttctccgacgaaaccgcgcgcatgtcgcacctgcatgctgccgaagacatcacccaccgcatgccggaagatttccccggcgtgtacggcacgctggccggcggcatcaatacgatgatcttcgagcacctcgacgccatcatcgattcggtgcgcatcctcaaccagtacgcccagggcgacctcaccgaagacgcgcgccgcctgcccggcagccgcgccgtgctgcacgaagccatggacgcggccaaggccagcctgctgtcgatcaacaccgaaatcaaacagctggcacaggccgccgcggccggcgacttcagcgcacgtggcgatgtcgcacgcttcaagtacgacttcgcggtgatggtggccgatctgaattcgatgatggaagtcagcgaccgcaacctgggcaagctctcgcagctgctcggcgccgtggccgatggcgacctcactgcgcgcatggatggcgaattccacggcgtgttcgcacgtctgcgcgacgacgccaacgccaccgtgcagcgcctgaccgacatcgtgggccgcatcaagcattccacgctgaccatcaacactgccgccagcgagatcgccgccggtaaccaggacctgtcgcagcgcaccgagcagcaggccgccaacctggaagaaaccgctgcctcgatggaagagctcacctccaccgtcaagcagaacgccgaacacgcccgccaggccaatcagctggcgatcggtgcggccgatgtggcgtcgcatggcggcagcgtggtcggccaggtggtcaccaccatgtccggcatcgaaacctcgtccaagaagatcgccgagatcatcagcgtcatcgacggtatcgcgttccagaccaacatcctggccttgaacgcggcggtggaagcggcgcgtgccggcgaacagggccgcggctttgccgtggtggccagtgaagtgcgcacgctggcacagcgctcggccggtgcggccaaggagatcaagggcttgatcgacgactcggtcagcaaggtggccgaaggctcggcgctggtccaccaggccggcaccaccatgagtgaaattgtctcttcggtgcagcgcgtgaccgacatcatgagcgagatctccgccgcctcgcaggaacagtcggccggcatcgagcaggtcaaccagaccgtgacgcagatggacgaagccacgcagcaaaacgcagcgttggtggaagaagccaccgctgcggcacgttcgatggaagaccaggcacagcagctcaccgaagcggtggcgctgttccgcctgtccagcgaactcgaatcagtgacgcgtgcgacgccggtggtacgtgcacaagccgcagtggcccggcctgctgccaaggccgctgccctcgccaagccgagcaagccggtggtgcgtgccgcgccgcgggcggtgacgacctcgaacgaatcggattgggcggagttttaa

SEQ ID NO: 20589 - protein, 752 aa, Xanthomonas campestris
MNKFNDWPIRRKLMIAFCLSAVLTALLGGLGFSRMKQMQQETTLINQDVVPVLSRLSELRGFAGEFRVYEVGQFVNLDDPERYAYFFKRMDEIQAKYAETQKALDAKIGAASPLKAEYAKLADASTRYFAANLKLRELYPQPDRAAAMEFSRKQSGEIRKELFASVHKMYAQQSKALGDMVTASAASFKFTSAVLLLGTLLMAALSVTFGWLIARSITTPLSKALGAIQAVSRGDLSVQVGKTSNDEIGQMLEATGRMTQMLRRFSDETARMSHLHAAEDITHRMPEDFPGVYGTLAGGINTMIFEHLDAIIDSVRILNQYAQGDLTEDARRLPGSRAVLHEAMDAAKASLLSINTEIKQLAQAAAAGDFSARGDVARFKYDFAVMVADLNSMMEVSDRNLGKLSQLLGAVADGDLTARMDGEFHGVFARLRDDANATVQRLTDIVGRIKHSTLTINTAASEIAAGNQDLSQRTEQQAANLEETAASMEELTSTVKQNAEHARQANQLAIGAADVASHGGSVVGQVVTTMSGIETSSKKIAEIISVIDGIAFQTNILALNAAVEAARAGEQGRGFAVVASEVRTLAQRSAGAAKEIKGLIDDSVSKVAEGSALVHQAGTTMSEIVSSVQRVTDIMSEISAASQEQSAGIEQVNQTVTQMDEATQQNAALVEEATAAARSMEDQAQQLTEAVALFRLSSELESVTRATPVVRAQAAVARPAAKAAALAKPSKPVVRAAPRAVTTSNESDWAEF

SEQ ID NO: 20590 - DNA, 2019 bp, Xanthomonas campestris
  CDS (1)..(2019)
atgcgcgatgacagccaattggtctacaccccctatatcgagagctaccacctggtggtggccaccctgatctacagcccggacgcgaccgagtcgctgacccgcctggatgccgccagcgacccgtcgcaggccggcgaaagcaccaccatgctgcgcgagcagctgggccagctgcaacgcaaccatgcccgcttccgccatgagctggaaaaggcgatgggcttgctggaacaacccgaccccacgctggcagctgcggcgcaggccgaggcaagccaggccaagactgcactcgccgcattgagcgctgccctggacggcaatgatgcccaggccgatgtgcaatggaatgcggcactggatgcggtgggccaagcgatgcagcaactcagcagcgtttcgctgcaggccctgcagcggcaatccgagcgccacctggaggacgcccgcaatgcgatgtggcaagccattgccggcttgtcggtgctggccttgctgatcgccggcctgtgctggtacacgctctccgccctcacccgcaatgtgcggcgcgccgccagcgtggctgcgcagattgcgcgcggccagctggacgagcacatcgtgccgcccagacaggatgaaaccggccagctgctggacaacatgcgcaagatgcaagagcagctgcagcgcgtgctggcagcgcagtcggacatggcgcagcgccacgacgccggccagatcagctaccgcatggacgccgacagcttccccggcgactacggcaccatggtgcgcgacaccaacgccttggtcggctcgcatatcgcagtgaagatgcagctggcgcagatcatgtcgcgctatgccatcggcgatttgagccaggatatgcagcgcctgcccggcgaaaaggccgtgctcaccgacaccatggacacggtaaaagccaacctctcggcgatgaataccgaaatcaacttgctggcgcaggccgcggccaacggcgacttcagcgtgcgtggcgatgcacaacgcttccagtacgacttccgcgccatggtggagagcctcaacaccttgatggccactgccgatggcaacctggaagccttgtctgccgtgttgcgggccatcgccgccggcgacctcaccacgcgcatgcagggcgagttccatggcgtgtttgcacgcatgcgcgacgacgccaacgccacggtgagccagctggccgatatcgtgggccgcatccagcgctccaccgacaccatcaacgatgccgccagcgaaattgcctctggcaatcaggacctgtcgcagcgcaccgagcagcaggccgccaacctggaagaaaccgccgcgtccatggaggaactcacctccaccgtacgcaacaatgccgaccacgcgcgtcacgccaatcagctggtgctgggcgcggcgcaggtggcgtcgcaaggtggcgaggtggtgagccaggtggtcggcaccatggccggcatccaggcagcgtcgaagaagatcgccgacatcatctcggtgatcgacggcatcgccttccagaccaatatcctggccttgaacgccgcggtggaagctgcgcgtgccggcgaacagggccgcggttttgccgtggtcgccagtgaagtgcgcacgctggcgcagcgctcggccggtgcggcgaaggagatcaagcagctgatcgacgattcggtgcagcgggtcgaacacggcaaccagctcgtgggccaggccggccagaccatgcaggagatcgtcagctcggtgcagcgcgtgaccgacatcatgggcgagatctccgctgcttcgcagcagcagtcgcagggtatcgagcaggtaggccagaccatcacccagatggaccaggccacccagcagaacgccgcgctggtggaagaagccaccgccgccgcccgcgcgatggaagaacaggcccagcagctgcgcgatgcggtctcggtgttccggctgcaggccgcaacggcacggccggcgctgaggcgcgcggcctga

SEQ ID NO: 20591 - protein, 672 aa, Xanthomonas campestris
MRDDSQLVYTPYIESYHLVVATLIYSPDATESLTRLDAASDPSQAGESTTMLREQLGQLQRNHARFRHELEKAMGLLEQPDPTLAAAAQAEASQAKTALAALSAALDGNDAQADVQWNAALDAVGQAMQQLSSVSLQALQRQSERHLEDARNAMWQAIAGLSVLALLIAGLCWYTLSALTRNVRRAASVAAQIARGQLDEHIVPPRQDETGQLLDNMRKMQEQLQRVLAAQSDMAQRHDAGQISYRMDADSFPGDYGTMVRDTNALVGSHIAVKMQLAQIMSRYAIGDLSQDMQRLPGEKAVLTDTMDTVKANLSAMNTEINLLAQAAANGDFSVRGDAQRFQYDFRAMVESLNTLMATADGNLEALSAVLRAIAAGDLTTRMQGEFHGVFARMRDDANATVSQLADIVGRIQRSTDTINDAASEIASGNQDLSQRTEQQAANLEETAASMEELTSTVRNNADHARHANQLVLGAAQVASQGGEVVSQVVGTMAGIQAASKKIADIISVIDGIAFQTNILALNAAVEAARAGEQGRGFAVVASEVRTLAQRSAGAAKEIKQLIDDSVQRVEHGNQLVGQAGQTMQEIVSSVQRVTDIMGEISAASQQQSQGIEQVGQTITQMDQATQQNAALVEEATAAARAMEEQAQQLRDAVSVFRLQAATARPALRRAA

SEQ ID NO: 20592 - DNA, 2100 bp, Xanthomonas campestris
  CDS (1)..(2100)
atgcagcacctgcaggacatgaccgacgacacctcggtgattgccgtgcagttgcgcaacctggtactgcccacttcgcaggaagacaatctgcgctttgcggccctgatcaaggaccgtgcaaaggcctacgaacagacccgccagaccttgtacgtgttctcggcatcgcccgaggcccaggcgcggcgcgacaagatcgatgcggccagcgccgctgccgccaaggccaacgcgcaagtggccgaactggggctcgcctccaaatccgacgaagcgctggccatgctgatgcagcaggccgccccggccaccgaagcgtggcagagcgccctggccgagtattcggcactgcagcgcaagcgcgccaagaccgcctatgaagacgccaccgccgcaatggcacgtggccgcgcgatgttgatcggcggcggcattgccgtgctgttgttcagtggcttgctcggctggatgatcacccgcagcctggtgcgcccgctcagccaggccacgctggccgccgaggcgatcgccaacggatcgctcgacaacgatgtgcgcagcaccgccaacgacgaaaccggccgcctgctgcacgccatggaccgcatgcagagccaggtgcgcaacctgatcaccgcacagctcaacatggccaagcgccacgaagaaggccagatcagcttccgcatggatgccgccgcattccccggtgacttcggccgcatggccagcgacaccaacgaattggtggccagccacatcaaggtgaagatgcagaccatccacttggtagagcgctacgccatcggcgacctgagcgaagacatgccgcgcctgcccggcgaaaaggccgccatcaccgcggcgatggaccaggtcaagaccaacctgtccacgatgaaccagcagatcaagcacctggcacaggccgcggccagcggcgacttcaccgcacgcggcgatgccgacaagttccagttcgacttccgcctgatggtgcagagcctcaacaccttgatgtccactgccgacggcaacctgcaatcgctgtccagcctgttgcagtcgatcgccgccggcgacctcaccgcacgcatgaccggccagtaccagggcgtgttcgcacagatgcgcgacgacgccaatgccaccgccgaacagctggccagcatcgtcggccgtatccagcatgccgctgatgcaatcggcctggcttccagcgaaatcgcctcgggcaaccaggatctgtcgcagcgcaccgagcagcaggccgccaatctggaagaaaccgccgcctcgatggaagaactcacttccacggtgaagcagaacgccgagcacgccagccaggccaatcagctcgccatcggcgccgcggccgtggcctcgcaaggtggcgaagtcgtcgccaaggtggtcaccaccatggccgacatccagggctcttcgaagaagattgccgagatcatcagcgtcatcgacggcattgcgttccagaccaatatcctggccttgaatgccgcggtggaagcggcgcgcgccggcgaacaaggccgtggctttgcagtggtggcatcggaagtgcgcaccctcgcccagcgttcggccggtgcggccaaggagatcaagcacctcatcgacgattcggtcagcaaggtcacccagggcgcggcgctggtcgatcaggccggcaccaccatggccgatatcgtggccagcgtgcagcgcgtgaccaacatcatgggcgagatttcctctgcctcgcaggagcagtattcgggcatcgagcaggtcaaccagaccgtgacccagatggacgaaaccacccagcagaacgccgccctggtggaagaagccaccgccgccgcccgcgcgatggaagaacaggcccagcagctcaccgaaacggtggccgtgttcaagctcgccgcgcaggcaccggtggcacgccagctctcggccattgccagcgcaccgggcaatgcccgctccgccgcacgcccggccgcgcgcaccaccgtggcagctgcagcaccgcgaccggtgcgcaccgcacctgccaccactgccgatcagtccgactggcaggagttctaa

SEQ ID NO: 20593 - protein, 699 aa, Xanthomonas campestris
MQHLQDMTDDTSVIAVQLRNLVLPTSQEDNLRFAALIKDRAKAYEQTRQTLYVFSASPEAQARRDKIDAASAAAAKANAQVAELGLASKSDEALAMLMQQAAPATEAWQSALAEYSALQRKRAKTAYEDATAAMARGRAMLIGGGIAVLLFSGLLGWMITRSLVRPLSQATLAAEAIANGSLDNDVRSTANDETGRLLHAMDRMQSQVRNLITAQLNMAKRHEEGQISFRMDAAAFPGDFGRMASDTNELVASHIKVKMQTIHLVERYAIGDLSEDMPRLPGEKAAITAAMDQVKTNLSTMNQQIKHLAQAAASGDFTARGDADKFQFDFRLMVQSLNTLMSTADGNLQSLSSLLQSIAAGDLTARMTGQYQGVFAQMRDDANATAEQLASIVGRIQHAADAIGLASSEIASGNQDLSQRTEQQAANLEETAASMEELTSTVKQNAEHASQANQLAIGAAAVASQGGEVVAKVVTTMADIQGSSKKIAEIISVIDGIAFQTNILALNAAVEAARAGEQGRGFAVVASEVRTLAQRSAGAAKEIKHLIDDSVSKVTQGAALVDQAGTTMADIVASVQRVTNIMGEISSASQEQYSGIEQVNQTVTQMDETTQQNAALVEEATAAARAMEEQAQQLTETVAVFKLAAQAPVARQLSAIASAPGNARSAARPAARTTVAAAAPRPVRTAPATTADQSDWQEF

SEQ ID NO: 20594 - DNA, 1356 bp, Xanthomonas campestris
  CDS (1)..(1356)
atgcagcgcctgctcaaggacgtgcaggagcagttgcgcgcccacctgcccagcttcgatgccgacaaactcatcgacaccagtatcaatcagttccacgccgtcccgaaagaccacgagcgcatgctcgaacagctcagcggcaccaacgtggcgcagatcgcggtcggcgaccgcatcgtgcgtcaggtcgtcagcccggtgttgaatgcggccggcgaacgcatgggtttcgtcgtcgagtgggccgaccgcacccaggaagtgcaggtggaagaagaagtcgcacggatcgtgcaggccgccgctgccggcgatctgagtgagcgggtcggcaccgccggcaagcagggctttttgctgcagctcgcgcagcagctcaacatgttgctggacaacaacgccgatggcctgtcgcgggtgtccgcactgctgtcgtcgctgtcgcagggtgacctcaccgcacgcatggacggcgatctgcaaggcgtgttcgccaccatccgcgacgatgccaacgccactgccgaccagctggccggcatcgtgcgccgtatcaaggactcctcgctggcaatcaactcggccgccaccgagatcgccaccggcaatagcgacctctcgcgccgcaccgaacagcaggccgccgcgctggaagaaaccgcagcctccatggaagaactcaccgccaccgtcaagcagaacgccgacaacgccgaccaggccaaccgcctggtgctgaatgccgcctgcgtggccgcgcaaggtggcgatgtggtcggccgcgtcgtcagcaccatggccgacatcgacgcctcgtccaagaggatcgccgagatcatcagcgtcatcgacggcattgcgttccagaccaacatcctggccttgaacgccgcggtggaagccgcgcgtgctggcgaacagggccgcggctttgctgtggtggcttctgaagtgcgcaccctcgcccagcgttcggccggtgccgccaaggagatcaaacacctcatcgaggattcggtggcgcgcatcggcaacggcgccgcgctggcctcggaagccggcagcaccatgcagcaggtggtcagcagcgtgcagcgcgtgaccgacatcatgggcgagatcaccagcgcctcgcgcgagcaggccgccggcatcacccaggtcaaccagaccgtcacccaaatggacgaaaccacccagcagaacgccgcactggtggaagaagccaccgccgctgcccgctcgatggaagagcaggccgcgcaattggtggacgctgtggccgtgttccggctcgagcaggaagaccgcctgagcacgctgctggccaacgcccgccacgcctatcactaa

SEQ ID NO: 20595 - protein, 451 aa, Xanthomonas campestris
MQRLLKDVQEQLRAHLPSFDADKLIDTSINQFHAVPKDHERMLEQLSGTNVAQIAVGDRIVRQVVSPVLNAAGERMGFVVEWADRTQEVQVEEEVARIVQAAAAGDLSERVGTAGKQGFLLQLAQQLNMLLDNNADGLSRVSALLSSLSQGDLTARMDGDLQGVFATIRDDANATADQLAGIVRRIKDSSLAINSAATEIATGNSDLSRRTEQQAAALEETAASMEELTATVKQNADNADQANRLVLNAACVAAQGGDVVGRVVSTMADIDASSKRIAEIISVIDGIAFQTNILALNAAVEAARAGEQGRGFAVVASEVRTLAQRSAGAAKEIKHLIEDSVARIGNGAALASEAGSTMQQVVSSVQRVTDIMGEITSASREQAAGITQVNQTVTQMDETTQQNAALVEEATAAARSMEEQAAQLVDAVAVFRLEQEDRLSTLLANARHAYH

SEQ ID NO: 20596 - DNA, 2373 bp, Xanthomonas campestris
  CDS (1)..(2373)
atgtcaatgcaatggatcaacaatctgaaactgatgccgcgcctgatgctggcgttcggcatcgtgctgctgatcatgcttattcaggggatcatcgcctactcgggcctggcctcgctcaacgacgtcaccagcgggctggcaggcaacaccatgtccagcgtgcgcgaagccggcgatctgcgcggcatgctcggcgagttccgcaactcgtcctatcagagcctggtgcgcgccagcgattcggtcaagcaggaagccaaggccaacgttggcaagctgcgcaaagacatcgacggtgtgatcaaggactacccacgcctgatcgagagccccgaacagaagaagctgttcgacaccttcgtggcggactggaagaaggcctcggcctcttacgccagtgtcgatgaaatgctcgaactcaatctccccgacgatgccgtggacaccttcgtgggtgaaacgcgcacgttgcacaacaaggccaaggattcactggccgcgttgatcgccgaagacaaccgcctggcgcaggctgccaaggccaaggccgaatcggtgcatgccacctcggtcaccctgaccgtgctggtggtgctgatcggcgtttccggcggcctgggtctggcgttcctgtttgcccgcgccatcgtgcgcagcatgcgcggcgccgtggccactgcctccgaaattgccggcggcaagctcgatggccagatcaatgtgcagggccaggacgaagtgggcgagctgatgcgcgccatgcagcgcatgcagcgtgacctgcgtgagcgcatcgaacgcgaccagcaagtagccaacgaaaacctgcgcatccgtatcgcactggacaagtcctccaccgggctgttcatcaccgataccgagcgcaagctgatctacgccaacgactcgttcaagaagaccgtggcgcattacgaaggcagcatccgtctggcttccagcgacttcgacgcgtccaaggtcatcggccagcacgtgagctacctcggcctgtccgacgccacgctgcgcaaggccatggccgcgctggatcgcgacggcaccaccaccttcgaagaacgcttcggcgaagcggtgttcgcccagaccgtcaccaccatccaggacgaagatggccagtgggtgggcgatgtctgcgaatggcgcgaccgcaccatcgaagtccaggtcgaagacgaagtggcccgcatcgtgcgcgccgccgctgctggtgacatgaccggccgcgtcgataccgacggcaagcagggcttcttcctgcagctggcccagcagctcaacggcttgctggacgccaacgccgccagcatcgagcagatctcggcattgctctcggcgctgtcgcggggcgacctcaccgtgcgtatgcagggcgagttcaagggcgtgtttgcgcagatgcgtgacgatgccaatgccactgccacgcagctggccgacatcgtgggccgcatcaagctctcgtcgacggcaatcaatgcctcggccggcgaaattgcctccggcaaccaggacctgtcgcagcgcaccgagcagcaggccgccaacctggaagaaacagccgcttcgatggaggaactcacctccaccgtgcgtcagaacgccgagagcgcccgccaggccaaccagctggcgatcggtgcaaccggcgtcgcctcgcaaggtggcgaagtggtgtcgcaggtggtcaacaccatgtccggcatcgaagcctcgtccaagaagatcgccgacatcatctcggtcatcgacggcatcgcgttccagaccaatatcctggccttgaacgcagcggtggaagccgcacgtgccggcgaacagggccgcggctttgcggtggtggcttcggaagtacgcacgctggcacagcgttcggccggtgccgccaaggaaatcaagggcctgatcgacgactccgtgcacaaggtggccgaaggctcggcgctggtgcgcaaggccggcagcaccatggccgaaatcgtcgccagcgtgcagcgcgtcaccgacatcatgggtgagatctccgccgcctcgcaggagcagtccgcaggcatcgagcaggtcaaccagaccatcacccagatggacgaaaccacccagcaaaacgccgcgttggtggaagaagccactgctgccgcccgctcgatggaagaacaggccggccacctggccgaagcggtgtcggtgttcaagctggacgcgcctgcagcacccgtccacgcccgcccggcagcctcacgcccggtcgcggtgaagacggctgccaagccggtacgcagcgctgcagctcccgctcgtccggccaaatccgaaaccgccctggcggatggaaactggcaagagttctga

SEQ ID NO: 20597 - protein, 790 aa, Xanthomonas campestris
MSMQWINNLKLMPRLMLAFGIVLLIMLIQGIIAYSGLASLNDVTSGLAGNTMSSVREAGDLRGMLGEFRNSSYQSLVRASDSVKQEAKANVGKLRKDIDGVIKDYPRLIESPEQKKLFDTFVADWKKASASYASVDEMLELNLPDDAVDTFVGETRTLHNKAKDSLAALIAEDNRLAQAAKAKAESVHATSVTLTVLVVLIGVSGGLGLAFLFARAIVRSMRGAVATASEIAGGKLDGQINVQGQDEVGELMRAMQRMQRDLRERIERDQQVANENLRIRIALDKSSTGLFITDTERKLIYANDSFKKTVAHYEGSIRLASSDFDASKVIGQHVSYLGLSDATLRKAMAALDRDGTTTFEERFGEAVFAQTVTTIQDEDGQWVGDVCEWRDRTIEVQVEDEVARIVRAAAAGDMTGRVDTDGKQGFFLQLAQQLNGLLDANAASIEQISALLSALSRGDLTVRMQGEFKGVFAQMRDDANATATQLADIVGRIKLSSTAINASAGEIASGNQDLSQRTEQQAANLEETAASMEELTSTVRQNAESARQANQLAIGATGVASQGGEVVSQVVNTMSGIEASSKKIADIISVIDGIAFQTNILALNAAVEAARAGEQGRGFAVVASEVRTLAQRSAGAAKEIKGLIDDSVHKVAEGSALVRKAGSTMAEIVASVQRVTDIMGEISAASQEQSAGIEQVNQTITQMDETTQQNAALVEEATAAARSMEEQAGHLAEAVSVFKLDAPAAPVHARPAASRPVAVKTAAKPVRSAAAPARPAKSETALADGNWQEF

SEQ ID NO: 20598 - DNA, 1974 bp, Xanthomonas campestris
  CDS (1)..(1974)
atggcgcaggcatcggcgagcgaagaggtcacccgcgatttccgcatgcaggtgcaggaatggaaaaatgtgctgatccgcggccgcgacccggcgcagctggacaagcacttgagtgccttccgcgcgcagggcagcaaggtgcaggccggtaccgaagcgctgaccaagaccctgtcggatgcgcaggcacgcgcgctggcgcaggaattcgccaaggcgcatctgactctgcaggcgcattacgaagccgctttgggcaagttcgccgatgccggctatgacacccaagtgggcgatgcgctggtgaaggggcaggaccgcgcgcccagccaggccctggaggcactggtgacccgcgccaagacgctggccgacgccgcggtgctcgccagtgcccaggcagcgcagcagaagctggtgtatgccggcgtggcgacgattgccgcggcgctgtgcctggtggtggtgctgggttggtggatccgccgctccatcgtgcgcccgatcgaaatcgtggcgcgcgcggcgcgttcggtggcggccggcgatctggccgcacgtgcggtgatcggcaaccgcgatgaaatcggcctgctgggccaggccatgacccaggtggtcagcacgctcgccgatgtttccagcgcgcaggccgacatggcgcagcggcatgaagccggcgaaatgagctaccggatggacgccgacgcattcccgggcgcctacggccgcatggtgggcgacaccaacggcctggtgggtgcgcaggtgggcctgatcggcgacatgttgcaggtgatgcagcattacgcggtgggcgacatgtcggtggacatgccgcgtttgccgggcgaaaaggcgcgcatcaccgaagccatggacaccaccaagcacaacctggccgccatcaacggcgaaatccgcgggctggtcgaggccgcggcagccggcgacttcgccacgcgcggcaatgcgcaggcgtatcagttcgaattccgcggcatggtggacggcctcaatggtttgatgcacaacgtggaccacaacctgggcgagctgtcgcagttgctcaaggccattgccgacggcgacctgaccgcgcgcatgcacggcaaccagcaaggcgtgttcgcgcgcatgcgtgacgatgccaacgccaccgtgcagcggctcaccgacatcgtcggcgacatcacgctggcggcgcagaccatccgcactgcttcggcggaaattgccgccggcaatgccgacctggcccaacgcaccgaacaacaggcagccaacctggaagaaacggccgcctcgatggaggaacttacctcgaccgtgcggcagaacgccgacaccgcgcagcaggccagtcgcggcgcgcaggcggcagccgacatcgccggccgtggcggcgacatggtgggcagcgtggtggagacgatgggcgagatcgaagtgtcgtcaaagaagatcgccgagatcatcagcgtcatcgacggcatcgcgttccagaccaatatcctggccctgaacgccgcggtagaagctgcgcgcgccggcgagcagggccgtggatttgcggtagtggcctcggaagtgcgtgcgctggcgcagcgctcggccggtgccgccaaggaggtcaagcacttgatcgacgcctcggtcgacagcgtcgaacgcggcagtgcacgggtggagcaggccgggcagaccatgcagcagatcgtgcagtcggtgcagcaggtcaccaccttgatcgcggagatttctgcggcgtcgcgcgagcagtcgtccggcatcgaacaggtggcacgcacggtcaacgacatggacgaaaccacccagcgcaacgccgcgctggtggaagaagcctcggccgcggcacgtgcgatggaagaacaggccgtggaactgagcgaagcggtctcggtgttccgcctggatgcacgtcgcccgcgtctggtggcggctgcctga

SEQ ID NO: 20599 - protein, 657 aa, Xanthomonas campestris
MAQASASEEVTRDFRMQVQEWKNVLIRGRDPAQLDKHLSAFRAQGSKVQAGTEALTKTLSDAQARALAQEFAKAHLTLQAHYEAALGKFADAGYDTQVGDALVKGQDRAPSQALEALVTRAKTLADAAVLASAQAAQQKLVYAGVATIAAALCLVVVLGWWIRRSIVRPIEIVARAARSVAAGDLAARAVIGNRDEIGLLGQAMTQVVSTLADVSSAQADMAQRHEAGEMSYRMDADAFPGAYGRMVGDTNGLVGAQVGLIGDMLQVMQHYAVGDMSVDMPRLPGEKARITEAMDTTKHNLAAINGEIRGLVEAAAAGDFATRGNAQAYQFEFRGMVDGLNGLMHNVDHNLGELSQLLKAIADGDLTARMHGNQQGVFARMRDDANATVQRLTDIVGDITLAAQTIRTASAEIAAGNADLAQRTEQQAANLEETAASMEELTSTVRQNADTAQQASRGAQAAADIAGRGGDMVGSVVETMGEIEVSSKKIAEIISVIDGIAFQTNILALNAAVEAARAGEQGRGFAVVASEVRALAQRSAGAAKEVKHLIDASVDSVERGSARVEQAGQTMQQIVQSVQQVTTLIAEISAASREQSSGIEQVARTVNDMDETTQRNAALVEEASAAARAMEEQAVELSEAVSVFRLDARRPRLVAAA

SEQ ID NO: 20600 - DNA, 2133 bp, Xanthomonas axonopodis
  CDS (1)..(2133)
atgatcgcccacctgctcgagagccatgtcatgaaacgcatcctgtcgctaccgttgttctggaaaatcctgatgccggcagcggtggcaatcgtttgcctgtcgggctatgtggctttcagcacgctggtgttccatcgcaacaacgatcgcctggaagcggtgcgcgacgtgcatttcccgatgctcgacgcgatgacgcgcaatgtggccgcgctggacaagctcatcaacgggctcaatggcgcggcggcagcaggcgatgccgacatgctggcggccaccaagccggtggccgacgagatccacggctcttacgtgaaactgcaaaaatccgatccggccaatgcgcaggaactggcccgtctgggcaagcagttcgatcggtactacagcctggcgcagggcgtggcggcggcattcgtggagcaacgcgaacccgatgccgcgcagatgagcgccatggcaccggcgctggagacgtaccgcaccaatctcaccgccatgcagaagcgcgccgatgcacgcttccgcggcaccgtgcaggaagcggtggacagctcggtcaccgccagcatcaccggcctgatcctgggcctggtcggtgcggtggtatgcattggattcggctggctcgtggcgcgcgccatcacccaaccgctcaaccgtgccgtgggcatcgcgcatgcggtgtcgtcgggcaagctggacaacgccatctcgatcgaccgcaacgatgaggtcggacagctgttgcaggcaatggacagcatgcagcgtcagctgcgccgcgtgatccaggcgcagaccgaaatgggcgaaaaacacgaagccggcgtggtcagccaccgtatcgccgaacaggagttcccaggcgaattcggcagcatggtgcgcgccagcaacgcattggtggccgggcatatcgcagtgaccatgcaaatcgtcgcattgaccgagcgctatgctgccggcgatttgtcgcagcagctggagccgttgccgggcgagaaggcggtgatcagccaatcgctcaacgacgtgcgcgccagcctgttgtcgatcaacggcgagatcaagcgcctggcctcggccgcagcggcaggcgacttcaccgcgcgtggcgacgaaaccgcgttcgagcacgacttccgccagatcgtggtggacctcaaccagctgatgagtacctcggaccagagcctgggtgcgttgtcgcaggtgttgcaggccatcgccagcggcgacctgaccgcacgcatgcacggcaacttcgccggcgtgttcgcccgcatgcgcgacgatgccaacaccacggtggaacgtctgaccgatatcgtcgggcgcattcaacattcttcgtcggaaatcgatactgccgccggcgagattgcggccggtaatcaggatctgtcgcggcgcaccgaacaacaggccgccaacctggaagaaaccgctgcatcgatggaagagctcaccgccacggtcaagcaaaacgccgagcacgcacgccaggccaacgaactggcacgtagcgccgccggcgtggcgtcgaagggaggcgaagtggtcagccaggtggtcggtaccatgtcgggtatcgaaacctcttcgaagaagattgccgagatcatcagcgtcatcgacggcatcgccttccagaccaatatcctggcgctcaatgccgcggtggaagccgcgcgtgccggcgaacaaggccgcgggtttgccgtggtggcaagcgaagtgcgctcgctggcacagcgctcctccggcgcggcgaaggagatcaaggatttgatcgacgcctcggtaggcaaggtggccgaaggctcggcgttggtgcacaaggccggcaccaccatgaccgagatcgtggccagcgtgaaccgtgtcaccgacatcatggggcagatcaccgctgcctccatcgaacagtcgagcggcatcgagcaggtcaaccagaccgtgatccagatggacgaaaccacccagcaaaacgccgccctggtggaagaagcgatggccgccgcgcgcgcgatggaaaagcaatccagcaccctcacccagctggtgtcgctgtttcaactggagcctgcgaccgcccagcacctggaaaaacacgtcgcctga

SEQ ID NO: 20601 - protein, 710 aa, Xanthomonas axonopodis
MIAHLLESHVMKRILSLPLFWKILMPAAVAIVCLSGYVAFSTLVFHRNNDRLEAVRDVHFPMLDAMTRNVAALDKLINGLNGAAAAGDADMLAATKPVADEIHGSYVKLQKSDPANAQELARLGKQFDRYYSLAQGVAAAFVEQREPDAAQMSAMAPALETYRTNLTAMQKRADARFRGTVQEAVDSSVTASITGLILGLVGAVVCIGFGWLVARAITQPLNRAVGIAHAVSSGKLDNAISIDRNDEVGQLLQAMDSMQRQLRRVIQAQTEMGEKHEAGVVSHRIAEQEFPGEFGSMVRASNALVAGHIAVTMQIVALTERYAAGDLSQQLEPLPGEKAVISQSLNDVRASLLSINGEIKRLASAAAAGDFTARGDETAFEHDFRQIVVDLNQLMSTSDQSLGALSQVLQAIASGDLTARMHGNFAGVFARMRDDANTTVERLTDIVGRIQHSSSEIDTAAGEIAAGNQDLSRRTEQQAANLEETAASMEELTATVKQNAEHARQANELARSAAGVASKGGEVVSQVVGTMSGIETSSKKIAEIISVIDGIAFQTNILALNAAVEAARAGEQGRGFAVVASEVRSLAQRSSGAAKEIKDLIDASVGKVAEGSALVHKAGTTMTEIVASVNRVTDIMGQITAASIEQSSGIEQVNQTVIQMDETTQQNAALVEEAMAAARAMEKQSSTLTQLVSLFQLEPATAQHLEKHVA

SEQ ID NO: 20602 - DNA, 1911 bp, Xanthomonas axonopodis
  CDS (1)..(1911)
atgccgctcccccttctcagatcacccagctggactcagcctatgtcgcttgcacacgatgccgcccccgtcgtccaaccgcccgccggtcggcacgttgcgcgcgccacctggactgcatggctgcccgctgctgcgcatatcggggtgctggcattgctcgcctgctacgccgccacgctggtacccggcggcttcctgagcgggctcggacgcctgctgcccgccctgttggtgctgggcgcggcaagcgccgggctctggtggtggtcgcgccgtcgtcacgacacgcagttgcagcaggcaatgcgtgcggtggtggcgatcggcgacggacgcacccagcgtctggacctgcgcaacgcctccggcgacctcgcaccgttgctgcacgcgctgcaggatgcccaggacaagctcgccatccgcatcgatgtgatggagcaaggcctgcgccatggccagttcgtgatcaaggcgctggacgatctggacaccatgatccgcatcgccgacgacgatggccaggtgctgttcgccaaccgcaaattgctcgccatgctcaagctgatcgagccggatgtgcagagcttccgtcccagcttccatgccgaaggcttcgtcggcggcagcatcggcgacatctatcccgacagccaggccgcgatcgaccgcatgcgcgcgttgaatgcctccaaggccgtgcgtgcgccgttcttcggccgccagatcgacttcgtctacagcccgatcatcgccgccgacggcaccaagctcggcaccatcgcgcagtggatggacgtcaccgcgcaggtcaacgccgagcaggcactgatccagatcatcgacgccgcctccgccggcgatttcagccgccgcatgcagatcgacggcatggacggtgtgctgctgaccctggcgcaaggcatcaaccgcatctacgactcggtggaaacccatctggccgcattggcgcgcgtgatcggtgcactggccgaaggcgacctcacccagcgcgtggacggcgatgcgcacggtatcttcgcgcgcttgcgcgacgacaccaaccagaccgttacccgcctcaccgagatcatcggcggcatccaggccgcatcggacaccatccgccaggccgcggtggaaatcgccgccggcaacatggatctttccgagcgcaccgagcaacaggcggccaatctggaagaaaccgcaagctcgatggaagagctcacctccaccgtgaagcagaacgccgagagcgcgctgcaggccaatcgcctggtcgtcggcaccggcgacgtggcgcagagcggcgggcaggtgatggacgaggtggtcgccaccatgggccagatcagcaccgcctcgcgcaagatcggcgagatcatcggtgtgatcgacggcatcgcgttccagaccaacatcctggcgctcaacgccgcggtggaagccgcgcgtgccggcgaacagggccgcggctttgcggtggttgcctcggaagtgcgcgcactggcgcggcgctctgccgatgcggccaaggagatcaagacgctcatcgccgactccaccgacaaggtggagctgggttcgggcctggtgcaccgcgccggcgcgaccatgcgcgagatcgtcggctcggtcaaacacgtcaccgacatcatgagcgagatcacctcggccagcgccgagcagtccagcgggatcgagcaggtcaaccgcacggtcgcgcagttggatgaagtgacccaacgcaacgccgcgctggtggaagaagccaccgccgccgcgcgcagcctggaagaacaggcggtggaactggccgatgcggtctcgatcttccgcctgcagtccgacgcccgccccggcgcctccaacatcgcgcgcgccagcttccacaacgcggcataa

SEQ ID NO: 20603 - protein, 636 aa, Xanthomonas axonopodis
MPLPLLRSPSWTQPMSLAHDAAPVVQPPAGRHVARATWTAWLPAAAHIGVLALLACYAATLVPGGFLSGLGRLLPALLVLGAASAGLWWWSRRRHDTQLQQAMRAVVAIGDGRTQRLDLRNASGDLAPLLHALQDAQDKLAIRIDVMEQGLRHGQFVIKALDDLDTMIRIADDDGQVLFANRKLLAMLKLIEPDVQSFRPSFHAEGFVGGSIGDIYPDSQAAIDRMRALNASKAVRAPFFGRQIDFVYSPIIAADGTKLGTIAQWMDVTAQVNAEQALIQIIDAASAGDFSRRMQIDGMDGVLLTLAQGINRIYDSVETHLAALARVIGALAEGDLTQRVDGDAHGIFARLRDDTNQTVTRLTEIIGGIQAASDTIRQAAVEIAAGNMDLSERTEQQAANLEETASSMEELTSTVKQNAESALQANRLVVGTGDVAQSGGQVMDEVVATMGQISTASRKIGEIIGVIDGIAFQTNILALNAAVEAARAGEQGRGFAVVASEVRALARRSADAAKEIKTLIADSTDKVELGSGLVHRAGATMREIVGSVKHVTDIMSEITSASAEQSSGIEQVNRTVAQLDEVTQRNAALVEEATAAARSLEEQAVELADAVSIFRLQSDARPGASNIARASFHNAA

SEQ ID NO: 20604 - DNA, 1992 bp, Xanthomonas axonopodis
  CDS (1)..(1992)
atgctcgatgccaacaccaacgtggcgatcggcttgcgcgacgtggtgatggtctccggcgatgcggccaaccggcgcgcactggacatgatcgaaaagagtcgtgcgcgctacaagcaggcccacgatgccttggctgcgatgccgagcagcgaactcgagaaaaaagcgctaacgctggtgcaggaaaagcgcgacgtctcggtcaagttcaacaaccagatcctcgactacggcatacgcgaccagaatcagcaagcgcaagccttgttgcaaggtgctgccgctgcggcgatggacgagcaacaagccgcgattgctgcaaatgctgccttagagcgccgcctcagcaaagatgcttacgcggcagccgttgcatcgatgcataacggcaagatcatcctggccagcggcggcattgctgcgctggcgatcagtgcgctgctcgcatggttgattacgcgcagcctgaccaggccgttgagccaggccacgcgcactgccgaagccattgccgcaggcgatctgcgcaacgatgtgcacaccaccgcaacggatgaaacaggtcgcctgttgcaggccatggacaagatgcaactgcagctgcgcaacctcatcgcggcgcagaccgacatggccaagcatcatgacaacggccagatcagcttccgcatcgacgcaaccgtcttcccgggcgactacggccgcatggccaacgacaccaatgcgttggtggcctcgcacgtggccgtgcaaaacgatctggcgcgcatcatggggcgctatgccatcggcgaactctccgaagacatgcagcccttgccgggcgaaaaggccgccttcagcaacaccatgtcgcaggtcaagctcaacctgtcggcaatgaatcaccagatcaagcaccttgcacaggccgccgccaatggcgacttcagtgcccgcggcgatgtcgagcgcttccagttcgacttccgcgtcatggtggagagcctgaaccagttgatgtccaccgcggacggcaatctgcaatcgctgtcggcactgctgcagtcgatcgcagccggcgacctcaccgcacgcatgagcggcgacttccgcggcgtgttcgcacagatgcgcgatgacgccaatgcgacagcgagccagctggcgcagatcgtcggcaacatccagcagtcggcagtgtcgatcaacgcggctgccaccgagatcgccgcgggcaatcaggatctgtcgcagcggaccgagcagcaggcggccaacctggaagagaccgccgcctcgatggaagagctgacctccaccgtcaagcagaatgccgagagtgcgcgccaggccaatcaactggcgatcggcgccgcacgcgtggcctcggagggtggcaatgtggttggtaaggtcgtggacacgatgagtggtatcgaagcctcgtccaagaagatcgccgacatcatctccgtcatcgacggcattgccttccagaccaacatcctggcgctgaacgccgcggtggaagctgcccgtgcaggcgaacaaggtcgtggctttgcggttgtcgcctcggaagtgcgcacgctggcgcagcgttcctccggcgcagcgaaagagatcaaggacctgatcgacgattccgttcaacgcgtggccgaaggctcggcactggtgcacagcgccggcaagaccatgggcgaggtcgtggccagcgtccagcgcgtcaccgatatcatgggcgagatttcggcggcctcgcaggagcaatctgccggcatcgaacaggtcaatcaaaccatcacgcacatggacgaaaccacgcaacagaatgcggcgctggtggaagaagccactgccgccgcccgctccatggaagaacaagccgtgcagctcaccgacgcggtcgccatcttcaagatcgatgcaaggcaggtacgccgggcagacacgcgcgccaccgcaccggtcgcgcatctgttgaacaaggttcgccacgcctga

SEQ ID NO: 20605 - protein, 663 aa, Xanthomonas axonopodis
MLDANTNVAIGLRDVVMVSGDAANRRALDMIEKSRARYKQAHDALAAMPSSELEKKALTLVQEKRDVSVKFNNQILDYGIRDQNQQAQALLQGAAAAAMDEQQAAIAANAALERRLSKDAYAAAVASMHNGKIILASGGIAALAISALLAWLITRSLTRPLSQATRTAEAIAAGDLRNDVHTTATDETGRLLQAMDKMQLQLRNLIAAQTDMAKHHDNGQISFRIDATVFPGDYGRMANDTNALVASHVAVQNDLARIMGRYAIGELSEDMQPLPGEKAAFSNTMSQVKLNLSAMNHQIKHLAQAAANGDFSARGDVERFQFDFRVMVESLNQLMSTADGNLQSLSALLQSIAAGDLTARMSGDFRGVFAQMRDDANATASQLAQIVGNIQQSAVSINAAATEIAAGNQDLSQRTEQQAANLEETAASMEELTSTVKQNAESARQANQLAIGAARVASEGGNVVGKVVDTMSGIEASSKKIADIISVIDGIAFQTNILALNAAVEAARAGEQGRGFAVVASEVRTLAQRSSGAAKEIKDLIDDSVQRVAEGSALVHSAGKTMGEVVASVQRVTDIMGEISAASQEQSAGIEQVNQTITHMDETTQQNAALVEEATAAARSMEEQAVQLTDAVAIFKIDARQVRRADTRATAPVAHLLNKVRHA

SEQ ID NO: 20606 - DNA, 2001 bp, Xanthomonas axonopodis
  CDS (1)..(2001)
atgctggtctgggcaatccgtatcgccagcgcgtcgctggagatggccaccaccacgctggacgcgttctcgcgcggcaacttcgacgtggcgctgccgcaagggcgcgacgaccaggccagcgatgtcctgcgcgggctgcgcaaggtgcagagcggcatccgccacgtcaacgaggaaatcaaccgcgtttcgcgcgaacacgatgccggcgagatcgatgcgcgcatcgatgtggcgcgcttcgatggcgatttccgcaccatgggcgatggcatcaaccgcatggtggccagccatatcgcggtgaaaaaacaggcgatggcgtgcgtggccgagttcggtcgcggcaatttttccgccgaactggaacggttgccgggcaagaaggccttcatcaacgagatcgtcgaccagatccgcggcaacctcaccggcatggtcgccgaggtcaaccgcatgtcggccgagcacgatgccggcgatatcgacgtggtcatcgacacccagcgcttcaccggcgatttccgtcgcatggccgagggcatcaacgcgatggtggccagccatatcgcggtcaagaagcaggccatcgcctgcgtcagcgaattcggccgcggcaacttcaccgcacagctgccgttgctgccgggcaagaagcgcttcatcaacgacaccatcgaacaggtgcgcggcaacctcaccggcctgatcgccgagatcaaccacatgtcggccgaacatgaagccggcgatatcgacgtggtcatcgacagcagccgcttcgatggcgacttccgcagcatggcgctgggcatcaaccagatggtgggcgcgcatatcgcggtcaagaaactggcgatgggcgtggtggccgaattcggccgcggcaacttcgatgcaccgctggcgcagctgccgggcaagaaggccttcatcaacgacaccgtggagcgcgcgcgcggcaatctgcgcagcatttccgaagtgatccaggtcatgggcgcgatggccgaaggcgacctcacccacaccgtggaaggccgttacgaaggcgcattcgccgacatgcagcgctatgtcaacaccaccatgagccgcctgaccgagatcgtcgatgaggtcaaccgcaacgccgaaaacctggccagtgcgtcggaagaggtcagcgccaccgcgcaggcgctggcccaggccgccagcgaacaggcggccggcgtggaagaaaccagcgcctcgctggagcagatgaccgcctccatcgcacagaacaccgaaaacgcgcgcgtcaccgacagcatggcggccaaggcggccagcgaagcggccgacggcggcgacaccgtgcgcgccaccgtggtggcgatgaaggagatcgccaagaagatcggcatcatcgacgacatcgcctatcagaccaacctgctggcgctcaatgccgccatcgaagccgcgcgcgccggcgaacacggcaagggctttgcggtggtggccgccgaagtgcgcaagctggccgaacgcagccagatcgctgcgcaggaaatcggcgaagtggccgaatccagcgtggaactggccgaaagcgccggccgcgtacttggcgagatggtgccttcgatccgccgcacctccgacctggtgcaggaaatcgccgccgcttccgaagaacagaccgccggcgtcagccagatcaataccgccgtgggccagttgaaccagaccacccaatcggccgccgccaatgccgaagaactggccgccacctcggaagagatgagcgcacaggccgaacagctgcagcagctgatgggcttcttccggctgggcaacggcggccgcggcgccgtgtcgggcagcagcaggcagggaccgcgcaggatcgcagcgcatgcgcctgccatcgtgagcagcgcgccgccgcgacgcaccaatgtgcgccagatcagtgcggtggccgccaccgccgatgcgatcgacgaatcgcaattcgccagcttctga

SEQ ID NO: 20607 - protein, 666 aa, Xanthomonas axonopodis
MLVWAIRIASASLEMATTTLDAFSRGNFDVALPQGRDDQASDVLRGLRKVQSGIRHVNEEINRVSREHDAGEIDARIDVARFDGDFRTMGDGINRMVASHIAVKKQAMACVAEFGRGNFSAELERLPGKKAFINEIVDQIRGNLTGMVAEVNRMSAEHDAGDIDVVIDTQRFTGDFRRMAEGINAMVASHIAVKKQAIACVSEFGRGNFTAQLPLLPGKKRFINDTIEQVRGNLTGLIAEINHMSAEHEAGDIDVVIDSSRFDGDFRSMALGINQMVGAHIAVKKLAMGVVAEFGRGNFDAPLAQLPGKKAFINDTVERARGNLRSISEVIQVMGAMAEGDLTHTVEGRYEGAFADMQRYVNTTMSRLTEIVDEVNRNAENLASASEEVSATAQALAQAASEQAAGVEETSASLEQMTASIAQNTENARVTDSMAAKAASEAADGGDTVRATVVAMKEIAKKIGIIDDIAYQTNLLALNAAIEAARAGEHGKGFAVVAAEVRKLAERSQIAAQEIGEVAESSVELAESAGRVLGEMVPSIRRTSDLVQEIAAASEEQTAGVSQINTAVGQLNQTTQSAAANAEELAATSEEMSAQAEQLQQLMGFFRLGNGGRGAVSGSSRQGPRRIAAHAPAIVSSAPPRRTNVRQISAVAATADAIDESQFASF

SEQ ID NO: 20608 - DNA, 2112 bp, Xanthomonas axonopodis
  CDS (1)..(2112)
atgcgcgcattgctcggcgaattccgcacctacgaactcgctcagctggcgcacgccgacgatccgaaggcggtgcagaattatttcgaacgcatggacaaggcgcgcgccgacgtcgcgacggcgcaggacgcctacgccaagaccaccacggcaggtagagagaccgagttgtacgacgaggtcaaactgaaactgtccgattactacaaggccaatgctgcgctcagcgccgcggtgcgtgccggcgatctggtcactgccaatcgcgtttccgacgagcaatcgcgtccggcgcggcgcgacctgttcgcaaaattggtggagctgaccaagttcaacgttgcccacatggacagcgagatcgcgcaggccgaggcaacctaccggcgttcggtgcacgtcatgctcgtggcgatggcgctgttcgtgctgctggctgcattttccggttggttcatcgcccgcagcatcgccggcccgctcggtcgcgccacgcgggtggccagtgccatcgcacagggcaaactggataacgccatccacgtcgacagccgcgacgaagccgggcaactgctgcacagcatggaaggcatgcagcggcaactgcaggccgtgctcgcagcgcaatcggaaatggccaagcgccacgatgccggccaaatcagctatcgcatggaacacgatgcgtttccaggcgactacggcaccatggtgcgcgacaccaacagcctggtcggctcgcatatcgcagtcaagatgaaactcgcgcagatcatgtcgcactatgcgatcggcgacttcagtcaggacatggaccgcctgcccggggagaaggccgtgctcagttccaccatggataccgtcaaggccaacctgtcggcgatgaacggcgagatcaagctgttggcgcaggccgccgccaacggcgacttcagcgtgcgcggcgacacgcagcgcttccagtacgatttccaggcgatggtggagagcctcaaccagctgatggcgaccgccgatgccaacctcggctcgctgtcgaagctgttgcaggccatcgccgcgggcgatctcaccgagcgcatgcaaggccagttcaatggcgtgttcgcccagatgcgcgacgatgccaatgccaccacggcgcaacttgccgatatcgttgggcgcatccagcacgccaccctgtcgatcaataccgcggccagcgagatcgcggccggcaacaacgatctgtcgcagcgcaccgagcagcaggccgccaacctggaagaaaccgccgcatcgatggaggaactcacctccaccgtacgccagaacgccgagcatgcgcgccaggccaaccaactcgccatcggtgcggccacggttgcctcgcaaggcggcagcgtggtgtcgcaggtggtgaccacgatgtccggcatcgaggtgtcgtcgaagaagatcgccgacatcatcagcgtgatcgacggcatcgccttccagaccaacatcctggccttgaacgctgcggtggaagcggcgcgtgccggcgaacagggccgtggtttcgccgtggttgcctcggaagtgcgcacgctcgcccagcgttcggccaatgcagccaaggagatcaagcacctcatcgacgattcggtgagcaaggtcgccgaaggctcggtcctggtggatcgggccggcaagaccatggccgacatcgtcgccagcgtgcagcgcgtcaccgacatcatgggcgagatttctgccgcctcgcaggaacagtcggccgggatcgagcaggtcaacctcaccgtgacgcagatggacgaagccacccagcagaacgccgcgctggtggaagaagccaccgccgcggcacgtgcgatggaagagcaagccggtcagctgtccgatgcggtgtcgatcttcaaggtccagcaggtcgccgccgtggcgcctgcggccaagcgccctgcgccgctgcgcctggccgccgcaaagccaggcgctaccaaaccgaccacgaccaagcgcgcacccgcaccggccggtgtcgcggccaaagccacagccacgccacgcccggtggctgccacagctggcaacagcgagtcggactggcaggagttctaa

SEQ ID NO: 20609 - protein, 703 aa, Xanthomonas axonopodis
MRALLGEFRTYELAQLAHADDPKAVQNYFERMDKARADVATAQDAYAKTTTAGRETELYDEVKLKLSDYYKANAALSAAVRAGDLVTANRVSDEQSRPARRDLFAKLVELTKFNVAHMDSEIAQAEATYRRSVHVMLVAMALFVLLAAFSGWFIARSIAGPLGRATRVASAIAQGKLDNAIHVDSRDEAGQLLHSMEGMQRQLQAVLAAQSEMAKRHDAGQISYRMEHDAFPGDYGTMVRDTNSLVGSHIAVKMKLAQIMSHYAIGDFSQDMDRLPGEKAVLSSTMDTVKANLSAMNGEIKLLAQAAANGDFSVRGDTQRFQYDFQAMVESLNQLMATADANLGSLSKLLQAIAAGDLTERMQGQFNGVFAQMRDDANATTAQLADIVGRIQHATLSINTAASEIAAGNNDLSQRTEQQAANLEETAASMEELTSTVRQNAEHARQANQLAIGAATVASQGGSVVSQVVTTMSGIEVSSKKIADIISVIDGIAFQTNILALNAAVEAARAGEQGRGFAVVASEVRTLAQRSANAAKEIKHLIDDSVSKVAEGSVLVDRAGKTMADIVASVQRVTDIMGEISAASQEQSAGIEQVNLTVTQMDEATQQNAALVEEATAAARAMEEQAGQLSDAVSIFKVQQVAAVAPAAKRPAPLRLAAAKPGATKPTTTKRAPAPAGVAAKATATPRPVAATAGNSESDWQEF

SEQ ID NO: 20610 - DNA, 1989 bp, Xanthomonas axonopodis
  CDS (1)..(1989)
atggtcaatggctacgccgagcgcgccgaaaagggcgagatcgacgtggagaccgccaagaaaagtgcgctgcataccctgtcgaccatgcgcgcacgtggcggtgtggattacatctacgtcaccgaccagacgccgacgatgctgatgcaccccacccggcccgacctggtcggcaagccgttgagcgatgtgctcagcccggacggcaagcgcgtgtttccggcgttcgtcaccgcagcgcaggccggcggcggctatgtcgattacacctgggccaagccagggcagaaggatccggtgcagaaaacctcgtacgcggcgctgtacaagccgtggggctgggtgatcggcaccggcgtgtacctggacgacactcaatcgcaggcgctggttttcaccggcatcgttgcgatcgccggaggcgccttggtgctgatcaatctgctggtgggctggatgatcggcaactccatcctggagccggtgtcgcgggccctggcagccatcaagggtgtggcgcgcggcgacctgagcgtgcgtaccgccgaacacggcaccgatgaaatcggccagatgctcaaggcgaccgatgagatggttcacaccttggagcgcttctccgcgcagaccaaggtgatggtgcacatgcatgccggcgacgatgtcacccaccgcatgccgaccgatttcccgggcgtctacggcgagctggccaccggcatcaacacgatgatcttcgagcacctggatgccatcgtcgatgcgatcggcatcctcaacgagtatgcgcaaggcgacctgtcgcgcaatgccgcgcgcctgcccggcacgcgcgcggtgctgcatgaagcgatggacgcagccaaggccagcctgctggcgatcaacaccgagatcaaacgcctggcccaggccgcggccaacggcgacttcagtcagcgcggcgatgcgacgcgcttcaagcacgactcggcgcgcatgatcaacgacctcaacgcgatgatggaggtcagcgaccgcaacctgggcaagctgtccgagctgctggcgtccctggccgaaggtgacctcaccgcgcgcctggacggccagtaccatggcgtgttcgcgcgcatgcgcgacgacgccaacgccacggccacccagctggccggcatcgtggggcgcatccagcaggccgccagttccatcaccggctcggccagcgaaatcgccgccggcaacaacgatctgtcgcagcgcaccgaacagcaggccgccagtctggaagaaaccgccgcctcgatggaggagctcacttccaccgtcaagcagaatgccgaaagcgcgcgtcaggccaaccagttggcgatcggcgccgccagcgtggcctcgcagggcggccaggtggtgagccaggtggtggacaccatgtccggcatccagacctcgtccaggaagatcgccgagatcatcagcgtcatcgacggcatcgccttccagaccaatatcctggcgttgaatgctgcggtggaagccgcacgtgccggcgaacaaggccgcggattcgcggtggtcgcctcggaagtacgcacgctggcccagcgttcggccagtgcggccaaggagatcaagcacctcatcgacgattcggtgggcaaggtttccgagggctcgctgctggtggatcaggccggcaagaccatggccgagatcgtctcttcggtgcagcgcgtcaccgacatcatgagcgaaatttctgccgcctcgcaggaacagtcggccgggatcgaacaggtcaacctcaccgtcacccagatggacgagagcacccagcagaacgcggcgttggtggaagaagccaccgccgcggccaatgccatgcaacagcaggcgcagcagctggatgaagcggtgtccagcttccggatcgtcgctgccgcctccaaccaattcggccatgcaggcgcacgcgcgccgacgcgggttgcgctggccgcccactga

SEQ ID NO: 20611 - protein, 662 aa, Xanthomonas axonopodis
MVNGYAERAEKGEIDVETAKKSALHTLSTMRARGGVDYIYVTDQTPTMLMHPTRPDLVGKPLSDVLSPDGKRVFPAFVTAAQAGGGYVDYTWAKPGQKDPVQKTSYAALYKPWGWVIGTGVYLDDTQSQALVFTGIVAIAGGALVLINLLVGWMIGNSILEPVSRALAAIKGVARGDLSVRTAEHGTDEIGQMLKATDEMVHTLERFSAQTKVMVHMHAGDDVTHRMPTDFPGVYGELATGINTMIFEHLDAIVDAIGILNEYAQGDLSRNAARLPGTRAVLHEAMDAAKASLLAINTEIKRLAQAAANGDFSQRGDATRFKHDSARMINDLNAMMEVSDRNLGKLSELLASLAEGDLTARLDGQYHGVFARMRDDANATATQLAGIVGRIQQAASSITGSASEIAAGNNDLSQRTEQQAASLEETAASMEELTSTVKQNAESARQANQLAIGAASVASQGGQVVSQVVDTMSGIQTSSRKIAEIISVIDGIAFQTNILALNAAVEAARAGEQGRGFAVVASEVRTLAQRSASAAKEIKHLIDDSVGKVSEGSLLVDQAGKTMAEIVSSVQRVTDIMSEISAASQEQSAGIEQVNLTVTQMDESTQQNAALVEEATAAANAMQQQAQQLDEAVSSFRIVAAASNQFGHAGARAPTRVALAAH

SEQ ID NO: 20612 - DNA, 2061 bp, Xanthomonas axonopodis
  CDS (1)..(2061)
atggtgctggcatcgcacgacaccacgcgtataggcaagcaggtcaccgacgcacgccaccgcaccatgctggaggcgatcaaggccggcaaggacgcgttggatttcacccccgatgcagacggcgcagtcagcgcctacgttccgctacagatcggcaaggcgcaggagcgcttcgcgctgggcgtggtggtgccgtatgccacgatcatgcagcaggcgcatcacctgctgtggaccatccttgccgtcggccttggttcggcgctggtgctcagcgtggcgctgttcgcgctgctgcgtcgccaggtggtgcggccgctggaggccgccgcgcacgtggccgatgcgatcgcctcgggcaagctcgacaaccagatcaccgtgcagcgccaggacgaagtgggccgcctgatgggcgccatgcaacgcatgcagagcgacctgcgcgagcgcatcgagcgcgatgcgcaggtcgccaacgaaaacctgcgcatccgcaccgcactggaacactcggaaatggaagtgttgctggccgacgaacagcacaacgcggtgttcatcacccaagcgctgcacacctcgttcaagcagggcgagcccgccttccatgccaagggccagaccggcttcagtgccgatgcggtggtcggcaagccgatggactacgtgttcggcaacgacagcgaaggcaccgcgcgcacgcagcgcctgcgtcagctgcagtccaccagcaccgaacgctatcgcttcgggccggtgacactggatctgaccatgaccccgctgtacgcccccgatggccgccgcagcggcagcatgctgctgtggcgcaatatcagtgccgaagtcagcacgcagcaggaagtggccgaactggtgcagtccgccttgatgggcgatttcggccagcgcctggcgctggaagacaagcacgggttctacctggaattcggccgccagctcaatggcctgctggaaaccacctcgctgagcctggaacggatttccagcctgctcagtgcgctggccgaaggcgacctcaccgtacgcatggacggcgatttccagggcgtgttcgcccgcatgcgcgacgatgccaacgccacggtggcgcagctcaccggcattgtctccggcatccagacctcggccacgcagatcagcgcagccgccagcgaaattgctgccggcaacaacgatctctcccagcgcaccgaacaacaggccgccaatctggaagaaaccgcagcctcgatggaggaactcacctccaccgtcaaacagaatgccgagcacgcgcgtcaggccaaccagctggccatcggcgcggccgacgtggcatcgcacggcggttcggtggtggcgcaggtcgtcaccacgatgtcgggcatcgagacctcgtccaagaaaatcgccgagatcatcagcgtcatcgatggcatcgcattccagaccaatatcctggccttgaatgccgccgtggaagcggcgcgtgccggcgaacagggccgcggctttgccgtggtcgcttcggaagtgcgcacgctggcgcaacgttcggctggtgctgcaaaggagatcaagcacctgatcgacgattcggtgagcaaggtggaacaaggcgcgtcgctggtgcatcaggccggcaccaccatgagcgagatcgtggccagcgtgcagcgcgtcaccgacatcatgggcgaaatctccgccgcgtcgcaggaacaatcgtccggcatcgagcaggtcaacctcaccgtgacgcagatggatgaagccacgcagcaaaatgccgcgctggtggaagaagccactgccgcagcgcgtgcgatggaagaacaggctggccagctgaccgaggcggtggcggtcttcaggctcaaccatgcagtcaaaccggtgttggctgcgcccactggcacaccagcggtgcgcgcggtggccaccaccaagccggcacctgcccgcggcaagcgcgcagcgacaccgctgcgtcagtccgtgggcaagtcgtccggcactgccgttaacgacagccagtggcaggatttctaa

SEQ ID NO: 20613 - protein, 686 aa, Xanthomonas axonopodis
MVLASHDTTRIGKQVTDARHRTMLEAIKAGKDALDFTPDADGAVSAYVPLQIGKAQERFALGVVVPYATIMQQAHHLLWTILAVGLGSALVLSVALFALLRRQVVRPLEAAAHVADAIASGKLDNQITVQRQDEVGRLMGAMQRMQSDLRERIERDAQVANENLRIRTALEHSEMEVLLADEQHNAVFITQALHTSFKQGEPAFHAKGQTGFSADAVVGKPMDYVFGNDSEGTARTQRLRQLQSTSTERYRFGPVTLDLTMTPLYAPDGRRSGSMLLWRNISAEVSTQQEVAELVQSALMGDFGQRLALEDKHGFYLEFGRQLNGLLETTSLSLERISSLLSALAEGDLTVRMDGDFQGVFARMRDDANATVAQLTGIVSGIQTSATQISAAASEIAAGNNDLSQRTEQQAANLEETAASMEELTSTVKQNAEHARQANQLAIGAADVASHGGSVVAQVVTTMSGIETSSKKIAEIISVIDGIAFQTNILALNAAVEAARAGEQGRGFAVVASEVRTLAQRSAGAAKEIKHLIDDSVSKVEQGASLVHQAGTTMSEIVASVQRVTDIMGEISAASQEQSSGIEQVNLTVTQMDEATQQNAALVEEATAAARAMEEQAGQLTEAVAVFRLNHAVKPVLAAPTGTPAVRAVATTKPAPARGKRAATPLRQSVGKSSGTAVNDSQWQDF

SEQ ID NO: 20614 - DNA, 2304 bp, Xanthomonas axonopodis
  CDS (1)..(2304)
atgggctataacggccagcgcggcctgctcgatgcgattgccgcacaggtcatttcctccgacgcgctgcgcaaccacatgcaggcggacatgatgcacgacgccctgcgcggcgatgtcaccgcggcgttgcttgctgcctccacgaaagacgataaagcggttgcagccgcacgcaccgcattgggggaacacgctggcgaattccgcgagtcgctggcagccaaccgcaaactgccgctggcccctgcattgcgcggcgagttggacgcggtgacgccggcattgcaggcctatatcgcatccgccgaccacgtggtgaacgctgccgaaacgcatgcggacagcgcagcggcctacgcggatttcaacgacaagttcggccagcttcaaacccgcatgggcgccatcagcgagcgcatcctggccttgaacgaggccagccgccgccaggccgagcaagacagccaccgcgtgatgtggcagcaaggcagtgccgtggtgctggcattggtgtgcctggcgctggcggccggctggatcctgcgctcggtgttcggcctgcttggcggcgagccgcagctggccatggcggccgcgcagcacatcgccgaaggctgcctggatcaaccgatcccggtcgccgcaaagcactcgcgcagcctgatggccgccttggcgcgcatgcagcgcgacctgcgcgagcgcctggagcgcgagcgcagcatcgcggccgaaaacctgcgcatccgtaccgcattggataacgcatccaccggcatgtacatcgccgacccggatctcaccatcatctacaccaatggtgcgctgcaagacctgctgcacacctacgcggacgatattcaggcctgcgcgcctgcgttccatcgcacggccaacctggtcggccagccggtctcgctgctggaagtgggcaacgcacaggacgcagagatctatcagcgtctggaccgccagggcgctgcccaacgcgaggtgcagtaccgcagcacctgcatcgcacagaacgtttcggcaattcgcgacgagaccggcgcgcatctgggcttcgtctgcgagtggcgcgaccgcacggccgaggcgcgcgtggaaatcgacgttgccgacgtggtgcgtagcgccgctgccggcgatctttccaagcgcatcgacagtgccggaaagcagggctttttcctgcaactggcgcaacagctcaatgccttgctcgatgccaacgcggtcagcatcgccgaagtgtcgcgcctgctcagcgcactggccgacggcgacttgagtgcgcgcatgcagggcgatttccatggcgtcttcgccacgatgcgcaacgacgccaataccaccgccgagcaactggcactggtgatcgggcgtatccagcaggccgccggcagcattcatactgcctcaagcgaaattgccgccggcaacaacgacctgtcgcagcgcaccgaacaacaagcggccaatctggaagagactgccgcctcgatggaggaactcacttccaccgtcaagcagaatgcggagagcgcacgccaggccaaccagctggcgatcggtgcggctgacgtggcttcgcagggcggcgcggtggtggcgcaggtggtcaccaccatgtccggcatcgaagtttcatcgaaaaagatcgccgagatcatcagcgtcatcgatggcatcgcgttccagaccaacatcctggcgctcaacgccgccgtggaagcggcgcgtgccggcgaacagggccggggttttgccgttgtggcctccgaggtgcgcacgctggcgcagcggtcggccggtgccgcaaaagagatcaaacatttgatcgacgattcggtgagcaaggtcgccgagggatcgcagctggtgcatcaggccggcaccaccatggccgacatcgttgccagcgtgcagcgcgtcaccgacatcatgggcgagatcgctgccgcgtcgcaagaacagtcgtcgggcatcgagcaggtcaacctcaccatcacccagatggatgaagcgacccagcagaacgccgcgttagtggaggaagccactgccgctgcgcgcaccatggaagaccaggccagccagctggcgcacgcagtgtcgcgctttaccctggccgatgcgccgccgtcgcaggctgcaacgcctgcggccaaaaaggccgccgtcgtcgcagttgcccgggcaagcaagaccagcacgcgtgcgccgggcgcacgcaagccggcagtgaacgcacccgcggccaccgccggcaacgacggccagtggcaggacttctga

SEQ ID NO: 20615 - protein, 767 aa, Xanthomonas axonopodis
MGYNGQRGLLDAIAAQVISSDALRNHMQADMMHDALRGDVTAALLAASTKDDKAVAAARTALGEHAGEFRESLAANRKLPLAPALRGELDAVTPALQAYIASADHVVNAAETHADSAAAYADFNDKFGQLQTRMGAISERILALNEASRRQAEQDSHRVMWQQGSAVVLALVCLALAAGWILRSVFGLLGGEPQLAMAAAQHIAEGCLDQPIPVAAKHSRSLMAALARMQRDLRERLERERSIAAENLRIRTALDNASTGMYIADPDLTIIYTNGALQDLLHTYADDIQACAPAFHRTANLVGQPVSLLEVGNAQDAEIYQRLDRQGAAQREVQYRSTCIAQNVSAIRDETGAHLGFVCEWRDRTAEARVEIDVADVVRSAAAGDLSKRIDSAGKQGFFLQLAQQLNALLDANAVSIAEVSRLLSALADGDLSARMQGDFHGVFATMRNDANTTAEQLALVIGRIQQAAGSIHTASSEIAAGNNDLSQRTEQQAANLEETAASMEELTSTVKQNAESARQANQLAIGAADVASQGGAVVAQVVTTMSGIEVSSKKIAEIISVIDGIAFQTNILALNAAVEAARAGEQGRGFAVVASEVRTLAQRSAGAAKEIKHLIDDSVSKVAEGSQLVHQAGTTMADIVASVQRVTDIMGEIAAASQEQSSGIEQVNLTITQMDEATQQNAALVEEATAAARTMEDQASQLAHAVSRFTLADAPPSQAATPAAKKAAVVAVARASKTSTRAPGARKPAVNAPAATAGNDGQWQDF

SEQ ID NO: 20616 - DNA, 2085 bp, Xanthomonas axonopodis
  CDS (1)..(2085)
atgcgcggttttgccggcgaattccgcgtctacgaagtgggccagttcctcaatctggaagacccggagcgctacgcgtatttcttcaagcgcatggatgaaatccaggccaagtacgccgatacccagaagcagctggacgccaagatcgatgcggcctcgccgttgaaagccgagtacgacaagctgaccgatgccagcgcacgctatttcgcggccaaccagcaactgcgcaagctctatgcggagcccgaccgcgccgccgcgatggagttttcgcgcaagcaatcgggcgagatccgcaaggaactgttcgcctcggtggacaagctgtatgcacagcagtccaaggcgctgggcgacatggtgagtgccagcgccagctcgttcaagctgaccagcgcagtgctgctgatcggcaccttgttgatggccgccttgtcggtgaccttcggctggttgatcgcgcgcagcatcaccagcccgatcgccaaggcactgggcgccatccgggcggtttcgcgcggcgatctgggcgtgcaggtcggcaagaccagcaaggacgagatcggccagatgctcgatgccactggtggcatgacccagatgctgcgccgtttctccgacgaaaccgcgcgcatgtcgcacctgcatgctgccgaagacatcacccaccgcatgccggaagattttcccggtgtctacggcaaccttgccaccggcatcaatacgatgatcttcgagcatctcgatgccatcgtcgatgcagtgcgcatcctcaatcaatacgcccagggcgaccttagcgaagatgcgcgtcgcctgcccgccagccgcgcggtgctgcatgaggcaatggatgcagccaaggccagcttgttgtcgatcaacaccgagatcaagcatctggcgcaggcggccgcctccggcgatttcagtgcgcgtggcgatgcgcagcgcttcaagtacgacttcgccgtgatggtgtcggatctgaactcgatgatggaagtcagcgaccgcaacctgggcaagctgtcgcagctgctcggcgcggtggccgatggcgacctgaccgcgcgcatggacgggcaattccacggggtattcgcacgtctgcgcgacgacgccaatgcgaccacccagcgcctgaccgacatcgtgggccgcatcaagcactccaccctggccatcaacacggccgccggcgagattgccgccggcaacaacgacctgtcgcaacgcaccgagcagcaggcggccaacctggaagaaaccgccgcttcgatggaagagctcacctccacggtcaagcagaacgccgagcacgcgcgtcaggccaaccagctcgccatcggcgcggcaggcgtggcatcgcacggcggcaacgtggtcggccaggtggtcaccaccatgtccggcatcgaaacctcgtccaagaagatcgccgagatcatcagcgtcatcgacggcatcgcgttccagaccaacatcctggccttgaatgccgcggtggaagcggcgcgcgccggcgagcagggccgtggctttgccgtggtggcctcggaagtgcgcacgctggcgcagcgttcggccggtgcagcgaaggaaatcaagggcctgatcgacgactcggtcagcaaggtagccgaaggctcggcactggtgaatcaggccggcagcaccatggccgagatcgtctcctcggtgcagcgcgtcaccgacatcatgagcgagatttctgccgcctcgcaggagcagtcggccggcatcgagcaggtcaaccagaccgtcacccacatggacgaggccacccagcagaacgccgcgttggtggaagaagccaccgccgcagcacgctcgatggaagagcaggcgcagcagctcaccgaagcggtggcgcagttccgcctctcggccgagctggaagcggtaacccgtgccacgccggtggtgcgccacatcgccgccaagcgcccggttgctgccagcatgccggccagcaagccgcatgctgcgcgcccggcgggccgtgccgcagcagcagtggcaccgtccaacgaatccgattggtccgagttctaa

SEQ ID NO: 20617 - protein, 694 aa, Xanthomonas axonopodis
MRGFAGEFRVYEVGQFLNLEDPERYAYFFKRMDEIQAKYADTQKQLDAKIDAASPLKAEYDKLTDASARYFAANQQLRKLYAEPDRAAAMEFSRKQSGEIRKELFASVDKLYAQQSKALGDMVSASASSFKLTSAVLLIGTLLMAALSVTFGWLIARSITSPIAKALGAIRAVSRGDLGVQVGKTSKDEIGQMLDATGGMTQMLRRFSDETARMSHLHAAEDITHRMPEDFPGVYGNLATGINTMIFEHLDAIVDAVRILNQYAQGDLSEDARRLPASRAVLHEAMDAAKASLLSINTEIKHLAQAAASGDFSARGDAQRFKYDFAVMVSDLNSMMEVSDRNLGKLSQLLGAVADGDLTARMDGQFHGVFARLRDDANATTQRLTDIVGRIKHSTLAINTAAGEIAAGNNDLSQRTEQQAANLEETAASMEELTSTVKQNAEHARQANQLAIGAAGVASHGGNVVGQVVTTMSGIETSSKKIAEIISVIDGIAFQTNILALNAAVEAARAGEQGRGFAVVASEVRTLAQRSAGAAKEIKGLIDDSVSKVAEGSALVNQAGSTMAEIVSSVQRVTDIMSEISAASQEQSAGIEQVNQTVTHMDEATQQNAALVEEATAAARSMEEQAQQLTEAVAQFRLSAELEAVTRATPVVRHIAAKRPVAASMPASKPHAARPAGRAAAAVAPSNESDWSEF

SEQ ID NO: 20618 - DNA, 2079 bp, Xanthomonas axonopodis
  CDS (1)..(2079)
atgaatgccaactccgtcattgccacgcagattcgcaatgtcgtgttgccgacctccaacgaggacaatctcaagtttatcgaaaacatcaagaatgcccgtgcagactacgtcaaggcacgcgaggccctgtacgcaaccccgccctcggaagaaggcaaggaaattcgtgcagaaatcgatcgccgccgagagatcgtcaagggcttgaacgacaaggtcatcgagctggtgatgactggccatagcgacgacgccctgcccttgctgctgaccaaggctgcaccggcgatgcagcagtggcaggacaagatcgcagaaaacatcgcattgcagaacaagctggcgggcgacgcctccgctgctgcgctgcagtccatggacgagtcgcgcaagttgctgatcggcggttcgctgctggtcgtgctgctgagcggcgccctgggcgtgctgatcacccgcagcctgacccagccgttgagccgcgcgacccgcgctgcagaatccatcgccggcggccggctggataacgatgtcgatacccagttcaacgacgaggccgggcgcctgctcaaggcgatgagcaagatgcaacaacagttgcgcaatctgctgagcgcgcagaccgacatggcccggcgccatgatgaaggccagatcagctaccgcatcgatgccgatgcgttcccaggcgactacggccgcatggcaagcgataccaacaatctggtcgcatcgcatatcgcggtgaaactgaagcttgcgcagatcatgggccgctacgccatcggcgatctcagcgaggacatggacaagctgcccggcgaaaaggccgtgctcaccgacaccatggcgcaggtcaaattcaacctgtcggcaatgaataccgagatcaagcacctggccacatcggcggccaatggcgacttcagtgcccgcggcgatgccgagcgtttccagtacgacttccgggtgatggtggaaagcctcaacaccttgatggccaccgccgatggcaacctgcaatcgctctcgggcttgttgcagtcgatcgctgccggcgacctcaccgcacgcatgagtggcgagttccatggcgtgtttgcgcagatgcgcgacgatgccaatgccaccgccacccagctggccgagatcgtcagcggcatcaaggcctcggccacgtcgatcaggggtgcggcaagcgaaatcgccgccggcaatcaggacctgtcgcagcgcaccgaacagcaggccgccaacctggaagaaaccgcggcctcgatggaagagctcacctccaccgtcaagcagaacgccgaaagcgcacgccaggccaaccaactcgccatcggcgcggccagcgtggcctcgcagggcggcgagatcgtcagcaaggtggtcggcaccatgagcgggatcgaagcttcgtccaagaagatcgccgacatcatctccgtcatcgacggcatcgccttccagaccaatatcctggccttgaacgcggccgtggaagcggcacgcgccggtgaacagggccgcggctttgcggtggtcgcctcggaagtgcgcaccctggcacagcgctcttcgggcgcggccaaggagatcaaggacctgatcgacgactcggtgcagcgggtggccgaaggctcggtgctggtgcacagcgccggcaccaccatgggcgagatcgtggccagcgtgcagcgcgtcaccgacatcatgggcgagatttctgcggcctcgcaggagcagtcggccgggatcgagcaggtcaaccagaccgtgaccagcatggacgaaaccacccagcagaacgccgcgctggtggaagaagccaccgccgcggcacgcgcaatggaagaacaggcccagcaactgaccgaagcggtggcgctgtttcggctatcggccgacgcaggagcgatgacccgcaccacgccggcggtgcgccagattgccgccaagcgtccggttgcggtcaacaagccgacgatcaagccgcatgtcgcacgcccgacggcacgccccactgttgcgtcggtcgcatccgaggcatccaattgggccgagttctaa

SEQ ID NO: 20619 - protein, 692 aa, Xanthomonas axonopodis
MNANSVIATQIRNVVLPTSNEDNLKFIENIKNARADYVKAREALYATPPSEEGKEIRAEIDRRREIVKGLNDKVIELVMTGHSDDALPLLLTKAAPAMQQWQDKIAENIALQNKLAGDASAAALQSMDESRKLLIGGSLLVVLLSGALGVLITRSLTQPLSRATRAAESIAGGRLDNDVDTQFNDEAGRLLKAMSKMQQQLRNLLSAQTDMARRHDEGQISYRIDADAFPGDYGRMASDTNNLVASHIAVKLKLAQIMGRYAIGDLSEDMDKLPGEKAVLTDTMAQVKFNLSAMNTEIKHLATSAANGDFSARGDAERFQYDFRVMVESLNTLMATADGNLQSLSGLLQSIAAGDLTARMSGEFHGVFAQMRDDANATATQLAEIVSGIKASATSIRGAASEIAAGNQDLSQRTEQQAANLEETAASMEELTSTVKQNAESARQANQLAIGAASVASQGGEIVSKVVGTMSGIEASSKKIADIISVIDGIAFQTNILALNAAVEAARAGEQGRGFAVVASEVRTLAQRSSGAAKEIKDLIDDSVQRVAEGSVLVHSAGTTMGEIVASVQRVTDIMGEISAASQEQSAGIEQVNQTVTSMDETTQQNAALVEEATAAARAMEEQAQQLTEAVALFRLSADAGAMTRTTPAVRQIAAKRPVAVNKPTIKPHVARPTARPTVASVASEASNWAEF

SEQ ID NO: 20620 - DNA, 2070 bp, Xanthomonas axonopodis
  CDS (1)..(2070)
atgtccattgccacggtcaatatcgagaccggtgcgcgcggctttatgctgtccgggcaggaaacgcatctcaaaccgtacaacaacggcaaggtgcagttcgaacaggaattcaccaacgccaagacgttgaccgccgacaacccggttcagcaggaacgcctgcagcgcctgcatgcggcgtatgagcagttcatgggctttgaggacaacctgatcgcgctgcgtggcaaaagcagcgacaccgagctgtccgcgctgctgacgcaattcaaggccggccatgaacgtgcggcgatggggcagatccgtcagctgctggtcgacttcgaagcgcaggaaaaccaattgctggtcaagcgcagcgcaacattgaaggccgcgaaggccagcaaccgttggtcgatgatcatcggcagcggcatcgccgtgctggtggcgctggccagcggctggttgatccgtcgtcgcctggtcaatcgcctgggcaccgcctcgcacgtggccgattccatcgccgctggcaatctgtcggtcagcgtggacagcagcggcaccgatgaaaccggtcgcctgctctccagcatgagcaagatgcagcagcagttgcagaaggtcttgcacggccagcaggaaatgaagcgccggcacgatcagggcgagctgaatttccgcctggacgacgcagcgtttcctggcgactacgccaccatcgtgcgcggcaacaacgacctggccgcctcgcatgtggccgtgatgatgcggttggcgcagatcatgggccaatacgcgatcggcgacctgcgcgaagacatggaagccctgcccggcgacaaggccgtgctcagcgacaccatggccaaggtcaagggcaacctgtcttcggtcaatcacgccatcaagcatctttcccaatgcgccgccaatggcgacttcagcgcccgcggcgatgcggaaaacttccagcacgacttccgcgtgatggtggaaagcctcaacaccttgatggccaccgccgacggcaacctgcagtcgctctcgggcttgttgcaggcgatcgctgccggcgacctcaccgcccgcatgagcggtgaattccacggcgtgttcgcgcagatgcgcgacgatgccaatgccaccgccgtgcagctggccgaaatcgtcaccggcatcaaggcctcggccatctcgatcaagggcgctgccagcgaaatcgctgccggcaacagcgacctgtcgcagcgcaccgaacagcaggccgccagcctggaagaaactgccgcctcgatggaagagctcacctccaccgtcaagcagaacgccgaaagcgcacgacaggccaaccagctcgccatcggcgcggccagcgtggccacgcagggcggcgagatcgccggccaggtggtcgagaccatggccggcatcgaggcctcgtcgaagaagatcgccgatatcatctccgtcatcgacggcatcgccttccagaccaacatcctggccttgaacgccgcggtggaagcggcgcgtgccggcgagcaaggccgcggcttcgccgtggtggcttctgaagtgcgtacgctggcacagcgctcttccggcgccgccaaggagatcaaggacctgatcgccgactcggtcgaacgtgtggccgccggttcggtgctggtcaataccgcaggcaggaccatgagcgagctggtgaccagcgtgcagcgggtcaccgacatcatgggcgagatctccgccgcttcgcaggaacagtcggctggcatcgaacaggtcaaccagaccgtcacccagatggacgaaaccacccaacagaacgccgcgctggtggaagaagccactgccgccgcgcgttcgctcgaagaacaggcgatcggattgaccgaggccgtggcggtcttcaagaccgagcaaggcaccgccagcactgtccgcacggcatcggtcgccaaggccgcgcccgccgtgcgcgccaagctgacctcgatcggcggcaccgctgccgccaagccgcgcgcggtcgctgcatcgacgaccgtcgagaccagctggcaggagttctga

SEQ ID NO: 20621 - protein, 689 aa, Xanthomonas axonopodis
MSIATVNIETGARGFMLSGQETHLKPYNNGKVQFEQEFTNAKTLTADNPVQQERLQRLHAAYEQFMGFEDNLIALRGKSSDTELSALLTQFKAGHERAAMGQIRQLLVDFEAQENQLLVKRSATLKAAKASNRWSMIIGSGIAVLVALASGWLIRRRLVNRLGTASHVADSIAAGNLSVSVDSSGTDETGRLLSSMSKMQQQLQKVLHGQQEMKRRHDQGELNFRLDDAAFPGDYATIVRGNNDLAASHVAVMMRLAQIMGQYAIGDLREDMEALPGDKAVLSDTMAKVKGNLSSVNHAIKHLSQCAANGDFSARGDAENFQHDFRVMVESLNTLMATADGNLQSLSGLLQAIAAGDLTARMSGEFHGVFAQMRDDANATAVQLAEIVTGIKASAISIKGAASEIAAGNSDLSQRTEQQAASLEETAASMEELTSTVKQNAESARQANQLAIGAASVATQGGEIAGQVVETMAGIEASSKKIADIISVIDGIAFQTNILALNAAVEAARAGEQGRGFAVVASEVRTLAQRSSGAAKEIKDLIADSVERVAAGSVLVNTAGRTMSELVTSVQRVTDIMGEISAASQEQSAGIEQVNQTVTQMDETTQQNAALVEEATAAARSLEEQAIGLTEAVAVFKTEQGTASTVRTASVAKAAPAVRAKLTSIGGTAAAKPRAVAASTTVETSWQEF

SEQ ID NO: 20622 - DNA, 2064 bp, Xanthomonas axonopodis
  CDS (1)..(2064)
atgcgcagcgccagtgcagctattgcgatcaatctgcgcaacatcgtgctgccgaccacgcaggaagaaaacctcggttttgccaaggtgatcgaggaacagcggcagaactacaaccaaaaccgcgaaaagctctacgcacgcccgccgtccaacgctgccggcgcggagatgcgtcggcagattgatattgcgcgcgaaaaagcgcgtatcgccaatcagcaggtcatggacctgggcttgaactacaagcctgatgaggcactcaaggtgttgatgcagcaggcggtaccggcgaaccaacaatggcaggccgcactcgatgcgtacgctgcgcgccagcgcagccgtggcgccgcggcttatgacgatgccaataccgccatggactatggccgggcgttgctgatcgccggcggcattgcggtcgtcgtgatcagcggcctgctggcctggctgatcacccgcagcctgacccagcccttgaaccgcgccacccgtgccgccgaggccatcgccgagggccgcctggatagcaatgtgcataccaccgccaccgacgagcccggccggctgctcagcgccatggccaagatgcagacgcagttgcaacgtttctccagcgaaaccgcgcggatgatcgagctgcacgccgacaaggacatcagccaccgcatgccgcaggacttccccggcgtgtatggcgacttgagcaagggcatcaacaccatgatgttcgagcacctggacgccatcgtcgatgccgtcgaagtgctcaacgaatacgcccgtggcgatctgcgccgcgatgcacggcgcctgccgggcagccgcgcggtgctgcacgaatcgatggatgcggccaaaaccagcctgttggcgatcaacaccgagatccagcgcctggccagcgcggcggctgccggcgacttcagcgcacgcggcgatgcgcagcggttcgagcacgatttcctgcgcatggtgcaggacctcaacgcgatgatggaggtcagcgacaccagcctgggcagcttgtcggcgctgttgcagtccatcgccgccggcgatctcaccgcccgcatgcacggcaacttccacggtgtgttcgccaagatgcgcgacgacgccaacgccaccaccgaacagctcacgcgtatcgtggtgcggatccagggcgcggccggcaacatcggcgcggccaccggcgaaatcgccgccggcaaccaggatctgtcgcagcgtaccgaacaacaggccgccaacctggaagagaccgctgcctcgatggaagagctcacctccaccgtcaagcagaacgccgaaagcgcacgccaggccaaccagctcgccatcggcgccgcccgcgttgcgtcgcaaggcggcgagatcgccggcaaggtggtcgagaccatgagcgggatcgagtcttcgtccaagaaaatcgccgatatcatcagcgtcatcgatggcatctcgttccagaccaacatcctggcgctcaacgccgcggtggaagcggcgcgtgccggcgaacaaggccgcggctttgccgtggtggccagcgaagtgcgtacgcttgcgcagcgctccaccgccgcggccaaggagatcaagagcctgatcgacgattcggtgcaacgcgtcgccgaaggctcgctgctggtgcacagcgccggcaccaccatggccgagatcgtgtccagcgtgcagcgcgtcaccgacatcatgggcgagatctccgcggcctcgcaggagcagtcggccggcatcgagcaggtcaaccagaccgtcacccagatggacgaaaccacccagcagaacgccgcactggtggaagaagccaccgccgccgcccgcgcactggaagaacaggcgctcggattgaccgaggcagtggcggtcttcaagaccgacagcaacgacgcatcgcgtgcagcatcacgacgcccggcagcaacgccggcgcttgcggccaaggcggtggcagccggccgcgctcctgcccccaggctgcgcgccgtggtcgctgcgccaggcaacgacagcagctggcaggagttctga

SEQ ID NO: 20623 - protein, 687 aa, Xanthomonas axonopodis
MRSASAAIAINLRNIVLPTTQEENLGFAKVIEEQRQNYNQNREKLYARPPSNAAGAEMRRQIDIAREKARIANQQVMDLGLNYKPDEALKVLMQQAVPANQQWQAALDAYAARQRSRGAAAYDDANTAMDYGRALLIAGGIAVVVISGLLAWLITRSLTQPLNRATRAAEAIAEGRLDSNVHTTATDEPGRLLSAMAKMQTQLQRFSSETARMIELHADKDISHRMPQDFPGVYGDLSKGINTMMFEHLDAIVDAVEVLNEYARGDLRRDARRLPGSRAVLHESMDAAKTSLLAINTEIQRLASAAAAGDFSARGDAQRFEHDFLRMVQDLNAMMEVSDTSLGSLSALLQSIAAGDLTARMHGNFHGVFAKMRDDANATTEQLTRIVVRIQGAAGNIGAATGEIAAGNQDLSQRTEQQAANLEETAASMEELTSTVKQNAESARQANQLAIGAARVASQGGEIAGKVVETMSGIESSSKKIADIISVIDGISFQTNILALNAAVEAARAGEQGRGFAVVASEVRTLAQRSTAAAKEIKSLIDDSVQRVAEGSLLVHSAGTTMAEIVSSVQRVTDIMGEISAASQEQSAGIEQVNQTVTQMDETTQQNAALVEEATAAARALEEQALGLTEAVAVFKTDSNDASRAASRRPAATPALAAKAVAAGRAPAPRLRAVVAAPGNDSSWQEF

SEQ ID NO: 20624 - DNA, 1965 bp, Xanthomonas axonopodis
  CDS (1)..(1965)
atggtctccacgctgatctacagccccgagaccaccgaatcgctgacccgtctggacgccgccagcgacccctcgcaggcgggcgacagccgcgccatgctgcgcgagcagctcgatcaacttgcccgaaaccatgtgcgtttccgccatgagctggacaaggcgatgggcctgctggagcagcccgaccctgccctggccgatgccgccaaggtcgaagccacccagtcacgcgccgcactggccgcactgggtaccgccttggagggcagcgatgccaaggccgacgcgcagtggaatgccgcactcgatgcgcttggccagagcatgcgggacctcagcaacgtgtccctgcaggcgctgcagcggcaatccgagcgccacctggtcgacgcacgcaacgcgatgtggcaagcgatcgccggcctgtcggtgctggcgctgctgatcgccgccctgtgctggtataccttgtcgcgcctgacccgcaatgtgcgccgcgccgcgacggtggcagccaatatcgcgcagggccagctggacgatcaggtcagtgccgccggccgcgacgaaaccggtcaattgctcgacaccatgcgccagatgcaagggcaactgcagcgcgtcctcagcgcgcaaagcgaaatggcgcagcgccacgacgccggccagatcagctaccgcatgcaggcagacagtttccccggtgcctacgccaccatggtgcgcgacaccaacgcgctggtgggctcgcacattgcagtcaagatgaaacttgcgcagatcatgtcgcgctacgccatcggcgacctgagccaggacatggagcgcctgcctggcgaaaaggcggtgttcaccgacaccatggataccgtcaaggccaacctgtcggcgatgaacagcgagatcaagctgcttgcgcaggccgcagccaatggcgatttcagcgtgcgcggcgacgcacagcgcttccagtacgacttccgcgcgatggtggacagcctcaatcaattgatggccacctccgatgcgaatctgcacgcgctctcgacggtattgcaggcgatcgcggcgggcgacctcaccgcccgcatgcacggcgacttccacggcgtgttcgcgcgcatgcgcgacgatgccaatactaccgtgacccagctggccaatatcgtcgggcgcatccagcagtccaccaatgccatcaacgacgccgccagcgaaattgccaccggcaatcaggatttgtcgcaacgcaccgaacagcaagcggccaatctggaagaaaccgctgcctcgatggaagaactcacctccaccgtgcgcaacaacgccgagcatgcgcgccgcgcaaaccagttggtggtcggtgcggccacggtcgcctcgcaaggcggtgcggtagtgggtgaggtcgttggcaccatggccggcatccaggctgcatccaagaagatcgccgacatcatcagcgtgatcgacggcatcgccttccagaccaatatcctggccttgaacgccgcggtggaagcggcgcgcgccggcgaacagggccgcggctttgcagtcgtggccagcgaagtgcgcacgctggcgcagcgctcggccggtgcggcaaaagagatcaagcaactgatcgaggactcggtcagccgggtcgaacacggcaaccagttggtgggccaggccggtcgcaccatgcaggacatcgtcgactcggtgcagaacgtcaccaccatcatgcatgagatcagcgaggcctcgcagcagcagtcgcaaggcatcgaacaggtcggccagaccatcgcgcagatggatcaggccacccagcagaacgccgcactggtggaagaagccaccgccgccgcccgttcgatggaagaacaggcgcagcaattgcgcgatgcggtctctgtgttccagttgcaggctgggcctgcgcgtcgccgcctgggccacgctgcctag

SEQ ID NO: 20625 - protein, 654 aa, Xanthomonas axonopodis
MVSTLIYSPETTESLTRLDAASDPSQAGDSRAMLREQLDQLARNHVRFRHELDKAMGLLEQPDPALADAAKVEATQSRAALAALGTALEGSDAKADAQWNAALDALGQSMRDLSNVSLQALQRQSERHLVDARNAMWQAIAGLSVLALLIAALCWYTLSRLTRNVRRAATVAANIAQGQLDDQVSAAGRDETGQLLDTMRQMQGQLQRVLSAQSEMAQRHDAGQISYRMQADSFPGAYATMVRDTNALVGSHIAVKMKLAQIMSRYAIGDLSQDMERLPGEKAVFTDTMDTVKANLSAMNSEIKLLAQAAANGDFSVRGDAQRFQYDFRAMVDSLNQLMATSDANLHALSTVLQAIAAGDLTARMHGDFHGVFARMRDDANTTVTQLANIVGRIQQSTNAINDAASEIATGNQDLSQRTEQQAANLEETAASMEELTSTVRNNAEHARRANQLVVGAATVASQGGAVVGEVVGTMAGIQAASKKIADIISVIDGIAFQTNILALNAAVEAARAGEQGRGFAVVASEVRTLAQRSAGAAKEIKQLIEDSVSRVEHGNQLVGQAGRTMQDIVDSVQNVTTIMHEISEASQQQSQGIEQVGQTIAQMDQATQQNAALVEEATAAARSMEEQAQQLRDAVSVFQLQAGPARRRLGHAA

SEQ ID NO: 20626 - DNA, 2088 bp, Xanthomonas axonopodis
  CDS (1)..(2088)
atgcaggaaatgaacaacgcggtgtcggtgattgccgtgcagctacgcaacatcgtgttgccgaccagcgatgcggagaatcgtcgcttcgctgcgatcatcgaagaccagcgcagcatctacaaggatgcacgcgagaagctctacaccttctcggcaacgcctgccgcccaggcgctgcgtgagaggatcgatgccaacaacaaggccgcccgcgcgctcaaccagcaggtgatcgacctgggtcttgccggcaaggcggaccaggccctgcctttgctgttgcaacgtgccgcacccgccacgcaggcatggcaggacacgctgctggaatattcggcgctgcagcgccaacgcgcccaggaggccaatgcgctggccaccacggcgatggcccgcggtcgtgccatgttgattggtggcggcctggcggtggtgctgatcagcagcgtgctcgcctggttgatcacgcgcagcctggtggttccgctgacacgcgccacgcgcgccgccgaagccattgcccaaggcaaactggacaacgacgtcagcgcgaacttcaacgacgagaccggtcgcctgttgcatgccatgaacgacatgcagggccagctgcgcaatctgattgccgcacagctgggcatggccaagcgccatgaagaaggccagatcagcttccgcatggatgccggcgcattcccgggcgatttcggccgcatggcccatgacaccaacgagctggtggccgcgcacatcaaggtcaagatgcagaccatccacctgatcgagcgttatgccatcggcgacctgtccgaagacatgcagcagttgcccggcgagaaggcggccatcaccgcggcaatgaaccaggtcaagcacaacctgtcgaccatgaacaccgagatcaagcagctggcgcaggctgcggccaatggcgacttcaccgcgcgcggcgatgccgagcagttccagttcgatttccgcatcatggtggaaagcctcaacaccttgatggccaccgccgacggcaacctgcaatcgctctcggccttgttgcagtcgatcgctgccggcgacctcaccgcgcgcatgagcggccaataccggggcgtgttcgcgcagatgcgcgacgatgccaatgccaccgccgaacaactggccagcatcgtcggccgcatccagatcgcggccgatgcgatcggtctggcctcgggcgaaatcgcctccggtaatcaggatctgtcgcagcgcaccgaacagcaggccgccaacctggaagaaaccgcggcctcgatggaagagctcacctccaccgtcaagcagaacgccgaacacgccagccaggccaaccagctcgccattggcgccgctgcggtcgcctcgcaaggcggcgacgtggtggcgaaggtggtcaccaccatgtccgacatccagggctcgtccaagaagatcgccgagatcatcagcgtcatcgacggcatcgcgttccagaccaatatcctggccttgaacgcggcagtggaagcggcgcgtgccggcgaacagggccgtggttttgcggtggtcgcgtctgaagtccgcacgctggcgcagcgttcggccggtgccgccaaggagatcaagcacctgatcgacgactcggtcgaaaaggtcacgcaaggcgcaaccctggtcgatcaggccggcaccaccatggccgagatcgtcgccagcgtgcagcgcgtcaccaacatcatgggcgagatttcctcggcctcgcaggagcagtacgcgggtatcgaacaggtcaaccagaccgtcacccacatggacgaagccacccagcagaacgccgcgctggtggaagaagccactgccgccgcccgctcgatggaagagcaggcaggtcatctggccgaagcggtgtcggtgttcaagctggacgactcggctgcgcaggcgccgcagagcgcacgcgtacgcccgatcacctcgcgcccggttgcagtgaaaagcgccgccaggccggtagcgcgcgcagcagcgagcgcctcacggccagccacatcccaggccgcgctggccgacggtaactggcaagagttctga

SEQ ID NO: 20627 - protein, 695 aa, Xanthomonas axonopodis
MQEMNNAVSVIAVQLRNIVLPTSDAENRRFAAIIEDQRSIYKDAREKLYTFSATPAAQALRERIDANNKAARALNQQVIDLGLAGKADQALPLLLQRAAPATQAWQDTLLEYSALQRQRAQEANALATTAMARGRAMLIGGGLAVVLISSVLAWLITRSLVVPLTRATRAAEAIAQGKLDNDVSANFNDETGRLLHAMNDMQGQLRNLIAAQLGMAKRHEEGQISFRMDAGAFPGDFGRMAHDTNELVAAHIKVKMQTIHLIERYAIGDLSEDMQQLPGEKAAITAAMNQVKHNLSTMNTEIKQLAQAAANGDFTARGDAEQFQFDFRIMVESLNTLMATADGNLQSLSALLQSIAAGDLTARMSGQYRGVFAQMRDDANATAEQLASIVGRIQIAADAIGLASGEIASGNQDLSQRTEQQAANLEETAASMEELTSTVKQNAEHASQANQLAIGAAAVASQGGDVVAKVVTTMSDIQGSSKKIAEIISVIDGIAFQTNILALNAAVEAARAGEQGRGFAVVASEVRTLAQRSAGAAKEIKHLIDDSVEKVTQGATLVDQAGTTMAEIVASVQRVTNIMGEISSASQEQYAGIEQVNQTVTHMDEATQQNAALVEEATAAARSMEEQAGHLAEAVSVFKLDDSAAQAPQSARVRPITSRPVAVKSAARPVARAAASASRPATSQAALADGNWQEF

SEQ ID NO: 20628 - DNA, 2043 bp, Xanthomonas axonopodis
  CDS (1)..(2043)
atggtgatcctgaccgtggtcggcatccaacgcgttcgcagcatcgaccagcagctcactgccatcaatgaagtcaacagcgtcaagcagcgctacgcgatcaacttccgcggcagtgtccacgaccgcgccatcgcgctgcgcgatgtcgtgctcatggacgaccccgcgaaccgccacgccgccgaacaatcgatcgacaagctcgctgccgattacgcacgctctgcgcaaccgctcgacgacatgatcgccagctcgaccgatgcggaagagaaagacattctccagcagatcaagaccatcgagcagcgcaccctgccgctgatcgcgcaagtgcgcgcgttccgcgatgcggccgacaaggcgcaggcacaacagcacctgctgcagcaagcgcgcccggccttcattgcctggctggccagcatcaacgccttcatcgatctgcaggaagccaagaaccgccaagccgccaggcaggccgttgccaccgcgcgcggctttgcgatgctgatggtgatgtccaccgtggtcgccctgctgctgggcgccgccatcgcgttcctgctcacgcgcagtgtggtgctgccgctacgccagtcgctgcgcctggcccagcgcatcaacgacggcgacctgcgcagccaggacgcagcgaccggcaacgacgaatccgggcaactgctgcgcgccatgcagcagatgcagcggcgcctgcaggaagtgatctccgcgcaacgcagcatggctgcgcgccacgacgccggcgagatcagctaccgcaccgacgcacggcgtttccccggcgaatatggcgacatggtgcaagacaccaacgcgctcgtgcacgcccacgtgcagacccaattgcgcatgaccgaggtcatgggcagctacgcggttggcgatcttgcccaggacatcgagcagtatcccggcgaaaaatccgccatcactgccaccatgcagcaggtcaagcgcaacctgcaggcgatcaacgcgcagatccaggaactgacccaggccgcctgcgcaggcgacttcgcgctacgcggccagccggagaagttcgagcacgacttccgcctgatggtggaaaacctcaacaccatgatggccacctccgataccaacctggccaacttctccgggctgctgcgcgcgatcgccgatggcgacctgaccgtgcgcatgtccggcaatttccacggcgtgttcgcctccatgcgcgacgacgccaacagcaccgtgcaccgcctcaccgacatcgtcacccgcatccagacaacctccaacagcatcggcttcgccgcagaagatatcgccagcggcaatcaggagctggcgcagcgcagcgaacaacaagccgccagcctcgaagaaaccgccgcctcgatggaagagctgacctccaccgtcaagcagaatgccgagcacgccgcccgcgccaaccagctcgcacgcggcgccgccgcgatcgccacggaaggccgcgacgtggtcggccaggtcatcgaacagatgtccggcatcgaagccgcttccaggcgcatcgccgacatcatttcggtcatcgacggcatcgccttccagaccaatatcctggccctcaacgccgcggtggaggccgcacgcgcaggcgaacaaggccgcggcttcgccgttgtcgcatcggaagtgcgcacgctctcgcaccgctcctcggatgcagcaaaagaaatcaagcggctcatcgacgactccgtacaacgcgtcgccgacggctccacactcgtgcacaaggccggcaccaccatgggcgaagtcgtcaccagcgtccaacacgtcaccgacatcatggcccacatctccgccgcctcgaacgaacaagccggcggtatcgaacaggtcaatcacaccatcgcgcagatggacgagaccacccaacacaacgtgcgcctggtcgaagccgccagcaccgccgcgcatgcgttggagcagcattccacgcaactcacccgcgcagtggacgtcttcaaggtcaacgcaacggtgctgtga

SEQ ID NO: 20629 - protein, 680 aa, Xanthomonas axonopodis
MVILTVVGIQRVRSIDQQLTAINEVNSVKQRYAINFRGSVHDRAIALRDVVLMDDPANRHAAEQSIDKLAADYARSAQPLDDMIASSTDAEEKDILQQIKTIEQRTLPLIAQVRAFRDAADKAQAQQHLLQQARPAFIAWLASINAFIDLQEAKNRQAARQAVATARGFAMLMVMSTVVALLLGAAIAFLLTRSVVLPLRQSLRLAQRINDGDLRSQDAATGNDESGQLLRAMQQMQRRLQEVISAQRSMAARHDAGEISYRTDARRFPGEYGDMVQDTNALVHAHVQTQLRMTEVMGSYAVGDLAQDIEQYPGEKSAITATMQQVKRNLQAINAQIQELTQAACAGDFALRGQPEKFEHDFRLMVENLNTMMATSDTNLANFSGLLRAIADGDLTVRMSGNFHGVFASMRDDANSTVHRLTDIVTRIQTTSNSIGFAAEDIASGNQELAQRSEQQAASLEETAASMEELTSTVKQNAEHAARANQLARGAAAIATEGRDVVGQVIEQMSGIEAASRRIADIISVIDGIAFQTNILALNAAVEAARAGEQGRGFAVVASEVRTLSHRSSDAAKEIKRLIDDSVQRVADGSTLVHKAGTTMGEVVTSVQHVTDIMAHISAASNEQAGGIEQVNHTIAQMDETTQHNVRLVEAASTAAHALEQHSTQLTRAVDVFKVNATVL

SEQ ID NO: 20630 - DNA, 2013 bp, Xanthomonas axonopodis
  CDS (1)..(2013)
atgcagcactatgccgataaggtcaaagcaggcgagctgagcctggagcaagccaaggaagccgcacgcaccacgctggccgacatgcgtaccaacgacggcgtggattacttcttcatcgtcgacccgcagatgcgcatcctgatgcatcccaagcgcccggtcggcaccgacatgaccgactacaagagcgatgccgggcaatacgtgtaccgcgatatcaagaccgccatcgatagcggcgacggcttcagctattacgacgcgcccaagccgggcaagaaggaacagctgcccaagatcagctacgccaagacctttccggcctggaactgggtgctggtgatgggcgtctatgccgaggacattcaagtacaggcgtggggcttcacgcgcaccttgacgctgatcggcggcgcgctggtggcgctggtgatcgggctgtgctggttgatcgcatcggccatggccgcgccgctgcgcgctgcctcgcgcactgccgaagccatcgcctcgggccgcttcgacaacgacatccgcgtggaatcgcgcgatgaaaccggccagctgatgcacagcatgcagcaaatgcagaaccagctgcagcgcttcaacggcgagatgcagaccatgatccgtctgcaacagggcgagaacatcgcgcaccgcattccggaagatttcccaggcgattacggcacgctggcgcacggcgtcaacacggtggtgttcgagcacctggacgccatcaacgaagcgatggacgtgatgagcgactacggccgtggcgatctgcgccgcgacatgcgtcgcctgcccggccagcgcgctgccctgcaccaggcgctggacacggtgaaagagaatctgtctgcgatcaacagcgacatcgcgcgcctggccgatgcagcggcgcgcggcgatttctccgcacgtggcgatcaatcgcattatcaattcgcgtttgcggaaatggtgcaggcgttgaaccggctgatgcagcaggccgacgctgggttggacgatgtgggccgcatcatggccgcgatcgccgacggcgatctgtcgcagcgcgtggagtcgcattacgaaggcgcgttcggccgccttgccgatgcagccaaccgcactgccatccaattgaccggcatcgtgcagggcatccagcactcggccgagatgatcaacaccgcggcaggcgagatcgccagcggtaatgccgacttgtccacgcgcaccgaacaccaggcagcgaacctggaagaaaccgccgcgtcgatggaagaactcacctccaccgtgcgccagaacgccgacaacgcgcgccaggccaaccaattggtcaagggcaccggcgatgtggccgagagcggcggccgcgtggtgcaggaagtggtgagcaccatgcaggcgatcacgcagtcgtcggcgcgtatttccgacatcatcggagtgatcgatggcatcgccttccagaccaatatccttgcgttgaatgcggccgtggaagcagcgcgcgcaggcgagcaaggccgtggttttgccgtggtcgccaccgaagtgcgcgccctggcgcagcgctcggccggtgccgccaaggaaatcaaacagctgatttccgattcggtagaaaaagtggcgcaaggctcggagctggtgcaacaggccggcagcaccatgaccgaggtggtcagctcggtgaagcgcgtgaccgacatcatggccgagatcacggcggccagcaccgaacaaagcgccggcatcgaacaggtcagcaccacggtgatgcagctggacgaaatgacgcagcaaaacgccgcattggtggaagaagccaccgcggcggcgcgcagcatggaagaccaggcggcagacctgacccgcgccgtggcggtgttccggttgacatcggatgccggccagcagcaggcacgtagcgcagccaacgcgcctgccactacgaagccggcggccgccaggcaagctgcacacgaccacaggctgcgtgcataa

SEQ ID NO: 20631 - protein, 670 aa, Xanthomonas axonopodis
MQHYADKVKAGELSLEQAKEAARTTLADMRTNDGVDYFFIVDPQMRILMHPKRPVGTDMTDYKSDAGQYVYRDIKTAIDSGDGFSYYDAPKPGKKEQLPKISYAKTFPAWNWVLVMGVYAEDIQVQAWGFTRTLTLIGGALVALVIGLCWLIASAMAAPLRAASRTAEAIASGRFDNDIRVESRDETGQLMHSMQQMQNQLQRFNGEMQTMIRLQQGENIAHRIPEDFPGDYGTLAHGVNTVVFEHLDAINEAMDVMSDYGRGDLRRDMRRLPGQRAALHQALDTVKENLSAINSDIARLADAAARGDFSARGDQSHYQFAFAEMVQALNRLMQQADAGLDDVGRIMAAIADGDLSQRVESHYEGAFGRLADAANRTAIQLTGIVQGIQHSAEMINTAAGEIASGNADLSTRTEHQAANLEETAASMEELTSTVRQNADNARQANQLVKGTGDVAESGGRVVQEVVSTMQAITQSSARISDIIGVIDGIAFQTNILALNAAVEAARAGEQGRGFAVVATEVRALAQRSAGAAKEIKQLISDSVEKVAQGSELVQQAGSTMTEVVSSVKRVTDIMAEITAASTEQSAGIEQVSTTVMQLDEMTQQNAALVEEATAAARSMEDQAADLTRAVAVFRLTSDAGQQQARSAANAPATTKPAAARQAAHDHRLRA

SEQ ID NO: 20632 - DNA, 1560 bp, Rhodovulum sulfidophilum
  CDS (1)..(1560)
atggccgattccacctcttccctggaaattgcgcaggcaaaaggtctacgcctgattggctatctcaacgttctgctaacgcccgttccggcgatcggtgcttggttggcgggcttgtctccgtggccgtttctggcgatgtctctcgcgattgccgcggtgaccatcggccttcagcgccgtggcgggagtatggcgcggatcgcagtgtcgcttggtgcgatgggtcaattgcctctgctgactgcggcactggccggaaacccttggcaacttgactcccacctgatctattttgccgtgctggcggtactggttatcctgcaggaccagcgggcgcttctctccgcttcaggaatcgtcattgttcatcacgcactgctgacgttttttctgccgacgctgatttatccgagtagcggcttgctggttgatttggggcgcctggcgctacacggcaccgtgtgggtagccgaaaccggaggtctgctttaccttttgcgcatgcagctcagtcagcgtgaccagatcgagcaagaggcagcaaggctatccgatgcgttggcaagctctcaagagctgcaactgaatttgacccaaaaggaagccgagcagctcaatgtcatggagcggttcagcgcggctttgaccaaattggccaaaggggaccttgcgacacgcatagagacgatctttccggatcagttcgaaccgctgcggaacgaattcaacagcgctgtcaactcgttgtcggccgccatgttcagcgtccaggaaaacgcggattcaatcaagtcggatacaagaaacattgcctcggcatccgagaaacctgccaaacggacagaggatcaggcgcacgctctgggaagtgtgacctcgcgtattgatgcaatcagtgaggtcatgtcctccgcatcagaagacgcccggcaggtcgcgatgacgacggccgagatgagagccgatgcggaaaacggcatgaaagtagtcgacggtgcgttggacgcaatgggtcaaatcaggagcagctcaggccagatcctgtcagttgtcgatttgattgaagacgtagcgtttcagaccaacctccttgcgctcaatgccggggtcgaggccgcgcgtgcggggtcggccggtcaaggcttcgctgttgtcgcatcggaagttcgtgcgcttgctggccgttcttcggatgcggcccgcgaaatcagtgctctcataaacgatagcgcccggcaggttcaaaacggtgtggaactcgtcgacaacgccggcaccgtccttcgtggtgttctagaagcggtgcgcaaggcatctgactccatgcagaacattgcatcgacggtcgggacccactcacaaggaatcgccgatttgaaacataccatgggtgagcttgatcagcttacacagcagaatgcagcaatgtttgaagaaacgtctgctgcaacgacagctttgaccgccgcaacaaatttgcttagcgagattgtggcggaatttcaaaatgccgccgagaatgagaattcagcgccacttctctgccagatctcctaa

SEQ ID NO: 20633 - protein, 519 aa, Rhodovulum sulfidophilum
MADSTSSLEIAQAKGLRLIGYLNVLLTPVPAIGAWLAGLSPWPFLAMSLAIAAVTIGLQRRGGSMARIAVSLGAMGQLPLLTAALAGNPWQLDSHLIYFAVLAVLVILQDQRALLSASGIVIVHHALLTFFLPTLIYPSSGLLVDLGRLALHGTVWVAETGGLLYLLRMQLSQRDQIEQEAARLSDALASSQELQLNLTQKEAEQLNVMERFSAALTKLAKGDLATRIETIFPDQFEPLRNEFNSAVNSLSAAMFSVQENADSIKSDTRNIASASEKPAKRTEDQAHALGSVTSRIDAISEVMSSASEDARQVAMTTAEMRADAENGMKVVDGALDAMGQIRSSSGQILSVVDLIEDVAFQTNLLALNAGVEAARAGSAGQGFAVVASEVRALAGRSSDAAREISALINDSARQVQNGVELVDNAGTVLRGVLEAVRKASDSMQNIASTVGTHSQGIADLKHTMGELDQLTQQNAAMFEETSAATTALTAATNLLSEIVAEFQNAAENENSAPLLCQIS

SEQ ID NO: 20634 - DNA, 1422 bp, Burkholderia cepacia
  CDS (1)..(1422)
atgcagatggcactcgccatgcagcgggcaagctcgggtgacacggccccggcggttggcaaggacctgctgctcaagccgatcaagcacgggcagtggcttgccgcgcaggtcgatgtggagttgttcaaggtcgagcaggggttgttccgcttgttcggctttggtggcgttcttgacttgccgagcaaggacattggcgacctggagcgcatgaagaaaatcatcgagctcgaacctggcagcaccgtgagcccggcactggtcgagcggctgcgacccgacatggcggtggtgcaagatggctccgaacgtttcgccccgctagtggccgaggcggtcggcttcatcaaggcgcttgtcttcagcatcaacctgctgggcggtctggtgctgctggcctccttttgggcgatccgcaaagcggtgctcgggccgctggaggaggcgctgcggctggcgggccagattgcccagggcgacctcacggggcagatcgtgacgcgttcgaacgacgaagtcggccaattgataaccgccctggcggacatgcagggcagcctttccagcatggtggcccatgtgcgccagaacgccgagagcctggaggcggccagttccgagattgcccagggcaaccacgacctgtcggcgcgcaccgaaagccaggccagcgccctggaagaaaccgccgccagcatggaggagctgagctccaccgtgcgccagaacgccgacaacgcgcgccatgccaaccagctcgcgcaaagcgccagcgccgtggccgtccaaggcggcgaagctgtggcccaggtggtcaacaccatgaccggcatcaacgaaagctcacgcaagatagccgacatcatcggcgtcattgacggcatcgccttccagaccaatatcctggccctgaatgccgcggtcgaggccgccagagcgggtgaacacggtcgcggctttgccgtggtggccgccgaagtgcgcagcctggcccagcgcagcgccgaggctgccaaggaaatcaagaccctgatcagcgacagcgtgggccgggtcgagcaaggcagcgccctggtggaccgggtcggcgccaccatgaaagaggtcgtggacagtatccggcgcgtgaccgacatcatgggcgagatcagcgcggccagcaccgagcagagccagggagtagcgcaggtgggtgaggccgtcaccaatatggaccaggtcacgcagcagaatgcggcgctggtcgagcagatggccgcggcggcctccagcctgaagggccagtccgaggagctggtgcagacggtggcggtgttcaaactggcgggtgaaggcagttctgacccggctgcctacgcacaaggccagtcgcatggaagaactgctgccgcatcggttggcagaccaccgacatcctga

SEQ ID NO: 20635 - protein, 473 aa, Burkholderia cepacia
MQMALAMQRASSGDTAPAVGKDLLLKPIKHGQWLAAQVDVELFKVEQGLFRLFGFGGVLDLPSKDIGDLERMKKIIELEPGSTVSPALVERLRPDMAVVQDGSERFAPLVAEAVGFIKALVFSINLLGGLVLLASFWAIRKAVLGPLEEALRLAGQIAQGDLTGQIVTRSNDEVGQLITALADMQGSLSSMVAHVRQNAESLEAASSEIAQGNHDLSARTESQASALEETAASMEELSSTVRQNADNARHANQLAQSASAVAVQGGEAVAQVVNTMTGINESSRKIADIIGVIDGIAFQTNILALNAAVEAARAGEHGRGFAVVAAEVRSLAQRSAEAAKEIKTLISDSVGRVEQGSALVDRVGATMKEVVDSIRRVTDIMGEISAASTEQSQGVAQVGEAVTNMDQVTQQNAALVEQMAAAASSLKGQSEELVQTVAVFKLAGEGSSDPAAYAQGQSHGRTAAASVGRPPTS

SEQ ID NO: 20636 - DNA, 1632 bp, Ralstonia solanacearum
  CDS (1)..(1632)
atgagaatctcggatatgaggatcggggtacggctcggtgcagcgttcgcgcttgtcgtggcgttgctgatcgggatcgccgcggtcggcatacaacggctggacgacaacaacacgaagatgggccagatcgtgagcgagcgctactcactgatcgcgctgagcaaccagatcaagaacaacggctacaaggccaacggcattctcagcaatctgctgctcgtcaccacgcccgagcagaagacgaagtacatgagtgactacgcggccatccgccaggccaacgcgcaggcatatggccgcctggagaagctgctcacgaccgatcagggcaaggcgctcttcaaagaacagttcgatgcgcgttcagcctacggtgccagcgtccgcaagttcttcgcgctggtcgatgccgacaacgtgcaggaggcgcgtgccctgtaccagggtgacatgtcgcgcctgcaagaccggtactacgtgctggtcgacaagatggtcgaccaccaggccggcgagatggagcacgatgtgagcgaggctgccgcccagggcgccaacgccaagatccagatgatcgtgctggccgttcttgccacgctgctggccattgccacgggggccttcatcacccgcaccatcacgcgcccgattaaccatgccatgcacctggctgaggccgtggcgcagggcaatctgacgcatctgctggaggtcgacacgcaagacgagatcggccgtctgctggcggcgctcaagcacatgatcgaaaacctgcacggcattgtcagccaggtgcggggcggcacggacaccatcacccgcgcatcgagcgaagtggccagcggcaacatcgatctctcgagccgtaccgaacagcaggccagctcactggaggaaacagcggcggccatggagcagctcacctccaccgtcaagcagaacgccgacaacgcgcaggaggccagccgcctggcatccaatgcgtcgatggtcgccaccaagggcggcgatgccgtggacgaggcgatccagaccatgagcacgatcaacacgtcgtcgcgcaagatcgtcgacatcatcggcgtgatcgacggcattgccttccagaccaatatcctggcgctcaacgctgcggtggaagccgcgcgcgccggcgagcagggtcgcggctttgccgtggtggctggcgaggtgcgcagcctcgcgcagcgcagcgcagcagcggccaaggagatcaaggcactcatcgaggattccgtcggccacgtcagcaccggcacggccaaggtggaagaggccggccagatcatccgcgacgtggtggccggcatccagaatgtgacgaacatcgtgtccgagatcagcgcatcgagccgcgagcagagcgacggcatcgaacagatcaacgaggccatcacgcagatggacaaggccacgcaggaaaacgcctcgctggtggaggaaagcgccacggcggcgcaggccctgcaggaccaggccaatcaactggccgacatggtcagcaccttcaagctccacgcagacctgtctggccgtggccgcgccgcgcaaggcgaggcaggctctgtggcacacgtcgcctggagtcaagcgcaaacgctttcgtag

SEQ ID NO: 20637 - protein, 543 aa, Ralstonia solanacearum
MRISDMRIGVRLGAAFALVVALLIGIAAVGIQRLDDNNTKMGQIVSERYSLIALSNQIKNNGYKANGILSNLLLVTTPEQKTKYMSDYAAIRQANAQAYGRLEKLLTTDQGKALFKEQFDARSAYGASVRKFFALVDADNVQEARALYQGDMSRLQDRYYVLVDKMVDHQAGEMEHDVSEAAAQGANAKIQMIVLAVLATLLAIATGAFITRTITRPINHAMHLAEAVAQGNLTHLLEVDTQDEIGRLLAALKHMIENLHGIVSQVRGGTDTITRASSEVASGNIDLSSRTEQQASSLEETAAAMEQLTSTVKQNADNAQEASRLASNASMVATKGGDAVDEAIQTMSTINTSSRKIVDIIGVIDGIAFQTNILALNAAVEAARAGEQGRGFAVVAGEVRSLAQRSAAAAKEIKALIEDSVGHVSTGTAKVEEAGQIIRDVVAGIQNVTNIVSEISASSREQSDGIEQINEAITQMDKATQENASLVEESATAAQALQDQANQLADMVSTFKLHADLSGRGRAAQGEAGSVAHVAWSQAQTLS

SEQ ID NO: 20638 - DNA, 1545 bp, Ralstonia solanacearum
  CDS (1)..(1545)
atgcgcgtcaacgaacccgttacccagcgtgaatatgagttcccggacaacgcgacgctcatgtcgaccaccgatacgcagagctacattgcctatgcgaatgcggcgttcgtcgacgtcagcggtttttcccgggaggagatcgagggccagccgcacaatatcgtgcgccacccggacatgccgcccgaggcgtttgccgacatgtgggccacgctcaagggcggcgagccctggagcgcgctggtcaagaaccgccgcaagaacggcgatcactattgggtgcgcgccaatgccacgccggtggtgcgcaacgggcggccggccggctacatgtccgtgcggaccaagcccacgcgcgacgaggtggcggcggccgaggcgctctaccgcgatttccgcgccggccgggccggcagccgcaccttccacaagggcctgatcgtgcggaccgggctgatggcctggcgctcggtcttccaggtcatgccggtgcgctggcgcatccgcctggcgttcatggtgctgctgccgctgacgctgggggcggcctggggcgcgggcttgtccggcgcggcgctcggcggctttgccgccgcgcaggcggtggcgctggcgctgggggccgggtggctgcaggcgcagatcgcccggccgctcgaacagacgctgcagcaggcgctgcgcgtggcgtcgggcgagagccagaaggcggtgctcatggaccgcgtcgacgagatcggcatgacgctgcggaccatcagccagctcggcctgatgtttcgctggctgatcgacgacgtcagcgaacaggtgctcaacgtccaggccgccagccaggagatcgcccaggacaacagcgacatcaacgcgcgcaccgagcaggcggcctccagcgtgcagcagacctccagctcgatgacgcagatgacggccaccgtggccagcaacgccgagaccgcgggcgaggccaaccagctctcgggcgccgcgaccgaggcggccgtcaacggcggccgcgccatggccgaggtggtcgccaccatggagtcgatctcgcagagcgccaaccagatcgccgacatcatcggcgtgatcgacagcattgcgttccagaccaatatcctggcgctcaacgcggcggtggaggcggcgcgcgcgggcgagcagggccggggtttcgcggtggtggccggcgaggtgcgggcgctggcgcagcgcagcgccagcgcggcccgggagatcaaggatctgatcggcgccagcgtgggcaaggtggcgtccggctcgcggctggtcggcgaggccggcaagaccatggatgacatcgtcagccaggtcaagcgcgtctcgggcatgattgccgagatcagcctggcgaccgcggagcagaccgacggcatcatgcaggtgagtcaggctgtcacgcacctggaccagatcacgcaggagaacgccacgctggtggagcagagcgccctggcggcggagagcctgcgggtgcaggcgacccgtctcgtggaagccgtcggcgtgttccgctga

SEQ ID NO: 20639 - protein, 514 aa, Ralstonia solanacearum
MRVNEPVTQREYEFPDNATLMSTTDTQSYIAYANAAFVDVSGFSREEIEGQPHNIVRHPDMPPEAFADMWATLKGGEPWSALVKNRRKNGDHYWVRANATPVVRNGRPAGYMSVRTKPTRDEVAAAEALYRDFRAGRAGSRTFHKGLIVRTGLMAWRSVFQVMPVRWRIRLAFMVLLPLTLGAAWGAGLSGAALGGFAAAQAVALALGAGWLQAQIARPLEQTLQQALRVASGESQKAVLMDRVDEIGMTLRTISQLGLMFRWLIDDVSEQVLNVQAASQEIAQDNSDINARTEQAASSVQQTSSSMTQMTATVASNAETAGEANQLSGAATEAAVNGGRAMAEVVATMESISQSANQIADIIGVIDSIAFQTNILALNAAVEAARAGEQGRGFAVVAGEVRALAQRSASAAREIKDLIGASVGKVASGSRLVGEAGKTMDDIVSQVKRVSGMIAEISLATAEQTDGIMQVSQAVTHLDQITQENATLVEQSALAAESLRVQATRLVEAVGVFR

SEQ ID NO: 20640 - DNA, 1575 bp, Ralstonia solanacearum
  CDS (1)..(1575)
atgctcatgtggaagtggatggactccagtatccggacacgcctgacggtgctcgtcgccgcctttgccgtgatggtcgcggcggtgggcggcaccggcatcgccaccggccgggccaccaacgccgatttgcgcgccgtctacctggaagatgccaagggcctcgacctgctggccaaggacacggccaacctgctgtgggcgcgcatccacctgaccaacttcgattcggtgtcctcgccggaagaactggccaagctgctcaaggacgcgcacgcgatggtcgatgcggccaatgcggcgtgggcggcgttcacgcaactgcccatccccgacgccgaccgggcccaactgcaggccgccgatgccgcgcgcgcccggttcgtcaagaccgcgctggaaccggccatcaccgcgctggagcgcagcgacctgaccacctaccgagatctgaacaccacccaggtgccgcagctgttcgcggtctatgacgccgcgctgcagccgctggtcaaggcgcgcttcgcttacggccaggcccgtttcgaccgttcgcagtcgcgctacgccgcgagcgtctggctctcgggcggcctgctgctggccgcgctggtgctgtcggtggtggcgcgcggcgtgttgggccgcacgctggtgcggccgctggagcgggccatccacgtgttcgagcgcatggccgcgggcgatctcgccacccgcatggacgagcccacccgcgccggccgccgcgatgagaccgcgcgcctgatgcacgccgtggcgtcgatgcagtcgagcctgcagaagatggtcggacaggtccgcaccggctccgactcgatcgccagcgccaccaagcagatcgccgccggcaacgccgacctgtcgcagcgcaccgaacagcaggcttcgtcgctggaggaaaccgcctccagcatggaggagctgacctcgatcgtgaagcagaacgcggacaacgcgcgccaggcgagcacgctggcggtcaacgcctccgatgtggcggtcaagggcggcgaagtggtcggccgcgtggtcgagaccatggccggcatcaacggcagcagcaagaagatcgccgacatcatcggcgtgatcgaagggattgcgttccagaccaacatcctggcgctgaacgcggcggtggaagcggcccgggccggcgagcagggtcgcggcttcgcggtggtggcgggcgaggtgcgcagcctggcgcagcgctcggcgggggcggccaaggagatcaaggaactgatctcggattcggtcgaccgcgtgcagaatggctcgaagctggtggccgaggccggcacggtgatcgacgaagtggtggtggcggtcaagcgcgtgacggacatcatgggcgagatcagcgcggcatccgacgagcagagctcgggcatcgagcaggtcaaccaggcggtgaaccagatggacgaggtgacgcagcagaacgcggcgctggtggagcaggccgcggccgccgccgaatcgctggaggcgcaggccgaagcgttgcggcaggcggtctcggcgttccgcgtcgggcacgcttga

SEQ ID NO: 20641 - protein, 524 aa, Ralstonia solanacearum
MLMWKWMDSSIRTRLTVLVAAFAVMVAAVGGTGIATGRATNADLRAVYLEDAKGLDLLAKDTANLLWARIHLTNFDSVSSPEELAKLLKDAHAMVDAANAAWAAFTQLPIPDADRAQLQAADAARARFVKTALEPAITALERSDLTTYRDLNTTQVPQLFAVYDAALQPLVKARFAYGQARFDRSQSRYAASVWLSGGLLLAALVLSVVARGVLGRTLVRPLERAIHVFERMAAGDLATRMDEPTRAGRRDETARLMHAVASMQSSLQKMVGQVRTGSDSIASATKQIAAGNADLSQRTEQQASSLEETASSMEELTSIVKQNADNARQASTLAVNASDVAVKGGEVVGRVVETMAGINGSSKKIADIIGVIEGIAFQTNILALNAAVEAARAGEQGRGFAVVAGEVRSLAQRSAGAAKEIKELISDSVDRVQNGSKLVAEAGTVIDEVVVAVKRVTDIMGEISAASDEQSSGIEQVNQAVNQMDEVTQQNAALVEQAAAAAESLEAQAEALRQAVSAFRVGHA

SEQ ID NO: 20642 - DNA, 1542 bp, Ralstonia solanacearum
  CDS (1)..(1542)
atgaaccgactcacgcttcggcagaagctgtggcttccgctcgtcctgagctggctgggattgctggcgatcacgctatggagtgcctggagcgcacgcacgctgcgcatggaagagcggcagcgcgacctgcagaatgtgagcgccacggcattcagcgtcatcaaggaatacggccagctcgcgcaggaaggcaagatgacggtggaagaggccaaggcgcagacgatggcccgcttgaaaaccatgcgctatggcgccgacggctatttctcgctgtcgaccacggatgcggtctcggtcatgcatccgatcaagccggaaatggtcggcaagaacatgtccgccgtcaccgatccggccggcaatcacctgttcaccgacatcgcccgcaccgccaaggccggcggcgggttcgtgcgctatctgtggccgaagcccggcagcagcaccccggagcccaagctgacctacgtcgcgtactaccagccctgggactggtccatgacgaccggcctgtatatcgacgacgtcgacgcggcgttccgcgcctcactgctgcagtcgttggggctgctgctgggcgtcggcctgctgatgacgctcgtggtggcgacgctcgcgcggggcctgcagcgccagttgggcggggatccggcctatgccgccgatatcgcggcgcggattgccgcgggcgatctggccatgcgcgtcgaaacccgtccgggggatcgcgacagcgtcctgttcgccatggcgcagatgcagcgggaactgacgggcaccatcagccacatcaagcattcggcggattcgatcgccagcgccacccagcagatcgccgccggcaacgccgacctgtcgcagcgtaccgaacagcaggcttcgtcgctggaggaaacggcctccagcatggaggagctgacctcgatcgtgaagcagaacgcggacaacgcacgccaggcgagcacgctggcggtcaatgcctcggacgtcgcggtcaagggcggcgaagtggtgggccgcgtggtcgagaccatggccggcatcaacgacagcagcaagaagatcgccgacatcatcggcgtgatcgagggcattgcattccagaccaacatcctggcgctgaacgcggcggtggaagcggcccgggccggcgagcagggtcgtggcttcgcggtggtggcgggcgaggtgcgcagcctggcgcagcgctcggcgggggcggccaaggagatcaaggaactgatcggcgactcggtcggccgtgtccggaacggcactgcgctggtggaggaggccggggctgtgattgatgaggtcgtcgtggccgtcaagcgcgtgacggacatcatgggtgagatcagcgccgcatcggccgagcagagctcgggcatcgagcaggtcaatcaggccgtgaaccagatggatcaggtgacgcagcagaacgcggccctggtggagcaggcagcggccgccgcattgtcgctggaagagcaggcgcaggtgttgcgtacggcagtgggccgcttccagatgtaa

SEQ ID NO: 20643 - protein, 513 aa, Ralstonia solanacearum
MNRLTLRQKLWLPLVLSWLGLLAITLWSAWSARTLRMEERQRDLQNVSATAFSVIKEYGQLAQEGKMTVEEAKAQTMARLKTMRYGADGYFSLSTTDAVSVMHPIKPEMVGKNMSAVTDPAGNHLFTDIARTAKAGGGFVRYLWPKPGSSTPEPKLTYVAYYQPWDWSMTTGLYIDDVDAAFRASLLQSLGLLLGVGLLMTLVVATLARGLQRQLGGDPAYAADIAARIAAGDLAMRVETRPGDRDSVLFAMAQMQRELTGTISHIKHSADSIASATQQIAAGNADLSQRTEQQASSLEETASSMEELTSIVKQNADNARQASTLAVNASDVAVKGGEVVGRVVETMAGINDSSKKIADIIGVIEGIAFQTNILALNAAVEAARAGEQGRGFAVVAGEVRSLAQRSAGAAKEIKELIGDSVGRVRNGTALVEEAGAVIDEVVVAVKRVTDIMGEISAASAEQSSGIEQVNQAVNQMDQVTQQNAALVEQAAAAALSLEEQAQVLRTAVGRFQM

SEQ ID NO: 20644 - DNA, 1575 bp, Ralstonia solanacearum
  CDS (1)..(1575)
atgcaagccatcatgcactcggtgcggttcaagattctgtgtgccttcggcgtgtgcattgcgctgctggccatcagcggcatatttgccgtgcgcggcttgatgcggctcaacggcaatatcacggacgcctataccggcaataccattcccatcgcccaattggccgaagtgcgggcaacacagctcgacctgcgcctgcaaatgcgccgcacgcaggcgctcaaggacgatgcggccgaggtcacggcggcgatccaggccatccgcacggacgtggagcagaccaaccgagtctggaagcaatacttcccggacagcatcacgagcgacaaggaacgcgaggtcgccacgaagatcaacgacacgctgcccaagttcaatgacgccgcgaacaaggcggtcgatgcgctgcgggccggcaatttagacgccgccgggcagatcatcaacggcaactcggccaccggcacgtcgatcagcgaatggctggcgcaggatatcgagatcaacctggagcaggccaaggacttcatgaccgacagcgctgcaacgtatcagcgcatcctgctggtcaccatcgcgctggtctgcgcggggatcgtggtcggcggggccatgtcgtggtatctgctgcgtgcgatttcgcgcccgctgagccgcgcggtcgatgtcgccaaccacatcgccggcggcacgctcgagaacgagatcgtgatcgactcgcagggcgagttcggcgagctgctcatcgccctgcgcaagatggaccgccaactggccgataccgtgcgcggcatcaaggcctcggccgaatcggtgacggtggcctcgcaggagatcgcggccggcaacgtcgacctgtcggcgcgcaccgagcagcaggcggcctcgctggaagagaccgcgtcgagcatgacgcagctgaccgagacggtcaaacagaacgcggagaacgcggcccaggccaatacgctggccgctagcgcgagcaccatggcccaggcaggcaacgatgccgtgcaggagatggtcggcacgatcgacaagatcagcaccagctccggcaagatctccgagatcaccggcctgatcgaaggcatcgccttccagaccaacatcctcgccctcaacgccgcggtggaagccgcgcgggcgggcgagcagggccgcggcttcgccgtggtggcgagcgaggtgcgcacgctggcgcagcgttcggccgcggcggccaaggagatcaaggaactgatcggctcgtcggtcgccgtggtgcaggaaggctccaagcaggcggtcgaggtcgggcagaacatgggccaggtgaaggaggcgatccgccgggtctccgatatcgtctccgaaatcgcggcggcttcggccgagcagagccggggcatcgagcaggtcaaccaggccgtcacgcagatggacgaggttacgcagcagaacgcggcgctggtcgagcaggcggccgcggcggcgcagtcgctcgaagagcaggccacgagcctgcgccgcgcggtctcggtgttccgcctgccggacggcacgacgcgcaccgcgctggcctga

SEQ ID NO: 20645 - protein, 524 aa, Ralstonia solanacearum
MQAIMHSVRFKILCAFGVCIALLAISGIFAVRGLMRLNGNITDAYTGNTIPIAQLAEVRATQLDLRLQMRRTQALKDDAAEVTAAIQAIRTDVEQTNRVWKQYFPDSITSDKEREVATKINDTLPKFNDAANKAVDALRAGNLDAAGQIINGNSATGTSISEWLAQDIEINLEQAKDFMTDSAATYQRILLVTIALVCAGIVVGGAMSWYLLRAISRPLSRAVDVANHIAGGTLENEIVIDSQGEFGELLIALRKMDRQLADTVRGIKASAESVTVASQEIAAGNVDLSARTEQQAASLEETASSMTQLTETVKQNAENAAQANTLAASASTMAQAGNDAVQEMVGTIDKISTSSGKISEITGLIEGIAFQTNILALNAAVEAARAGEQGRGFAVVASEVRTLAQRSAAAAKEIKELIGSSVAVVQEGSKQAVEVGQNMGQVKEAIRRVSDIVSEIAAASAEQSRGIEQVNQAVTQMDEVTQQNAALVEQAAAAAQSLEEQATSLRRAVSVFRLPDGTTRTALA

SEQ ID NO: 20646 - DNA, 1557 bp, Ralstonia solanacearum
  CDS (1)..(1557)
atgacccgcttgaagatcgggctcaggcttggcgtggcattcggctttgtggtcttgctggggttgctgacggcggcgctggccgtcgcacggctcaacgccaccagcggcgacatcgaacagatcgccagcagcctctatccgaagacggccctgatcaacaccatgaagatcaacgccgccagcatggcctcgctgctgcgcgacgcctggatcgcgccggatgccgcggccgccaaggtgccgctgcagaagctgatggagctgcgtgacgtcagcgtgaagctgcgtgacgatttgcagaagcggatccgtacccaatccggccaggacctgttcaagcggctgcaggacacgcaggagcgctacggcgccctgcgcgcccgcgtcatcgccgccatcaacgccggcgacaaggaagcggcgcgagacctcctgctgaccgagatgcccgccgtgcagtcgacctacttcgatgcgctcgacgccctggtcgcgtatcagacgcaactcatggtggacaccacgggccgcgcgctcaccgcgtccgagcgcgcggccatcctgctgctcgtcatggcggcggcggcggccgtgctggcggtcttcgcgggggtgtggatcacccgctcgatcgtccggccgctggaccaggccttgcacctggcggacaacgtggcccagggcgacctgtcgacccgcatcgattcgcgcgccgccgacgagaccggccagctggtgcgcgcgctcgaatcgatgcgcgcgaacctcgccacgatcgtgcaggaagtgcatgagagcacggacaccatcgcaaccgcctccgggcaggtggccgccggcagcaccgacctgtcgtcgcggaccgagcagcaggccgcctcgctggaggagaccgccgccagcatgaccgagctcaccgaaaccgtccgccgcaacgcggacaacgcccgggaagccagcacgctggccacggcagcggccagcgtggccaccgacgggcaggccgccatcggccgcctcaacgacaccatgcaccgcatgcacgaagactccggcaagatcgccgacatcacgggcgtgatcgagggcattgccttccagaccaacatcctcgccctcaatgccgccgtggaagcggcccgcgccggcgaacaggggcgcggcttcgcggtggtggccggcgaggtccgcagcctggcgcagcgcgcctcggcggcggccaaggagatcaagcagctgatcgagcgctcggtcagcggcatgcatgaaggcaaggaggccacgcgggccgtcggcaccaccatcgaccgcatcgagaccgaaatcggccgcgtggcgcagatcgtcgtgaccattgccgatgcatcggaagagcagcgcagcaacatcgagcatgtcggccaggccgtccagcagatggacgaggtcacgcagcagaacgcggcgctggtcgagcaggccgccgccgcggcgcagtcgctggaagagcaggccgcgcagctgaagacctccgtggcggtgttccggctggcgcccgggccgtcggcctggtga

SEQ ID NO: 20647 - protein, 518 aa, Ralstonia solanacearum
MTRLKIGLRLGVAFGFVVLLGLLTAALAVARLNATSGDIEQIASSLYPKTALINTMKINAASMASLLRDAWIAPDAAAAKVPLQKLMELRDVSVKLRDDLQKRIRTQSGQDLFKRLQDTQERYGALRARVIAAINAGDKEAARDLLLTEMPAVQSTYFDALDALVAYQTQLMVDTTGRALTASERAAILLLVMAAAAAVLAVFAGVWITRSIVRPLDQALHLADNVAQGDLSTRIDSRAADETGQLVRALESMRANLATIVQEVHESTDTIATASGQVAAGSTDLSSRTEQQAASLEETAASMTELTETVRRNADNAREASTLATAAASVATDGQAAIGRLNDTMHRMHEDSGKIADITGVIEGIAFQTNILALNAAVEAARAGEQGRGFAVVAGEVRSLAQRASAAAKEIKQLIERSVSGMHEGKEATRAVGTTIDRIETEIGRVAQIVVTIADASEEQRSNIEHVGQAVQQMDEVTQQNAALVEQAAAAAQSLEEQAAQLKTSVAVFRLAPGPSAW

SEQ ID NO: 20648 - DNA, 1803 bp, Ralstonia solanacearum
  CDS (1)..(1803)
atgctgaaccgactttccatccgcttccgactcaacgccgcccttgtgctgcttggcgcactgctcgccatcatcggcaccatcggcgtgatcggcatgcgcgcctccgacgcgaacatccgcgagatctacagcaatcagctcgcctcgacctcgctggtctccaaggcccagctgaacgccgccgtgatccggaccacgctggaccgcgcggtgttccatatcgatgctgccgatgtgccggccgtcatcgacaaggccgccgcgtaccgcgccaagtccgaggacgcctggaaacagtacaagggcctgccgatgagcgccgacgaggcccgcctggccgccgacgtcgacgccaagcgcaccaccctgttccgcgacggcatcgagccgctggtcaccgcgctgcgtgctcgcgatgccgccgccgtcgacaaggcggtgatgaccgtgattccgccgatgttcgtcgcgctgtcggccgccgtggatgcgctggaccgcaaccaggccgaacaggccaaggctgcctacgagggggctgtgacgcgttcgcagaacttcctgtggctgatcatcggtgccatcgtggtggggattctctcggcggtggcctgtgcgttcggcctggaccgggcgatctcggtgccgctgagccgcatgctcggcagtttcggtgagatctcgcgtggcaacctcaccgagcagatcgtcgtcaccagccaggacgagatgggcgcgctcacgcgcggcttgcaggacatgcagcgcgggctgatccggaccatcgagacgatgcgcggcggcagcgattcgatcgccagcgccaccaagcagatcgcggccggcaacatggatctgtcgcagcgcacggaagagcaggccagctcgctggaagaaacggcctccagcatggaagagctgacctcgatcgtgaagcagaacgcggacaacgcgcgccaggcgagcacgctggcggtcaacgcttcggacatcgcggtcaagggcggcgaggtggtgggccgcgtggtcgagaccatggccggcatcaacgacagcagcaagaagatcgctgacatcatcggcgtgatcgagggcattgcattccagaccaacatcctggcgctgaacgcggcggtggaagcggcccgggccggtgagcaggggcgtggcttcgcggtggtggcgggcgaggtgcgcagcctggcgcagcgctcggcgggggcggccaaggagatcaaggagctgatctcggactcggtcggccgggtcgagaacggcaccacgctggtggccgaggccggcacggtgatcgacgaagtggtggtggcggtcaagcgcgtgacggacatcatgggcgagatcagcgcggcgtcggacgagcagagctcgggcatcgagcaggtcaaccaggccgtgaaccagatggatgaggtgacgcagcagaacgcggcactggtggaagaggccgcggcggccgcgcaatcgctggaagagcaggcgcgcctgctgcgcgagacggtggcctcgttccgcctgccgcaaggcggcggcgaggtgcgtgccgccgcgccggccgtgcgtgccgtggcggcggccaagcctgccgcagcggcgaccgtcgccaggccggcggtccgcaagccggctgcaacggtgcgtgcgcgtgcgccgcgcaaacccgctgccgaggcaccggttgccaaggcggcatcatcgccggcgccggcgccggcggaaccggccggcggcaagctggccctgtcggcggcggtcgatcaggatgactggacccagttctga

SEQ ID NO: 20649 - protein, 600 aa, Ralstonia solanacearum
MLNRLSIRFRLNAALVLLGALLAIIGTIGVIGMRASDANIREIYSNQLASTSLVSKAQLNAAVIRTTLDRAVFHIDAADVPAVIDKAAAYRAKSEDAWKQYKGLPMSADEARLAADVDAKRTTLFRDGIEPLVTALRARDAAAVDKAVMTVIPPMFVALSAAVDALDRNQAEQAKAAYEGAVTRSQNFLWLIIGAIVVGILSAVACAFGLDRAISVPLSRMLGSFGEISRGNLTEQIVVTSQDEMGALTRGLQDMQRGLIRTIETMRGGSDSIASATKQIAAGNMDLSQRTEEQASSLEETASSMEELTSIVKQNADNARQASTLAVNASDIAVKGGEVVGRVVETMAGINDSSKKIADIIGVIEGIAFQTNILALNAAVEAARAGEQGRGFAVVAGEVRSLAQRSAGAAKEIKELISDSVGRVENGTTLVAEAGTVIDEVVVAVKRVTDIMGEISAASDEQSSGIEQVNQAVNQMDEVTQQNAALVEEAAAAAQSLEEQARLLRETVASFRLPQGGGEVRAAAPAVRAVAAAKPAAAATVARPAVRKPAATVRARAPRKPAAEAPVAKAASSPAPAPAEPAGGKLALSAAVDQDDWTQF

SEQ ID NO: 20650 - DNA, 1548 bp, Ralstonia solanacearum
  CDS (1)..(1548)
atgaaaacgctctcgatcaaggccaggctggccctggtgctcttcgttctggctgtcttcctcgcgggcgtgggcgcgctcgggctggtcggcaatctgcgctctaacgcggcgctgaaagaaacctattccaacaacctggcgtccacgcgcgcgctcggcctggccgaggccaagctggcccaggcgcgcacggcgctggaccgcgccatcttcgaaaccgatcccgccaagaccaccgatgccatcagccgcatccaggcgcagatcggcaacagcgagaaggcctgggcggaatacctgaacctgccgttctccacgcccgaagaggagaaggtggccggcgaggccaagaagcagcgcgacctcatcatcaaggacaacatcgccgccgccgtcgaggcgctcaagcgtggcgacaaggacgcggcacgccagctggcggtggagcagattccctataacttccgcacctatgcgtcgcagtccgaccggctcaacgcgatccagacggaagtgtcggccgccttgtacgaggcgtcgcagtcgttcttcaaggggctggtctggaccttcgtgatcgtcatcgccgcgggtctggcgctggcggcgggctgctacctgatcctgtcgcgtgccatctcgctgccgctggccgagatgctggtgcacttccgcgagatcgcctcgggcaacctgacgaccgacgtgcgcgtgcgctcgcgcgatgaaatgggcgtgctgatggaaggcctgcagcagatgcaggacaagctgaaggcgaccgtgctgacggtgcgccacggcagcgagtcgattgcttcggccacgcagcagatcgccgcgggcaataccaacctgtcgcagcgcacggaagagcaggccagctcgctggaggaaaccgcgtcgagcatggaagagctgacttccatcgtcaagcagaacgccgacaacgcccgccaggccagcacgctggccgagaacgcctccggcatcgccatgcagggcggcgcggtggtgcaggacgtggtgacgacgatggcgcagatcagcgaatcgtcgcgcaagatcaccgacatcatcgccgtgatcgaaggcatcgccttccagaccaacatcctggcgctgaacgccgcggtggaagcggcgcgggccggcgagcaggggcgcggcttcgcggtggtggccggcgaagtgcgcacgctggcgcagcgcagcgcgggcgcggccaaggaaatcaaatcgctgatcgaggattccgccacccgtgtggaatcggggtcgtcgctggtggcgcgtgccggcaagacgatggacgagatcgtcgtggccgtgaagcgcgtgaccgacatcatgggcgagatcagcgccggctcggccgagcaaagcaccggcatcgagcagatcaatgaagccgtcacgcagatggacgacgtgacgcagcagaacgccgcgctggtcgagcaggccgctgccgcggcccaggcgctggaagagcaggccgacgagctgcgccgcgcggtgtcggtgttccgcgtggcggcctga

SEQ ID NO: 20651 - protein, 515 aa, Ralstonia solanacearum
MKTLSIKARLALVLFVLAVFLAGVGALGLVGNLRSNAALKETYSNNLASTRALGLAEAKLAQARTALDRAIFETDPAKTTDAISRIQAQIGNSEKAWAEYLNLPFSTPEEEKVAGEAKKQRDLIIKDNIAAAVEALKRGDKDAARQLAVEQIPYNFRTYASQSDRLNAIQTEVSAALYEASQSFFKGLVWTFVIVIAAGLALAAGCYLILSRAISLPLAEMLVHFREIASGNLTTDVRVRSRDEMGVLMEGLQQMQDKLKATVLTVRHGSESIASATQQIAAGNTNLSQRTEEQASSLEETASSMEELTSIVKQNADNARQASTLAENASGIAMQGGAVVQDVVTTMAQISESSRKITDIIAVIEGIAFQTNILALNAAVEAARAGEQGRGFAVVAGEVRTLAQRSAGAAKEIKSLIEDSATRVESGSSLVARAGKTMDEIVVAVKRVTDIMGEISAGSAEQSTGIEQINEAVTQMDDVTQQNAALVEQAAAAAQALEEQADELRRAVSVFRVAA

SEQ ID NO: 20652 - DNA, 1590 bp, Ralstonia solanacearum
  CDS (1)..(1590)
atgcgaaacaatctcccggtcaccgacgccgaaaccaccctcgcccccgccgactacctgatctcccgcaccgacccggccggccgcatcgtcttcgccaacccggccttcgtgcgcatcagcggcttcaccgaagccgagctgatcggcgcgccgcacaacgtggtgcgccaccccgacatgcccgaggccgcattcgccgacctgtgggccaccctgcgctcggggcagtcgtggcgcggactggtcaagaaccggcgcaaggacggcggcttctactgggtgcaagccaacgtgacgccggtgctccaggacggcgcgatcgcgggctacacctcggtgcgctcgatggcgacgccggcgcagatcgcacgcgccgggcgggtctatgccgccatccgcgcgggcgatgcgtcatacgcggtgcgctcgggacgcatcctgcgcacgggctggcggcgcctgttcaacctgttccggatcgacagcctgcgcttgcgtgtgatcggcctgcagagcctgatcgccgtggccatcctgatcggcacgctgtgggcgcacctggcgctggaagccgccgacctgcgcggcatgccgtggctggtgctctcgcgcgactggctgtggctcaccggcgtgggctgcgccgggctggcgacgctgtccggcctgctgctggcgcgcacgctgatccgcccgctggagcaggccgccgcgctcgccacccgcctggcggccggcgacctcacctccacgctggaggcccgcggcaacgatgagatcggcgacgtggtgcgcgccatgggcacgatgcgcgcgagcctgtggtccatcgtgcgggacatccaggacggcgcggccaacgtggcgcacagtaccctgcagatctcggccggcaaccacgacctgtcggcgcgcaccgagcagcaggccgccgcgctgcaggagacggcctccagcatggagcagctcacgtcgatggtggcccgcaatgccgaccatgcgcgcgaagccagcgtcctggccgaacaggcctcctccgtcgcgacggacggcgggcggatcgtgcagcgcgtggtcgacaccatgggcgccatccgcggctccagccggcacgtcacggacatcatcgccaccatcgagagcatcgccttccagaccaacatcctcgcgctcaacgccgccgtggaggcggcccgcgcgggcgaggaagggcgcggcttcgcggtggtggcgggcgaggtgcgcagcctggcgcagcgcagcgcccaggctgccgcgcagaccaaggcgatcatccaggcctccgaccagtcggtgcgcgacggcgaagccctcgtgcagcaggccggcgcgaccatgcagcagatcgtcgcgtccgtgcagaccgtgacgcagctgatatcggaaatctcggccagttcgcgcgagcagagcagcggcatcgcgcagatcaacacctcggtatcgcagctcgatggcgtgacgcagcagaacgccacgctggtggagaaagcggcggcggccgcgtcggtcctggccggccaatcggaagcgctcaagcgcgccgtggcggtgttccgcgcctga

SEQ ID NO: 20653 - protein, 529 aa, Ralstonia solanacearum
MRNNLPVTDAETTLAPADYLISRTDPAGRIVFANPAFVRISGFTEAELIGAPHNVVRHPDMPEAAFADLWATLRSGQSWRGLVKNRRKDGGFYWVQANVTPVLQDGAIAGYTSVRSMATPAQIARAGRVYAAIRAGDASYAVRSGRILRTGWRRLFNLFRIDSLRLRVIGLQSLIAVAILIGTLWAHLALEAADLRGMPWLVLSRDWLWLTGVGCAGLATLSGLLLARTLIRPLEQAAALATRLAAGDLTSTLEARGNDEIGDVVRAMGTMRASLWSIVRDIQDGAANVAHSTLQISAGNHDLSARTEQQAAALQETASSMEQLTSMVARNADHAREASVLAEQASSVATDGGRIVQRVVDTMGAIRGSSRHVTDIIATIESIAFQTNILALNAAVEAARAGEEGRGFAVVAGEVRSLAQRSAQAAAQTKAIIQASDQSVRDGEALVQQAGATMQQIVASVQTVTQLISEISASSREQSSGIAQINTSVSQLDGVTQQNATLVEKAAAAASVLAGQSEALKRAVAVFRA

SEQ ID NO: 20654 - DNA, 1548 bp, Ralstonia solanacearum
  CDS (1)..(1548)
atgcgcaactggaccgtcaagagaaagcttgccaccctggtcgcctcgatcatcattgccttcgtgtgcctgaccgtcttcctgctcgggcgccaggccgccgcgacggcggacatccggagcctgtacgacaaggactatcgcgcggcgtcgatcatcggccagatcgacgggctgctcacccgcgtggatatcaacatcctgcggatgatcgccatcggcgatccggcttccatctcgggctggaaggcccagaacacggagcgtttcaacaaggtcgaccaactgctggtggagttggacgcatcggccgacccgagcatggcggcatcgatcaagaccctgggcgaggcctatggccgcatgcgcaagggcatggagcaccaggtcgaggcggtcgaggcgggtgatatcaagcgcggcggcgagatcaacaagaacgaggtcaaggacaacgccgacaagacgttcggcacgctggccgagctcaagagcgcgcaggacctgatcgccaagaacaaggtccaggcccaggaagcggcggcggcattggcccgcgtggtctcgatcacggcggcggcgctgatcgcgctcggctcgctgggtctcgggctgctgatgctgcgcgacctgctgcgccagctcggcggcgagccgtcggtggcggcccaggcggtcagcgccatggcgcagggcgacctttcccgcgtgattgccgtcgacgcagacgataggacgagcctgctggccaagctcaaggagatgcaggcgtcgctgtccggcatcgtggccaccgtgcgcaacaacgccgaaagcgtggccacggccagcgcccagatcgcgcagggcaatcaggacctgagccatcgcaccgagcagcaggccagcgcgctgcaggagacgtcggcgacgatggatgagctgggctcgaccgtgggcaacaatgccgagaacgcgcgccaggccaatcagctcgcgtcgggggcctccagcgttgccgccgagggtggcgaggtggtcagccaggtggtcggcatgatgaaggggatcaacgatggctccaagaagatcgccgacatcatcggcgtcatcgacggcattgcgttccagaccaacattctggcgttgaacgccgcggtggaggccgcacgcgcgggcgagcagggccgcgggttcgcggtggtcgccgccgaggtgcgcagcctggcgcagcgcagtgccgcggctgccaaggaaatcaaggcgttgatcacgagcagtgtcgagcaggttgaacagggcaccacgctggtcgaccgggccggcgcgacgatggaacagatcgtgggcgcgatccagcgcgtgtccaacatcgtcgccgagatcagctcggccagcgcggagcagagctccggcgtctcgcaggtcggccaggccgtcagccagatggacgaggccacgcagcagaacgccgcgctggtcgagcaaagcgcggcggccgcgagcagcctgcaaggccaggcacagcagctcgtgcaggccgtcgcggtgttcaagctggcgcggtag

SEQ ID NO: 20655 - protein, 515 aa, Ralstonia solanacearum
MRNWTVKRKLATLVASIIIAFVCLTVFLLGRQAAATADIRSLYDKDYRAASIIGQIDGLLTRVDINILRMIAIGDPASISGWKAQNTERFNKVDQLLVELDASADPSMAASIKTLGEAYGRMRKGMEHQVEAVEAGDIKRGGEINKNEVKDNADKTFGTLAELKSAQDLIAKNKVQAQEAAAALARVVSITAAALIALGSLGLGLLMLRDLLRQLGGEPSVAAQAVSAMAQGDLSRVIAVDADDRTSLLAKLKEMQASLSGIVATVRNNAESVATASAQIAQGNQDLSHRTEQQASALQETSATMDELGSTVGNNAENARQANQLASGASSVAAEGGEVVSQVVGMMKGINDGSKKIADIIGVIDGIAFQTNILALNAAVEAARAGEQGRGFAVVAAEVRSLAQRSAAAAKEIKALITSSVEQVEQGTTLVDRAGATMEQIVGAIQRVSNIVAEISSASAEQSSGVSQVGQAVSQMDEATQQNAALVEQSAAAASSLQGQAQQLVQAVAVFKLAR

SEQ ID NO: 20656 - DNA, 1941 bp, Ralstonia solanacearum
  CDS (1)..(1941)
atgcgtgagtcatctcaagttccccgctcccctgccgtagctttttccacgtgcgcattccggccggctgtcgccggagtgcggtgtcgtcatcgcggtacgcagtctgattcgtctccaacctcaaagaaaagaatcacgatgtcctctctccgcacccgcatcctcgtcatctcttcggccaccgtgatcggtgcgctcgcgctgtcgggggccgccacgtacgccatcgtgcgcgccagcacgctggcatccatcgatcagaacctgacggccatcgccagcggcaacacgctggccatcgacaagtgggtgacagccaaggcccaggccgtgaaggcgacggcggaggcggtggagtacggcgatccgcatggcctggtcaagcacatgggcgatgccgatggcttcccgatcaccaccgtcggctggaccgacaagacgttcttctccaccagcgccggcacgcccaaggactacgatccgaccgcccgcccctggtacaagtcggccatcgccgccggcaagccgaccgtcaccaagccttacggcgatgcgtcgaccggcgtgccgtacgtatcgttcgccgcgccgctgatgcgcaacggcgcggcgaccggcgcgctgagcggcgcggtgccgctggacggcgtgcgcgaagtggtggcggcggtgcatccgacgccgtcgagcctggccttcgtggtggcgcgcgacggccaggtgatcgcgcaccccgatgccaagctgatgctcaagccggtgacggaggtgtcggccgcgctgacgccggatgcgctgacgtcgctggccaaggcgaccgcgccgctggaagtggagctggccggtgccgccaagctgctcaaggcgcaggcggtgcagggcaccgactggtatctggtgatcgcgctggacaaggctgaggccaccgccggcctgcgcagcgtggcgcgcgcgctgggggtggcgatggtgctgctgacgctggcggcggtaggcatcgcggcgttcttcaccgcgcagtcgttccgccggctgtcgcaggtgcgcgatgcgatggacaccatcggctccggcggcggcgacctgacgcatcggctgccggtggtcggcaacgatgaggtggcgcagatctccgcatcgttcaacaccttcatcgacaagatcggcgaggtgctgctggaggtgcgcgccagcgtcgaaaacatgaagtccgccaccggcgagatcgagatgggcaaccgcgacctgtcgctgcgcacggagacgtcggcgagcaacctgcaggaaacctcggccgcactcaccgagctgaccaccagcgtgaagaactccgccgaggccgcagtgcaggccacgcgcctcgcgggcgaggccagcgaggcggccgtgcgcggcggcgaggtggtgtcgggtgcggtcagcacgatggacgcgatcgcgcagtcgtcgtcgcgcatcagcgagatcatcggcgtgatcgacagcattgcgttccagaccaacatcctcgcgctcaacgccgcggtggaggccgcccgcgctggcgagaacggccgcggctttgccgtggtggccggcgaggtgcgcacgctggcgcagcgcagcgccgccgccgcgcgcgagatcaaggcgctcatccaggcctcggaagccagcgtcaaggccggcgccgagcgcgtcgatgccgctggcgcgacgatgcgcgagatcgtggaaggcatccagcgcgtcagccgcatcatcggtgagatcgacggcgccatgcacgagcagagcgcgggcatcagccagatcgatcgcagcgtcgccgagatggatcaggccacgcagcagaacgccgcgctggtggagcaatcgaccgctgcctcgtcgatgctcaacgagcaggcgcatgggctggcgcgcacggttgggctgttccggctgcgcgggggctag

SEQ ID NO: 20657 - protein, 646 aa, Ralstonia solanacearum
MRESSQVPRSPAVAFSTCAFRPAVAGVRCRHRGTQSDSSPTSKKRITMSSLRTRILVISSATVIGALALSGAATYAIVRASTLASIDQNLTAIASGNTLAIDKWVTAKAQAVKATAEAVEYGDPHGLVKHMGDADGFPITTVGWTDKTFFSTSAGTPKDYDPTARPWYKSAIAAGKPTVTKPYGDASTGVPYVSFAAPLMRNGAATGALSGAVPLDGVREVVAAVHPTPSSLAFVVARDGQVIAHPDAKLMLKPVTEVSAALTPDALTSLAKATAPLEVELAGAAKLLKAQAVQGTDWYLVIALDKAEATAGLRSVARALGVAMVLLTLAAVGIAAFFTAQSFRRLSQVRDAMDTIGSGGGDLTHRLPVVGNDEVAQISASFNTFIDKIGEVLLEVRASVENMKSATGEIEMGNRDLSLRTETSASNLQETSAALTELTTSVKNSAEAAVQATRLAGEASEAAVRGGEVVSGAVSTMDAIAQSSSRISEIIGVIDSIAFQTNILALNAAVEAARAGENGRGFAVVAGEVRTLAQRSAAAAREIKALIQASEASVKAGAERVDAAGATMREIVEGIQRVSRIIGEIDGAMHEQSAGISQIDRSVAEMDQATQQNAALVEQSTAASSMLNEQAHGLARTVGLFRLRGG

SEQ ID NO: 20658 - DNA, 1986 bp, Ralstonia solanacearum
  CDS (1)..(1986)
atgcgaacgtccgcccctcagcacgccccccaatccgcgaccagcctgggctcccggctggccgtcgccggcctggccgccctggtcctggtgttcggcgcctttgcgctggcgatctcgcaatccagcctgcgcacgctggaagaccatgcgcagtcggccatgcgcgaccaggaagccgccatgcgcgacatgatcgccctgttcgacggcaccatgcgcaccgaggccgaccgcttcctgaccgccttcgcggatgcggcgcccggcccgtacagcgtggacccggcgcagaccgtggcggtggccggcaagcccacgcccaccttcaggagcggcgacacggcgatgaacctcgatttcgccatccccgacaagttcttcgcccgcaccggcggcaccatcgccaccgtgttcgcccgcaccggcgacgatttcgtgcgcgtgaccacctcgctcaagaaagagaacggcgagcgcgccatcggcacgctgctcgaccgcgcccatccgagctacagggcgctgatggcgggcgagtcgttccgcgggctggcatggctgttcggcgtgccctacatgagcaagtacgagccggtgcgcgatgccgcgggcaaggtggtcggcgccctgtacgtgggcgtggacgtgcgcgcggaactggcgctgctcaaggacaagatccgctcgcacggcatcggcaagaccggcggctacttcgtcatcgacggcaaggcgggcgccgaccagggcaaggtgctgatcgaccgcgacccgggccgcgaaggcaagaacctgctggatgccaaggacgccgacggcctggcctgggtgcgcgagatgatcgagcgcagggacggcatcctgcgccacacgctggccgacaccgaaggcggcccggcgcgcgcgcgcttcaccgtgttcacgcagtatccggactggaagctggtgattgccggcaccgcctacgtggatgagctggaggccgacctggtctcggcgcgcaaccgcttcctgctgctcggcctggcgctgggcgcgctgctggcgggcggcctgtactggatgctgcgccgcgcggtcagcgcgccgctggccgaggtggcgggcgtggcccggcgcgtggccgccggcgacctgacgcaccgcttctccggcacccgccgcgacgagatcggccaactgatgcacgccatcaacggcttgggcgacggcctgagcggcattgtcgacaaggtgcgcgcgagcgcctcgaccatcgcctcgagcaccggccagatcgccgccggcaacgtcgacctgtcggcgcgtaccgaggcgcaggccggcaacctggagcgcaccgcctccagcatcgagcaactggccgccaccgtgcgccagaacgccgacagcgctcagcatgcgcacgacatggtgcagtccgccagcgaggccgccaacgcgggcggccggacggtggcgcggctggtcggcaccatgtcgggcatccacacgacggcgcagaagattgccgacatcaccggcatcatcgacggcatcgccttccagaccaacatcctggcgctgaacgccgccgtggaggcggcccgcgcgggcgaacagggtcgcggcttcgcggtcgtggccggcgaggtgcgcagcctcgcgcaacgcagcgcggcggccgccaaggaaatcaaggaactgatcagccgctcggtgcaggaagtgcaggccggcaacgaagcggcgcgcggcgcgggcgaggccatgcaggacatcgtcacgcgggtcgagcgcatcgccggcatcatgggcgagatcagccacgcctcgcgcgagcagtcgcagggcatcgaggaggtcaaccgcgcggtgacctcgatggatgaggtgacgcagcagaacgccgcgctggtggaagaagccgccgccgcggccgagagcctgcggcagcaggcccaggaactgcgcggcgcggtggatgtgttccggctggcctga

SEQ ID NO: 20659 - protein, 661 aa, Ralstonia solanacearum
MRTSAPQHAPQSATSLGSRLAVAGLAALVLVFGAFALAISQSSLRTLEDHAQSAMRDQEAAMRDMIALFDGTMRTEADRFLTAFADAAPGPYSVDPAQTVAVAGKPTPTFRSGDTAMNLDFAIPDKFFARTGGTIATVFARTGDDFVRVTTSLKKENGERAIGTLLDRAHPSYRALMAGESFRGLAWLFGVPYMSKYEPVRDAAGKVVGALYVGVDVRAELALLKDKIRSHGIGKTGGYFVIDGKAGADQGKVLIDRDPGREGKNLLDAKDADGLAWVREMIERRDGILRHTLADTEGGPARARFTVFTQYPDWKLVIAGTAYVDELEADLVSARNRFLLLGLALGALLAGGLYWMLRRAVSAPLAEVAGVARRVAAGDLTHRFSGTRRDEIGQLMHAINGLGDGLSGIVDKVRASASTIASSTGQIAAGNVDLSARTEAQAGNLERTASSIEQLAATVRQNADSAQHAHDMVQSASEAANAGGRTVARLVGTMSGIHTTAQKIADITGIIDGIAFQTNILALNAAVEAARAGEQGRGFAVVAGEVRSLAQRSAAAAKEIKELISRSVQEVQAGNEAARGAGEAMQDIVTRVERIAGIMGEISHASREQSQGIEEVNRAVTSMDEVTQQNAALVEEAAAAAESLRQQAQELRGAVDVFRLA

SEQ ID NO: 20660 - DNA, 1548 bp, Ralstonia solanacearum
  CDS (1)..(1548)
atgcgacagtggacactcaaagcaaaactgcgcctggcgctggccctgatgtggctgggcctgatcggcgtgggcgtctggagtgcgatggaaacccgggccaccatgctcgatgagcgcaagacgggcctgcagaacctggtggatgccgccgagggcatcgccaagctgtatcacgcgaaggcgcagtccggcgccatgggcgaggacgaggccaggaagaccgccctcgcgacgctggcgtcgctgcgctatggcaccacgggctatctcttcgtggtggattcgcagctgatcctgcagatgcacccgacgctggccgacatggtcggcaagagcaccgcccaattcaaagacccgaccggcaaaccgctctacccggccatcgtcaatgccgccaaggacaaaggctacggctttgccgaataccagggccgcctgccgggcagcgacaccgccctgcccaagatcggctacgtcaagcgcttcgccccgtgggactggaacatttccagcgccgtgttcctgcaggaagtggagacggcctacgtccgctcgctgatcgccaacctgatcgccatcctggtggtgggcggcgcggtgacgctggccatgttcctcatcatccgcaatgtgcagcgcgggctgggcggtgagccggcctatgccaccgagatcgcccgccgaatcgccgacggcgacctggcggtgcgcgtgcagacccgcccggatgaccgcaacagcatgctgttcgccatggcccggatgcagcagcaactgaccggcaccatcggccatatcaagacctccgccgactcgatcgccagcgccacccagcagatcgccaccggcaacgccgacctgtcgcagcgcacggaagagcaggccagctcgctggaagaaacggcctccagcatggaagagctgacctcgatcgtgaagcagaacgcggacaacgcgcgccaggcgagcacgctggcggtcaacgcttcggacatcgcggtcaagggcggcgaggtggtgggccgcgtggtcgataccatggccggcatcaacgacagcagcaagaagatcgccgacatcatcggcgtgatcgagggcattgcattccagaccaacatcctggcgctgaacgcggcggtggaagccgcccgggccggcgagcagggtcgcggcttcgcggtggtggcgggcgaggtgcgcagcctggcgcagcgctcggcgggggcggccaaggagatcaaggtgctgatctcggactcggtcggccgggtcgagaacggcaccacgctggtggccgaggccggcacggtgatcgacgaagtggtggtggcggtcaagcgcgtgacggacatcatgggcgagatcagcgcggcgtcggacgagcagagttcgggcatcgagcaggtcaaccaggccgtgaaccagatggacgaggtgacgcagcagaacgcggcactggtggaagaggccgcggccgccgcgctgtcgctggaagagcaggcaacgttgctgcgcgacgccgtggcgtcgttccgtacgacctga

SEQ ID NO: 20661 - protein, 515 aa, Ralstonia solanacearum
MRQWTLKAKLRLALALMWLGLIGVGVWSAMETRATMLDERKTGLQNLVDAAEGIAKLYHAKAQSGAMGEDEARKTALATLASLRYGTTGYLFVVDSQLILQMHPTLADMVGKSTAQFKDPTGKPLYPAIVNAAKDKGYGFAEYQGRLPGSDTALPKIGYVKRFAPWDWNISSAVFLQEVETAYVRSLIANLIAILVVGGAVTLAMFLIIRNVQRGLGGEPAYATEIARRIADGDLAVRVQTRPDDRNSMLFAMARMQQQLTGTIGHIKTSADSIASATQQIATGNADLSQRTEEQASSLEETASSMEELTSIVKQNADNARQASTLAVNASDIAVKGGEVVGRVVDTMAGINDSSKKIADIIGVIEGIAFQTNILALNAAVEAARAGEQGRGFAVVAGEVRSLAQRSAGAAKEIKVLISDSVGRVENGTTLVAEAGTVIDEVVVAVKRVTDIMGEISAASDEQSSGIEQVNQAVNQMDEVTQQNAALVEEAAAAALSLEEQATLLRDAVASFRTT

SEQ ID NO: 20662 - DNA, 990 bp, Ralstonia solanacearum
  CDS (1)..(990)
atgtgtcggagcaggcccgcgatcgaccgcgtggaagcccgctacggccccgtggccaccgggatcgtgcaactggcgctggacggcaagcgcgacgaggccatccagaagatggacgacgaatgccgtccgctgctggtcgagctgatccaggccaccaccgcctacgcccgctatacgcgcgaacgccaggagcagctcgtcgcggctgacgaagcgcagtatgggcagcagcgcagcctgctgatcgcgctgtcgatcgcggcggtgctcgtggcgatcggggcgggcgtgctgatcacgcgctcgatcacgcgccccatcggcaaggccgtgaacgtggcggagacggtggcccgcggcgacctcggcagccgcatcgacgccgaaggcaccgacgagaccagccaccggctcgccgcgctcgccgacatgaacacccgcctgacgcagatcgtcgacaaggtgcgcgacagcagcggcagcatcgccggcgcggccaggccgatcgcggcgggcaacgccgacctgagccagcgcaccgaagcgcaggcctcctcgctgcaggaaaccgccgccggcatggaagagctgacctccaccgtaaagcagaacgccgacaatgcccagcacgccaccgaactggccgcgacggcgtcggaggtggcgcagaagggcaacgccgtggtgagccaggtggtctcgaccatgcaggccatcagcgaccgctccggcaagatcgcggagatcaccagcatcatcgaggggattgccttccagaccaacatcctggccctgaacgccgcggtggaagccgcccgcgcgggcgatcagggacggggcttcgcggtggtcgccaacgaggtgcgcagcctcgcgcagcgctctgccaaggcggccaaggagatcaagaggctgatcgcctcgtcggtcgagcgcatccacgacagctcgacgctggcgacgcgctacagcggatcgcgcagatag

SEQ ID NO: 20663 - protein, 329 aa, Ralstonia solanacearum
MCRSRPAIDRVEARYGPVATGIVQLALDGKRDEAIQKMDDECRPLLVELIQATTAYARYTRERQEQLVAADEAQYGQQRSLLIALSIAAVLVAIGAGVLITRSITRPIGKAVNVAETVARGDLGSRIDAEGTDETSHRLAALADMNTRLTQIVDKVRDSSGSIAGAARPIAAGNADLSQRTEAQASSLQETAAGMEELTSTVKQNADNAQHATELAATASEVAQKGNAVVSQVVSTMQAISDRSGKIAEITSIIEGIAFQTNILALNAAVEAARAGDQGRGFAVVANEVRSLAQRSAKAAKEIKRLIASSVERIHDSSTLATRYSGSRR

SEQ ID NO: 20664 - DNA, 1608 bp, Ralstonia solanacearum
  CDS (1)..(1608)
atgaatttttttgagattcagggaaatcatcaaggggaagttatgggtttgcatcgcttgaccgttaaaaccaagttgctcgccagtttcggtttgctggcggcgatcgtcgtggcgctttctggtttcgccattctcgcgctggacggcgccaatgcgcgtttcatcggatttgtcgacggcgtgaatgcccgtgtgatgctggtcaacaggatccgggctgcggttgaccggcgcgccctcgcggcgcgcaacctggtgctggcgaccacagcgcaggagcgggcgtttgaaaaggcggaagccgagcgggcccatgaggaagtccacgcgggtctggccgagctggaaaccaggctggccgcgccgggcgtcacggacaaggcgagacaactgggcgcggagatccggcggatcgagaacgcctatggcccggtcgcgctggacatcgtcaagctggcggcggaggggcagcgcgaggcggccaaccagaagatcaatgccgagtgcaagccgttgctcgatacgttggtcaaggccgtgaaggtctatgcgggctacggtgccgagctgtcccagcggaccctgcaggaggcggaggtgcgcgcggcctggctgcgcagcatcgtgatcggcgcgagcgtggctgccgtcatgctggcggtcgggctggggctggtgatcacgcgcagcctgctgaaggcactgggcacggagcccgcggtgctcaacgagatcacgcggaagatctcggcgggggacctggcgccgattccccttgcgcaagccgcgccgaagggcagcgtgttcgaatcgatggcggccatgcagcagagcctggcggggatcgtcggtgcggtgcgcggcgccgccaatgccatctcggtcggctcggcgcagatcgcggccggcaatgtggatctgtcttcgcgcacggaagagcaggcgtcctcgctgcagcagaccgtttcgaccatggagcagctgaccgcgacggtgcggcagaacgccgacaacgcgcggcaggcgaacaccctgtccatcgatgcctcggccgtggcccagaagggtagcgcggaggtgggccaggtcgtggcaacgatgggggacatcagccgggagtccgtcaagatcggcgagatcaccgggatcatcgagagcattgcgttccagaccaatatcctggccctgaacgcggcggtcgaggcggcgcgcgcgggcgagcagggccgcgggttcgcggtggtggccagcgaggtgcgcacgctggcgcagcgctcgtccagcgcggccaaggacatcaaggagctgatcggtgcgtcgctggagaagatcacgaccggctcgggcgcggccgagcaggcgggccgcaccatgcaggcggtcacgctggcggtcgaaaaggtcacggcgatcatccacgagatcacccaggcttccgaggagcagaccagcggcatcgagcagatcagccatgcgatgggccagatggaccaggtgacgcagcacaacgcggcgctggtggagcaggcggcggcggcctcccagtccctggagcagcagggccgggagctggaccacgcggtggcgtcgttccggctcgcctga

SEQ ID NO: 20665 - protein, 535 aa, Ralstonia solanacearum
MNFFEIQGNHQGEVMGLHRLTVKTKLLASFGLLAAIVVALSGFAILALDGANARFIGFVDGVNARVMLVNRIRAAVDRRALAARNLVLATTAQERAFEKAEAERAHEEVHAGLAELETRLAAPGVTDKARQLGAEIRRIENAYGPVALDIVKLAAEGQREAANQKINAECKPLLDTLVKAVKVYAGYGAELSQRTLQEAEVRAAWLRSIVIGASVAAVMLAVGLGLVITRSLLKALGTEPAVLNEITRKISAGDLAPIPLAQAAPKGSVFESMAAMQQSLAGIVGAVRGAANAISVGSAQIAAGNVDLSSRTEEQASSLQQTVSTMEQLTATVRQNADNARQANTLSIDASAVAQKGSAEVGQVVATMGDISRESVKIGEITGIIESIAFQTNILALNAAVEAARAGEQGRGFAVVASEVRTLAQRSSSAAKDIKELIGASLEKITTGSGAAEQAGRTMQAVTLAVEKVTAIIHEITQASEEQTSGIEQISHAMGQMDQVTQHNAALVEQAAAASQSLEQQGRELDHAVASFRLA

SEQ ID NO: 20666 - DNA, 1542 bp, Ralstonia solanacearum
  CDS (1)..(1542)
atgctcgctcgcctgacgatacgcacccgactggtcctcacggtttccattctgttcctgctggccttgctgatcggcgtggccgggctgcttggcctgcgcgacgcgaacggcgcgcacgaagagacctaccgcaaccagttcccgtcggcgctcgcgctgggcgaatccgacctcagcctgacccgcgcccgcacggcgctcgacaaggcgatgctgtatccggaagacaaggacgcgatgcagttgctggaccgcaccgaagagctgatcaccggctccgacgcggcctggaagaaatacctggcgctgccgcacggcgacgaagaaacgcggctgtccaaggaggtcggcaccaagcgcgaagcggcggccggcagcctgcgcgacatcatcaaggcgctgcgcgcgagcgaccgggccgcggccgacgccatcatggacaagcgcgtttccaagtccttccgcgaggcgaacgacgccagccaggcgctcggcaagcagcagttgacgttctccaaggccaatttcgacgattcccagcaggcctacgcgcgcatccgcaatctggtgatcgcggccatcgtgctcgcgctggtggtgtcggccggatgcgcgtggctgctgctgcgcgccatcgtcgggccgctgaatgccacgctggcacagttcgaccgcattgccgccggcgacctgacgcagcccgtgcgcatcgaccgccgcgatgagatgggccacctgctggagggcctcgcccgcatgcaggccgcgctgacggacacggtgcgccgggtgcgccatggctcggaatcgatcggcgcggccaccaagcagatcgccgccggcaacgccgacctgtcgcagcgcaccgaagggcaggcgagctcgctggaagagacggcgtcgagcatggaggagatgacctcgatcgtgcgccagaacgccgacaacgcccgccaggccagccagctggccgacagcgcctcggcggtcgccagccagggcggcgccgtggtgaccgacgtggtggcgaccatgcgcgagatcagcgcgtcgtcgcgcacggtgtcggagatcatcggcgtgatcgacggcattgcgttccagaccaacatcctggcgctcaacgccgcggtggaggccgcccgcgccggcgagcagggccgcggcttcgcggtcgtggccggcgaggtgcgcagcctggcgcagcgcagcgccgcggccgccaaagagatcaaggagatgatcgaagcctcgctcgccaaggtcgacaccggcagcaagctggccgagcaggccggcagcaccatggaaaacatcgtcacctccatccgccgcgtgacggacatcatgggcgagatcgccgcggcctccagcgagcagagctcgggcatcgagcaggtcaacaaggccgtcacgctgatggacgaagccacccagcagaacgccgcgctggtcgagcaggccgccgccgcggccgaatcgctggaagagcaggcgcaggcgctgaacgaggcgatcgcggccttccggctggcctga

SEQ ID NO: 20667 - protein, 513 aa, Ralstonia solanacearum
MLARLTIRTRLVLTVSILFLLALLIGVAGLLGLRDANGAHEETYRNQFPSALALGESDLSLTRARTALDKAMLYPEDKDAMQLLDRTEELITGSDAAWKKYLALPHGDEETRLSKEVGTKREAAAGSLRDIIKALRASDRAAADAIMDKRVSKSFREANDASQALGKQQLTFSKANFDDSQQAYARIRNLVIAAIVLALVVSAGCAWLLLRAIVGPLNATLAQFDRIAAGDLTQPVRIDRRDEMGHLLEGLARMQAALTDTVRRVRHGSESIGAATKQIAAGNADLSQRTEGQASSLEETASSMEEMTSIVRQNADNARQASQLADSASAVASQGGAVVTDVVATMREISASSRTVSEIIGVIDGIAFQTNILALNAAVEAARAGEQGRGFAVVAGEVRSLAQRSAAAAKEIKEMIEASLAKVDTGSKLAEQAGSTMENIVTSIRRVTDIMGEIAAASSEQSSGIEQVNKAVTLMDEATQQNAALVEQAAAAAESLEEQAQALNEAIAAFRLA

SEQ ID NO: 20668 - DNA, 1545 bp, Ralstonia solanacearum
  CDS (1)..(1545)
atgaaactcgcgatcaagcttcccctggcctttgccgcagcgctgctgctgatgtttgccggggcgatctacggcattgtgtccctcaacgggtcgatcaccgaatacaacaccacggtccaggcgcgcgtggccgacgagcgcgcggtgaccagcatgctggtcaacttcaagacccaggtgcaggagtggaaggacacgctgctgcgcggcaaggtccaggccacgcgcgacaagcactgggccgccttcggccagcgcgagcaggacgtcgccgggcaggcccgggcgctgcaggcgtcgctgccgccgggcaagagccgtgatctggtcggccagttcgcggccgcccacgcgacgatgggacagggctatcggaagggctacgagtccttcgttgcggcggcgttcgatccgacggtgggcgatcaggtggtgaccggggtggaccgcgagccgtcgaggctgctcgacgaggcggcgcgtgagatcgcggcggaaagcgccgcggtgtcggcccggacggcggcgacggcgcacacggtactggtggtcagcgtcgtgctgatgctggtggcgttcgggttgggcctggccggtgcgttcctgttcagccgctcgatcacgcggccgctgtcgcgcgcggtcgaggtggcgcgcacggtggcgcagggcgatctggggagcgcgttcgaggcgcgcggctccgacgagatcgcgcaactgctgatcgcgctcagggagatgcagggcagcctggccaaggtggtgagcgaggtgcggcgcaatgcagaaggcgtggcctcggccagtgcgcagatcgcttcgggcaacctgaacctgtcgtcgcgcaccgaggagcaggcggcctcgctggaggagaccgccgccaacatgggcgagctgacctcgaccgtgcgcctcaattccgagaatgccgtgcaggcgtcgacgctggccggccacgcctccgatacggcggcgcgcggcggcaaggtgatgaccgacgtggtcgagaccatgcagggcatttcggagagctcggccaaggtgggcgagatcatcggcgtgatcgacagcattgcgttccagaccaacatcctcgcgctcaacgcggcggtcgaggccgcgcgtgccggcgagcaggggcgcgggtttgcggtggtggcgggcgaggtgcgcacgctggcgcagcgcagcgcctcggcggccaaggagatcaagggcctgatcggccagtcggccgagcgggtggaagccggcgcgcggctggtgcaggaggccggcggcatcatcgacgagatcgtggcctccgtgcagcgcgtgacgcagatcgtgtcggagatctcgtcggcctcggccgagcagagcaccggtatcgagcaggtgaacatcgccgtcgggcagatcgaggaagtgacgcagcagaacgccgcgctggtggaagaggcctcggccgcggcgcagcagatggccgaccaggccgacgcgctgcgccgcgcggtggcgatcttccgggtggacggcgaggccgggcgggcatag

SEQ ID NO: 20669 - protein, 514 aa, Ralstonia solanacearum
MKLAIKLPLAFAAALLLMFAGAIYGIVSLNGSITEYNTTVQARVADERAVTSMLVNFKTQVQEWKDTLLRGKVQATRDKHWAAFGQREQDVAGQARALQASLPPGKSRDLVGQFAAAHATMGQGYRKGYESFVAAAFDPTVGDQVVTGVDREPSRLLDEAAREIAAESAAVSARTAATAHTVLVVSVVLMLVAFGLGLAGAFLFSRSITRPLSRAVEVARTVAQGDLGSAFEARGSDEIAQLLIALREMQGSLAKVVSEVRRNAEGVASASAQIASGNLNLSSRTEEQAASLEETAANMGELTSTVRLNSENAVQASTLAGHASDTAARGGKVMTDVVETMQGISESSAKVGEIIGVIDSIAFQTNILALNAAVEAARAGEQGRGFAVVAGEVRTLAQRSASAAKEIKGLIGQSAERVEAGARLVQEAGGIIDEIVASVQRVTQIVSEISSASAEQSTGIEQVNIAVGQIEEVTQQNAALVEEASAAAQQMADQADALRRAVAIFRVDGEAGRA

SEQ ID NO: 20670 - DNA, 1803 bp, Ralstonia solanacearum
  CDS (1)..(1803)
atggaacgcttcctgaaaaacaccagtgtgcgagccggcctgctggcgattctggtgacctttgcactgatgatcgtggtgggcgcggcggtcggcgtgctggccctgagcacggccaacgtatcgaccgagcgcgtgcatgccatctcggcacgcagcatgctgctcaatgacgcctacaaggacatgatgcgcgcccgcaccgggctggcgcgcgtctacggcatgctgcgcgagaatcccggcacgcccttggcgtccaacgcgctcgatagcgccgagtcgggcgtgaagaaatcgctcgcccagctcgacgcgttcaagagtgcgccggccatcgaaggcgtggatcaggccctgcgccaggccgccgcccaggccgcgcaggcgcatgccgacgccgtgcagcgcgccatggccgccctgcgcgccagcgatgcggccgcctacgccaccatcaacgccaaggacgtcacctcatcgggggcggcctggtcggtcgagatcgaacgcttccagaagctcagcagccaactggcccaggaagaggctgacggcgggcaggcgcgctacggcctgatcgtcaagttcgtgagcgtcggcatcgtcatggcgctggcgttgattgccgccgtgcactacgcgctcaaagccttcgtggtgacgccgctcaacgacgcggtggatgtgctgacgcgcgtggccgagggcgatctgtctgtgcaggtgagggaaggcggacgcaacgagctgggccggctgctgtcggccgtggcccgcatgcgcgccagcctgctgcagacggtgcgccaggtgcgcagcagctcggacgcggtcaacaccggcgcgcacgagatcgccagcggcaacctcgatctgtcgtcgcggaccgagcagcagtcggcgtcgctggagaagacggccgccagcatggagcagatgacctccaccgtcaccaacaactccgagaacgctcgccaggccagcgcgctcgcggccagcgcggccgacctggcctcgcgcggcggcgaggtggtgcgcggcgtggtctcgaccatggacgagatcagcgcgagctcgcgcaagatggccgacatcatcggcgtgatcgacggcatcgccttccagaccaatatcctggcgctcaacgcggcggtggaagccgcccgcgccggcgagcaggggcgcggcttcgccgtggtggccggcgaggtgcgggccctggcccagcgcagcgcggccgccgccaaggagatcaaggacctgatcgatgcctcggtcgatcgcgtgcaggccggcaacacgctggtggcccaggcgggttcgaccatgaccgagacggtggatgcggtgcgccgcgtggccaatatcgtcgaagacattgccgccgcctcgtccgagcagacgcagggcatcctgcagatcagccaggcggtgtcggagatggagcaggtgacgcagcagaacgccgcgctggtcgagcaggccgcggccgccgcgcagtcgctggaggagcagtcgctgaacctgacccacgtggtggcccagttccggctggacgagacggacggtgtggtggcggctgccgcgtccaagccggtgcgtaccgcgccggctgccgccgtgaagccggccgccaagccgccgcgcccggtcgtgcgcaagcgtgggcccagccccaaggccgtggcgccggccaccgtgcctgtcgttgcgcccgctgccgcgcctgtcgttgcgccggtcaaggcccagccgctggccgccgtcgccggctcggacggcgactgggaaaccttctga

SEQ ID NO: 20671 - protein, 600 aa, Ralstonia solanacearum
MERFLKNTSVRAGLLAILVTFALMIVVGAAVGVLALSTANVSTERVHAISARSMLLNDAYKDMMRARTGLARVYGMLRENPGTPLASNALDSAESGVKKSLAQLDAFKSAPAIEGVDQALRQAAAQAAQAHADAVQRAMAALRASDAAAYATINAKDVTSSGAAWSVEIERFQKLSSQLAQEEADGGQARYGLIVKFVSVGIVMALALIAAVHYALKAFVVTPLNDAVDVLTRVAEGDLSVQVREGGRNELGRLLSAVARMRASLLQTVRQVRSSSDAVNTGAHEIASGNLDLSSRTEQQSASLEKTAASMEQMTSTVTNNSENARQASALAASAADLASRGGEVVRGVVSTMDEISASSRKMADIIGVIDGIAFQTNILALNAAVEAARAGEQGRGFAVVAGEVRALAQRSAAAAKEIKDLIDASVDRVQAGNTLVAQAGSTMTETVDAVRRVANIVEDIAAASSEQTQGILQISQAVSEMEQVTQQNAALVEQAAAAAQSLEEQSLNLTHVVAQFRLDETDGVVAAAASKPVRTAPAAAVKPAAKPPRPVVRKRGPSPKAVAPATVPVVAPAAAPVVAPVKAQPLAAVAGSDGDWETF

SEQ ID NO: 20672 - DNA, 1890 bp, Ralstonia solanacearum
  CDS (1)..(1890)
atgcacggagaccttggaatgagcaagctcagcttccgccagaagctttggctgccgctggcgttcagcctgatcgcgctgacgctgatgtcggtgttcaatgcctatcaggcgcgcgggattcgcatcgaggaacgcaggaacaacctggtcagcgtgaccagcatggcgctcaacctggtcaagcagtacgacgacctggcccgcggcggcgtcctgaccaaggaggcggcacagcagcaggcgctggaccgcttccgctcgctgcgctacgacaaggacggctacttcaccatcacccgttccgacaacgtggtggtgatgcacccgatcaagcccgaattcatcggcaaggaccagaccggcttcaaggacgcgcagggcaacagcgtctacgtcaatctcaccagcgccgccaggcagcccaacggcggcttcaccagctatgtctggccgcacgtcggtgggacggcgctggtgccgaagacggccttcgcgcagcgctacgagccgtgggactgggtgttttcgaccggcgcctacatggatgacatcaacgccgcgttcatgacgtcgctgtacgagagcggcggcctgctgctgctggcgggcgcggtgctggtgttgctggccggcgtggccaaccggggtctgcagcgtgcgctgggcggcgacccggcctatgcggcggaggtggccaaccgcatcgccggcggcgacctgagcgtcgagattgccacccggccggatgaccgcgacagcctgctctacgccatgggccgcatgcgcggcgcgctggtgcagaccatcggccgcatcaggggcgcatcggagaccatcggcacggccacgcgcgagatcgccagcggaaacctggatctgtcttcgcgtaccgagcagcaggcgagctcgctcgaagagaccgcctcggccatggaagagctgatgtcgaccgtgcagcagaacgccgacaacgccaaccaggccaaccagctggccgtgtccgcctccgacgtggcggtgcggggcggcgacgtggtgtcccgcgtggtcgagacgatgggctcgatcaatgcgtcctcgcgcaagatcgtcgacatcatcggcgtgatcgacgggatcgctttccagaccaacatcctggcgctcaatgccgccgtggaagcggcgcgcgcgggcgagcaggggcgcggcttcgcggtggtggccggcgaggtgcgcagcctggcgcagcgcagcgccgccgcggccaaggagatcaaggcgctgatcgacgactccgtgaccaacgtggatgccggcagcgccctggtggaagaagccggcacgaccatgcgcgagatcgtcgccagcgtccggcgcgtgacggacatcgtcggcgagatcaccgccgcgagccaggagcagcgctcgggcattgaagaagtcagccacgctgtcacgcagctcgacgatgccacccagcagaatgccgcgctggtggagcaggcagcggccgccgcgcaatcgttgcaggagcaggccgacagcctgacgcaggtcgtggcgcagttccgcctcgaccccacgatgtcggcggtgcgcagcgtggtggccaaggccgagccgacgatcgcgccgccggtgcccaaggctgccgaggccgggccggccacacccgtacccgtggccgcacccgtggccgcgccggcccaggcgccgcgccgcgagccggtcaagcccagccccgaggccgcgaggcccaagctgcagccgcgcaaggcgccggtgcttgccaagcgcgcggccaggccggataccgcgcccgccacggtgccggccgcatcgcccaagcctctgcaccagccgctggtggccgccggcgacgatgccgactgggaaaccttctga

SEQ ID NO: 20673 - protein, 629 aa, Ralstonia solanacearum
MHGDLGMSKLSFRQKLWLPLAFSLIALTLMSVFNAYQARGIRIEERRNNLVSVTSMALNLVKQYDDLARGGVLTKEAAQQQALDRFRSLRYDKDGYFTITRSDNVVVMHPIKPEFIGKDQTGFKDAQGNSVYVNLTSAARQPNGGFTSYVWPHVGGTALVPKTAFAQRYEPWDWVFSTGAYMDDINAAFMTSLYESGGLLLLAGAVLVLLAGVANRGLQRALGGDPAYAAEVANRIAGGDLSVEIATRPDDRDSLLYAMGRMRGALVQTIGRIRGASETIGTATREIASGNLDLSSRTEQQASSLEETASAMEELMSTVQQNADNANQANQLAVSASDVAVRGGDVVSRVVETMGSINASSRKIVDIIGVIDGIAFQTNILALNAAVEAARAGEQGRGFAVVAGEVRSLAQRSAAAAKEIKALIDDSVTNVDAGSALVEEAGTTMREIVASVRRVTDIVGEITAASQEQRSGIEEVSHAVTQLDDATQQNAALVEQAAAAAQSLQEQADSLTQVVAQFRLDPTMSAVRSVVAKAEPTIAPPVPKAAEAGPATPVPVAAPVAAPAQAPRREPVKPSPEAARPKLQPRKAPVLAKRAARPDTAPATVPAASPKPLHQPLVAAGDDADWETF

SEQ ID NO: 20674 - DNA, 1854 bp, Ralstonia solanacearum
  CDS (1)..(1854)
atggctgatccggctgcgtgcagtgcgctctacatggcaggaacccataccgtgctcaactccatccgtacccgcatcttgctgacctgcgtcgccatcgtggtgggcgcattgaccctcgccggtggcctcaactacgtcgtcacccgctcctacaacgacgacgcgatccgccagaacctgcagtccgtcgcacgcggccatatcgccggcatcgatgactgggtggcgtccaagacccagatggtggtcgcgctgcaggatgcggcgctgtcggccgatccggtgccggccctcaagacggtggccgcgtcgggcggcttcatcagcgtgtatgtcggctaccccgacaagtcgtacaagttcgccgacccgagcggggttccacccacctacgatccgaccgcgcgcccctggtacaagcaggccgcggaggccggcaagccggtggtgacgccgccctacgtcagtgccagcaccggcaagctggtggtcacgttcgccgtgcccatcctgcgcgacggcggcctgaagggcgtggtcgccagcgatgtgtcgatggacgccgtgatcgccaacgtcaaggccattcacccgacgccggccagcttcggcttcctggtcaacgccgccggcaagatcgtcgcccatcccgatgacaaattcacgctcaagccggtcaccgacctgtcggccgacctgagcgacgcgaccctcgccgcgcttgcgcagaccgacaagccgttgcaggtcaatgtgggcggcgccgccaagctgcttcatcgccagggcgtgcagggcaccgactggggcctggtggtggcgctcgacaagtccgacgcgaccgccggcatgcgttcgctggtgaccacgtcgatcggcgtgctggtggtggtggcgctggtggcggccgccatcgtcggcgcgatgacggcgcgcgcgttccgccgcctgtcgatgatccgcgacgcgatggacgacatcggctccggcagcggtgacctcaccaagcgcctgcccgccgacggccaggacgaagtcgcgcagatcgcccgctcgttcaatgccttcgccgacaagctgaccgcggtgctgcagcagatccgcctgggcagcgactcggtgcgctcggccgcgcaggagatcgccgccggcaacgccgatctgtcgcagcgcaccgaagagcaggccagctcgctggaggagaccgcctccagcatggaagagctgaccagcatcgtgaagcagaacgccgacaatgcgcgccaggccagctcgctggcggtcaacgcctccgacgtggcgacgcgcggcggcagcgtggtcggccaggtggtccagaccatgggcggcatcaacgagagcagcaagaagatcgccgacatcatcggcgtgatcgagagcatcgcgttccagaccaacatcctcgcgctcaacgccgccgtggaagcggcgcgcgcgggcgagcagggccgcggcttcgcggtggtggcgagcgaggtgcgcagcctggcgcagcgctcggcgggcgcggccaaggagatcaaggcgctgatccacgactcggtcgatcgtgtctccaacggcaccgcgctggtggaccaggccggcgtgaccatggccgagatcgtcgaggccgtgaagcgcgtgaccgacatcatgggcgagatctccgccgcgtcggaagagcagagcagcggcatcgagcaggtcaaccaggccgtcaaccagatggatcaggtgacccagcagaacgcagcgctggtcgagcaggccgccgccgcggcggaatcgctggaagagcaggcgcgcaacctgaacgacgcggtcggctcgttccgcctgtcgcactga

SEQ ID NO: 20675 - protein, 617 aa, Ralstonia solanacearum
MADPAACSALYMAGTHTVLNSIRTRILLTCVAIVVGALTLAGGLNYVVTRSYNDDAIRQNLQSVARGHIAGIDDWVASKTQMVVALQDAALSADPVPALKTVAASGGFISVYVGYPDKSYKFADPSGVPPTYDPTARPWYKQAAEAGKPVVTPPYVSASTGKLVVTFAVPILRDGGLKGVVASDVSMDAVIANVKAIHPTPASFGFLVNAAGKIVAHPDDKFTLKPVTDLSADLSDATLAALAQTDKPLQVNVGGAAKLLHRQGVQGTDWGLVVALDKSDATAGMRSLVTTSIGVLVVVALVAAAIVGAMTARAFRRLSMIRDAMDDIGSGSGDLTKRLPADGQDEVAQIARSFNAFADKLTAVLQQIRLGSDSVRSAAQEIAAGNADLSQRTEEQASSLEETASSMEELTSIVKQNADNARQASSLAVNASDVATRGGSVVGQVVQTMGGINESSKKIADIIGVIESIAFQTNILALNAAVEAARAGEQGRGFAVVASEVRSLAQRSAGAAKEIKALIHDSVDRVSNGTALVDQAGVTMAEIVEAVKRVTDIMGEISAASEEQSSGIEQVNQAVNQMDQVTQQNAALVEQAAAAAESLEEQARNLNDAVGSFRLSH

SEQ ID NO: 20676 - DNA, 1662 bp, Salmonella typhimurium
  CDS (1)..(1662)
atgttaaagcgaattaaaattgttaccagcttactgctggtattggcgctatttggccttttacaactgacatccggcgggctgttcttcaactcgctgaagaatgacaaagaaaacttcaccgtattgcaaactattcgtcagcagcagtctgccctgaatgcaacctgggtggagctgttgcaaacgcgtaataccctgaatcgcgcgggtatccgctggatgatggaccagagcaatattggcagcggcgcaactgtcgctgaactgatgcagggggcgaccaatacgctgaagctgaccgaaaaaaactgggagcagtatgaggcgttaccgcgcgatccacgtcagagtgaagcggctttccttgagatcaaacgaacctatgatatctaccacggcgcgttggcggagcttattcagcttcttggcgcgggtaagattaacgagttttttgatcaaccgactcaaagctatcaggacgcttttgagaagcagtacatggcctatatgcagcaaaacgatcgtctgtacgatattgctgttgaggataacaacagttcctacaaccaggcgatgtgggtactggtcagtgtgctgattgccgttctggtggtcattatcgccgtctggttcggcatcaaactgtcgcttatcgccccgatgaatcgtctgattgaaagcattcgtcatatcgccagcggcgatctggtgaagcgtatcgacgtggaaggctccaacgaaatggggcagttggctgaaaacctgcgtcatatgcaaagtgaactgatgcgtaccgtgggcgatgtacgtaacggcgcgaatgcgatctatagcggcgccagcgagattgcgatgggcaacaacgatctctcttcccgtactgagcagcaggcagcgtctctggaagagaccgccgccagtatggaacaactgaccgccaccgtgaaacagaacgccgaaaacgcccgtcaggccagtcacctggcgctgagtgcgtcagagacagcgcaaaaaggcggcaaagtggtggataacgtcgtacaaacaatgcgcgatatcgcctccagttcgcagaaaatcgccgatattatcagcgtaatcgacggtattgctttccagaccaatattctggcgctgaatgcggcggtagaagcggcgcgcgcaggcgagcagggacgcgggttcgcagtggtggccggtgaagtccgtaatctggcccagcgtagcgcgcaggcggcacgggagatcaagagtctgattgaggattccgtgagccgtgttgatgtaggttcgacgctggtcgaaagcgccggtgaaaccatggatgagatcgtcaatgcagtgacccgcgtgaccgatatcatgggcgagattgcctcggcgtctgacgagcaaagccgtggtatcgaccaggtgggcctggcggtagcggagatggatcgcgtaacgcagcagaacgcctcgctggtggaagagtccgccgccgcggctgcggcgctggaagagcaagccagccgtctgacccaggccgtcgcggtgttccgtattcaccagcaacagcagcgtgcgcgtgaagtggctgcggtaaaaaccccggcagccgtgtcgtcaccaaaggccgcagtggccgacggcagcgataattgggaaacattttaa

SEQ ID NO: 20677 - protein, 553 aa, Salmonella typhimurium
MLKRIKIVTSLLLVLALFGLLQLTSGGLFFNSLKNDKENFTVLQTIRQQQSALNATWVELLQTRNTLNRAGIRWMMDQSNIGSGATVAELMQGATNTLKLTEKNWEQYEALPRDPRQSEAAFLEIKRTYDIYHGALAELIQLLGAGKINEFFDQPTQSYQDAFEKQYMAYMQQNDRLYDIAVEDNNSSYNQAMWVLVSVLIAVLVVIIAVWFGIKLSLIAPMNRLIESIRHIASGDLVKRIDVEGSNEMGQLAENLRHMQSELMRTVGDVRNGANAIYSGASEIAMGNNDLSSRTEQQAASLEETAASMEQLTATVKQNAENARQASHLALSASETAQKGGKVVDNVVQTMRDIASSSQKIADIISVIDGIAFQTNILALNAAVEAARAGEQGRGFAVVAGEVRNLAQRSAQAAREIKSLIEDSVSRVDVGSTLVESAGETMDEIVNAVTRVTDIMGEIASASDEQSRGIDQVGLAVAEMDRVTQQNASLVEESAAAAAALEEQASRLTQAVAVFRIHQQQQRAREVAAVKTPAAVSSPKAAVADGSDNWETF

SEQ ID NO: 20678 - DNA, 1521 bp, Salmonella typhimurium
  CDS (1)..(1521)
atgtcttctcatccctacgtcagccagctaaataccccgctggatgatgataccactctgatgtctacgaccgacctggaaagctatatcactcacgccaatgacacttttgtccaagtgagcggctatcagttaaacgagttactggcgcagccacataatctggtgcgtcatccggatatgccgaaagctgccttcgcagatatgtggtacaccctaaaacagggcgaaccgtggagcggcattgtgaaaaaccggcgtaaaaacggcgaccattattgggtgcgggccaacgcggtaccgatgatacgtgaagggcgtgtgactggatatatgtcgatccgtacccgcgccacggatgatgaggttgccgccgtcgagcctttatatcaggcgctaaatgaagggcggtgtagtaaacgaattcataaaggcctggtggttcgtcagggtttgctgggcaaactgcccgctatgcctgttcgctggcgagtgcgtagcattatggggctaatggccgtaatgctggcgttggcgttgttcggtacggatgcctcatggcaggcgttgctgttgggcgcgttggcgatgctggcaggtacggcgctattggaatggcaaattgtgcgtcccattgaaaatgtggcgacgcaggcgctgaaagtggcgaccggcgaacgcaacagcgtacaacatcttaatcgtagcgatgagttggggctgacgctgagggccgtggggcagcttggcttgatgtgccgctggctgatcaatgacgtatcaagtcaggtttccagcgtcagaaacggcagtgaaaggctggcgaagggtaataatgatctgaacgaacacacccgtcagaccgtggagaatgttcaggaaacggtaacgaccatgaaccagatggcggagtccgtgaagctcaattccgagacggcttccgctgcggataagctttccatggcggccagtagcgcggcgactcagggaggtgaggcgatggatacggtgattaaaacgatggatgatatcgctcacagtacgcaacgtatcgggacgatcaccacgctaattaacgatatcgcttttcagacgaatatcctggcgctgaatgcggcggtagaagcggcgagagcgggcgagcaggggaaagggtttgccgtggttgctggcgaggtacgccatcttgccagccgcagcgctaatgcggcgaacgatattcgtaaattaattgatgccagcgcaacaaaggtgcagtcaggctccgagcaggttcacgccgcaggccgtaccatggatgacattgtagctcaggtgcaaaatgtcaccctgcttatcgcacgtatcagtcagtcgacgcaggaacagacagatgggctttccagcctgacccgcgccgtggacgagttgaaccgcataacccagaaaaatgcggcgctggtggaagagagcgcacaagtctccgcaatggtaaaacaccgtgccagccggctggaggatgcggtcacggtactgcattaa

SEQ ID NO: 20679 - protein, 506 aa, Salmonella typhimurium
MSSHPYVSQLNTPLDDDTTLMSTTDLESYITHANDTFVQVSGYQLNELLAQPHNLVRHPDMPKAAFADMWYTLKQGEPWSGIVKNRRKNGDHYWVRANAVPMIREGRVTGYMSIRTRATDDEVAAVEPLYQALNEGRCSKRIHKGLVVRQGLLGKLPAMPVRWRVRSIMGLMAVMLALALFGTDASWQALLLGALAMLAGTALLEWQIVRPIENVATQALKVATGERNSVQHLNRSDELGLTLRAVGQLGLMCRWLINDVSSQVSSVRNGSERLAKGNNDLNEHTRQTVENVQETVTTMNQMAESVKLNSETASAADKLSMAASSAATQGGEAMDTVIKTMDDIAHSTQRIGTITTLINDIAFQTNILALNAAVEAARAGEQGKGFAVVAGEVRHLASRSANAANDIRKLIDASATKVQSGSEQVHAAGRTMDDIVAQVQNVTLLIARISQSTQEQTDGLSSLTRAVDELNRITQKNAALVEESAQVSAMVKHRASRLEDAVTVLH

SEQ ID NO: 20680 - DNA, 1644 bp, Salmonella typhimurium
  CDS (1)..(1644)
atgcgtttgctgcaaaactttactattcgtatggtcatgctgacgatactgggacttttttgtctactctggtcgggggtggggttatacagcgtccatgctttatccgaagtttcggaaggaaatgatattgaccggcatcttgtgcggcaaatgacggtgctaagccagggtaacgatcaatatttccgctttgttacccgccttagccgcgcgatggatgtaaaaatcggcggcggcacgcccgattttgcgcccgcccggcagtcgctcgagaatatgcgtcagaagctggaggagatgaaagcgctatcgccagggccgatgaaccctgatatctcaagggaggtcttgtccaactggcaggccttgctggagaaaggcgtcgttcctcaaatgcaactggcgcagcaaggatcgctgaccgcctggagcgaacatgccagtacggtcacgcccgcactcagtcgcgcgttcggcgccagcgcggaacggtttagtcatgaagctggcgccatgctggataacacacgtgtgatggtcgatggtaaaacctataccatccgcatcctgcttatcacggcggtgattctgggcattgctatcctgatttttaccgatcgctatctggttgcaatgatggtgaaaccgctggagcgcatccgtcagcagtttcagcgcatcgcgcaaggcgatcttagccagccgattgaagcgttggggcgtaactgcgtaggccggttggtgccgctactacgcgcgatgcaggacagtttacgcgaagccgtgagtacgatccgcgccggaagcgacaatatctggcgcggcgcgacggaaatttctaccggtaataacgatctctcttcccgaacggaagaacaggccgccgcgctggaagaaactgccgccagcatggaacagcttaccgcaacggtgaaaatgaacgccgaacacgctcgccaggcgagtcagcttgcggatgccgcctcgctaacggcaggaaaaggcggtgaactggtttccgatgtggtagaaacaatgaacggtatttccgccagttcgcagcagatcgccgaaattactaccgtgattaatagtattgctttccagaccaatattctggccttgaacgcagcggtagaagcggccagagcgggcgagcagggacgcggcttcgcggtggtcgccggtgaggtacgtaacctggccagccgcagcgcgggggcggcgaaagaaattgaagccttaattggcgaatcggtacgtcgcgtagcgcagggcgcgcagttggtccaggagaccggcgcgacgatggacgccatcctgcgcggcgtcacggaagtgacgacgattatgaaacagatcgcgtccgcctccgaagaacagagtaaaggtatttctcaggttggcgtggcgatcacgcaaatggatagcgttacgcaacaaaacgccgcgctggttgagcaggtttccgcggcggcggcggcgctggaacggcagacggaggatttgcaacgctccgtacagcagttccggctttccgctagtgagccgcaacaacgcgtaacggcgaaagcggcgcctggcgttcagagaatggcgtcggctcccgcacagtctactgatgaatgggtttccttctga

SEQ ID NO: 20681 - protein, 547 aa, Salmonella typhimurium
MRLLQNFTIRMVMLTILGLFCLLWSGVGLYSVHALSEVSEGNDIDRHLVRQMTVLSQGNDQYFRFVTRLSRAMDVKIGGGTPDFAPARQSLENMRQKLEEMKALSPGPMNPDISREVLSNWQALLEKGVVPQMQLAQQGSLTAWSEHASTVTPALSRAFGASAERFSHEAGAMLDNTRVMVDGKTYTIRILLITAVILGIAILIFTDRYLVAMMVKPLERIRQQFQRIAQGDLSQPIEALGRNCVGRLVPLLRAMQDSLREAVSTIRAGSDNIWRGATEISTGNNDLSSRTEEQAAALEETAASMEQLTATVKMNAEHARQASQLADAASLTAGKGGELVSDVVETMNGISASSQQIAEITTVINSIAFQTNILALNAAVEAARAGEQGRGFAVVAGEVRNLASRSAGAAKEIEALIGESVRRVAQGAQLVQETGATMDAILRGVTEVTTIMKQIASASEEQSKGISQVGVAITQMDSVTQQNAALVEQVSAAAAALERQTEDLQRSVQQFRLSASEPQQRVTAKAAPGVQRMASAPAQSTDEWVSF

SEQ ID NO: 20682 - DNA, 1155 bp, Salmonella typhimurium
  CDS (1)..(1155)
atgttgagaaatatcagcgtcaggacatgcattattctattcatggtatgtgcgtttcttttggtggatactttacaaatagcttttctgcacgatctccctattttaattacgtgtaatatcatttatctgatctcggcattactgctttggtggtatatgacctgctatctggtagtgccgattaataccgtgaagaaaagtattgaagaggtcgcagcaggaaacttgtctattcatatctccgaatttggcaataattgcgccgggcgactcatccccggtattaatagcctgtcggagaatatttccgcgttggtacgtgaaatcagatcctcttcgcaaacggcaatgaccctttccgaacaactggcggcgcgcagtctgtcgctatccgtaaagacggaacagcagtcggcctcgttaattcaaactgccgccagtatagatgaaatggcggcgagtaccaaaaacaatgcggataatacccgaatggcgagcatacaggcggattgtgcaacccaatgcgcccgtaaaggcggtgaattaatggtgcgggttacagaaaatatgcgttctattaccgactgtgcctcgcagatgacggagattatttcattgattgacggtatcgcattccagactaatattctggcgcttaacgcggcggtagaggctgcacgggcgggcgatcatggaaaaggtttctccgtggtggccggggaagtgcgtaatctggcgcatcgtagcgccgaggcggcaaaaagtatcaaggcgctgatcgacgttacgcatgacaatgtgcggcagggggccgccatagtgcaggaggctgaaaaaaatatgcaggagattgttggcggctccgggcaattaaacgtgctgatgagtgaaatttccaccaccacgcgggagcaggaaaaaggcattaaccagataaccctggcgttgagcgatctggaaagcgcaacccatagcaatgtcttaatggttgaagcgctatctgcttcttcggatgttttaaaggcgcaggtgatcgagttacagactaaaaccgacaaatttcgtttaagccagccgggttacagtgaacatgcgctgtcgcactctcatgtatcatctctttcgaccatcaccaggcgcggccaggcctga

SEQ ID NO: 20683 - protein, 384 aa, Salmonella typhimurium
MLRNISVRTCIILFMVCAFLLVDTLQIAFLHDLPILITCNIIYLISALLLWWYMTCYLVVPINTVKKSIEEVAAGNLSIHISEFGNNCAGRLIPGINSLSENISALVREIRSSSQTAMTLSEQLAARSLSLSVKTEQQSASLIQTAASIDEMAASTKNNADNTRMASIQADCATQCARKGGELMVRVTENMRSITDCASQMTEIISLIDGIAFQTNILALNAAVEAARAGDHGKGFSVVAGEVRNLAHRSAEAAKSIKALIDVTHDNVRQGAAIVQEAEKNMQEIVGGSGQLNVLMSEISTTTREQEKGINQITLALSDLESATHSNVLMVEALSASSDVLKAQVIELQTKTDKFRLSQPGYSEHALSHSHVSSLSTITRRGQA

SEQ ID NO: 20684 - DNA, 1626 bp, Salmonella typhimurium
  CDS (1)..(1626)
atgggcaacacattctcgatgcaagcctcgcataaactgggcttcctgcatcatattcggctggttccgctgttttcctccattctcggtggcatccttcttctttttgctttgagcgccgggctggcaggctattttctgttacaggccgatcgcgatcagcgtgatgtcacggacgagattcaggtacggatgggattatccaacagcgctaaccacttacgtaccgcacgtatcaatatgatccacgctggcgcggcgagccggattgctgaaatggatgaaatgaaagccaatattgccgctgcggaaacgcggatcaagcagtctcaggacggctttaacgcttatatgtccagagcggtgaaaacacccgccgatgacgcgttagataacgagttaaacgcccgctacaccgcctatatcaacggcctgcaaccgatgctgaaatttgccaaaaatggcatgttcgaagcgatcattaatcatgaaaacgagcaggcaaaacaactggatgccgcatataaccatgtcctgttgaaagcgattgaactgcgcaccgagcgggcgagactacttagcgagcaggcttaccaacgtacccggctcggtatgatgtttatgattggcgcatttacgttggcgctggtattgacgttaatgaccttcatggtgctgcgtcgcacggtgatacaacccttgcagcagtctgcgtcacgtatcgaacgcattgcggccggcgatctgaccatggctgacgagcccacaggacgcagtgaaattggtcgcctgagccatcatcttcagcagatgcagcatgcgttgcaacaaacggtaggggcggtgcgtcagggggcggaggaaatttatcgaggcaccagcgaaattaccgctggtaatacggatttatcttctcgtactgaacagcaggctgccgccattgaacagaccgcggccagtatggaacagttgacggcaaccgttaagcagaatgcggataatgcgcatcacgccagcaaactggcggaagatgcttccggtaaagccagccgcggaggccagatggtttccggggtcgtacaaacgatggggaatatttccaccagctcgaaaaaaatctcggaaattaccgccgtcattaacagtatcgctttccagaccaacatcctggcgctgaacgcggcggtcgaggcggcacgcgccggggaacaaggacgcggttttgcggtggtcgccagtgaggttcgtaccctcgccagtcgcagcgcgcaggcggcaaaagagattgaaggcttgatcggcgcatcggtcagcctgattgaacaaggatctgaagaggttatcgctgcggggagcaccatgaatgagattgtggatgccgtcaaacgcgtcaccgatattatgctcgacatcgcggcagcctctgatgagcaaagtcgcggtattgttcaggtcagtcaggctatttctgagatggacagggttacgcaacaaaacgcgtcgctggtcgaagaggcgtccgcggcggcacgttcgcttgaagaacaggctgcccgcttgacgcaagccgttgatgcgtttcgtttacatgatactggcgcgacgatgcgatcatccttcctttag

SEQ ID NO: 20685 - protein, 541 aa, Salmonella typhimurium
MGNTFSMQASHKLGFLHHIRLVPLFSSILGGILLLFALSAGLAGYFLLQADRDQRDVTDEIQVRMGLSNSANHLRTARINMIHAGAASRIAEMDEMKANIAAAETRIKQSQDGFNAYMSRAVKTPADDALDNELNARYTAYINGLQPMLKFAKNGMFEAIINHENEQAKQLDAAYNHVLLKAIELRTERARLLSEQAYQRTRLGMMFMIGAFTLALVLTLMTFMVLRRTVIQPLQQSASRIERIAAGDLTMADEPTGRSEIGRLSHHLQQMQHALQQTVGAVRQGAEEIYRGTSEITAGNTDLSSRTEQQAAAIEQTAASMEQLTATVKQNADNAHHASKLAEDASGKASRGGQMVSGVVQTMGNISTSSKKISEITAVINSIAFQTNILALNAAVEAARAGEQGRGFAVVASEVRTLASRSAQAAKEIEGLIGASVSLIEQGSEEVIAAGSTMNEIVDAVKRVTDIMLDIAAASDEQSRGIVQVSQAISEMDRVTQQNASLVEEASAAARSLEEQAARLTQAVDAFRLHDTGATMRSSFL

SEQ ID NO: 20686 - DNA, 1782 bp, Rhizobium meliloti
  CDS (1)..(1782)
atgttttctttcaccaggagccgtgacgcacggcagatcatcgacgccttgtccaaatcgcaggcaatcattcaattcgatctcgccggcaatgtcctcgatgccaacgagaatttctgcaaggcgctcggctacagtctgcaggaaatcgtcggacagcaccatcgcatcttctgcgcgccggaattcgtggcgactgaggagtatcgtgagttctgggcgcgcctcggccgcggcgaactcgacagcaacagctaccgacgcctcgccaagggcggacgggagatctggatacaggcgagctacaacccggtcttccgaaacggcaagccctgcaaggtcgtcaagttcgcaaccgacatcaccgcagccaagatgaaggccacggaagatgccggcaagctcgatgccatttcccgctcgcaggcgatgatcgagttctcgcctgccggcgaggtgatgacagccaacgagaacttctgcaacacgctcggctatcagctctccgaaatccagggccggcaccacagcatgttctgcgagcccggttataccggcacggccgaatatgccgatttctggaggcggctggcccagggcgaattcatcgccaacgaattcgtccgctacggcaagggcggcaaggaagtctggatccaggcggcctacaaccccattcgcgatccgaacggccgggtttacaaggtggtcaaattcgcgacagacgttaccgaacgcatggccgcgatcaattcgctcggagccggcctgcgtgcgcttgccgagggcgatctggcacaatcgatcgacacgcccttcgttcccagcatggaaatggtgcgcaaggacttcaacgaagcgcttgtccgcctctgtcgggccatgcagacggtcggcgaaaatgccagcgcgatcgctggcggcgcgcgcgagatccggtctgccgccgacgccctgtcgaaacgcaccgaacagcaggcggcctccgtcgaggaaacggccgcagcgctggacgagatcaccacgactgtcgcggattccagccgccgcgccgaggaagcaggcaatctggtcgcaaagacgaaggacggcgccgagcgctccggacttgtcgtcaaaagcgcgatcggcgccatgggccagatcgagcaatcctcgcgggaaatcagcaacatcatcggcgtgatcgacgacatcgccttccagacgaacctgctggccctcaatgccggtgtcgaggcggcgcgtgccggagaagccggcaagggctttgccgtcgtagctcaggaggtccgcgaactggcgcagcgatcggccagcgcggcaaaggacatcaagaccctgatcaccgcttcaggcgagcatgtgaggaacggcgtatcgctggtcggccagacgggcaccgctctggaaaccatcctggcgcaggtgcaggagataaatcacaacgtctcggcgatcgtggaagcggctcgcgaacagtcgaccgggctcaaggaaatcaaccaggcggtcaatgcgatggatcagacgacgcagcagaacgccgccatggtggaggaaagcacggccgcgagccatcggatgtcgcaggaggcggacgcgttgcacgccctgctgcgtcagttccgcatcggacgggacgcttcgcccgcaagcgacaacaggatggaagcgcctcattcgcccacgcggctccacgcaacggcaaagacgctacgcagcggcacgagatccaatctcgcgctcgctcccgccgcggacgactgggagaatttctga

SEQ ID NO: 20687 - protein, 593 aa, Rhizobium meliloti
MFSFTRSRDARQIIDALSKSQAIIQFDLAGNVLDANENFCKALGYSLQEIVGQHHRIFCAPEFVATEEYREFWARLGRGELDSNSYRRLAKGGREIWIQASYNPVFRNGKPCKVVKFATDITAAKMKATEDAGKLDAISRSQAMIEFSPAGEVMTANENFCNTLGYQLSEIQGRHHSMFCEPGYTGTAEYADFWRRLAQGEFIANEFVRYGKGGKEVWIQAAYNPIRDPNGRVYKVVKFATDVTERMAAINSLGAGLRALAEGDLAQSIDTPFVPSMEMVRKDFNEALVRLCRAMQTVGENASAIAGGAREIRSAADALSKRTEQQAASVEETAAALDEITTTVADSSRRAEEAGNLVAKTKDGAERSGLVVKSAIGAMGQIEQSSREISNIIGVIDDIAFQTNLLALNAGVEAARAGEAGKGFAVVAQEVRELAQRSASAAKDIKTLITASGEHVRNGVSLVGQTGTALETILAQVQEINHNVSAIVEAAREQSTGLKEINQAVNAMDQTTQQNAAMVEESTAASHRMSQEADALHALLRQFRIGRDASPASDNRMEAPHSPTRLHATAKTLRSGTRSNLALAPAADDWENF

SEQ ID NO: 20688 - DNA, 2070 bp, Rhizobium meliloti
  CDS (1)..(2070)
atgaacaccgttccatccgccaagggaaagctttccgtcagcctacgccttgcgacgcttgcgggcgcagcctttctaggtttcggttccgttctcgccgtcggcctttatgagcaaggcggctcgcaagaggcactcgacaaggcggttatcgctcagcgcggcatgggaacgctcgaggaaatgcgccttgcccgcctggagctcgtgcttgcggcaatggacaccatcgtcgaccgcggcgaacgccggatacagccggaacgtgcggcccagatcggatcctcgctcgaggtcatcgagggcaggcaagccgatctcgaagcgctcgcgcgtcttatcggcaagccggaagttcttgccggtttcgaatcggatatggcccaactgcgcaaggccgtcgagcaggacctgaaagcgctcgtggaggccggagcgccagccgaggaattcgcccgcatcgacgatgtcatcgacgccgcaggcgagcgcgtgggcgcatcgcttgcgcaattggccgatgccgcagccagcctggccgcggggcgcatcgcagatgtccgcaccagtggtgagcatgcgctcatgctccaggcagccgcctgtttgctggcaatggcgaccctgatcggcctgatctggttccatgggaacgtcttgcgccggggcatcctcggtctgcgcgacagcatgcggcggatacattcgggcgatctcacggctgaagcggcggggctcgaccgcggcgacgaaatcggcgagatggcacgttcggtggagcttttccgggtctcggcaatcgagaaacgcgcgctcaaggaaagggccagggcgagccggcaggaaaccgagacggaacgcgagcgtcacgagacggagcgcgagcaggcgatcggactgatcaacaccgcagtcgaagccctcggcggagcgctcaatcagcttgcagacggcaatctggcggttgcgatccgcgagcctttcgatggcgggctcgatgcgttgcgccgtgacttcaacgacacggtggaacggctgagccaggtcctttcgagtgtcaaggagaataccgcctcgatcgaatcgaacgggcggcagatgcgcagcgctgccgatgatctggcgcggcggacggaaaaacaggccgcgtcgctggagcagacgtcggccgcgctcgaggaaatcaccgtcacggtgaagacagcgaccgagcgcgccgaagaggcgagccacatggtcgacgagacacgcatcaatgcggaggagtccgggcgcatcgtcggcgaggcgatcgccgccatggcccgcatcgagggcgcttccagcgagatcggcaagatcatcgacgtgatcgacgagattgcgttccagaccaatctgctggcgctcaatgccggggtcgaggccgcgcgggcgggagaggccggcaagggctttgccgtcgttgcccaggaggtgagggagctcgcccagcgcgctgccggtgccgcgaaggatatcaaggctctggtgagccgctcgggcaatgaagtcaagaccggcgtcaggctggttcaggagaccggcgacgcgctcggccgcatcggtgccaaggtggcctgcatcaacgaacatatgagctcgatcgtcatggcggcgcgcgagcaatcgacgggccttcgcgaaatcgataccgctgtcgctcaactcgatcagatgacgcagcagaatgccgcaatggtcgagcagaccaatgcggcgagccatacgcttgcgcaggatgccgagaaactcagcgagatcgtcgggcaattccgccacgggcaggcgcgcgagacggcgatccgcacggcggcgatccagccgccgggcagggcaggctcggcgacggcaagcgctccggcgcgggcggcaacagcgactgctgccgcgcccgtgtcgcttcgcaagcccgcggccgcgcaatcatccacgcgtccagctccatctccagcaaaggcgttgatgggaaaactggctggcgcattcggtaacaggccgggatcaacgccgtcggtaacggcgtccggtgaaaattgggaagagttttga

SEQ ID NO: 20689 - protein, 689 aa, Rhizobium meliloti
MNTVPSAKGKLSVSLRLATLAGAAFLGFGSVLAVGLYEQGGSQEALDKAVIAQRGMGTLEEMRLARLELVLAAMDTIVDRGERRIQPERAAQIGSSLEVIEGRQADLEALARLIGKPEVLAGFESDMAQLRKAVEQDLKALVEAGAPAEEFARIDDVIDAAGERVGASLAQLADAAASLAAGRIADVRTSGEHALMLQAAACLLAMATLIGLIWFHGNVLRRGILGLRDSMRRIHSGDLTAEAAGLDRGDEIGEMARSVELFRVSAIEKRALKERARASRQETETERERHETEREQAIGLINTAVEALGGALNQLADGNLAVAIREPFDGGLDALRRDFNDTVERLSQVLSSVKENTASIESNGRQMRSAADDLARRTEKQAASLEQTSAALEEITVTVKTATERAEEASHMVDETRINAEESGRIVGEAIAAMARIEGASSEIGKIIDVIDEIAFQTNLLALNAGVEAARAGEAGKGFAVVAQEVRELAQRAAGAAKDIKALVSRSGNEVKTGVRLVQETGDALGRIGAKVACINEHMSSIVMAAREQSTGLREIDTAVAQLDQMTQQNAAMVEQTNAASHTLAQDAEKLSEIVGQFRHGQARETAIRTAAIQPPGRAGSATASAPARAATATAAAPVSLRKPAAAQSSTRPAPSPAKALMGKLAGAFGNRPGSTPSVTASGENWEEF

SEQ ID NO: 20690 - DNA, 2526 bp, Rhizobium meliloti
  CDS (1)..(2526)
atgttcatcgacaggatacttgcccgcttcaagattcagacgaaggttctgttcttcatcctgcctttcgtcgtcagcatctcggccgtcggcataaccggactttatgcctctggactgctgcagggccgcatggagatttcgaacagcgtcctcaagacgctgagcggcttcaaggacgtctatgcccagatgaacaacttcctgcagcagacaaccgacgaaagtcggcggatgctcaaggacgcaatcgtcacgcagaaggaagttctggccgaaaccgcggcgcaggttgcgggcggaaacggcgaggacgagctggctgccgccattgccgcgaccagcgacatcgagacgcgcatcgacgggctctggacattgcatgagggcgagcagaagctccgggccgagacgagggccgatctggagcgtctggcggccgaacaggcgaagatcaacgaagaggcgaaccggctgcaatacgcggtgcgcaaggacgagaatgcggcgaagacgatgctgcgcaacgccgaaaaactcatgcgtgccagccgcttctacgccgaattcgcgaccgaggtgagcggggcgataacggtcgaggagaagctgaaggtcgcagagggtcacttcccggccataggccgcacgcaacgggatatcttcgtgcttttgccgaagggcgagaattcccttgccgaaaccgtcaattctgcttccggggcgatcggcgccctcatcaagacgccgcccggccccgaaacgctcgccggcctttccaaatatgtcgaccgtttccgcaccgccagcttccggctggaggcagcttcggtcggcaagatgcgcgaggcgacgcagatattcagcgagctcgacggcaagatcgcagggacggagtcggtactgaccgcgacacgcaggctctccacatcgcttaccgacatccaaatcgccgccgcggcatttctcggaacgacgagcgaggaaagccgcaagaagctcctcgacaggttccttgcagtccagtccaacctcacaactctgcgcggcatcgcgagcggcatgagcttcttcgaccaggccgccggcgcacttctgccgatcatcgacgggatgaagaaggatggccttgcgctggtcgagatcacggataagcgcactgtcgaattcggggccgcgggcgccgcgatcaacgagatctggagcgacctcaccgggtttgccgagcagcagaaggtcgccgccggcagcgagcgtgcggaagccaatcagatctccgttgcggcgacgatcaccggcgtcgtgatcgcgctcctggccggcatcgcgctcacgctcacgctgaaaaagccgatcggccagatcacggctgccatgcggcggctggcggacggcgcgctcgatacctcgatcgacggcggcatgcgccgagacgagatcggcgacatggcgcgtgccctcggcgtcttcaaggaaaatgcgctctccaaggtgcgcatcgaggcggaaagcgccgaagagcgtgcccgcgcggaagccgagcgcagccgcaacgatgccgagaagcgcgagctcgacagacagatcgatcttgccgtgagcgaactcgcagccggtctcggacgcctggcacagggcgacctgtcgcggcagatcgaagtgcccttcgccggccgtctcgaacagttgcggctggatttcaacggatcgctcttccgccttcaggatacgctggcgcagattcgcgccaatgcccaggcgatccagcagggtggcgccgacatgcaccggtctgccgacgcgctgtcgaagcggacagaggctcaggccgcttcgctcgaggagacggcggcggccgtcgaccagatcaccgtgacggtgcgctcctcggcggagcgggcgcacgaggcgaaccaggccgtgtctcataccaagcggagcgccgacagttcggcgacggtcgtcaccaacgccgtcgccgccatgggacgcatcgaggccgcctcccgccagatcgagcagatcatcgaagtgatcgacgatatcgccttccagaccaacctcctggcgctcaatgccggtatcgaagcggcgcgtgccggcgaggcgggcaagggctttgccgtcgtggctcaggaagtgcgcgaactggcgcagcgctcggccgaggcggcgcgagagatcaaggggctgatcgacaaatcgacccaagaggtgagttccggctcgcgtctcgtcaaggaaacgggcgcggtgctcgcctcgatcagcgccgagatcgtcacagtcagccagcatgtcgagatgatcgccacggccagccgcgatcaggccgcagccctgaacgaggtcaacggttccgtcaaccagatggaccagatgacgcagcagaacgcctccatggtggaggaggcgaccggcaccagccgggcgctcgccaatcaggcggatacgctgatgatgctggtcgagcagttccggctcgagccggtggccgcagccgaccacagctaccgggcggcctaa

SEQ ID NO: 20691 - protein, 841 aa, Rhizobium meliloti
MFIDRILARFKIQTKVLFFILPFVVSISAVGITGLYASGLLQGRMEISNSVLKTLSGFKDVYAQMNNFLQQTTDESRRMLKDAIVTQKEVLAETAAQVAGGNGEDELAAAIAATSDIETRIDGLWTLHEGEQKLRAETRADLERLAAEQAKINEEANRLQYAVRKDENAAKTMLRNAEKLMRASRFYAEFATEVSGAITVEEKLKVAEGHFPAIGRTQRDIFVLLPKGENSLAETVNSASGAIGALIKTPPGPETLAGLSKYVDRFRTASFRLEAASVGKMREATQIFSELDGKIAGTESVLTATRRLSTSLTDIQIAAAAFLGTTSEESRKKLLDRFLAVQSNLTTLRGIASGMSFFDQAAGALLPIIDGMKKDGLALVEITDKRTVEFGAAGAAINEIWSDLTGFAEQQKVAAGSERAEANQISVAATITGVVIALLAGIALTLTLKKPIGQITAAMRRLADGALDTSIDGGMRRDEIGDMARALGVFKENALSKVRIEAESAEERARAEAERSRNDAEKRELDRQIDLAVSELAAGLGRLAQGDLSRQIEVPFAGRLEQLRLDFNGSLFRLQDTLAQIRANAQAIQQGGADMHRSADALSKRTEAQAASLEETAAAVDQITVTVRSSAERAHEANQAVSHTKRSADSSATVVTNAVAAMGRIEAASRQIEQIIEVIDDIAFQTNLLALNAGIEAARAGEAGKGFAVVAQEVRELAQRSAEAAREIKGLIDKSTQEVSSGSRLVKETGAVLASISAEIVTVSQHVEMIATASRDQAAALNEVNGSVNQMDQMTQQNASMVEEATGTSRALANQADTLMMLVEQFRLEPVAAADHSYRAA

SEQ ID NO: 20692 - DNA, 1998 bp, Rhizobium meliloti
  CDS (1)..(1998)
atgaaaattcgcggaaagataaacctcatcgtcggcatcatgagtctgctggcgatagcgatcaccggtatgtcgttgctgatcgtgagcgagtacaaccaacggctcggtgaataccagaacgcctccgaccgggctttcaagggcgagcggctcaatcgcctggtaacggcggtggtgatggaggcgcgcggcatctatgcggcgccaacggtcgagaaggcaaagccttttgccgagggaattctcaagaacctcgacaagatcgacgcgctgctcaccgagtggcggccgctggtgccggccgacgtcctgcccgccttcgataccctcgtcgaacgcgcggaggaattcaagacgttccgaagcgagacggctcgcctcggcacgcaggttgcgccgaaagctgccaacgagcagggcaacaacgaagcgaaccgggccaaccgcaaggcgttccaggctgaaatcgacgtggtcgtcgacgagaaccttgcctcgcttcagacgatcaccgcggatctggccgactacaagcgctcgatcgtgctgatcgtccttgcaaccgctgccctgggcatgctggccgggatcggtgccgccttctatattgcgaccaatcacctcagccgcccgattctcgatctgacgggcaagatgaagctgcttgccggcggcgatctctcggttgatgtgcccttcgccgggcgcaaggacgagatcggcgacatggcggcggcggtcgaagtcttcaagcagaacagcctcgccgtgcgcgagctcaacgcccaggaagagatcctgcgcgaaaagagcgcggacctgcagtcgagcatcgccacggtcgtcgcggcggctgcggcaggggatttcaccaggcgcatcagcaaggactacgacaacgacgatctgaaccgctttgcggcgagcgtcaacgaactggtcaacagtgtcgacacgggcatcgccgagacccggagggtcatcgcaagcctggcgacgggcgacctcacgcaaagcatgaagggccagttccagggcgccttcgccgagttgcagacgaacgtcaacgataccttgcagaccttgcagaagaccttgcgcgaggtccgcatgacgacggactcgatcaacgggaactctacggagttgcgcagtgccgccgacgatctgtccaagcggacagagcagcaggccgcagctctggaggaaacctcggcggcgctcgacgagataaccgccgcggttcgcaattcgacggagcgggcccaggaagcgaccgtcatggtcacggaggcgaaggacagcgcagcggagtcggcatcggtcgtccgcaacgccatcgatgccatgggccggatcgaacaggcatcgagcgagatcggccagatcaccaacgtcatcgacgagatcgccttccagacgaacctgctggccctcaatgccggcgtcgaggcggcgcgcgccggtgatgccggcaagggttttgccgtcgttgcgcaggaggtccgcgagctcgcccagcgtgcagccagcgccgccaaggatatcaagtcgctgatttcaaaatcgggcggcgaggtggccaccggcgtcaagctcgtccaggcgacgggagcggcgctcggacagatcgagacgcgggtcctcaagatcaacgatcacatccattcgatcgcgacggccgcacgcgagcagtccacgggcctcggggaggtcagcaccgccgtcaaccagatggatcaggtcacccagcgcaacgccgccatggtggaggaggcgaatgccgccacgcacaagctgtctgccgaggccgacaatctcgccaacctcatcgcctatttcaaggtcgagcgcgaggcggtgcgtacggtcgtgccggcaaaggatgcgagccggccggtggcctcgcccgcccgccgcatgatgggcacggtcgcgcgcgcattcggcaacggctccgctgcggtcgcccgcgacgattgggaggagttctga

SEQ ID NO: 20693 - protein, 665 aa, Rhizobium meliloti
MKIRGKINLIVGIMSLLAIAITGMSLLIVSEYNQRLGEYQNASDRAFKGERLNRLVTAVVMEARGIYAAPTVEKAKPFAEGILKNLDKIDALLTEWRPLVPADVLPAFDTLVERAEEFKTFRSETARLGTQVAPKAANEQGNNEANRANRKAFQAEIDVVVDENLASLQTITADLADYKRSIVLIVLATAALGMLAGIGAAFYIATNHLSRPILDLTGKMKLLAGGDLSVDVPFAGRKDEIGDMAAAVEVFKQNSLAVRELNAQEEILREKSADLQSSIATVVAAAAAGDFTRRISKDYDNDDLNRFAASVNELVNSVDTGIAETRRVIASLATGDLTQSMKGQFQGAFAELQTNVNDTLQTLQKTLREVRMTTDSINGNSTELRSAADDLSKRTEQQAAALEETSAALDEITAAVRNSTERAQEATVMVTEAKDSAAESASVVRNAIDAMGRIEQASSEIGQITNVIDEIAFQTNLLALNAGVEAARAGDAGKGFAVVAQEVRELAQRAASAAKDIKSLISKSGGEVATGVKLVQATGAALGQIETRVLKINDHIHSIATAAREQSTGLGEVSTAVNQMDQVTQRNAAMVEEANAATHKLSAEADNLANLIAYFKVEREAVRTVVPAKDASRPVASPARRMMGTVARAFGNGSAAVARDDWEEF

SEQ ID NO: 20694 - DNA, 2367 bp, Rhizobium meliloti
  CDS (1)..(2367)
atgttcaagttccaagccagatcgctggcgacaaagttgatcgcggtgacgggaggcacgatcgccctcgtgctgctcgcgtcgaattacgtgctcatctcccagacgcaggaccgtgtggaaacgctggtcttcgacggcgcgaagacggaagcgcgggcgatcgcgtccgacatcgcgggaagcgtcggcgaacttgccgccgccgcgcggaccatgtcgggcgttctggggcgcggccatgccgggcagtccaccgaccgcgcaggcgccatcaatctcctgaaggccaatctggagcagcatggctttgccttcggcagctggttcgccgaagagcccaaggcctatgacggaaaggacgtcatcgacaacacggaacgtggcggcaatgccgacggtgcgttcacgccctattggtccaaggaccgcaacggaaatatccagctctcgaccttcaaggccgattatgcggccgagtggtacggcctcgccgcgaagagcggcaagggcgccatcacccagccatatctcgccgagggcaccgacgtcccgaccacgatgacgtcgatcgcctaccccgtcatgtcgaacggcaggatgatcggcgtctcgggtgtcgatatctcgctcgccgcactcgccgaccgtctctcggcggtcaagcctttcggctccggccgggtctacctgctgtcgcagagcggcaagtggctcgccgcacctatccccgaactgctgatgaaggaatacgacggcgaaggcgttgagtccgtgaaggatgccctttccaccggcacgccccgcatgatcgagaacctgacttacgacggcaacgagcctttcgaccgagtcgtctatcctttcagcctgcccgacgtgaacgcgcagtggctggttctggtcgatgttccgcgctcagccatcaatgcgccggttcgcgatcagacctatatgatgatcgtcggcggcctggtggtcctcggcgccgtgctcgccggcctctatttcgccgttcgccgcttcgtccagaagccgcttgccggactcgtgggcgacgtcgagacgctcagcaacggagaatatacccggccgatttccggtcaggaacgctccgacgagacaggcgccgtcgccaggtcgctcgagggcttccgtcaccagcttgccgacaacaggcggctcgaaagcgaggcccgccacgagagagaacaggccgaactggaacgcggacgttcggaaaacgaacgcaccgaggccagcgcgctgcagcgcgacatcgtcgcacgccttggcaaggccctgtcgcatctctccgccggtgacctcgccttccgccttaccggcgacttccccggcgaatacgcgcagctgaagcgcgatttcaacgcgacgatggagagcctcgaagagacgatccgcaccgtcaaccactccgtcgtcaatatcggcagtggcaccagcgagatctcgggcgccgccaacgacctgtcgcatcggactgaacagcaggcagcaagcctcgaggagaccgcggccgcccttgacgaactgacctcgcaagtgaacgccagcgccgagaacgccaaggtcgccgcgaagtccgtcgaggtcgcaagcagcgacgcggaacagtccggcgaggtggtgcagaaggcgatcgccgccatgcagggtatcgagcagtcgtcgcatgaagtcagccggatcatcggcgtcatcgatgaaatcgcctttcagaccaaccttctggcgctcaatgccggggtcgaagccgcccgcgccggcgacgccggcaagggcttcgcggtcgtcgcacaggaagtccgcgaactcgcgcagcgctccgccaatgccgcaaaggaaatcaagacgctgatcaatacatcggcgggccaggttcgcgagggcgtcgacctcgtcggcaaggccggcggcgcgctcgagaagatcgccgagcaggtggtgcagatcaacgggctcatccgccagatctccagctccgcctcggaacaggcggtcggcctcaaggagatcaattccgccgtcaatcagatggaccaggtgacacagcagaacgccgccatggtggaagagacgactgccgccagcatggcgctgaacgacgaggcccgcgccctcagcgcgctggtcgcccgtttccagatcgccccgcaggctgcccaggcccaagcctcggccgaaatgctgcgcggtacggccgagcggatgcgtgcggctgctcccgcggaaaatcgtccggcacaggcgccgcgcagtgccgcctactccaattcgactcaaagagtgcttgccaagacatccggcgccaatgcgctcgcgcaggacaattgggaagaattttga

SEQ ID NO: 20695 - protein, 788 aa, Rhizobium meliloti
MFKFQARSLATKLIAVTGGTIALVLLASNYVLISQTQDRVETLVFDGAKTEARAIASDIAGSVGELAAAARTMSGVLGRGHAGQSTDRAGAINLLKANLEQHGFAFGSWFAEEPKAYDGKDVIDNTERGGNADGAFTPYWSKDRNGNIQLSTFKADYAAEWYGLAAKSGKGAITQPYLAEGTDVPTTMTSIAYPVMSNGRMIGVSGVDISLAALADRLSAVKPFGSGRVYLLSQSGKWLAAPIPELLMKEYDGEGVESVKDALSTGTPRMIENLTYDGNEPFDRVVYPFSLPDVNAQWLVLVDVPRSAINAPVRDQTYMMIVGGLVVLGAVLAGLYFAVRRFVQKPLAGLVGDVETLSNGEYTRPISGQERSDETGAVARSLEGFRHQLADNRRLESEARHEREQAELERGRSENERTEASALQRDIVARLGKALSHLSAGDLAFRLTGDFPGEYAQLKRDFNATMESLEETIRTVNHSVVNIGSGTSEISGAANDLSHRTEQQAASLEETAAALDELTSQVNASAENAKVAAKSVEVASSDAEQSGEVVQKAIAAMQGIEQSSHEVSRIIGVIDEIAFQTNLLALNAGVEAARAGDAGKGFAVVAQEVRELAQRSANAAKEIKTLINTSAGQVREGVDLVGKAGGALEKIAEQVVQINGLIRQISSSASEQAVGLKEINSAVNQMDQVTQQNAAMVEETTAASMALNDEARALSALVARFQIAPQAAQAQASAEMLRGTAERMRAAAPAENRPAQAPRSAAYSNSTQRVLAKTSGANALAQDNWEEF

SEQ ID NO: 20696 - DNA, 1665 bp, Rahnella aquatilis
  CDS (1)..(1665)
atgtttaaagcgatcaacaatatgcgtgtcggtgcccggctgggtgcggcatttagtctggtgatactgctgctgatcatcgtcagcgtaacggcagtaactaaaataagcagtattaacagcagtatcgaacaaataatcagcgaccgttatgtcaaagtgcgtctggcatttgatgttcgtgacggggtgaacgatcagattaaatatcttcgcggtattgtcatcgataccaaaaatccagagcaaaataacaaacgttatttacagcttgatgactccgtgaaacaaactaatttagcgatggataaaatcgccgctattcagactaccgtggtcggcaaacagaagattaaagcgctgcaggatgcgagtgatatctttgaagctgcgaaagaacaactggtcgctttagctcgcgccggggatatggacggcgcgacggagttcgttctgcgcaaactgaccacctcgcaaaatgcctatctggatctggcttccgcgtttgctaactcacaagatcagcagcttcaggctgaagggaaaaaagctatcgcggacgggcacaatgccattcagctgacactgattttctccgtactggcgattctggtcgcggcagcactgggcttcttcctcacccgttccattacccgtcctctgcatactgccgtaaaagtggcggaaaatgtcgcggcaggggatctgactacgcaaattcaggtgacctcaggcgatgaaaccggtcagctcatgcaggggctgaagaacatgaacgaaaacctgctgaaaattgtgaccgaagtgcgtgcgggcacgaacgcgatccacagcgcttcgggcgaaatcgcggccggaaacctggatttatcttcccgtaccgaacagcaggccagctctctggaagaaacggcgtcggccatggagcaaatgacggcgaccgtgaaacagaatgcggataacgcccgtcaggccaatcagctggccgcgcaggcttcccgcgtagctgttcagggcggtgaagtggtgggcgaagtggtcaacaccatggaaggtattaacgcgtcttcccgtaaaatcgtcgacattattgctgtgattgacggcattgcgttccagaccaatattctggcgctgaatgccgcggttgaagcggcgcgtgccggtgagcaggggcgtggctttgcggtcgtggcgtctgaggtgcgtaatctggcgcagcgctctgcgagtgccgcgaaagagatcaaagtgctgatcgacgattcggtggcaaaagtggataacggcacacaactggtcgcgaaagccggttcgacgatggcagaagtggtgtccagcgtgaaaagcgtgaccgacattgtgggcgaaatcgccatcgccagtaacgaacagagcaccggcattgaggaaattaataaagccatcacgcagatggatgaagtgacgcagcagaacgccgctctggttcaggaagcctcatcggcggcatattccctcaatgagcaggcggagcgtttgtcgcaggccatcagcatcttcaaagtcagcgcaggttccgcgacggcggcggtgcgtaaggctgctcacgcgaaaacaccggccttgttgtcaaaccgccagccggttcctgttattgaagaaggtaactgggaaaccttttaa

SEQ ID NO: 20697 - protein, 554 aa, Rahnella aquatilis
MFKAINNMRVGARLGAAFSLVILLLIIVSVTAVTKISSINSSIEQIISDRYVKVRLAFDVRDGVNDQIKYLRGIVIDTKNPEQNNKRYLQLDDSVKQTNLAMDKIAAIQTTVVGKQKIKALQDASDIFEAAKEQLVALARAGDMDGATEFVLRKLTTSQNAYLDLASAFANSQDQQLQAEGKKAIADGHNAIQLTLIFSVLAILVAAALGFFLTRSITRPLHTAVKVAENVAAGDLTTQIQVTSGDETGQLMQGLKNMNENLLKIVTEVRAGTNAIHSASGEIAAGNLDLSSRTEQQASSLEETASAMEQMTATVKQNADNARQANQLAAQASRVAVQGGEVVGEVVNTMEGINASSRKIVDIIAVIDGIAFQTNILALNAAVEAARAGEQGRGFAVVASEVRNLAQRSASAAKEIKVLIDDSVAKVDNGTQLVAKAGSTMAEVVSSVKSVTDIVGEIAIASNEQSTGIEEINKAITQMDEVTQQNAALVQEASSAAYSLNEQAERLSQAISIFKVSAGSATAAVRKAAHAKTPALLSNRQPVPVIEEGNWETF

SEQ ID NO: 20698 - DNA, 1587 bp, Agrobacterium tumefaciens
  CDS (1)..(1587)
atgcaacagcttgtcacggctctccaggacgagggcggaggtcctgaaggcctgtttgcgcttcgatccgctcaagccaagcttaacggtcagatcgcagatatgctgaatgatctgacggtgacctccatcatcctcggagtcgacgtcaaattgatcgcggcgaaggaaaagcaagctgcccgaaacgccgcggaattgtctcgaggaatgacccagcagactgtcgcggtcaatgcggcaacgagctttctgttgattgcggccgcgcttgccgccctgttctacgtccggcgttccgtgacgcggcggctgatcaggctcgcgacggtcatgggccgtatcgcctccggtgatcattccactcaagtccccatgtccggccgtgacgagatcaccgacatggcgggcgccgtcgaagtgttccggaccaatgccgtcgccaacatccgcctcgagcaggaagccgaggaacaacgcaacctgaccgaggaggatcgtcgtcgtaaggccgagagcgatcgtgtccgcgccgaggcgatggcacaagccacctacggcctcggtgaagggttgaagcacctttctgcgggcaatctgacgttccgactttccgcgcctttcgcggatgaattcgagacgctgcgcgccgatttcaatgccgctgccggccagcttgccgagacgctgcgcgccgttgccgatgccacaaacgccatcgacagcggcagccgcgaggtcagcgtcagcgccgatgacctctccaaacggaccgagcagcaggctgcctcgctcgaagaaaccgcggcggccctcgaccagatcacggtgaatgtcaccaattcatccaagcgcgccgacgaagcccgcgcgatcgccgcccaggccaatgccagcgccgctcaatcgggtcatgtggtggcgagcgccgtcgacgccatggagaagatcgaacagtcgtcgaaccaggtctccaacatcatcggcgtcatcgacgaaatcgccttccagactaatcttcttgcactgaatgccggcgtcgaagcggcacgcgctggtgaggctggcaagggcttcgccgttgtcgcgcaggaagtgcgcgaactggcgcaacgctccgcaaaggctgccagagagatcaaggatctcatccgaaactcatcggtcgaggtgcagaacggcgtcaagctcgtcagcgaaaccggagcggccttgaaaacgattgagggctatatcgtcaccgtcaaccagcatatggacgcgatcgcgatatcggcccgcgaacagtcggttggtctttcggaggtgaacaccgccgtcaaccagatggatcaggtcacccagcaaaatgcggccatggtcgaggagagcaatgcagcaagcgcgacacttgccaacgaggccgggcggcttcgtgccttaattagccaattccagttcggcgatgcggtacgccgggcggtttccatcagtgaggtcagcccatccacccggcccatcgcatcgccggcgcgtcggattgcgagtgctgtcgccaaagccttttctggcaacgccgcggtcaagcagacctgggaagagttctga

SEQ ID NO: 20699 - protein, 528 aa, Agrobacterium tumefaciens
MQQLVTALQDEGGGPEGLFALRSAQAKLNGQIADMLNDLTVTSIILGVDVKLIAAKEKQAARNAAELSRGMTQQTVAVNAATSFLLIAAALAALFYVRRSVTRRLIRLATVMGRIASGDHSTQVPMSGRDEITDMAGAVEVFRTNAVANIRLEQEAEEQRNLTEEDRRRKAESDRVRAEAMAQATYGLGEGLKHLSAGNLTFRLSAPFADEFETLRADFNAAAGQLAETLRAVADATNAIDSGSREVSVSADDLSKRTEQQAASLEETAAALDQITVNVTNSSKRADEARAIAAQANASAAQSGHVVASAVDAMEKIEQSSNQVSNIIGVIDEIAFQTNLLALNAGVEAARAGEAGKGFAVVAQEVRELAQRSAKAAREIKDLIRNSSVEVQNGVKLVSETGAALKTIEGYIVTVNQHMDAIAISAREQSVGLSEVNTAVNQMDQVTQQNAAMVEESNAASATLANEAGRLRALISQFQFGDAVRRAVSISEVSPSTRPIASPARRIASAVAKAFSGNAAVKQTWEEF

SEQ ID NO: 20700 - DNA, 1857 bp, Agrobacterium rhizogenes
  CDS (1)..(1857)
atgcaggagggtgtgacccgcgcgctatcgcgctacaaatcattgtcctcgatgctccgcaatgcgcaggcctcggcggcggacagcgtcgagcggtcgcgcgccctgaccgatcttcagatggcggccgcccagatatcgaccctgatgtcggccatacccaatgcatcggaaaccgaattgaccgcgatcaaggatcaatatgatgccaccggcaaggagatcgacagcatactcgcccgtctgaaagcctcaggcggcagtactgctatgcaagtgctcgtaaaagcgctcctggacgagggcacgggtcctcaagggctgtttgcgcttcgagccgaccaggccaagctcaacggccagaccgctgatatgctcaatgatatgacggtgacctccatcatccttggtgtcgacgtcaaattgatcgcggcgaaggaaaagcaagccgcccgacatgctgcggaactgtcgcggggaatgacccagcagaccgtcgcggtcaacgctgcaacgagctgcctggtgatcgcggccgcgctcattgccctgttctacgtccggcgttccgtgacgcggcgactaatcgggctcgccaccgtcatgggccgtctcgctgccggtgaccattccactcttgtcccggtgaccggccgtgacgagatcaccgagatggccggcgccgtcgaagtgttccgggccaacgctgtcgccaacatccgccttgagcaggaagcagtggaacagcgcaatctcacagaagaggaccggcgtattaaggccgagagcgatcgcctccgggcagaggcaatggcacaagccacacagggtctcggcgaagggttgaagcacctctccaccggcgatctcacctatcggctttcgcagccttttgccgccgaattcgagacgctgcgcgccgatttcaacggtgccgtcggccagcttgccgagacgctgagagccgtcgcggacgcggcaaacgccatcgacagtggcagccgcgaggtcagcggcagcgccgacgacctatccaagcgcaccgagcagcaggccgcgtcgctcgaagaaacggcggcggccctcgaccagatcacggtgaatgtcgccaattcgtccaagcgcgccgacgaagctcgcatgatcgccgcccaggccaataccagtgccgcccattccggccaggtggtggcgagcgctgtcgacgccatggagaagatcgagcaatcgtcgaagcaggtctccaacattatcggagtcatcgacgaaatcgcattccagaccaatctccttgcgctcaatgccggcgtcgaagcggcgcgcgctggcgacgccggcaaaggcttcgcggttgtcgcacaggaagttcgcgaacttgcacaacgctccgctaaggccgcaagagagatcaaggaactgatccgaaattcctcggtcgaggtacagagcggcgtcaagctcgtcagcgagaccgggactgccctgaaaaccatcgagggctacattgtcaccgtcaaccatcatatggactcgatcgcgacatcggcccgggaacagtcggttggtctggccgaggtgaataccgccgtcaatcagatggatcaggtcacccagcagaatgccgccatggtcgaggaaagcaatgcagcgagcgcgacccttgccggtgaagcaggacggctgcgcgacctgatcagccagttccaatttggcgaagccatgcgccggccggcgcccgtcaccgaggccagcccttccaaccggccggtcgcatcgccggcgcgccggattgtcggtgcggttgccaaggccttttccggaaacgctgccgtcaagcagacctgggaagagttctga

SEQ ID NO: 20701 - protein, 618 aa, Agrobacterium rhizogenes
MQEGVTRALSRYKSLSSMLRNAQASAADSVERSRALTDLQMAAAQISTLMSAIPNASETELTAIKDQYDATGKEIDSILARLKASGGSTAMQVLVKALLDEGTGPQGLFALRADQAKLNGQTADMLNDMTVTSIILGVDVKLIAAKEKQAARHAAELSRGMTQQTVAVNAATSCLVIAAALIALFYVRRSVTRRLIGLATVMGRLAAGDHSTLVPVTGRDEITEMAGAVEVFRANAVANIRLEQEAVEQRNLTEEDRRIKAESDRLRAEAMAQATQGLGEGLKHLSTGDLTYRLSQPFAAEFETLRADFNGAVGQLAETLRAVADAANAIDSGSREVSGSADDLSKRTEQQAASLEETAAALDQITVNVANSSKRADEARMIAAQANTSAAHSGQVVASAVDAMEKIEQSSKQVSNIIGVIDEIAFQTNLLALNAGVEAARAGDAGKGFAVVAQEVRELAQRSAKAAREIKELIRNSSVEVQSGVKLVSETGTALKTIEGYIVTVNHHMDSIATSAREQSVGLAEVNTAVNQMDQVTQQNAAMVEESNAASATLAGEAGRLRDLISQFQFGEAMRRPAPVTEASPSNRPVASPARRIVGAVAKAFSGNAAVKQTWEEF

SEQ ID NO: 20702 - DNA, 1815 bp, Rhizobium meliloti
  CDS (1)..(1815)
atgagaagaattcggatttcagcgcgtctttacgcgctggtcgcgtttgcgcttttgacgatggcggcggcgctgaccttcggactgatccaggcgcaggacaagctggttgccgagcgcaaggccatgctcgcggcgatgaacgagaacgcgatcacggtgttcgacgcctatcacgcccaggaaaaggccggaacgctcacgcgcgaggaggcgcagggctgcgctctggaggcgatccgggcgatgcgctatcaggacagcggctatttctgggtgaacgatatgcatccgaagatggtgatgcatccgatcaagcccgaactcgacggcgccgacctgacgcagaacaaggacccgaacggcaagttcctgttcgtggaattcgtcaagacggtgcaggcgcacggcaagggcttcgtcgattattactggccgaagcccggcgccgacgagcccgtgctgaaatattcgcatgtggccggtttcgagccctggggatgggtggtcggcaccggtgtttatgcagacgatctcgccgccatgttccgcgagcgcgcctggcagatggccggcattctggtcgcggcagcgctcgcgatcctcatggcggccttggcgatcgtgcgcagcgtcgttcggcccatcgaaaagctgaaggtctcgatgcgggcgatcgcagacgaggacctttcctcggatgttccggaaaccgatcgcgccgacgagatcgggcagatggcgaaggtgctcgtcgtcctgcgcgactccgtcagggagcgcctcgaactgcgatcgcgcgaggcggagcagcaggaccgcctcgacgcagaacggcgcggccacgaggagcgccagcgtacgactgccgcaacccaggccgaggcgatggagacgctcggcgccgcgctcgagcggctggcaaacggcgacctcaccgccgcggtcgcccggatcgcgccggaatatgccaagctcaaggacgacttcaacacggcggtcgccgcgcttcgcgacgtcatcggcgccatttcccgatccaccgaaatcgtccatggcagtgccgccgatatatcagaggcggccaacaacctgtcgcgccggaccgaacagcaggcggcggctcttgaagagacagccgcggctcttgacgagatcacctccaccgtacgtcatgcgtcgggtcgtgccctcgaggcgcgcgacatggtcgacgagacgaaggcgagcgccgcaaaatccggtgatatcgtgcgcaacgcgatcgatgccatggggcggatcgaagcctcatcgagccggatcagccagatcatcggcgtgatcgacgagatcgccttccagacgaacctgctggcgctgaatgcaggcgtcgaggcggcgcgggcaggggaggccggccgcggtttcgccgtcgttgcccaggaggtccgcgaactcgcgcaacgctcggccggcgcggcaaaggaaatcaaggcgctgataggcacctcggtgaaggaagtcggtgccggcgtcgaactcgtccgctcgacgggtgatgcgctgatggagatcgatgctctggtcaaccgtgtcaacgagcaggtggccgcgattgcgaccgctgctcgggaacaggcgaccggactgcaggaggtcaacacggccgtcaacagcatggaccagatgacgcagcagaacgcggcaatggtcgaggagacgaccgcggcaagccagacactggcgcaggaaagtcgtgagctgaaggcgctgctcgaacagttcaggctcgaggaacggggcgcgcagccggcctatggcagggcagcgtaa

SEQ ID NO: 20703 - protein, 604 aa, Rhizobium meliloti
MRRIRISARLYALVAFALLTMAAALTFGLIQAQDKLVAERKAMLAAMNENAITVFDAYHAQEKAGTLTREEAQGCALEAIRAMRYQDSGYFWVNDMHPKMVMHPIKPELDGADLTQNKDPNGKFLFVEFVKTVQAHGKGFVDYYWPKPGADEPVLKYSHVAGFEPWGWVVGTGVYADDLAAMFRERAWQMAGILVAAALAILMAALAIVRSVVRPIEKLKVSMRAIADEDLSSDVPETDRADEIGQMAKVLVVLRDSVRERLELRSREAEQQDRLDAERRGHEERQRTTAATQAEAMETLGAALERLANGDLTAAVARIAPEYAKLKDDFNTAVAALRDVIGAISRSTEIVHGSAADISEAANNLSRRTEQQAAALEETAAALDEITSTVRHASGRALEARDMVDETKASAAKSGDIVRNAIDAMGRIEASSSRISQIIGVIDEIAFQTNLLALNAGVEAARAGEAGRGFAVVAQEVRELAQRSAGAAKEIKALIGTSVKEVGAGVELVRSTGDALMEIDALVNRVNEQVAAIATAAREQATGLQEVNTAVNSMDQMTQQNAAMVEETTAASQTLAQESRELKALLEQFRLEERGAQPAYGRAA

SEQ ID NO: 20704 - DNA, 2124 bp, Rhizobium meliloti
  CDS (1)..(2124)
atgccgcctctttcagggagccccaccttgtccaaacgatcgaatctcatgacgcgcattctcgttgccgcgtcctgcgtcgtcgtcggcgcctttgcaggcttttccgtctatatcgacagtctccagcgcgccacgaccacgaaagcagtggaggaggatatcgcttcctccggcaaccaggcggcgcagagcgtcgccaactggctgaacggccgtgtgacgctgaccgcgatggcggcggacgctgccggccaggtggctgacgaagccgccatcgggagcgtcctgaagaacgacgtgctgaccggcgaattcatctccacctatgtcggcaacgagagcggccagttcatgatctggccggactcgaagatgcccgacggttacgatccgcgccagcgcccctggtatcagcaggcggtgaaggccgatgcgcgcgtcctaaccgaaccctatgtcgacgcgtcgagcggcgacctgatcatcagcgccgccgtaccggtgaagcacgagggcaaactttacggtgtgacgggcagcgatttctcgctcaaggccctcgtttccatggtcaacggcatcgacgtcggcggcgaaggctttgcgttcctcgccaacaaggatggccagatcctggttcatcccaatgccaagctcgtgacgaagacgctcgccgacgccttcccggtggatccgccggcgatcggcaccgggatcatgcacaccgagctcgacggtaagccgatgctcgtgagcttcgtgccggtgaaggggcttccgtcggtcgaatggtatgtcggcttcgcgctcgatgcggatgtcgcctattcggcgatcagccagttccgcgtcgccgcgacgatcgccacgatcctggcggtcggcgcgatgatcgccttcctcgccacgcttctgagccgcctcgtcatccgtccggtaaccgacatgaccggtgccatggagaagctcgcagccggcagtctcgacgttacgatcccgggagaggagcggcgcgaccagatcgggtcgatggcggcggccgtcgccgttttccgtgccaatgcggtcgaacggaagcgcctcgaagacgaggccgattccaaccgctcgctttcggagcgcgagcgtctcgagcgcgaggcgcagaagacccgcgatgccgccgaggttcagcatgcggtcgatgcgctggcgacgggtctcggacggctggccgacggcgatctcgcctatcggatcggcagtccctttgccgaccgcctggatcgcctccgggaagacttcaacaactcggtcgccaagctgcacaacacgctttgcgcagtgggcgccaatgcccgcgcgatcgacgcgggcgcgacggagattcgctcggccgccgacgacctcgcacgccgcaccgaacagcaggcggcatccgtcgaagaaacggccgctgcgctcgaggagatcaccaccaccgtccgcgattccgcccaccgggccgaggaagtcggtgcgctggtcgcccgcacccgtgccggtgcggagaagtccggcgaggtggtgcagaatgcggtcgaggccatgcacgccatcgagaaatcgtccggagaaatctcgaacatcatcggcgtcatcgacgacatcgccttccagaccaatctcctggcgctcaatgccggcgtcgaagcggcacgggccggcgaggcgggcaagggtttcgctgtcgtcgcccaggaagtgcgcgaactcgcccaacgctcggccaatgccgccaaggaaatcaaggcgctgatcaccacctcgggcgagcaggtgcattccggcgtgacgctggtcggtgataccggacgggcgctgcaggcgatcgtcgtcgaggtgcaggagatcaacaagcatgtaagcgcgatcgtaacggcgacgcgcgagcagtcgaccggtctccaggagatcaacacggccgtcaacacgatggaccagggcacccagcagaatgccgctatggtcgagcagcagacggctgccagtcacggcctcgcatccgaggccgcggcgctcaacgcgctgctcgcccagtttatactgggcgagacgcaagcggcctcttaccaggccacgagccgccgccgtgcagcctga

SEQ ID NO: 20705 - protein, 707 aa, Rhizobium meliloti
MPPLSGSPTLSKRSNLMTRILVAASCVVVGAFAGFSVYIDSLQRATTTKAVEEDIASSGNQAAQSVANWLNGRVTLTAMAADAAGQVADEAAIGSVLKNDVLTGEFISTYVGNESGQFMIWPDSKMPDGYDPRQRPWYQQAVKADARVLTEPYVDASSGDLIISAAVPVKHEGKLYGVTGSDFSLKALVSMVNGIDVGGEGFAFLANKDGQILVHPNAKLVTKTLADAFPVDPPAIGTGIMHTELDGKPMLVSFVPVKGLPSVEWYVGFALDADVAYSAISQFRVAATIATILAVGAMIAFLATLLSRLVIRPVTDMTGAMEKLAAGSLDVTIPGEERRDQIGSMAAAVAVFRANAVERKRLEDEADSNRSLSERERLEREAQKTRDAAEVQHAVDALATGLGRLADGDLAYRIGSPFADRLDRLREDFNNSVAKLHNTLCAVGANARAIDAGATEIRSAADDLARRTEQQAASVEETAAALEEITTTVRDSAHRAEEVGALVARTRAGAEKSGEVVQNAVEAMHAIEKSSGEISNIIGVIDDIAFQTNLLALNAGVEAARAGEAGKGFAVVAQEVRELAQRSANAAKEIKALITTSGEQVHSGVTLVGDTGRALQAIVVEVQEINKHVSAIVTATREQSTGLQEINTAVNTMDQGTQQNAAMVEQQTAASHGLASEAAALNALLAQFILGETQAASYQATSRRRAA

SEQ ID NO: 20706 - DNA, 1524 bp, Erwinia amylovora
  CDS (1)..(1524)
atgtcgatcgcaatgataatcatatctttcttgatactgacttcgtttttactatcccgtctaactgccactacgtcagaattacagaatttgtatgaaagagactatcagtctgcctcgataattggtcaggtcgatggcctgctcacccgtgtggatatcaacattctccggatgatcgccatcggtgacccggcatcgattgccggctggaaaaaacaaaacaccgaaaactttgacgaagttaacgcgctgttaaataagcttaaacccacaattgataccacaatgacgtcgtcctttaacggattaatatcatcgtatgagttaatgcgtaaggggatggagcatcaggtacaggccgttgagtctggcgacataaaaaaagccagcgaaatcaacagaaatgaagtaaaagcgtatgcggataaaacatttggtgcattatccactctaaaaaaacatcaggatgcagttgcggaaaataaggtagttgctcagaaacgtaaggatttcaggacgctcatcatttcactcctcgctgccggggctgttacgctgatatcggttgcactgggaacgctgatcctgcgcagtttacttcggcagctgggcggagagcctctggcagcagcacaggaggtcaggctgatggcaggaggcgaccttacctttcccatcctggtggagcagcacgatcgtgtcagcctgctggcccagctgaaagatatgcagtcatccctttccgcgctggtgactaacgtgcgcagcaatgcagaaagcctggcaaccgccagtacccagatatctcagggcaaccaggatctcagccagcgaacggaagaacaagccagctcgctgcaacagacctctgccaccatggaacaactgggttccaccgtcagcaataacgctgaaaacgcacatcaggccagccagctggcttccggtgcctcaacgctggcagcggaaggggagctaatggtcgggcgtgttatctcaaccatgagagtcatcaatgacagctcaaagaaaatttccgaaatcatcaatgtgatcgatggcatcgcctttcagacgaatattctggcgctgaatgcggcggtggaagccgctcgtgcaggtgaacagggacgtggattcgcggttgttgccgccgaagtgcgcagcctggcacaacgcagcgccaatgccgccaaagaaatcagcacattaattaccaacagcgtcgggcaggtcgagcagggctgtctgttggtggatgaaacaggcgtaaccatgacgcggattatggaggcgatcaaacaagtgaaatatattgtgtctgaaatcagtgctgcgagcctggaacaaagctcaggggtaaaacaggtgggacaggccatcacccagatcgacatggtgacgcagcaaaacgctgctttggtggaagaaagcgccgctgctacagaaaacctgaaagaacaggctgagcaacttgtccaggcggtggccgtctttcaggtgacggccaccgccgtttaa

SEQ ID NO: 20707 - protein, 507 aa, Erwinia amylovora
MSIAMIIISFLILTSFLLSRLTATTSELQNLYERDYQSASIIGQVDGLLTRVDINILRMIAIGDPASIAGWKKQNTENFDEVNALLNKLKPTIDTTMTSSFNGLISSYELMRKGMEHQVQAVESGDIKKASEINRNEVKAYADKTFGALSTLKKHQDAVAENKVVAQKRKDFRTLIISLLAAGAVTLISVALGTLILRSLLRQLGGEPLAAAQEVRLMAGGDLTFPILVEQHDRVSLLAQLKDMQSSLSALVTNVRSNAESLATASTQISQGNQDLSQRTEEQASSLQQTSATMEQLGSTVSNNAENAHQASQLASGASTLAAEGELMVGRVISTMRVINDSSKKISEIINVIDGIAFQTNILALNAAVEAARAGEQGRGFAVVAAEVRSLAQRSANAAKEISTLITNSVGQVEQGCLLVDETGVTMTRIMEAIKQVKYIVSEISAASLEQSSGVKQVGQAITQIDMVTQQNAALVEESAAATENLKEQAEQLVQAVAVFQVTATAV

SEQ ID NO: 20708 - DNA, 2172 bp, Agrobacterium rhizogenes
  CDS (1)..(2172)
atgagcattcattttgacttcctgctgctgcgcggaccgatccggaccaaaatcttttgcctgctgacgccgatacttgtcggcatcgctggcttgagcctcgtcaactatctctccggcaacatgctgaatacccagctcgcgagcagctcgagcgggatggtcacgctgtctgcgatcaaacaagcccaggacgggatgaactccttcctgcttgaggcgaccgaggccaagcgcgacgcgctgaaggcgctgctcgccgaccagagcgccaagatatcgacgagcctgtccttcgcccaagagcaggatgaacggcagagcttgcttgccgccgggacgattgccgaagaggtctccaggacgatcgacggcctctgggaaatgcacagcgacgagaggaaacttcgcgagggtatcgctagcgatctcgcaaccttgtcggacgtgcagtccaagctgcagacttacctcaacattcccgccgaccaggcggcggcacaagcggcgacggcggaaacgctgaacaagatcaattccatgaactatgaatttcggatcgcctcctccgattttctgggtggaatgaacgacgataccctcaagaaggtgaagggccgtctcaaggggctaggcttctatctcggcaaggtgaaagaacagcatgccgccaacggtcctatccaggaattggccagcaaagccatcgacgtgatcggcgggacctcggagaggttcgaccaactcctcgtcaaggtcggagaacgtgacgctgccttcaaggctgcgagcgccagcatgaatgacgcctggaacaagatccttctattcgccgacatccagcgcggccatgcatccgcggcccaagaccaggcgcaaaccatatccttagtgacgaccgtgatcgccctgctcttcggctgcgtcgccggctatctgctgctgagaaccatcaagtctccgatcgaagcgctgacggcctccatgaaggcggttgcatcaggcaagctcgatgaaaagatcggcagcgtcgaaacgcgcgacgagatcggcgagatggcaagggcgcttgatgtctttcgcaacaacgcgctcgaaaagatccgcgtggaaaatgaggcggaacagtcgaggtcgctcgcgcgccaacaacgccaggaagacgacctgcgcaagacccgcgatgcggctgccatcagtaacgcggtcgaggcggttgcatccggcctgcacaagctggcgagcggcgatctgacagtgaccatcggccgtcctctcgacggtgagctcgatcagcttcggcaggacttcaatgcctcgatgctgcacctgcaggcgacgatgcggcagatccgcgacaatgtcgaaatgattcagggcaatggcaaccagatggcggaggccgccgaggacctcgccaagcggaccgagcagcaggctgcttcgcttgaggaaacggctgccgccgtcgacgagatcaccgtcacggttcgctcgtcggcggaacgggccaaggatgccgaccagatcgtccgtcaggccaagcagagcgccgacgactcggcgatcgtcgtcaacaacgcgatcgacgccatgggccgcatcgaggaggcctcccgccagatcgagcagatcaccggtgtgatcgacgagatcgctttccagaccaatctgctggcgctgaatgccggcgtcgaagcggcccgcgcaggcgaggcaggaaaaggctttgctgtcgttgcccaggaggtgcgcgaactcgcgcaacgctccgccaaggcggccaaggagatcaaggtcctgatcaacaagtcgacggccgaggtcaataccggctcgcatctggtccaggaaaccggcgcggtccttgcgaagatcagcacccagatcgtcaccatcagccagcatgtcgagacgatcgcccgtggcagccatgatcagtcgagcgcgctgcagggggtcaactcgaccgtcaatcagatggaccagatgacacagcacaatgcggcgatggtcgaggaaacgacggccgcaagccgcgagctcgcctcccaggccgacagcctgctggcgctggttcagcagttcaggatcgaaggaaatgcacgagaatttgggttctcaaacgccgaggaactgtcgcaccaaccggccaatcaaagtgcggcatga

SEQ ID NO: 20709 - protein, 723 aa, Agrobacterium rhizogenes
MSIHFDFLLLRGPIRTKIFCLLTPILVGIAGLSLVNYLSGNMLNTQLASSSSGMVTLSAIKQAQDGMNSFLLEATEAKRDALKALLADQSAKISTSLSFAQEQDERQSLLAAGTIAEEVSRTIDGLWEMHSDERKLREGIASDLATLSDVQSKLQTYLNIPADQAAAQAATAETLNKINSMNYEFRIASSDFLGGMNDDTLKKVKGRLKGLGFYLGKVKEQHAANGPIQELASKAIDVIGGTSERFDQLLVKVGERDAAFKAASASMNDAWNKILLFADIQRGHASAAQDQAQTISLVTTVIALLFGCVAGYLLLRTIKSPIEALTASMKAVASGKLDEKIGSVETRDEIGEMARALDVFRNNALEKIRVENEAEQSRSLARQQRQEDDLRKTRDAAAISNAVEAVASGLHKLASGDLTVTIGRPLDGELDQLRQDFNASMLHLQATMRQIRDNVEMIQGNGNQMAEAAEDLAKRTEQQAASLEETAAAVDEITVTVRSSAERAKDADQIVRQAKQSADDSAIVVNNAIDAMGRIEEASRQIEQITGVIDEIAFQTNLLALNAGVEAARAGEAGKGFAVVAQEVRELAQRSAKAAKEIKVLINKSTAEVNTGSHLVQETGAVLAKISTQIVTISQHVETIARGSHDQSSALQGVNSTVNQMDQMTQHNAAMVEETTAASRELASQADSLLALVQQFRIEGNAREFGFSNAEELSHQPANQSAA

SEQ ID NO: 20710 - DNA, 2277 bp, Agrobacterium rhizogenes
  CDS (1)..(2277)
atgcagattttccacaatgctttgcaattctcccaccgcatgcggtccataaaggccaagtttgccgtggtgatcatagggacagcgatcgtctcttgcgcatctgttggagcattgagctaccagatcggcaaggacggtttgatcgaggcgagcaagatccgcctggaggccatcgcagccaatcagtcgaaggcgctgagagcctatgatgaaagggttcagcagacgctaaccgaaatagcgcagagccagtcgctcggagaaatgacggagcaggccggaaaggcgatcgcaatgtctgacgccaagatacgggaagcgttccaggatacgtcgaaaactccggagcaaagagcggccttcgacggatcgaccgtcaagatgctctatgccgtcaagcatagctcggtgcatggaccactcttcagcgcctggaagaatgccgatctcagcgatatcttcgtcatcgataacaatggccagctggtctacacggtcaccaaaggccccgagttcatgacgagcgtccaggatccgaagaacgcatccctgaagtcgctgtttgatgcatccaccgccggacccgccgatcagatttaccggacggggttcatacccttcaagagcgaggaaagcgatatttcggcctttcttgccaaaccccttgccaacgtcgtctggggctccgtcgtcaagcgtggcaccgtcgtgatccgtatcgcgccggcaaatctgctggcgcttatttcgcccgaggggttgggacggagcgtcgacgaagccttcctgatcgccgctgacggaaccttgcgagccggcaccctcgcaggggaaaatggggtggcgccggaattgctgagcgccgcgaaagagcagatgagtggctccgtcttcgctggtggctcccaaggctcctatttctattcctacgtgcccgtaaatctgttcgggcagtcgcaccttctggttatcggtcaggaaaagtccaaagttctcgcctcggctgatgaacttgcgaaatgggcaggtctgacgaccttggccgtgctgttcggcatggggatcgtgggttacgtcttttcatcccgcctcaccaaacccttgaaggacatcactggactgatgaaccgcctgaacaatggcgaccagacgatcgagattcgatccgtgtcccgctccgacgagatcggcattatggcgcgcgcgctcgaatcattccgtcaaagcgcagccgacaaggtgcgaatggaggaggaggcgatccagcgcaatgggcagctggaacatgagcggcagctgcgcgaaaccgacagggcaagaagtgccgcggagctggaagtggcggtgtccgagctggcgaccggactgaagaacctggcggagggacggctcgatcatcgcatcgagcatcctttcgcgccctccctcgaccagcttcgccaggatttcaacggctcgatgacgcggcttcaggcgaccatgcgccagatccgcgacaatgtcgaaatgatccagggcaacggcaaccagatggccgaggcggccgaggatctctccaagcgcaccgaacagcaggctgcttcgctcgaagaaacggcagccgccgtcgacgagatcaccgtcacggtccgctcgtcggcggaacgtgccaaggatgccgaccagatcgttcgccaggcaaagcgcagcgccgacgactcggcgatcgtcgtcgacaatgcgatcgacgctatgggccgtatcgaagaagcttcccgccagatcgagcagatcaccggtgtgatcgacgagatcgctttccagaccaatctgctggcgctcaacgccggcgtcgaagcggcgcgcgccggcgatgcgggcaagggctttgccgtcgttgcccaagaggtgcgcgaactggcacaacgctctgccaaggcggccaaggagatcaaggtcctcatcaacaagtcgactgccgaggtcaataccggctcgcatctggtccaggaaaccggcgccgtccttgccaagatcagcacccagatcgtcacgatcagtcaccacgtcgagacgatcgcccgcggcagccacgatcagtcgtgcgcgctgcagggggtcaactcgaccgtcaatcagatggaccagatgacacagcacaatgcggctatggtcgaggaaacgacggctgcgagccgcgaactcgcctcccaggctgacagcctgctggcgctggtccagcagttcaggatcgaaggaaacgcacgagaattaagcgtttacagggcagcttga

SEQ ID NO: 20711 - protein, 758 aa, Agrobacterium rhizogenes
MQIFHNALQFSHRMRSIKAKFAVVIIGTAIVSCASVGALSYQIGKDGLIEASKIRLEAIAANQSKALRAYDERVQQTLTEIAQSQSLGEMTEQAGKAIAMSDAKIREAFQDTSKTPEQRAAFDGSTVKMLYAVKHSSVHGPLFSAWKNADLSDIFVIDNNGQLVYTVTKGPEFMTSVQDPKNASLKSLFDASTAGPADQIYRTGFIPFKSEESDISAFLAKPLANVVWGSVVKRGTVVIRIAPANLLALISPEGLGRSVDEAFLIAADGTLRAGTLAGENGVAPELLSAAKEQMSGSVFAGGSQGSYFYSYVPVNLFGQSHLLVIGQEKSKVLASADELAKWAGLTTLAVLFGMGIVGYVFSSRLTKPLKDITGLMNRLNNGDQTIEIRSVSRSDEIGIMARALESFRQSAADKVRMEEEAIQRNGQLEHERQLRETDRARSAAELEVAVSELATGLKNLAEGRLDHRIEHPFAPSLDQLRQDFNGSMTRLQATMRQIRDNVEMIQGNGNQMAEAAEDLSKRTEQQAASLEETAAAVDEITVTVRSSAERAKDADQIVRQAKRSADDSAIVVDNAIDAMGRIEEASRQIEQITGVIDEIAFQTNLLALNAGVEAARAGDAGKGFAVVAQEVRELAQRSAKAAKEIKVLINKSTAEVNTGSHLVQETGAVLAKISTQIVTISHHVETIARGSHDQSCALQGVNSTVNQMDQMTQHNAAMVEETTAASRELASQADSLLALVQQFRIEGNARELSVYRAA

SEQ ID NO: 20712 - DNA, 1725 bp, Agrobacterium tumefaciens
  CDS (1)..(1725)
atgaatattctcaatcgtggtgccaatgcatgcgcggtacttgccgccctctctaaatctcaagccatgatcgaattcgatctgaccggaaggatactcaccgccaacgacaatttctgccgggcgctcggctacgagctagccgaaattatcggcaaacatcacagcatgttcgttgaaccggactttgtaaaatcggcagactataaggcgttctgggcgaaactcgccgccggcaacttcgaccagcagcaatataagcgcatcggcaagggcggcaaggaagtctggatcgaggcgtcctataaccctgtcatgcgccgtggcaagccggtcaaggttgtcaagatcgccaccgacatcaccgcccagaagctgaaagttgcagaagatgccggcaagatcgaggctttgtcgcgggcgcaggcgattatcgagttcacgccgaccggcgacgtcctgaccgccaacgagaatttcctgtccgccctcggatattctctgagcgagatccagggcaaacaccattcgatgttctgcgaaccatcctataccgcgtcgcccgactatcggaatttctggaagatgcttgcaggcggggatttgatggcggacgagttcatgcggctcggcaagggtggtcgcaaggtctttatccaggcatcctataatccgatcttcgatatgaacggcagagttttcaaggtcgtgaaattcgcgaccgacgtgaccacccgggtcgaaaacgtcgaacagctcgcgggctgcctgaacaggctggcggacggtgacctggcgcagcaaatcgaaaaaccgttcatcccctcgctcgaacgtttgcgcaccgatttcaacgccgcctccgacaagctgaagcgcgcgatggcgactgtcgccgacaacgccagggcgatctccgcgggatccagcgagattcggaccgccgccgacgagctggcaaaacgcaccgagcaacaagccgcctcggtcgaggagaccgccgctgcgctcgaggaaatcaccacaacggtcaaggattccagtcgtcgggcggaggaggctggccaactcgttgcacgcacccgcgaacatgcagagcattccggggaggtggtgcgcgacgcgatcggcgccatggatcagatcgaaacgtcctctcgcgagatctccaacatcatcggtgtcatcgatgagatcgcgttccagaccaacctcctggcgctgaatgccggtgtcgaagcggcccgtgccggcgaagcgggcaagggattcgcggtcgtcgcgcaggaagtccgcgagctcgcgcagcgatcggccaaggccgccaaggaaatcaagacgctgatcacctcgtcgggcagccaggtccagagcggggtatcgcttgtcacgaaagccggttccgcgctgcaggaaatcgcaacccaggtccacgacatcaacacgaatgtcgtcgcgattgtcgaagcggcacgcgagcagtcgaacgctctcggtgagatcaacaaggccgtgaacagcgtcgatcagggaacgcaacaaaacgccgcgatggtcgaggagcagacggcggccagccacagccttgctcgcgaggccgccgcgctattcgagctgctggagcatttcaggttcgatgataccggccgaacgcaagcgtttgctggccaggttcatcggccatccgtcgcgccagtcgccaaaccgtcgagcttcgctgcgtag

SEQ ID NO: 20713 - protein, 574 aa, Agrobacterium tumefaciens
MNILNRGANACAVLAALSKSQAMIEFDLTGRILTANDNFCRALGYELAEIIGKHHSMFVEPDFVKSADYKAFWAKLAAGNFDQQQYKRIGKGGKEVWIEASYNPVMRRGKPVKVVKIATDITAQKLKVAEDAGKIEALSRAQAIIEFTPTGDVLTANENFLSALGYSLSEIQGKHHSMFCEPSYTASPDYRNFWKMLAGGDLMADEFMRLGKGGRKVFIQASYNPIFDMNGRVFKVVKFATDVTTRVENVEQLAGCLNRLADGDLAQQIEKPFIPSLERLRTDFNAASDKLKRAMATVADNARAISAGSSEIRTAADELAKRTEQQAASVEETAAALEEITTTVKDSSRRAEEAGQLVARTREHAEHSGEVVRDAIGAMDQIETSSREISNIIGVIDEIAFQTNLLALNAGVEAARAGEAGKGFAVVAQEVRELAQRSAKAAKEIKTLITSSGSQVQSGVSLVTKAGSALQEIATQVHDINTNVVAIVEAAREQSNALGEINKAVNSVDQGTQQNAAMVEEQTAASHSLAREAAALFELLEHFRFDDTGRTQAFAGQVHRPSVAPVAKPSSFAA

SEQ ID NO: 20714 - DNA, 2410 bp, Rhizobium leguminosarum
  CDS (37)..(1998)
atccttccaacaaagctcaccgcggggagagtgcatatgaagaatatcatgagtttcggagttgtggcgcgcttggcgcttggcttcggcgttctcctcttgctgatggtcggcttgaccatctattcgacggaagaagttgcgctgatcaacgataaacttggagcgatgaacgacgtcaacagcgtgaagcaacggtttgccatcaactatcgcggcagcgtgcatgatcgggcgatcgccatccgcgacgtcactctggtgacatctgacgatgagcggaagacggccgaggcattgatcgggaagctggcagcctcttacgccgagaatgaaaagcgcatggcggatatggttgcatctccggccggtgcgacggaacaggaaaagaccatcctcagcgagattgcagacattcaggcgaaggccaatccattggtcgcccagatcattgcgctgcaggagaagggcgacggcgaggccgcccgcaagattctgctcgaacaggctcgaccggccttcgttgcctggctcggcgccatcaacaaattcatcgactatcaggaagcgctgaacaaatcgatcggcggcgaggttcgcagctcggcaagcggcttcaagccattcgcactgaccgcgcttggcattgcggccgttctttcgctggttgccgcggccgtgaccgcacgcacgatcgtcggcccgctggcaaaacttcagctttcgctgaaagccatggccgatggcaatcttgatggcgatcgccgcctcgaagcgcgcggcgatgagatcggcaagctcgcacgggcggtggccgggctgcgcgacgcaatttcggcaaaggcggaacgggaagccgacgccgaggcgaagcgagccgtgtcggagcggcatcgcctcgagcaggacgcagatgaacgccgcacgcttgcggagcagacggacaaggctgtcggccagcttggcgatgcgctgcaggcgctggctgacggcgaccttacacagcagatcggcactccgttcattccgtccttggaaaagctccgcgccgacttcaattctgcggtcgaaaagctccgtgccgccatgcagaaggttgcgcagaacgccagcgccatagcggccggtgcgcaggagatccgctccgcctcggacgatctcgccaagcggaccgaacagcaggcagcctcggtcgaggaaaccgccgcggccctggaagagattacgaccaccgttgccgactcgagcaacaaggctcaggaagccggccaactcgttcgcaagacgaaggatagcgcggagcgctctggcagcgtcgttcgggatgcggtcgatgccatgggcaagatcgaatcctccgccaccgaaatcggcagcatcatcggtgtcatcgatgaaatcgccttccagaccaacctgctggcgctcaatgccggtgtcgaagccgcccgcgccggtgaggcaggcaagggctttgccgtcgtcgctcaggaagtacgcgagttggcgcaacgttccgccaaggcggcaaaagaaatcaaggaactcatcaacgcttcgaacggccacgtcaaaagcggtgtggccctggttggcgagaccggaaaggcgctgaaagagattgcggagcaggtgcagcaggtcgacggcaatgtgggggccatcgtcggcgcttcgcaagagcaggcgacgggactgaaagaaatcaataccgccgtcaacaggatggatcagggcacgcagcagaacgccgccatggtggaagaagccacagcggcctctcataacctcgccaaggaagccgacgcgctgttccagcttctgggccagttcaacattggcggagcggtggcaccgaagcgcgcatcgcagcccgcagccgcagcgtcgcatgctcaaccggcgccctcgcctgcgcgccagatgattgccaaagtgggtaagtcgttccagacgaatgggaatgcggcattggccggcgattgggaagagttttaagtcgccctgatctctctccagtctatgctggaacgccaaagcggcataattttgcgcaagggcagcgtttgctgcccttcgcactttcggatcaaagaaggtgagcatgatgttgtctgaaaaccgctcacacttttcggcatcatgctctaggcccggaccggagccttggccggaagcagggcgttgaccacgaccgcaacggcgatgttggccgcaagcgccagcagtccggtatagacggtgaagggttcgccgccgaggctgatcagatgcagaggcttccaaccggcatcccagacgaggaaagtgccgccgccgaagccgacgaaccagccggcaagcaggccgggtgcacggaaccagttggtatagaggccgaagaccagggccggaagcgtctgcaggatcc

SEQ ID NO: 20715 - protein, 653 aa, Rhizobium leguminosarum
MKNIMSFGVVARLALGFGVLLLLMVGLTIYSTEEVALINDKLGAMNDVNSVKQRFAINYRGSVHDRAIAIRDVTLVTSDDERKTAEALIGKLAASYAENEKRMADMVASPAGATEQEKTILSEIADIQAKANPLVAQIIALQEKGDGEAARKILLEQARPAFVAWLGAINKFIDYQEALNKSIGGEVRSSASGFKPFALTALGIAAVLSLVAAAVTARTIVGPLAKLQLSLKAMADGNLDGDRRLEARGDEIGKLARAVAGLRDAISAKAEREADAEAKRAVSERHRLEQDADERRTLAEQTDKAVGQLGDALQALADGDLTQQIGTPFIPSLEKLRADFNSAVEKLRAAMQKVAQNASAIAAGAQEIRSASDDLAKRTEQQAASVEETAAALEEITTTVADSSNKAQEAGQLVRKTKDSAERSGSVVRDAVDAMGKIESSATEIGSIIGVIDEIAFQTNLLALNAGVEAARAGEAGKGFAVVAQEVRELAQRSAKAAKEIKELINASNGHVKSGVALVGETGKALKEIAEQVQQVDGNVGAIVGASQEQATGLKEINTAVNRMDQGTQQNAAMVEEATAASHNLAKEADALFQLLGQFNIGGAVAPKRASQPAAAASHAQPAPSPARQMIAKVGKSFQTNGNAALAGDWEEF

SEQ ID NO: 20716 - DNA, 3600 bp, Desulfovibrio gigas
  CDS (302)..(2251)
acacggagagcgctccgcgtgcggcgtgcgtgctgacaacctgatccagtaacaaatataacgcattgtaatatctcatttatggcgaattgtcgtcctgcgtggcgcatgggaggtctgcacgttttattcatagggagtaaccacctaacacctggggagaagtgctggccagccgccccgcaccaaccggttgggaagaggaataacattttcttttccatggagatacggtatccatttttccggtctggcctggactgtggcatgggaggataaacactaacgctgaggggtttccatgcagtggttcaacaatttgaagataggcactcggctcatcgcaagttccatactcgtcctcgggctcatggggggcgtgggatggctggggatgtccagcatgcagaccaccaatgcgttgctggaggaaatctacgaaaacaacctcaagccgattgtgcaccttgcagacgccaatgccgagttcatcaagtttggccgcaaccaataccgcatcttcatcagcaccaatgaccaggacgctgaggaattcgtcaagcgcggcgatgagaatatcgcccggaccaacaaggcgttggcggactacaccaaggcgaccctgacaggcaaagagcgcgaactgtacgatacattcaagcctgcctatgacgcctaccttgccgaaaacgccaagctccgccagatgatgcgcaacaaggaagacaaggacgtcatcacggacttcgtgctcaaccgcgtggcgcccctcggcgtgttgcccgaccagctgctgagcgacatggccgaggagaaccgcaatgaggccgaaaaggccgccgcacaggcgcacggcgtctatctcgaagcgcgcgagcgcatgttctgggtcatcggcgtggccgtgctgctggggctggcctcgggggtgttcctgtcccggctcatctcccgtggcgtgcgccagtgcgtggaggtggcccaggccctggccgtgggtgatttgaccaagcagctcaccatccgccagagggatgaaatcggccagatggccgaggccatgcgcgccgtggccgccgccgaacatgatgtggccggcaagctcgataagctttcccgaggcgatctgggcattgaggtgatgccgcgctccgaacaggacaccctcatgcgcgccattggcagcatcgtcctggccgagcgtgatgtggcggagaagatgaaacaggtggccgaaggcgatttgcgcatcaaggtggccccgcgttccgaacaggacgagctcgtgcgcgccattgccgagatgatcgaacgcgtgacgcagatcgtcgacgaggtgcggaccggcgcgcagaacgtggcctcgggcgacgaggagatgagcgccagttccgagacgctctcccagggcgcgtctgaacaggcggcttcggtggagcagtgctcgtcgtccatggaagaaatgtcctcctccatcaaccaaaatgccgagaatgcccgccagaccgggtccatcgcctccaaggccgcccaggacgccaaggaatccggcgaggccgtgcacaacaccgtggcggccatgaaggagattgccggcaagatttccatcatcgaggaaatcgcccggcagacggatttgctggccttgaacgccgcagtggaagccgcacgcgccggcgagcatggccgcggctttgccgtagtcgcctcggaagtgcgcaagctggctgagcgcagccagacggccgccgcggaaatcaacaagctttcttccacctccacggccgtggccgagcgcgccggcacgctgctggaaaagctggtgccggacatccagaagacggcggatctggtgcaggaaatcgccgccaccagccaggaacagaactccggagccggccaggtgaatctggccctgcagcagctggatcaggtggtgcagcagaacgcctcggcctccgaggagctggccagcacggcggaggagctttccgcccaggccgagcagctccaggcagccatggacttcttcatcacggatggcaaggtggcagcccgcaccgtgcgggcgtccgtcgcccggcctgccccggccagggttgccgcccggcccgcgcccaagcgcctgcctgcggcccggcgtgccggcacgactggcgcgactggcgcgactggggtgcacctggacttgtccaggggcgaagtggaggacgatgatctcggcttcgaacgcttcggcgccgatacataacccgccggaggacaacagtatgacggccagcctttcggaaggggttatgcggctgctgaccctcaccctggacaacgtctattttgccctggacattcattgcgtgcgcgagattctggacatgacggacatcaccagcatcccccatacgccggaatacatgcgcggcgtggtgaatgtgcgcggcagcgccgtgcccgtggtggatttgcggctgaagtttggcctgcctgcagcagagcggacgctgaacacccgcatcgtcatcctggagattccccggggggagggcgtggcggccatcggcgccatcgcggattcggtccgggaggtgctggaggtggaaaccgccagaatcgacccgcccccgcgcatgggcacgggcattcgggcggacttcatccggggcatctgccgccaggacgaacgcttcctgctcatcctggacgccgccaaggtcttcaccacggatgaagtcctgtccctggacgagcttggcgcgcagcctggcccggtggtggcttgaggggggtcgaagaattcttccagtgtatgcaggcatcagaaagtcgattccgcgggggcggaaaaagtgatcaaaaaaatctcgccgccccttgcgaaaaccacgggcctcctgcatgatgggggagtcttttttccgagcaacaccttgtcacaaatgaccctggaggccgcatccatgaaaatgtgcgacatgtttcaaactgccgactggaaaaccgaaaagcacgtgcccgccatcgagtgcgacgatgccgtggcggcagacgccttcttccccgtcaccgtgagcctgggcaaggaaattgcccaccccaacaccacggagcaccacatccgctggatccgttgctacttcaagcccgagggcgacaagttcagctatgaggtgggttccttcgagttcaccgcccacggcgaatgcgccaagggccccaacgaagggccggtgtacaccaaccacaccgtgacgttccagctgaagatcaagacccccggcgtcctggtggcttcgtctttctgcaatattcacgggttgtgggaatcttccaaggccgtggccctcaagtaatcgctgcatgctgccgatcatacaaagggagacctcgcaaggggcctccctttttttgtgggcgggcaaactggaaatccattgtccgcagtggcgtggttgatattatgcgcgccacacatgccgtcgggcgatttagggagatttccccgggggggaaggtatcatttccggggatgtgctgccatcgagatggaggggttgcgtcaaatttgtgaatcatggggagacggggcggaatgggttttgaaca

SEQ ID NO: 20717 - protein, 649 aa, Desulfovibrio gigas
MQWFNNLKIGTRLIASSILVLGLMGGVGWLGMSSMQTTNALLEEIYENNLKPIVHLADANAEFIKFGRNQYRIFISTNDQDAEEFVKRGDENIARTNKALADYTKATLTGKERELYDTFKPAYDAYLAENAKLRQMMRNKEDKDVITDFVLNRVAPLGVLPDQLLSDMAEENRNEAEKAAAQAHGVYLEARERMFWVIGVAVLLGLASGVFLSRLISRGVRQCVEVAQALAVGDLTKQLTIRQRDEIGQMAEAMRAVAAAEHDVAGKLDKLSRGDLGIEVMPRSEQDTLMRAIGSIVLAERDVAEKMKQVAEGDLRIKVAPRSEQDELVRAIAEMIERVTQIVDEVRTGAQNVASGDEEMSASSETLSQGASEQAASVEQCSSSMEEMSSSINQNAENARQTGSIASKAAQDAKESGEAVHNTVAAMKEIAGKISIIEEIARQTDLLALNAAVEAARAGEHGRGFAVVASEVRKLAERSQTAAAEINKLSSTSTAVAERAGTLLEKLVPDIQKTADLVQEIAATSQEQNSGAGQVNLALQQLDQVVQQNASASEELASTAEELSAQAEQLQAAMDFFITDGKVAARTVRASVARPAPARVAARPAPKRLPAARRAGTTGATGATGVHLDLSRGEVEDDDLGFERFGADT

SEQ ID NO: 20718 - DNA, 1662 bp, Salmonella typhimurium
  CDS (1)..(1662)
atgtttaaccgtatccgcgttgtcacaatgctgatgatggtgctgggggttttcgcactgctacagcttgtttccggtggtttgctgttttcttcattacagcataaccagcaaggttttgttatttctaacgaattacgtcagcaacaaagcgaactcacgtcgacatgggacttaatgctgcaaacgcgcattaacctgagccgctccgccgcacgcatgatgatggacgcttctaaccagcagagcagcgccaaaacggatttactccagaatgcaaaaacgactctcgcacaggcggcggcgcactacgccaatttcaaaaatatgacgccattgccagcgatggcggaggccagcgcgaacgtcgatgaaaaatatcagcgctatcaggccgcattagccgaacttattcagtttctggacaatggcaatatggatgcctacttcgcccagccaacccagggaatgcaaaacgcgttgggcgaggcgctgggcaattacgcccgggtgagcgaaaacctgtaccgccagacatttgatcaaagtgctcatgactaccgttttgcgcaatggcaactgggggttcttgcggtcgtgctggtgctgattttgatggtggtttggttcggcattcgtcatgccctgcttaacccattagcgcgagtgattactcatatccgtgaaattgccagcggcgatctgacgaaaacgctcaccgtctcaggacgtaatgaaattggcgaactggcgggaacggttgaacatatgcaacgctcgctgattgacaccgtaacgcaggttcgtgaaggttcggatgcgatttattccggcaccagtgaaattgccgccggtaataccgacctctcttcccgtaccgaacagcaggcctccgctctggaggagacggctgccagcatggaacaactgacggccaccgtgaagcaaaacgccgataacgcccgccaggcttcgcaactggcgcaaagcgcctccgagaccgcgcgtcatggcggcaaagtggtcgacggcgtagtaaacactatgcacgaaattgccgacagttcgaaaaaaatcgctgacattatcagcgttatcgacggtattgccttccagactaacattctggcgctgaacgcggcggtagaagcggcgcgcgcgggagagcaggggcgcggttttgcggtcgtggcaggcgaggtgcgtaatctggccagccgcagcgcccaggcggcgaaagaaataaaagcgttgattgaagattccgtctcgcgtgtcgataccggttctgtgctggtggaaagcgccggggaaaccatgactgacatcgtcaatgccgttacgcgcgtcacggatatcatgggcgaaatcgcctccgcctcggatgagcaaagccggggtatcgatcaggtcgctttggccgtttccgaaatggatcgcgtaacgcaacagaacgcctcgctggttcaggaatccgcagcggccgccgccgcgctggaagagcaggccagccgtctgacccaggcggtatcggctttccgcctggcatcgcgaccgctggcggtaaataaacctgagatgcgtttgtcagtgaacgctcagtccggcaatacgccgcagtcattagccgccagggatgatgcgaactgggaaaccttctga

SEQ ID NO: 20719 - protein, 553 aa, Salmonella typhimurium
MFNRIRVVTMLMMVLGVFALLQLVSGGLLFSSLQHNQQGFVISNELRQQQSELTSTWDLMLQTRINLSRSAARMMMDASNQQSSAKTDLLQNAKTTLAQAAAHYANFKNMTPLPAMAEASANVDEKYQRYQAALAELIQFLDNGNMDAYFAQPTQGMQNALGEALGNYARVSENLYRQTFDQSAHDYRFAQWQLGVLAVVLVLILMVVWFGIRHALLNPLARVITHIREIASGDLTKTLTVSGRNEIGELAGTVEHMQRSLIDTVTQVREGSDAIYSGTSEIAAGNTDLSSRTEQQASALEETAASMEQLTATVKQNADNARQASQLAQSASETARHGGKVVDGVVNTMHEIADSSKKIADIISVIDGIAFQTNILALNAAVEAARAGEQGRGFAVVAGEVRNLASRSAQAAKEIKALIEDSVSRVDTGSVLVESAGETMTDIVNAVTRVTDIMGEIASASDEQSRGIDQVALAVSEMDRVTQQNASLVQESAAAAAALEEQASRLTQAVSAFRLASRPLAVNKPEMRLSVNAQSGNTPQSLAARDDANWETF

SEQ ID NO: 20720 - DNA, 24 bp, Primer
atgattaaccgtatccgcgtagtc

SEQ ID NO: 20721 - DNA, 27 bp, Primer
ttaaaatgtttcccagtttggatcttg

SEQ ID NO: 20722 - DNA, 2200 bp, Escherichia coli K12; identical to SEQ ID NO: 17198
  CDS (776)..(2200)

SEQ ID NO: 20723 - protein, 474 aa, Escherichia coli K12; identical to SEQ ID NO: 17199

SEQ ID NO: 20724 - DNA, 3053 bp, Arabidopsis thaliana (mouse-ear cress); identical to SEQ ID NO: 17200
  CDS (1)..(2556)

SEQ ID NO: 20725 - protein, 851 aa, Arabidopsis thaliana (mouse-ear cress); identical to SEQ ID NO: 17201

SEQ ID NO: 20726 - DNA, 1422 bp, Salmonella enterica subsp. enterica serovar Typhi; identical to SEQ ID NO: 17202
  CDS (1)..(1422)

SEQ ID NO: 20727 - protein, 473 aa, Salmonella enterica subsp. enterica serovar Typhi; identical to SEQ ID NO: 17203

SEQ ID NO: 20728 - DNA, 1497 bp, Mycobacterium leprae; identical to SEQ ID NO: 17204
  CDS (1)..(1497)

SEQ ID NO: 20729 - protein, 498 aa, Mycobacterium leprae; identical to SEQ ID NO: 17205

SEQ ID NO: 20730 - DNA, 2829 bp, Arabidopsis thaliana (mouse-ear cress); identical to SEQ ID NO: 17206
  CDS (1)..(2829)

SEQ ID NO: 20731 - protein, 942 aa, Arabidopsis thaliana (mouse-ear cress); identical to SEQ ID NO: 17207

SEQ ID NO: 20732 - DNA, 1491 bp, Methanobacterium thermoautotrophicum; identical to SEQ ID NO: 17208
  CDS (1)..(1491)

SEQ ID NO: 20733 - protein, 496 aa, Methanobacterium thermoautotrophicum; identical to SEQ ID NO: 17209

SEQ ID NO: 20734 - DNA, 1392 bp, Sinorhizobium meliloti; identical to SEQ ID NO: 17210
  CDS (1)..(1392)

SEQ ID NO: 20735 - protein, 463 aa, Sinorhizobium meliloti; identical to SEQ ID NO: 17211

SEQ ID NO: 20736 - DNA, 1503 bp, Mycobacterium tuberculosis; identical to SEQ ID NO: 17212
  CDS (1)..(1503)

SEQ ID NO: 20737 - protein, 500 aa, Mycobacterium tuberculosis; identical to SEQ ID NO: 17213

SEQ ID NO: 20738 - DNA, 2091 bp, Saccharomyces cerevisiae; identical to SEQ ID NO: 17214
  CDS (233)..(1720)

SEQ ID NO: 20739 - protein, 495 aa, Saccharomyces cerevisiae; identical to SEQ ID NO: 17215

SEQ ID NO: 20740 - DNA, 5981 bp, Saccharomyces cerevisiae; identical to SEQ ID NO: 17216
  CDS (2282)..(5578)

SEQ ID NO: 20741 - protein, 1098 aa, Saccharomyces cerevisiae; identical to SEQ ID NO: 17217

SEQ ID NO: 20742 - DNA, 2358 bp, Kluyveromyces marxianus var. lactis, Candida sphaerica; identical to SEQ ID NO: 17218
  CDS (722)..(2188)

SEQ ID NO: 20743 - protein, 488 aa, Kluyveromyces marxianus var. lactis, Candida sphaerica; identical to SEQ ID NO: 17219

SEQ ID NO: 20744 - DNA, 3170 bp, Saccharomyces cerevisiae; identical to SEQ ID NO: 17220
  CDS (147)..(2837)

SEQ ID NO: 20745 - protein, 896 aa, Saccharomyces cerevisiae; identical to SEQ ID NO: 17221

SEQ ID NO: 20746 - DNA, 1500 bp, Synechocystis sp; identical to SEQ ID NO: 17222
  CDS (1)..(1500)

SEQ ID NO: 20747 - protein, 499 aa, Synechocystis sp; identical to SEQ ID NO: 17223

SEQ ID NO: 20748 - DNA, 2586 bp, Arabidopsis thaliana (mouse-ear cress); identical to SEQ ID NO: 17224
  CDS (1)..(2586)

SEQ ID NO: 20749 - protein, 861 aa, Arabidopsis thaliana (mouse-ear cress); identical to SEQ ID NO: 17225

SEQ ID NO: 20750 - DNA, 2388 bp, Arabidopsis thaliana (mouse-ear cress); identical to SEQ ID NO: 17226
  CDS (1)..(2388)

SEQ ID NO: 20751 - protein, 795 aa, Arabidopsis thaliana (mouse-ear cress); identical to SEQ ID NO: 17227

SEQ ID NO: 20752 - DNA, 2676 bp, Schizosaccharomyces pombe; identical to SEQ ID NO: 17228
  CDS (1)..(2676)

SEQ ID NO: 20753 - protein, 891 aa, Schizosaccharomyces pombe; identical to SEQ ID NO: 17229

SEQ ID NO: 20754 - DNA, 2550 bp, Schizosaccharomyces pombe; identical to SEQ ID NO: 17230
  CDS (1)..(2550)

SEQ ID NO: 20755 - protein, 849 aa, Schizosaccharomyces pombe; identical to SEQ ID NO: 17231

SEQ ID NO: 20756 - DNA, 2835 bp, Schizosaccharomyces pombe; identical to SEQ ID NO: 17232
  CDS (1)..(2835)

SEQ ID NO: 20757 - protein, 944 aa, Schizosaccharomyces pombe; identical to SEQ ID NO: 17233

SEQ ID NO: 20758 - DNA, 2580 bp, Schizosaccharomyces pombe; identical to SEQ ID NO: 17234
  CDS (52)..(2505)

SEQ ID NO: 20759 - protein, 817 aa, Schizosaccharomyces pombe; identical to SEQ ID NO: 17235

SEQ ID NO: 20760 - DNA, 1993 bp, Schizosaccharomyces pombe; identical to SEQ ID NO: 17236
  CDS (266)..(1705)

SEQ ID NO: 20761 - protein, 479 aa, Schizosaccharomyces pombe; identical to SEQ ID NO: 17237

SEQ ID NO: 20762 - DNA, 2621 bp, unidentified; identical to SEQ ID NO: 17238
  CDS (25)..(2487)

SEQ ID NO: 20763 - protein, 820 aa, unidentified; identical to SEQ ID NO: 17239

SEQ ID NO: 20764 - DNA, 2640 bp, Helianthus annuus; identical to SEQ ID NO: 17240
  CDS (171)..(2510)

SEQ ID NO: 20765 - protein, 779 aa, Helianthus annuus; identical to SEQ ID NO: 17241

SEQ ID NO: 20766 - DNA, 1913 bp, Selaginella lepidophylla; identical to SEQ ID NO: 17242
  CDS (111)..(1913)

SEQ ID NO: 20767 - protein, 600 aa, Selaginella lepidophylla; identical to SEQ ID NO: 17243

SEQ ID NO: 20768 - DNA, 4351 bp, Caenorhabditis elegans; identical to SEQ ID NO: 17244
  CDS (112)..(3996)

SEQ ID NO: 20769 - protein, 1294 aa, Caenorhabditis elegans; identical to SEQ ID NO: 17245

SEQ ID NO: 20770 - DNA, 2637 bp, Debaryomyces hansenii; identical to SEQ ID NO: 17246
  CDS (1)..(2637)

SEQ ID NO: 20771 - protein, 878 aa, Debaryomyces hansenii; identical to SEQ ID NO: 17247

SEQ ID NO: 20772 - DNA, 1443 bp, Debaryomyces hansenii; identical to SEQ ID NO: 17248
  CDS (1)..(1443)

SEQ ID NO: 20773 - protein, 480 aa, Debaryomyces hansenii; identical to SEQ ID NO: 17249

SEQ ID NO: 20774 - DNA, 2403 bp, Yarrowia lipolytica; identical to SEQ ID NO: 17250
  CDS (1)..(2403)

SEQ ID NO: 20775 - protein, 800 aa, Yarrowia lipolytica; identical to SEQ ID NO: 17251

SEQ ID NO: 20776 - DNA, 3447 bp, Kluyveromyces lactis; identical to SEQ ID NO: 17252
  CDS (1)..(3447)

SEQ ID NO: 20777 - protein, 1148 aa, Kluyveromyces lactis; identical to SEQ ID NO: 17253

SEQ ID NO: 20778 - DNA, 2631 bp, Kluyveromyces lactis; identical to SEQ ID NO: 17254
  CDS (1)..(2631)

SEQ ID NO: 20779 - protein, 876 aa, Kluyveromyces lactis; identical to SEQ ID NO: 17255

SEQ ID NO: 20780 - DNA, 1437 bp, Acinetobacter sp; identical to SEQ ID NO: 17256
  CDS (1)..(1437)

SEQ ID NO: 20781 - protein, 478 aa, Acinetobacter sp; identical to SEQ ID NO: 17257

SEQ ID NO: 20782 - DNA, 1476 bp, Candida glabrata; identical to SEQ ID NO: 17258
  CDS (1)..(1476)

SEQ ID NO: 20783 - protein, 491 aa, Candida glabrata; identical to SEQ ID NO: 17259

SEQ ID NO: 20784 - DNA, 3198 bp, Candida glabrata; identical to SEQ ID NO: 17260
  CDS (1)..(3198)

SEQ ID NO: 20785 - protein, 1065 aa, Candida glabrata; identical to SEQ ID NO: 17261

SEQ ID NO: 20786 - DNA, 3345 bp, Candida glabrata; identical to SEQ ID NO: 17262
  CDS (1)..(3345)

SEQ ID NO: 20787 - protein, 1114 aa, Candida glabrata; identical to SEQ ID NO: 17263

SEQ ID NO: 20788 - DNA, 2673 bp, Candida glabrata; identical to SEQ ID NO: 17264
  CDS (1)..(2673)

SEQ ID NO: 20789 - protein, 890 aa, Candida glabrata; identical to SEQ ID NO: 17265

SEQ ID NO: 20790 - DNA, 2013 bp, Cryptococcus neoformans var; identical to SEQ ID NO: 17266
  CDS (1)..(2013)

SEQ ID NO: 20791 - protein, 670 aa, Cryptococcus neoformans var; identical to SEQ ID NO: 17267

SEQ ID NO: 20792 - DNA, 1302 bp, Picrophilus torridus; identical to SEQ ID NO: 17268
  CDS (1)..(1302)

SEQ ID NO: 20793 - protein, 433 aa, Picrophilus torridus; identical to SEQ ID NO: 17269

SEQ ID NO: 20794 - DNA, 1482 bp, Rhodopseudomonas palustris; identical to SEQ ID NO: 17270
  CDS (1)..(1482)

SEQ ID NO: 20795 - protein, 493 aa, Rhodopseudomonas palustris; identical to SEQ ID NO: 17271

SEQ ID NO: 20796 - DNA, 1440 bp, Corynebacterium diphtheriae; identical to SEQ ID NO: 17272
  CDS (1)..(1440)

SEQ ID NO: 20797 - protein, 479 aa, Corynebacterium diphtheriae; identical to SEQ ID NO: 17273

SEQ ID NO: 20798 - DNA, 2589 bp, Oryza sativa; identical to SEQ ID NO: 17274
  CDS (1)..(2589)

SEQ ID NO: 20799 - protein, 862 aa, Oryza sativa; identical to SEQ ID NO: 17275

SEQ ID NO: 20800 - DNA, 2812 bp, Oryza sativa; identical to SEQ ID NO: 17276
  CDS (53)..(2527)

SEQ ID NO: 20801 - protein, 824 aa, Oryza sativa; identical to SEQ ID NO: 17277

SEQ ID NO: 20802 - DNA, 2208 bp, Thermoproteus tenax; identical to SEQ ID NO: 17278
  CDS (1)..(2208)

SEQ ID NO: 20803 - protein, 735 aa, Thermoproteus tenax; identical to SEQ ID NO: 17279

SEQ ID NO: 20804 - DNA, 1479 bp, Mycobacterium paratuberculosis; identical to SEQ ID NO: 17280
  CDS (1)..(1479)

SEQ ID NO: 20805 - protein, 492 aa, Mycobacterium paratuberculosis; identical to SEQ ID NO: 17281

SEQ ID NO: 20806 - DNA, 1461 bp, Geobacter sulfurreducens; identical to SEQ ID NO: 17282
  CDS (1)..(1461)

SEQ ID NO: 20807 - protein, 486 aa, Geobacter sulfurreducens; identical to SEQ ID NO: 17283

SEQ ID NO: 20808 - DNA, 3333 bp, Ashbya gossypii; identical to SEQ ID NO: 17284
  CDS (1)..(3333)

SEQ ID NO: 20809 - protein, 1110 aa, Ashbya gossypii; identical to SEQ ID NO: 17285

SEQ ID NO: 20810 - DNA, 1485 bp, Ashbya gossypii; identical to SEQ ID NO: 17286
  CDS (1)..(1485)

SEQ ID NO: 20811 - protein, 494 aa, Ashbya gossypii; identical to SEQ ID NO: 17287

SEQ ID NO: 20812 - DNA, 3498 bp, Oryza sativa; identical to SEQ ID NO: 17288
  CDS (176)..(2875)

SEQ ID NO: 20813 - protein, 899 aa, Oryza sativa; identical to SEQ ID NO: 17289

SEQ ID NO: 20814 - DNA, 3048 bp, Neurospora crassa; identical to SEQ ID NO: 17290
  CDS (1)..(3048)

SEQ ID NO: 20815 - protein, 1015 aa, Neurospora crassa; identical to SEQ ID NO: 17291

SEQ ID NO: 20816 - DNA, 1572 bp, Neurospora crassa; identical to SEQ ID NO: 17292
  CDS (1)..(1572)

SEQ ID NO: 20817 - protein, 523 aa, Neurospora crassa; identical to SEQ ID NO: 17293

SEQ ID NO: 20818 - DNA, 2730 bp, Neurospora crassa; identical to SEQ ID NO: 17294
  CDS (1)..(2730)

SEQ ID NO: 20819 - protein, 909 aa, Neurospora crassa; identical to SEQ ID NO: 17295

SEQ ID NO: 20820 - DNA, 1488 bp, Synechococcus sp; identical to SEQ ID NO: 17296
  CDS (1)..(1488)

SEQ ID NO: 20821 - protein, 495 aa, Synechococcus sp; identical to SEQ ID NO: 17297

SEQ ID NO: 20822 - DNA, 1350 bp, Thermus thermophilus; identical to SEQ ID NO: 17298
  CDS (1)..(1350)

SEQ ID NO: 20823 - protein, 449 aa, Thermus thermophilus; identical to SEQ ID NO: 17299

SEQ ID NO: 20824 - DNA, 3862 bp, Caenorhabditis elegans; identical to SEQ ID NO: 17300
  CDS (30)..(3722)

SEQ ID NO: 20825 - protein, 1230 aa, Caenorhabditis elegans; identical to SEQ ID NO: 17301

SEQ ID NO: 20826 - DNA, 1590 bp, Magnaporthe grisea; identical to SEQ ID NO: 17302
  CDS (1)..(1590)

SEQ ID NO: 20827 - protein, 529 aa, Magnaporthe grisea; identical to SEQ ID NO: 17303

SEQ ID NO: 20828 - DNA, 1485 bp, Bradyrhizobium japonicum; identical to SEQ ID NO: 17304
  CDS (1)..(1485)

SEQ ID NO: 20829 - protein, 494 aa, Bradyrhizobium japonicum; identical to SEQ ID NO: 17305

SEQ ID NO: 20830 - DNA, 1449 bp, Corynebacterium efficiens; identical to SEQ ID NO: 17306
  CDS (1)..(1449)

SEQ ID NO: 20831 - protein, 482 aa, Corynebacterium efficiens; identical to SEQ ID NO: 17307

SEQ ID NO: 20832 - DNA, 2774 bp, Arabidopsis thaliana; identical to SEQ ID NO: 17308
  CDS (102)..(2690)

SEQ ID NO: 20833 - protein, 862 aa, Arabidopsis thaliana; identical to SEQ ID NO: 17309

SEQ ID NO: 20834 - DNA, 2583 bp, Oryza sativa; identical to SEQ ID NO: 17310
  CDS (1)..(2583)

SEQ ID NO: 20835 - protein, 860 aa, Oryza sativa; identical to SEQ ID NO: 17311

SEQ ID NO: 20836 - DNA, 1458 bp, Corynebacterium glutamicum; identical to SEQ ID NO: 17312
  CDS (1)..(1458)

SEQ ID NO: 20837 - protein, 485 aa, Corynebacterium glutamicum; identical to SEQ ID NO: 17313

SEQ ID NO: 20838 - DNA, 2358 bp, Xanthomonas campestris; identical to SEQ ID NO: 17314
  CDS (1)..(2358)

SEQ ID NO: 20839 - protein, 785 aa, Xanthomonas campestris; identical to SEQ ID NO: 17315

SEQ ID NO: 20840 - DNA, 1368 bp, Xanthomonas axonopodis; identical to SEQ ID NO: 17316
  CDS (1)..(1368)

SEQ ID NO: 20841 - protein, 455 aa, Xanthomonas axonopodis; identical to SEQ ID NO: 17317

SEQ ID NO: 20842 - DNA, 2574 bp, Solanum tuberosum; identical to SEQ ID NO: 17318
  CDS (1)..(2574)

SEQ ID NO: 20843 - protein, 857 aa, Solanum tuberosum; identical to SEQ ID NO: 17319

SEQ ID NO: 20844 - DNA, 1380 bp, Encephalitozoon cuniculi; identical to SEQ ID NO: 17320
  CDS (1)..(1380)

SEQ ID NO: 20845 - protein, 459 aa, Encephalitozoon cuniculi; identical to SEQ ID NO: 17321

SEQ ID NO: 20846 - DNA, 1398 bp, Ralstonia solanacearum; identical to SEQ ID NO: 17322
  CDS (1)..(1398)

SEQ ID NO: 20847 - protein, 465 aa, Ralstonia solanacearum; identical to SEQ ID NO: 17323

SEQ ID NO: 20848 - DNA, 1674 bp, Ralstonia solanacearum; identical to SEQ ID NO: 17324
  CDS (1)..(1674)

SEQ ID NO: 20849 - protein, 557 aa, Ralstonia solanacearum; identical to SEQ ID NO: 17325

SEQ ID NO: 20850 - DNA, 2214 bp, Pyrobaculum aerophilum; identical to SEQ ID NO: 17326
  CDS (1)..(2214)

SEQ ID NO: 20851 - protein, 737 aa, Pyrobaculum aerophilum; identical to SEQ ID NO: 17327

SEQ ID NO: 20852 - DNA, 3001 bp, Arabidopsis thaliana; identical to SEQ ID NO: 17328
  CDS (204)..(2306)

SEQ ID NO: 20853 - protein, 700 aa, Arabidopsis thaliana; identical to SEQ ID NO: 17329

SEQ ID NO: 20854 - DNA, 3272 bp, Oryza sativa; identical to SEQ ID NO: 17330
  CDS (247)..(2985)

SEQ ID NO: 20855 - protein, 912 aa, Oryza sativa; identical to SEQ ID NO: 17331

SEQ ID NO: 20856 - DNA, 1681 bp, Amanita muscaria; identical to SEQ ID NO: 17332
  CDS (101)..(1552)

SEQ ID NO: 20857 - protein, 483 aa, Amanita muscaria; identical to SEQ ID NO: 17333

SEQ ID NO: 20858 - DNA, 1344 bp, Thermoplasma volcanium; identical to SEQ ID NO: 17334
  CDS (1)..(1344)

SEQ ID NO: 20859 - protein, 447 aa, Thermoplasma volcanium; identical to SEQ ID NO: 17335

SEQ ID NO: 20860 - DNA, 1563 bp, Rhizobium loti; identical to SEQ ID NO: 17336
  CDS (1)..(1563)

SEQ ID NO: 20861 - protein, 520 aa, Rhizobium loti; identical to SEQ ID NO: 17337

SEQ ID NO: 20862 - DNA, 2637 bp, Oryza sativa; identical to SEQ ID NO: 17338
  CDS (1)..(2637)

SEQ ID NO: 20863 - protein, 878 aa, Oryza sativa; identical to SEQ ID NO: 17339

SEQ ID NO: 20864 - DNA, 1326 bp, Thermoplasma acidophilum; identical to SEQ ID NO: 17340
  CDS (1)..(1326)

SEQ ID NO: 20865 - protein, 441 aa, Thermoplasma acidophilum; identical to SEQ ID NO: 17341

SEQ ID NO: 20866 - DNA, 1389 bp, Streptomyces coelicolor; identical to SEQ ID NO: 17342
  CDS (1)..(1389)

SEQ ID NO: 20867 - protein, 462 aa, Streptomyces coelicolor; identical to SEQ ID NO: 17343

SEQ ID NO: 20868 - DNA, 2635 bp, Arabidopsis thaliana; identical to SEQ ID NO: 17344
  CDS (1)..(2604)

SEQ ID NO: 20869 - protein, 867 aa, Arabidopsis thaliana; identical to SEQ ID NO: 17345

SEQ ID NO: 20870 - DNA, 2843 bp, Zygosaccharomyces rouxii; identical to SEQ ID NO: 17346
  CDS (24)..(2726)

SEQ ID NO: 20871 - protein, 900 aa, Zygosaccharomyces rouxii; identical to SEQ ID NO: 17347

SEQ ID NO: 20872 - DNA, 3197 bp, Drosophila melanogaster; identical to SEQ ID NO: 17348
  CDS (662)..(3091)

SEQ ID NO: 20873 - protein, 809 aa, Drosophila melanogaster; identical to SEQ ID NO: 17349

SEQ ID NO: 20874 - DNA, 1503 bp, Pseudomonas anguilliseptica; identical to SEQ ID NO: 17350
  CDS (1)..(1503)

SEQ ID NO: 20875 - protein, 500 aa, Pseudomonas anguilliseptica; identical to SEQ ID NO: 17351

SEQ ID NO: 20876 - DNA, 1503 bp, Synechococcus sp; identical to SEQ ID NO: 17352
  CDS (1)..(1503)

SEQ ID NO: 20877 - protein, 500 aa, Synechococcus sp; identical to SEQ ID NO: 17353

SEQ ID NO: 20878 - DNA, 1395 bp, Rhizobium sp; identical to SEQ ID NO: 17354
  CDS (1)..(1395)

SEQ ID NO: 20879 - protein, 464 aa, Rhizobium sp; identical to SEQ ID NO: 17355

SEQ ID NO: 20880 - DNA, 1437 bp, Candida albicans; identical to SEQ ID NO: 17356
  CDS (1)..(1437)

SEQ ID NO: 20881 - protein, 478 aa, Candida albicans; identical to SEQ ID NO: 17357

SEQ ID NO: 20882 - DNA, 1515 bp, Emericella nidulans; identical to SEQ ID NO: 17358
  CDS (1)..(1515)

SEQ ID NO: 20883 - protein, 504 aa, Emericella nidulans; identical to SEQ ID NO: 17359

SEQ ID NO: 20884 - DNA, 2695 bp, Pichia angusta; identical to SEQ ID NO: 17360
  CDS (793)..(2220)

SEQ ID NO: 20885 - protein, 475 aa, Pichia angusta; identical to SEQ ID NO: 17361

SEQ ID NO: 20886 - DNA, 1542 bp, Schizosaccharomyces pombe; identical to SEQ ID NO: 17362
  CDS (1)..(1542)

SEQ ID NO: 20887 - protein, 513 aa, Schizosaccharomyces pombe; identical to SEQ ID NO: 17363

SEQ ID NO: 20888 - DNA, 1520 bp, Yarrowia lipolytica; identical to SEQ ID NO: 17364
  CDS (27)..(1436)

SEQ ID NO: 20889 - protein, 469 aa, Yarrowia lipolytica; identical to SEQ ID NO: 17365

SEQ ID NO: 20890 - DNA, 1645 bp, Zygosaccharomyces rouxii; identical to SEQ ID NO: 17366
  CDS (77)..(1534)

SEQ ID NO: 20891 - protein, 485 aa, Zygosaccharomyces rouxii; identical to SEQ ID NO: 17367

SEQ ID NO: 20892 - DNA, 3069 bp, Saccharomyces cerevisiae; identical to SEQ ID NO: 17368
  CDS (1)..(3069)

SEQ ID NO: 20893 - protein, 1022 aa, Saccharomyces cerevisiae; identical to SEQ ID NO: 17369

SEQ ID NO: 20894 - DNA, 1554 bp, Aspergillus niger; identical to SEQ ID NO: 17370
  CDS (1)..(1554)

SEQ ID NO: 20895 - protein, 517 aa, Aspergillus niger; identical to SEQ ID NO: 17371

SEQ ID NO: 20896 - DNA, 25 bp, Primer
atgagtcgtttagtcgtagtatcta

SEQ ID NO: 20897 - DNA, 24 bp, Primer
ttacgcaagctttggaaaggtagc

SEQ ID NO: 20898 - DNA, 1263 bp, Escherichia coli K12; identical to SEQ ID NO: 2696
  CDS (1)..(1263)

SEQ ID NO: 20899 - protein, 420 aa, Escherichia coli K12; identical to SEQ ID NO: 2697

SEQ ID NO: 20900 - DNA, 1278 bp, Agrobacterium tumefaciens; identical to SEQ ID NO: 2698
  CDS (1)..(1278)

SEQ ID NO: 20901 - protein, 425 aa, Agrobacterium tumefaciens; identical to SEQ ID NO: 2699

SEQ ID NO: 20902 - DNA, 1281 bp, Sinorhizobium meliloti; identical to SEQ ID NO: 2700
  CDS (1)..(1281)

SEQ ID NO: 20903 - protein, 426 aa, Sinorhizobium meliloti; identical to SEQ ID NO: 2701

SEQ ID NO: 20904 - DNA, 1281 bp, Escherichia coli; identical to SEQ ID NO: 2702
  CDS (1)..(1281)

SEQ ID NO: 20905 - protein, 426 aa, Escherichia coli; identical to SEQ ID NO: 2703

SEQ ID NO: 20906 - DNA, 1308 bp, Streptomyces coelicolor; identical to SEQ ID NO: 2704
  CDS (1)..(1308)

SEQ ID NO: 20907 - protein, 435 aa, Streptomyces coelicolor; identical to SEQ ID NO: 2705

SEQ ID NO: 20908 - DNA, 1296 bp, Photorhabdus luminescens; identical to SEQ ID NO: 2706
  CDS (1)..(1296)

SEQ ID NO: 20909 - protein, 431 aa, Photorhabdus luminescens; identical to SEQ ID NO: 2707

SEQ ID NO: 20910 - DNA, 1281 bp, Shigella flexneri; identical to SEQ ID NO: 2708
  CDS (1)..(1281)

SEQ ID NO: 20911 - protein, 426 aa, Shigella flexneri; identical to SEQ ID NO: 2709

SEQ ID NO: 20912 - DNA, 1263 bp, Shigella flexneri; identical to SEQ ID NO: 2710
  CDS (1)..(1263)

SEQ ID NO: 20913 - protein, 420 aa, Shigella flexneri; identical to SEQ ID NO: 2711

SEQ ID NO: 20914 - DNA, 1308 bp, Vibrio vulnificus; identical to SEQ ID NO: 2712
  CDS (1)..(1308)

SEQ ID NO: 20915 - protein, 435 aa, Vibrio vulnificus; identical to SEQ ID NO: 2713

SEQ ID NO: 20916 - DNA, 1281 bp, Escherichia coli O6; identical to SEQ ID NO: 2714
  CDS (1)..(1281): y means t/u or c

SEQ ID NO: 20917 - protein, 426 aa, Escherichia coli O6; identical to SEQ ID NO: 2715
  misc_feature (246)..(246): Xaa can be Ala or Val
  misc_feature (251)..(251): Xaa can be Ala or Val

SEQ ID NO: 20918 - DNA, 1263 bp, Escherichia coli O6; identical to SEQ ID NO: 2716
  CDS (1)..(1263): n means a or g or c or t/u, w means a or t/u

SEQ ID NO: 20919 - protein, 420 aa, Escherichia coli O6; identical to SEQ ID NO: 2717
  misc_feature (239)..(239): Xaa can be any amino acid
  misc_feature (265)..(265): Xaa can be Thr or Ser

SEQ ID NO: 20920 - DNA, 1260 bp, Klebsiella oxytoca; identical to SEQ ID NO: 2718
  CDS (1)..(1260)

SEQ ID NO: 20921 - protein, 419 aa, Klebsiella oxytoca; identical to SEQ ID NO: 2719

SEQ ID NO: 20922 - DNA, 1356 bp, Ralstonia solanacearum; identical to SEQ ID NO: 2720
  CDS (1)..(1356)

SEQ ID NO: 20923 - protein, 451 aa, Ralstonia solanacearum; identical to SEQ ID NO: 2721

SEQ ID NO: 20924 - DNA, 1272 bp, Salmonella typhimurium; identical to SEQ ID NO: 2722
  CDS (1)..(1272)

SEQ ID NO: 20925 - protein, 423 aa, Salmonella typhimurium; identical to SEQ ID NO: 2723

SEQ ID NO: 20926 - DNA, 1284 bp, Rhizobium loti; identical to SEQ ID NO: 2724
  CDS (1)..(1284)

SEQ ID NO: 20927 - protein, 427 aa, Rhizobium loti; identical to SEQ ID NO: 2725

SEQ ID NO: 20928 - DNA, 1299 bp, Yersinia pestis; identical to SEQ ID NO: 2726
  CDS (1)..(1299)

SEQ ID NO: 20929 - protein, 432 aa, Yersinia pestis; identical to SEQ ID NO: 2727

SEQ ID NO: 20930 - DNA, 1287 bp, Photobacterium profundum; identical to SEQ ID NO: 2728
  CDS (1)..(1287)

SEQ ID NO: 20931 - protein, 428 aa, Photobacterium profundum; identical to SEQ ID NO: 2729

SEQ ID NO: 20932 - DNA, 22 bp, Primer
atgaaaacgttaattgcccggc

SEQ ID NO: 20933 - DNA, 22 bp, Primer
ttattccgcacagccgtagcga

SEQ ID NO: 20934 - DNA, 1350 bp, Escherichia coli K12; identical to SEQ ID NO: 4558
  CDS (1)..(1350)

SEQ ID NO: 20935 - protein, 449 aa, Escherichia coli K12; identical to SEQ ID NO: 4559

SEQ ID NO: 20936 - DNA, 7367 bp, Gallus gallus (chicken); identical to SEQ ID NO: 4560
  CDS (154)..(7128)

SEQ ID NO: 20937 - protein, 2324 aa, Gallus gallus (chicken); identical to SEQ ID NO: 4561

SEQ ID NO: 20938 - DNA, 7038 bp, Rattus norvegicus (Norway rat); identical to SEQ ID NO: 4562
  CDS (1)..(7038)

SEQ ID NO: 20939 - protein, 2345 aa, Rattus norvegicus (Norway rat); identical to SEQ ID NO: 4563

SEQ ID NO: 20940 - DNA, 6270 bp, Cyclotella cryptica; identical to SEQ ID NO: 4564
  CDS (1)..(6270)

SEQ ID NO: 20941 - protein, 2089 aa, Cyclotella cryptica; identical to SEQ ID NO: 4565

SEQ ID NO: 20942 - DNA, 7360 bp, Triticum aestivum (common wheat); identical to SEQ ID NO: 4566
  CDS (159)..(6932)

SEQ ID NO: 20943 - protein, 2257 aa, Triticum aestivum (common wheat); identical to SEQ ID NO: 4567

SEQ ID NO: 20944 - DNA, 1476 bp, Methanobacterium thermoautotrophicum; identical to SEQ ID NO: 4568
  CDS (1)..(1476)

SEQ ID NO: 20945 - protein, 491 aa, Methanobacterium thermoautotrophicum; identical to SEQ ID NO: 4569

SEQ ID NO: 20946 - DNA, 1353 bp, Bacillus subtilis; identical to SEQ ID NO: 4570
  CDS (1)..(1353)

SEQ ID NO: 20947 - protein, 450 aa, Bacillus subtilis; identical to SEQ ID NO: 4571

SEQ ID NO: 20948 - DNA, 1419 bp, Aquifex aeolicus; identical to SEQ ID NO: 4572
  CDS (1)..(1419)

SEQ ID NO: 20949 - protein, 472 aa, Aquifex aeolicus; identical to SEQ ID NO: 4573

SEQ ID NO: 20950 - DNA, 1377 bp, Pseudomonas aeruginosa; identical to SEQ ID NO: 4574
  CDS (1)..(1377)

SEQ ID NO: 20951 - protein, 458 aa, Pseudomonas aeruginosa; identical to SEQ ID NO: 4575

SEQ ID NO: 20952 - DNA, 3453 bp, Bacillus halodurans; identical to SEQ ID NO: 4576
  CDS (1)..(3453)

SEQ ID NO: 20953 - protein, 1150 aa, Bacillus halodurans; identical to SEQ ID NO: 4577

SEQ ID NO: 20954 - DNA, 1347 bp, Agrobacterium tumefaciens; identical to SEQ ID NO: 4578
  CDS (1)..(1347)

SEQ ID NO: 20955 - protein, 448 aa, Agrobacterium tumefaciens; identical to SEQ ID NO: 4579

SEQ ID NO: 20956 - DNA, 1731 bp, Agrobacterium tumefaciens; identical to SEQ ID NO: 4580
  CDS (1)..(1731)

SEQ ID NO: 20957 - protein, 576 aa, Agrobacterium tumefaciens; identical to SEQ ID NO: 4581

SEQ ID NO: 20958 - DNA, 1350 bp, Yersinia pestis; identical to SEQ ID NO: 4582
  CDS (1)..(1350)

SEQ ID NO: 20959 - protein, 449 aa, Yersinia pestis; identical to SEQ ID NO: 4583

SEQ ID NO: 20960 - DNA, 1365 bp, Listeria monocytogenes; identical to SEQ ID NO: 4584
  CDS (1)..(1365)

SEQ ID NO: 20961 - protein, 454 aa, Listeria monocytogenes; identical to SEQ ID NO: 4585

SEQ ID NO: 20962 - DNA, 3525 bp, Agrobacterium tumefaciens; identical to SEQ ID NO: 4586
  CDS (1)..(3525)

SEQ ID NO: 20963 - protein, 1174 aa, Agrobacterium tumefaciens; identical to SEQ ID NO: 4587

SEQ ID NO: 20964 - DNA, 1992 bp, Agrobacterium tumefaciens; identical to SEQ ID NO: 4588
  CDS (1)..(1992)

SEQ ID NO: 20965 - protein, 663 aa, Agrobacterium tumefaciens; identical to SEQ ID NO: 4589

SEQ ID NO: 20966 - DNA, 2037 bp, Brucella melitensis; identical to SEQ ID NO: 4590
  CDS (1)..(2037)

SEQ ID NO: 20967 - protein, 678 aa, Brucella melitensis; identical to SEQ ID NO: 4591

SEQ ID NO: 20968 - DNA, 1344 bp, Nostoc sp. PCC 7120; identical to SEQ ID NO: 4592
  CDS (1)..(1344)

SEQ ID NO: 20969 - protein, 447 aa, Nostoc sp. PCC 7120; identical to SEQ ID NO: 4593

SEQ ID NO: 20970 - DNA, 1350 bp, Salmonella enterica subsp. enterica serovar Typhi; identical to SEQ ID NO: 4594
  CDS (1)..(1350)

SEQ ID NO: 20971 - protein, 449 aa, Salmonella enterica subsp. enterica serovar Typhi; identical to SEQ ID NO: 4595

SEQ ID NO: 20972 - DNA, 1350 bp, Pseudomonas aeruginosa; identical to SEQ ID NO: 4596
  CDS (1)..(1350)

SEQ ID NO: 20973 - protein, 449 aa, Pseudomonas aeruginosa; identical to SEQ ID NO: 4597

SEQ ID NO: 20974 - DNA, 1965 bp, Mycobacterium tuberculosis; identical to SEQ ID NO: 4598
  CDS (1)..(1965)

SEQ ID NO: 20975 - protein, 654 aa, Mycobacterium tuberculosis; identical to SEQ ID NO: 4599

SEQ ID NO: 20976 - DNA, 1338 bp, Deinococcus radiodurans; identical to SEQ ID NO: 4600
  CDS (1)..(1338)

SEQ ID NO: 20977 - protein, 445 aa, Deinococcus radiodurans; identical to SEQ ID NO: 4601

SEQ ID NO: 20978 - DNA, 1446 bp, Campylobacter jejuni; identical to SEQ ID NO: 4602
  CDS (1)..(1446)

SEQ ID NO: 20979 - protein, 481 aa, Campylobacter jejuni; identical to SEQ ID NO: 4603

SEQ ID NO: 20980 - DNA, 3288 bp, Pseudomonas aeruginosa; identical to SEQ ID NO: 4604
  CDS (1)..(3288)

SEQ ID NO: 20981 - protein, 1095 aa, Pseudomonas aeruginosa; identical to SEQ ID NO: 4605

SEQ ID NO: 20982 - DNA, 1368 bp, Lactococcus lactis subsp. lactis; identical to SEQ ID NO: 4606
  CDS (1)..(1368)

SEQ ID NO: 20983 - protein, 455 aa, Lactococcus lactis subsp. lactis; identical to SEQ ID NO: 4607

SEQ ID NO: 20984 - DNA, 2010 bp, Caulobacter crescentus; identical to SEQ ID NO: 4608
  CDS (1)..(2010)

SEQ ID NO: 20985 - protein, 669 aa, Caulobacter crescentus; identical to SEQ ID NO: 4609

SEQ ID NO: 20986 - DNA, 1344 bp, Clostridium acetobutylicum; identical to SEQ ID NO: 4610
  CDS (1)..(1344)

SEQ ID NO: 20987 - protein, 447 aa, Clostridium acetobutylicum; identical to SEQ ID NO: 4611

SEQ ID NO: 20988 - DNA, 1335 bp, Aquifex aeolicus; identical to SEQ ID NO: 4612
  CDS (1)..(1335)

SEQ ID NO: 20989 - protein, 444 aa, Aquifex aeolicus; identical to SEQ ID NO: 4613

SEQ ID NO: 20990 - DNA, 2004 bp, Mycobacterium tuberculosis; identical to SEQ ID NO: 4614
  CDS (1)..(2004)

SEQ ID NO: 20991 - protein, 667 aa, Mycobacterium tuberculosis; identical to SEQ ID NO: 4615

SEQ ID NO: 20992 - DNA, 1998 bp, Rickettsia prowazekii; identical to SEQ ID NO: 4616
  CDS (1)..(1998)

SEQ ID NO: 20993 - protein, 665 aa, Rickettsia prowazekii; identical to SEQ ID NO: 4617

SEQ ID NO: 20994 - DNA, 3276 bp, Deinococcus radiodurans; identical to SEQ ID NO: 4618
  CDS (1)..(3276)

SEQ ID NO: 20995 - protein, 1091 aa, Deinococcus radiodurans; identical to SEQ ID NO: 4619

SEQ ID NO: 20996 - DNA, 1368 bp, Streptococcus pneumoniae; identical to SEQ ID NO: 4620
  CDS (1)..(1368)

SEQ ID NO: 20997 - protein, 455 aa, Streptococcus pneumoniae; identical to SEQ ID NO: 4621

SEQ ID NO: 20998 - DNA, 1506 bp, Methanococcus jannaschii; identical to SEQ ID NO: 4622
  CDS (1)..(1506)

SEQ ID NO: 20999 - protein, 501 aa, Methanococcus jannaschii; identical to SEQ ID NO: 4623

SEQ ID NO: 21000 - DNA, 1521 bp, Archaeoglobus fulgidus; identical to SEQ ID NO: 4624
  CDS (1)..(1521)

SEQ ID NO: 21001 - protein, 506 aa, Archaeoglobus fulgidus; identical to SEQ ID NO: 4625

SEQ ID NO: 21002 - DNA, 3384 bp, Mycobacterium tuberculosis; identical to SEQ ID NO: 4626
  CDS (1)..(3384)

SEQ ID NO: 21003 - protein, 1127 aa, Mycobacterium tuberculosis; identical to SEQ ID NO: 4627

SEQ ID NO: 21004 - DNA, 1374 bp, Chlamydia muridarum, Chlamydia trachomatis MoPn; identical to SEQ ID NO: 4628
  CDS (1)..(1374)

SEQ ID NO: 21005 - protein, 457 aa, Chlamydia muridarum, Chlamydia trachomatis MoPn; identical to SEQ ID NO: 4629

SEQ ID NO: 21006 - DNA, 1359 bp, Bacillus halodurans; identical to SEQ ID NO: 4630
  CDS (1)..(1359)

SEQ ID NO: 21007 - protein, 452 aa, Bacillus halodurans; identical to SEQ ID NO: 4631

SEQ ID NO: 21008 - DNA, 6774 bp, Arabidopsis thaliana (mouse-ear cress); identical to SEQ ID NO: 4632
  CDS (1)..(6774)

SEQ ID NO: 21009 - protein, 2257 aa, Arabidopsis thaliana (mouse-ear cress); identical to SEQ ID NO: 4633

SEQ ID NO: 21010 - DNA, 3237 bp, Caulobacter crescentus; identical to SEQ ID NO: 4634
  CDS (1)..(3237)

SEQ ID NO: 21011 - protein, 1078 aa, Caulobacter crescentus; identical to SEQ ID NO: 4635

SEQ ID NO: 21012 - DNA, 3435 bp, Clostridium acetobutylicum; identical to SEQ ID NO: 4636
  CDS (1)..(3435)

SEQ ID NO: 21013 - protein, 1144 aa, Clostridium acetobutylicum; identical to SEQ ID NO: 4637

SEQ ID NO: 21014 - DNA, 1335 bp, Bacillus subtilis; identical to SEQ ID NO: 4638
  CDS (1)..(1335)

SEQ ID NO: 21015 - protein, 444 aa, Bacillus subtilis; identical to SEQ ID NO: 4639

SEQ ID NO: 21016 - DNA, 1365 bp, Chlamydophila pneumoniae, Chlamydia pneumoniae; identical to SEQ ID NO: 4640
  CDS (1)..(1365)

SEQ ID NO: 21017 - protein, 454 aa, Chlamydophila pneumoniae, Chlamydia pneumoniae; identical to SEQ ID NO: 4641

SEQ ID NO: 21018 - DNA, 1410 bp, Xylella fastidiosa; identical to SEQ ID NO: 4642
  CDS (1)..(1410)

SEQ ID NO: 21019 - protein, 469 aa, Xylella fastidiosa; identical to SEQ ID NO: 4643

SEQ ID NO: 21020 - DNA, 7080 bp, Arabidopsis thaliana (mouse-ear cress); identical to SEQ ID NO: 4644
  CDS (1)..(7080)

SEQ ID NO: 21021 - protein, 2359 aa, Arabidopsis thaliana (mouse-ear cress); identical to SEQ ID NO: 4645

SEQ ID NO: 21022 - DNA, 3414 bp, Lactococcus lactis subsp. lactis; identical to SEQ ID NO: 4646
  CDS (1)..(3414)

SEQ ID NO: 21023 - protein, 1137 aa, Lactococcus lactis subsp. lactis; identical to SEQ ID NO: 4647

SEQ ID NO: 21024 - DNA, 1533 bp, Sulfolobus solfataricus; identical to SEQ ID NO: 4648
  CDS (1)..(1533)

SEQ ID NO: 21025 - protein, 510 aa, Sulfolobus solfataricus; identical to SEQ ID NO: 4649

SEQ ID NO: 21026 - DNA, 1347 bp, Haemophilus influenzae; identical to SEQ ID NO: 4650
  CDS (1)..(1347)

SEQ ID NO: 21027 - protein, 448 aa, Haemophilus influenzae; identical to SEQ ID NO: 4651

SEQ ID NO: 21028 - DNA, 3462 bp, Bacillus subtilis; identical to SEQ ID NO: 4652
  CDS (16)..(3462)

SEQ ID NO: 21029 - protein, 1148 aa, Bacillus subtilis; identical to SEQ ID NO: 4653

SEQ ID NO: 21030 - DNA, 1803 bp, Mycobacterium tuberculosis; identical to SEQ ID NO: 4654
  CDS (1)..(1803)

SEQ ID NO: 21031 - protein, 600 aa, Mycobacterium tuberculosis; identical to SEQ ID NO: 4655

SEQ ID NO: 21032 - DNA, 1344 bp, Vibrio cholerae; identical to SEQ ID NO: 4656
  CDS (1)..(1344)

SEQ ID NO: 21033 - protein, 447 aa, Vibrio cholerae; identical to SEQ ID NO: 4657

SEQ ID NO: 21034 - DNA, 1356 bp, Staphylococcus aureus; identical to SEQ ID NO: 4658
  CDS (1)..(1356)

SEQ ID NO: 21035 - protein, 451 aa, Staphylococcus aureus; identical to SEQ ID NO: 4659

SEQ ID NO: 21036 - DNA, 2004 bp, Agrobacterium tumefaciens; identical to SEQ ID NO: 4660
  CDS (1)..(2004)

SEQ ID NO: 21037 - protein, 667 aa, Agrobacterium tumefaciens; identical to SEQ ID NO: 4661

SEQ ID NO: 21038 - DNA, 1434 bp, Aquifex aeolicus; identical to SEQ ID NO: 4662
  CDS (1)..(1434)

SEQ ID NO: 21039 - protein, 477 aa, Aquifex aeolicus; identical to SEQ ID NO: 4663

SEQ ID NO: 21040 - DNA, 1368 bp, Helicobacter pylori; identical to SEQ ID NO: 4664
  CDS (1)..(1368)

SEQ ID NO: 21041 - protein, 455 aa, Helicobacter pylori; identical to SEQ ID NO: 4665

SEQ ID NO: 21042 - DNA, 1332 bp, Campylobacter jejuni; identical to SEQ ID NO: 4666
  CDS (1)..(1332)

SEQ ID NO: 21043 - protein, 443 aa, Campylobacter jejuni; identical to SEQ ID NO: 4667

SEQ ID NO: 21044 - DNA, 1833 bp, Halobacterium sp. NRC-1; identical to SEQ ID NO: 4668
  CDS (1)..(1833)

SEQ ID NO: 21045 - protein, 610 aa, Halobacterium sp. NRC-1; identical to SEQ ID NO: 4669

SEQ ID NO: 21046 - DNA, 1797 bp, Mycobacterium leprae; identical to SEQ ID NO: 4670
  CDS (1)..(1797)

SEQ ID NO: 21047 - protein, 598 aa, Mycobacterium leprae; identical to SEQ ID NO: 4671

SEQ ID NO: 21048 - DNA, 1347 bp, Caulobacter crescentus; identical to SEQ ID NO: 4672
  CDS (1)..(1347)

SEQ ID NO: 21049 - protein, 448 aa, Caulobacter crescentus; identical to SEQ ID NO: 4673

SEQ ID NO: 21050 - DNA, 1965 bp, Caulobacter crescentus; identical to SEQ ID NO: 4674
  CDS (1)..(1965)

SEQ ID NO: 21051 - protein, 654 aa, Caulobacter crescentus; identical to SEQ ID NO: 4675

SEQ ID NO: 21052 - DNA, 1989 bp, Sinorhizobium meliloti; identical to SEQ ID NO: 4676
  CDS (1)..(1989)

SEQ ID NO: 21053 - protein, 662 aa, Sinorhizobium meliloti; identical to SEQ ID NO: 4677

SEQ ID NO: 21054 - DNA, 1374 bp, Chlamydia trachomatis; identical to SEQ ID NO: 4678
  CDS (1)..(1374)

SEQ ID NO: 21055 - protein, 457 aa, Chlamydia trachomatis; identical to SEQ ID NO: 4679

SEQ ID NO: 21056 - DNA, 1362 bp, Neisseria meningitidis; identical to SEQ ID NO: 4680
  CDS (1)..(1362)

SEQ ID NO: 21057 - protein, 453 aa, Neisseria meningitidis; identical to SEQ ID NO: 4681

SEQ ID NO: 21058 - DNA, 3624 bp, Caulobacter crescentus; identical to SEQ ID NO: 4682
  CDS (1)..(3624)

SEQ ID NO: 21059 - protein, 1207 aa, Caulobacter crescentus; identical to SEQ ID NO: 4683

SEQ ID NO: 21060 - DNA, 2013 bp, Sinorhizobium meliloti; identical to SEQ ID NO: 4684
  CDS (1)..(2013)

SEQ ID NO: 21061 - protein, 670 aa, Sinorhizobium meliloti; identical to SEQ ID NO: 4685

SEQ ID NO: 21062 - DNA, 7041 bp, Homo sapiens (man); identical to SEQ ID NO: 4686
  CDS (1)..(7041)

SEQ ID NO: 21063 - protein, 2346 aa, Homo sapiens (man); identical to SEQ ID NO: 4687

SEQ ID NO: 21064 - DNA, 4201 bp, Saccharomyces cerevisiae; identical to SEQ ID NO: 4688
  CDS (430)..(3966)

SEQ ID NO: 21065 - protein, 1178 aa, Saccharomyces cerevisiae; identical to SEQ ID NO: 4689

SEQ ID NO: 21066 - DNA, 7020 bp, Homo sapiens (man); identical to SEQ ID NO: 4690
  CDS (1)..(7020)

SEQ ID NO: 21067 - protein, 2339 aa, Homo sapiens (man) [sequence omitted]

SEQ ID NO: 21068 - DNA, 6042 bp, Saccharomyces cerevisiae; identical to SEQ ID NO: 4692
  CDS (373)..(5880)

SEQ ID NO: 21069 - protein, 1835 aa, Saccharomyces cerevisiae; identical to SEQ ID NO: 4693

SEQ ID NO: 21070 - DNA, 4315 bp, Saccharomyces cerevisiae; identical to SEQ ID NO: 4694
  CDS (676)..(4218)

SEQ ID NO: 21071 - protein, 1180 aa, Saccharomyces cerevisiae; identical to SEQ ID NO: 4695

SEQ ID NO: 21072 - DNA, 6558 bp, Ustilago maydis (corn smut); identical to SEQ ID NO: 4696
  CDS (1)..(6558)

SEQ ID NO: 21073 - protein, 2185 aa, Ustilago maydis (corn smut); identical to SEQ ID NO: 4697

SEQ ID NO: 21074 - DNA, 8521 bp, Saccharomyces cerevisiae; identical to SEQ ID NO: 4698
  CDS (1539)..(8240)

SEQ ID NO: 21075 - protein, 2233 aa, Saccharomyces cerevisiae; identical to SEQ ID NO: 4699

SEQ ID NO: 21076 - DNA, 1794 bp, Saccharopolyspora erythraea; identical to SEQ ID NO: 4700
  CDS (1)..(1794)

SEQ ID NO: 21077 - protein, 597 aa, Saccharopolyspora erythraea; identical to SEQ ID NO: 4701

SEQ ID NO: 21078 - DNA, 1347 bp, Synechocystis sp; identical to SEQ ID NO: 4702
  CDS (1)..(1347)

SEQ ID NO: 21079 - protein, 448 aa, Synechocystis sp; identical to SEQ ID NO: 4703

SEQ ID NO: 21080 - DNA, 1970 bp, Arabidopsis thaliana (mouse-ear cress); identical to SEQ ID NO: 4704
  CDS (140)..(1753)

SEQ ID NO: 21081 - protein, 537 aa, Arabidopsis thaliana (mouse-ear cress); identical to SEQ ID NO: 4705

SEQ ID NO: 21082 - DNA, 1921 bp, Nicotiana tabacum (common tobacco); identical to SEQ ID NO: 4706
  CDS (85)..(1695)

SEQ ID NO: 21083 - protein, 536 aa, Nicotiana tabacum (common tobacco); identical to SEQ ID NO: 4707

SEQ ID NO: 21084 - DNA, 1998 bp, Leishmania major; identical to SEQ ID NO: 4708
  CDS (1)..(1998)

SEQ ID NO: 21085 - protein, 665 aa, Leishmania major; identical to SEQ ID NO: 4709

SEQ ID NO: 21086 - DNA, 6993 bp, Triticum aestivum (common wheat); identical to SEQ ID NO: 4710
  CDS (39)..(6974)

SEQ ID NO: 21087 - protein, 2311 aa, Triticum aestivum (common wheat); identical to SEQ ID NO: 4711

SEQ ID NO: 21088 - DNA, 6786 bp, Glycine max (soybean); identical to SEQ ID NO: 4712
  CDS (1)..(6786)

SEQ ID NO: 21089 - protein, 2261 aa, Glycine max (soybean); identical to SEQ ID NO: 4713

SEQ ID NO: 21090 - DNA, 2030 bp, Glycine max (soybean); identical to SEQ ID NO: 4714
  CDS (90)..(1709)

SEQ ID NO: 21091 - protein, 539 aa, Glycine max (soybean); identical to SEQ ID NO: 4715

SEQ ID NO: 21092 - DNA, 6915 bp, Brassica napus (rape); identical to SEQ ID NO: 4716
  CDS (1)..(6915)

SEQ ID NO: 21093 - protein, 2304 aa, Brassica napus (rape); identical to SEQ ID NO: 4717

SEQ ID NO: 21094 - DNA, 7175 bp, Medicago sativa (alfalfa); identical to SEQ ID NO: 4718
  CDS (70)..(6843)

SEQ ID NO: 21095 - protein, 2257 aa, Medicago sativa (alfalfa); identical to SEQ ID NO: 4719

SEQ ID NO: 21096 - DNA, 2175 bp, Caenorhabditis elegans; identical to SEQ ID NO: 4720
  CDS (1)..(2175)

SEQ ID NO: 21097 - protein, 724 aa, Caenorhabditis elegans; identical to SEQ ID NO: 4721

SEQ ID NO: 21098 - DNA, 3864 bp, Caenorhabditis elegans; identical to SEQ ID NO: 4722
  CDS (36)..(3563)

SEQ ID NO: 21099 - protein, 1175 aa, Caenorhabditis elegans; identical to SEQ ID NO: 4723

SEQ ID NO: 21100 - DNA, 4974 bp, Caenorhabditis elegans; identical to SEQ ID NO: 4724
  CDS (1)..(4974)

SEQ ID NO: 21101 - protein, 1657 aa, Caenorhabditis elegans; identical to SEQ ID NO: 4725

SEQ ID NO: 21102 - DNA, 6867 bp, Emericella nidulans, Aspergillus nidulans; identical to SEQ ID NO: 4726
  CDS (1)..(6867)

SEQ ID NO: 21103 - protein, 2288 aa, Emericella nidulans, Aspergillus nidulans; identical to SEQ ID NO: 4727

SEQ ID NO: 21104 - DNA, 6165 bp, Caenorhabditis elegans; identical to SEQ ID NO: 4728
  CDS (1)..(6165)

SEQ ID NO: 21105 - protein, 2054 aa, Caenorhabditis elegans; identical to SEQ ID NO: 4729

SEQ ID NO: 21106 - DNA, 6843 bp, Schizosaccharomyces pombe; identical to SEQ ID NO: 4730
  CDS (1)..(6843)

SEQ ID NO: 21107 - protein, 2280 aa, Schizosaccharomyces pombe; identical to SEQ ID NO: 4731

SEQ ID NO: 21108 - DNA, 1773 bp, Streptomyces coelicolor; identical to SEQ ID NO: 4732
  CDS (1)..(1773)

SEQ ID NO: 21109 - protein, 590 aa, Streptomyces coelicolor; identical to SEQ ID NO: 4733

SEQ ID NO: 21110 - DNA, 1773 bp, Streptomyces coelicolor; identical to SEQ ID NO: 4734
  CDS (1)..(1773)

SEQ ID NO: 21111 - protein, 590 aa, Streptomyces coelicolor; identical to SEQ ID NO: 4735

SEQ ID NO: 21112 - DNA, 3933 bp, Aedes aegypti (yellow fever mosquito); identical to SEQ ID NO: 4736
  CDS (69)..(3656)

SEQ ID NO: 21113 - protein, 1195 aa, Aedes aegypti (yellow fever mosquito); identical to SEQ ID NO: 4737

SEQ ID NO: 21114 - DNA, 1542 bp, Sulfolobus metallicus; identical to SEQ ID NO: 4738
  CDS (1)..(1542)

SEQ ID NO: 21115 - protein, 513 aa, Sulfolobus metallicus; identical to SEQ ID NO: 4739

SEQ ID NO: 21116 - DNA, 1335 bp, Bacillus subtilis; identical to SEQ ID NO: 4740
  CDS (1)..(1335)

SEQ ID NO: 21117 - protein, 444 aa, Bacillus subtilis; identical to SEQ ID NO: 4741

SEQ ID NO: 21118 - DNA, 6822 bp, Brassica napus; identical to SEQ ID NO: 4742
  CDS (1)..(6822)

SEQ ID NO: 21119 - protein, 2273 aa, Brassica napus; identical to SEQ ID NO: 4743

SEQ ID NO: 21120 - DNA, 1599 bp, Corynebacterium glutamicum; identical to SEQ ID NO: 4744
  CDS (1)..(1599)

SEQ ID NO: 21121 - protein, 532 aa, Corynebacterium glutamicum; identical to SEQ ID NO: 4745

SEQ ID NO: 21122 - DNA, 3728 bp, Corynebacterium glutamicum; identical to SEQ ID NO: 4746
  CDS (165)..(3587)

SEQ ID NO: 21123 - protein, 1140 aa, Corynebacterium glutamicum; identical to SEQ ID NO: 4747

SEQ ID NO: 21124 - DNA, 7371 bp, Rattus norvegicus; identical to SEQ ID NO: 4748
  CDS (1)..(7371)

SEQ ID NO: 21125 - protein, 2456 aa, Rattus norvegicus; identical to SEQ ID NO: 4749

SEQ ID NO: 21126 - DNA, 3916 bp, Aspergillus terreus; identical to SEQ ID NO: 4750
  CDS (139)..(3720)

SEQ ID NO: 21127 - protein, 1193 aa, Aspergillus terreus; identical to SEQ ID NO: 4751

SEQ ID NO: 21128 - DNA, 3195 bp, Corynebacterium glutamicum; identical to SEQ ID NO: 4752
  CDS (872)..(2647)

SEQ ID NO: 21129 - protein, 591 aa, Corynebacterium glutamicum; identical to SEQ ID NO: 4753

SEQ ID NO: 21130 - DNA, 3558 bp, Schizosaccharomyces pombe; identical to SEQ ID NO: 4754
  CDS (1)..(3558)

SEQ ID NO: 21131 - protein, 1185 aa, Schizosaccharomyces pombe; identical to SEQ ID NO: 4755

SEQ ID NO: 21132 - DNA, 1620 bp, Arabidopsis thaliana; identical to SEQ ID NO: 4756
  CDS (1)..(1620): n means a or g or c or t/u

SEQ ID NO: 21133 - protein, 539 aa, Arabidopsis thaliana; identical to SEQ ID NO: 4757
  misc_feature (351)..(351): Xaa can be Asp or Glu

SEQ ID NO: 21134 - DNA, 3727 bp, Bacillus stearothermophilus; identical to SEQ ID NO: 4758
  CDS (92)..(3535)

SEQ ID NO: 21135 - protein, 1147 aa, Bacillus stearothermophilus; identical to SEQ ID NO: 4759

SEQ ID NO: 21136 - DNA, 6765 bp, Arabidopsis thaliana; identical to SEQ ID NO: 4760
  CDS (1)..(6765)

SEQ ID NO: 21137 - protein, 2254 aa, Arabidopsis thaliana; identical to SEQ ID NO: 4761

SEQ ID NO: 21138 - DNA, 6783 bp, Triticum aestivum; identical to SEQ ID NO: 4762
  CDS (1)..(6783): y means t/u or c

SEQ ID NO: 21139 - protein, 2260 aa, Triticum aestivum; identical to SEQ ID NO: 4763
  misc_feature (1980)..(1980): Xaa can be Pro or Ser

SEQ ID NO: 21140 - DNA, 3375 bp, Mycobacterium tuberculosis; identical to SEQ ID NO: 4764
  CDS (1)..(3375)

SEQ ID NO: 21141 - protein, 1124 aa, Mycobacterium tuberculosis; identical to SEQ ID NO: 4765

SEQ ID NO: 21142 - DNA, 1362 bp, Synechococcus sp; identical to SEQ ID NO: 4766
  CDS (1)..(1362)

SEQ ID NO: 21143 - protein, 453 aa, Synechococcus sp; identical to SEQ ID NO: 4767

SEQ ID NO: 21144 - DNA, 3800 bp, Rhizobium etli; identical to SEQ ID NO: 4768
  CDS (150)..(3614)

SEQ ID NO: 21145 - protein, 1154 aa, Rhizobium etli; identical to SEQ ID NO: 4769

SEQ ID NO: 21146 - DNA, 1422 bp, Wolinella succinogenes; identical to SEQ ID NO: 4770
  CDS (1)..(1422)

SEQ ID NO: 21147 - protein, 473 aa, Wolinella succinogenes; identical to SEQ ID NO: 4771

SEQ ID NO: 21148 - DNA, 3603 bp, Wolinella succinogenes; identical to SEQ ID NO: 4772
  CDS (1)..(3603)

SEQ ID NO: 21149 - protein, 1200 aa, Wolinella succinogenes; identical to SEQ ID NO: 4773

SEQ ID NO: 21150 - DNA, 1347 bp, Wolinella succinogenes; identical to SEQ ID NO: 4774
  CDS (1)..(1347)

SEQ ID NO: 21151 - protein, 448 aa, Wolinella succinogenes; identical to SEQ ID NO: 4775

SEQ ID NO: 21152 - DNA, 1956 bp, Chromobacterium violaceum; identical to SEQ ID NO: 4776
  CDS (1)..(1956)

SEQ ID NO: 21153 - protein, 651 aa, Chromobacterium violaceum; identical to SEQ ID NO: 4777

SEQ ID NO: 21154 - DNA, 1779 bp, Photorhabdus luminescens; identical to SEQ ID NO: 4778
  CDS (1)..(1779)

SEQ ID NO: 21155 - protein, 592 aa, Photorhabdus luminescens; identical to SEQ ID NO: 4779

SEQ ID NO: 21156 - DNA, 1350 bp, Photorhabdus luminescens; identical to SEQ ID NO: 4780
  CDS (1)..(1350)

SEQ ID NO: 21157 - protein, 449 aa, Photorhabdus luminescens; identical to SEQ ID NO: 4781

SEQ ID NO: 21158 - DNA, 1350 bp, Gloeobacter violaceus; identical to SEQ ID NO: 4782
  CDS (1)..(1350)

SEQ ID NO: 21159 - protein, 449 aa, Gloeobacter violaceus; identical to SEQ ID NO: 4783

SEQ ID NO: 21160 - DNA, 3609 bp, Gloeobacter violaceus; identical to SEQ ID NO: 4784
  CDS (1)..(3609)

SEQ ID NO: 21161 - protein, 1202 aa, Gloeobacter violaceus; identical to SEQ ID NO: 4785

SEQ ID NO: 21162 - DNA, 1491 bp, Chromobacterium violaceum; identical to SEQ ID NO: 4786
  CDS (1)..(1491)

SEQ ID NO: 21163 - protein, 496 aa, Chromobacterium violaceum; identical to SEQ ID NO: 4787

SEQ ID NO: 21164 - DNA, 1965 bp, Chromobacterium violaceum; identical to SEQ ID NO: 4788
  CDS (1)..(1965)

SEQ ID NO: 21165 - protein, 654 aa, Chromobacterium violaceum; identical to SEQ ID NO: 4789

SEQ ID NO: 21166 - DNA, 1998 bp, Rickettsia sibirica; identical to SEQ ID NO: 4790
  CDS (1)..(1998)

SEQ ID NO: 21167 - protein, 665 aa, Rickettsia sibirica; identical to SEQ ID NO: 4791

SEQ ID NO: 21168 - DNA, 1164 bp, Anopheles gambiae str; identical to SEQ ID NO: 4792
  CDS (1)..(1164)

SEQ ID NO: 21169 - protein, 387 aa, Anopheles gambiae str; identical to SEQ ID NO: 4793

SEQ ID NO: 21170 - DNA, 8736 bp, Plasmodium yoelii yoelii; identical to SEQ ID NO: 4794
  CDS (1)..(8736): m means a or c

SEQ ID NO: 21171 - protein, 2911 aa, Plasmodium yoelii yoelii; identical to SEQ ID NO: 4795
  misc_feature (1554)..(1554): Xaa can be Asp or Glu

SEQ ID NO: 21172 - DNA, 6828 bp, Neurospora crassa; identical to SEQ ID NO: 4796
  CDS (1)..(6828)

SEQ ID NO: 21173 - protein, 2275 aa, Neurospora crassa; identical to SEQ ID NO: 4797

SEQ ID NO: 21174 - DNA, 2232 bp, Neurospora crassa; identical to SEQ ID NO: 4798
  CDS (1)..(2232)

SEQ ID NO: 21175 - protein, 743 aa, Neurospora crassa; identical to SEQ ID NO: 4799

SEQ ID NO: 21176 - DNA, 1347 bp, Synechococcus sp; identical to SEQ ID NO: 4800
  CDS (1)..(1347)

SEQ ID NO: 21177 - protein, 448 aa, Synechococcus sp; identical to SEQ ID NO: 4801

SEQ ID NO: 21178 - DNA, 3501 bp, Rhodopirellula baltica; identical to SEQ ID NO: 4802
  CDS (1)..(3501)

SEQ ID NO: 21179 - protein, 1166 aa, Rhodopirellula baltica; identical to SEQ ID NO: 4803

SEQ ID NO: 21180 - DNA, 1353 bp, Rhodopirellula baltica; identical to SEQ ID NO: 4804
  CDS (1)..(1353)

SEQ ID NO: 21181 - protein, 450 aa, Rhodopirellula baltica; identical to SEQ ID NO: 4805

SEQ ID NO: 21182 - DNA, 1350 bp, Prochlorococcus marinus subsp; identical to SEQ ID NO: 4806
  CDS (1)..(1350)

SEQ ID NO: 21183 - protein, 449 aa, Prochlorococcus marinus subsp; identical to SEQ ID NO: 4807

SEQ ID NO: 21184 - DNA, 1347 bp, Prochlorococcus marinus; identical to SEQ ID NO: 4808
  CDS (1)..(1347)

SEQ ID NO: 21185 - protein, 448 aa, Prochlorococcus marinus; identical to SEQ ID NO: 4809

SEQ ID NO: 21186 - DNA, 1350 bp, Prochlorococcus marinus; identical to SEQ ID NO: 4810
  CDS (1)..(1350)

SEQ ID NO: 21187 - protein, 449 aa, Prochlorococcus marinus; identical to SEQ ID NO: 4811

SEQ ID NO: 21188 - DNA, 1425 bp, Helicobacter hepaticus; identical to SEQ ID NO: 4812
  CDS (1)..(1425)

SEQ ID NO: 21189 - protein, 474 aa, Helicobacter hepaticus; identical to SEQ ID NO: 4813

SEQ ID NO: 21190 - DNA, 1353 bp, Candidatus Blochmannia floridanus; identical to SEQ ID NO: 4814
  CDS (1)..(1353)

SEQ ID NO: 21191 - protein, 450 aa, Candidatus Blochmannia floridanus; identical to SEQ ID NO: 4815

SEQ ID NO: 21192 - DNA, 2022 bp, Bordetella parapertussis; identical to SEQ ID NO: 4816
  CDS (1)..(2022)

SEQ ID NO: 21193 - protein, 673 aa, Bordetella parapertussis; identical to SEQ ID NO: 4817

SEQ ID NO: 21194 - DNA, 1371 bp, Bordetella parapertussis; identical to SEQ ID NO: 4818
  CDS (1)..(1371)

SEQ ID NO: 21195 - protein, 456 aa, Bordetella parapertussis; identical to SEQ ID NO: 4819

SEQ ID NO: 21196 - DNA, 1365 bp, Bordetella bronchiseptica; identical to SEQ ID NO: 4820
  CDS (1)..(1365)

SEQ ID NO: 21197 - protein, 454 aa, Bordetella bronchiseptica; identical to SEQ ID NO: 4821

SEQ ID NO: 21198 - DNA, 1347 bp, Bordetella bronchiseptica; identical to SEQ ID NO: 4822
  CDS (1)..(1347)

SEQ ID NO: 21199 - protein, 448 aa, Bordetella bronchiseptica; identical to SEQ ID NO: 4823

SEQ ID NO: 21200 - DNA, 1365 bp, Bordetella bronchiseptica; identical to SEQ ID NO: 4824
  CDS (1)..(1365)

SEQ ID NO: 21201 - protein, 454 aa, Bordetella bronchiseptica; identical to SEQ ID NO: 4825

SEQ ID NO: 21202 - DNA, 3504 bp, Bordetella bronchiseptica; identical to SEQ ID NO: 4826
  CDS (1)..(3504)

SEQ ID NO: 21203 - protein, 1167 aa, Bordetella bronchiseptica; identical to SEQ ID NO: 4827

SEQ ID NO: 21204 - DNA, 7327 bp, Zea mays; identical to SEQ ID NO: 4828
  CDS (8)..(6985)

SEQ ID NO: 21205 - protein, 2325 aa, Zea mays; identical to SEQ ID NO: 4829

SEQ ID NO: 21206 - DNA, 7324 bp, Zea mays; identical to SEQ ID NO: 4830
  CDS (8)..(6982)

SEQ ID NO: 21207 - protein, 2324 aa, Zea mays; identical to SEQ ID NO: 4831

SEQ ID NO: 21208 - DNA, 3537 bp, Sus scrofa; identical to SEQ ID NO: 4832
  CDS (1)..(3537)

SEQ ID NO: 21209 - protein, 1178 aa, Sus scrofa; identical to SEQ ID NO: 4833

SEQ ID NO: 21210 - DNA, 7041 bp, Homo sapiens; identical to SEQ ID NO: 4834
  CDS (1)..(7041)

SEQ ID NO: 21211 - protein, 2346 aa, Homo sapiens [sequence omitted]

SEQ ID NO: 21212 - DNA, 2467 bp, Mus musculus; identical to SEQ ID NO: 4836
  CDS (6)..(2180)

SEQ ID NO: 21213 - protein, 724 aa, Mus musculus; identical to SEQ ID NO: 4837

SEQ ID NO: 21214 - DNA, 1323 bp, Bacillus cereus; identical to SEQ ID NO: 4838
  CDS (1)..(1323)

SEQ ID NO: 21215 - protein, 440 aa, Bacillus cereus; identical to SEQ ID NO: 4839

SEQ ID NO: 21216 - DNA, 3447 bp, Bacillus cereus; identical to SEQ ID NO: 4840
  CDS (1)..(3447)

SEQ ID NO: 21217 - protein, 1148 aa, Bacillus cereus; identical to SEQ ID NO: 4841

SEQ ID NO: 21218 - DNA, 1353 bp, Bacillus anthracis; identical to SEQ ID NO: 4842
  CDS (1)..(1353)

SEQ ID NO: 21219 - protein, 450 aa, Bacillus anthracis; identical to SEQ ID NO: 4843

SEQ ID NO: 21220 - DNA, 3447 bp, Bacillus anthracis; identical to SEQ ID NO: 4844
  CDS (1)..(3447)

SEQ ID NO: 21221 - protein, 1148 aa, Bacillus anthracis; identical to SEQ ID NO: 4845

SEQ ID NO: 21222 - DNA, 3636 bp, Nitrosomonas europaea; identical to SEQ ID NO: 4846
  CDS (1)..(3636)

SEQ ID NO: 21223 - protein, 1211 aa, Nitrosomonas europaea; identical to SEQ ID NO: 4847

SEQ ID NO: 21224 - DNA, 1356 bp, Chlamydophila caviae; identical to SEQ ID NO: 4848
  CDS (1)..(1356)

SEQ ID NO: 21225 - protein, 451 aa, Chlamydophila caviae; identical to SEQ ID NO: 4849

SEQ ID NO: 21226 - DNA, 3516 bp, Streptomyces avermitilis; identical to SEQ ID NO: 4850
  CDS (1)..(3516)

SEQ ID NO: 21227 - protein, 1171 aa, Streptomyces avermitilis; identical to SEQ ID NO: 4851

SEQ ID NO: 21228 - DNA, 2103 bp, Streptomyces avermitilis; identical to SEQ ID NO: 4852
  CDS (1)..(2103)

SEQ ID NO: 21229 - protein, 700 aa, Streptomyces avermitilis; identical to SEQ ID NO: 4853

SEQ ID NO: 21230 - DNA, 1851 bp, Streptomyces avermitilis; identical to SEQ ID NO: 4854
  CDS (1)..(1851)

SEQ ID NO: 21231 - protein, 616 aa, Streptomyces avermitilis; identical to SEQ ID NO: 4855

SEQ ID NO: 21232 - DNA, 1773 bp, Streptomyces avermitilis; identical to SEQ ID NO: 4856
  CDS (1)..(1773)

SEQ ID NO: 21233 - protein, 590 aa, Streptomyces avermitilis; identical to SEQ ID NO: 4857

SEQ ID NO: 21234 - DNA, 1359 bp, Nitrosomonas europaea; identical to SEQ ID NO: 4858
  CDS (1)..(1359)

SEQ ID NO: 21235 - protein, 452 aa, Nitrosomonas europaea; identical to SEQ ID NO: 4859

SEQ ID NO: 21236 - DNA, 1371 bp, Enterococcus faecalis; identical to SEQ ID NO: 4860
  CDS (1)..(1371)

SEQ ID NO: 21237 - protein, 456 aa, Enterococcus faecalis; identical to SEQ ID NO: 4861

SEQ ID NO: 21238 - DNA, 3492 bp, Enterococcus faecalis; identical to SEQ ID NO: 4862
  CDS (64)..(3492)

SEQ ID NO: 21239 - protein, 1142 aa, Enterococcus faecalis; identical to SEQ ID NO: 4863

SEQ ID NO: 21240 - DNA, 1347 bp, Coxiella burnetii; identical to SEQ ID NO: 4864
  CDS (1)..(1347)

SEQ ID NO: 21241 - protein, 448 aa, Coxiella burnetii; identical to SEQ ID NO: 4865

SEQ ID NO: 21242 - DNA, 1986 bp, Coxiella burnetii; identical to SEQ ID NO: 4866
  CDS (1)..(1986)

SEQ ID NO: 21243 - protein, 661 aa, Coxiella burnetii; identical to SEQ ID NO: 4867

SEQ ID NO: 21244 - DNA, 3396 bp, Tropheryma whipplei; identical to SEQ ID NO: 4868
  CDS (1)..(3396)

SEQ ID NO: 21245 - protein, 1131 aa, Tropheryma whipplei; identical to SEQ ID NO: 4869

SEQ ID NO: 21246 - DNA, 1776 bp, Tropheryma whipplei; identical to SEQ ID NO: 4870
  CDS (1)..(1776)

SEQ ID NO: 21247 - protein, 591 aa, Tropheryma whipplei; identical to SEQ ID NO: 4871

SEQ ID NO: 21248 - DNA, 2004 bp, Methylobacterium extorquens; identical to SEQ ID NO: 4872
  CDS (1)..(2004)

SEQ ID NO: 21249 - protein, 667 aa, Methylobacterium extorquens; identical to SEQ ID NO: 4873

SEQ ID NO: 21250 - DNA, 7446 bp, Setaria italica; identical to SEQ ID NO: 4874
  CDS (59)..(7024)

SEQ ID NO: 21251 - protein, 2321 aa, Setaria italica; identical to SEQ ID NO: 4875

SEQ ID NO: 21252 - DNA, 3994 bp, Bos taurus; identical to SEQ ID NO: 4876
  CDS (69)..(3605)

SEQ ID NO: 21253 - protein, 1178 aa, Bos taurus; identical to SEQ ID NO: 4877

SEQ ID NO: 21254 - DNA, 1530 bp, Acidianus brierleyi; identical to SEQ ID NO: 4878
  CDS (1)..(1530)

SEQ ID NO: 21255 - protein, 509 aa, Acidianus brierleyi; identical to SEQ ID NO: 4879

SEQ ID NO: 21256 - DNA, 1368 bp, Xylella fastidiosa; identical to SEQ ID NO: 4880
  CDS (1)..(1368)

SEQ ID NO: 21257 - protein, 455 aa, Xylella fastidiosa; identical to SEQ ID NO: 4881

SEQ ID NO: 21258 - DNA, 2115 bp, Vibrio parahaemolyticus; identical to SEQ ID NO: 4882
  CDS (1)..(2115)

SEQ ID NO: 21259 - protein, 704 aa, Vibrio parahaemolyticus; identical to SEQ ID NO: 4883

SEQ ID NO: 21260 - DNA, 1344 bp, Vibrio parahaemolyticus; identical to SEQ ID NO: 4884
  CDS (1)..(1344)

SEQ ID NO: 21261 - protein, 447 aa, Vibrio parahaemolyticus; identical to SEQ ID NO: 4885

SEQ ID NO: 21262 - DNA, 1416 bp, Pseudomonas syringae; identical to SEQ ID NO: 4886
  CDS (1)..(1416)

SEQ ID NO: 21263 - protein, 471 aa, Pseudomonas syringae; identical to SEQ ID NO: 4887

SEQ ID NO: 21264 - DNA, 1740 bp, Pseudomonas syringae; identical to SEQ ID NO: 4888
  CDS (1)..(1740)

SEQ ID NO: 21265 - protein, 579 aa, Pseudomonas syringae; identical to SEQ ID NO: 4889

SEQ ID NO: 21266 - DNA, 1344 bp, Pseudomonas syringae; identical to SEQ ID NO: 4890
  CDS (1)..(1344)

SEQ ID NO: 21267 - protein, 447 aa, Pseudomonas syringae; identical to SEQ ID NO: 4891

SEQ ID NO: 21268 - DNA, 3681 bp, Pseudomonas syringae; identical to SEQ ID NO: 4892
  CDS (1)..(3681)

SEQ ID NO: 21269 - protein, 1226 aa, Pseudomonas syringae; identical to SEQ ID NO: 4893

SEQ ID NO: 21270 - DNA, 1353 bp, Pseudomonas syringae; identical to SEQ ID NO: 4894
  CDS (1)..(1353)

SEQ ID NO: 21271 - protein, 450 aa, Pseudomonas syringae; identical to SEQ ID NO: 4895

SEQ ID NO: 21272 - DNA, 1950 bp, Pseudomonas syringae; identical to SEQ ID NO: 4896
  CDS (1)..(1950)

SEQ ID NO: 21273 - protein, 649 aa, Pseudomonas syringae; identical to SEQ ID NO: 4897

SEQ ID NO: 21274 - DNA, 1416 bp, Pseudomonas putida; identical to SEQ ID NO: 4898
  CDS (1)..(1416)

SEQ ID NO: 21275 - protein, 471 aa, Pseudomonas putida; identical to SEQ ID NO: 4899

SEQ ID NO: 21276 - DNA, 1953 bp, Pseudomonas putida; identical to SEQ ID NO: 4900
  CDS (1)..(1953)

SEQ ID NO: 21277 - protein, 650 aa, Pseudomonas putida; identical to SEQ ID NO: 4901

SEQ ID NO: 21278 - DNA, 1356 bp, Pseudomonas putida; identical to SEQ ID NO: 4902
  CDS (1)..(1356)

SEQ ID NO: 21279 - protein, 451 aa, Pseudomonas putida; identical to SEQ ID NO: 4903

SEQ ID NO: 21280 - DNA, 3435 bp, Lactobacillus plantarum; identical to SEQ ID NO: 4904
  CDS (1)..(3435)

SEQ ID NO: 21281 - protein, 1144 aa, Lactobacillus plantarum; identical to SEQ ID NO: 4905

SEQ ID NO: 21282 - DNA, 1389 bp, Lactobacillus plantarum; identical to SEQ ID NO: 4906
  CDS (1)..(1389)

SEQ ID NO: 21283 - protein, 462 aa, Lactobacillus plantarum; identical to SEQ ID NO: 4907

SEQ ID NO: 21284 - DNA, 1341 bp, Clostridium tetani; identical to SEQ ID NO: 4908
  CDS (1)..(1341)

SEQ ID NO: 21285 - protein, 446 aa, Clostridium tetani; identical to SEQ ID NO: 4909

SEQ ID NO: 21286 - DNA, 3318 bp, Bradyrhizobium japonicum; identical to SEQ ID NO: 4910
  CDS (1)..(3318)

SEQ ID NO: 21287 - protein, 1105 aa, Bradyrhizobium japonicum; identical to SEQ ID NO: 4911

SEQ ID NO: 21288 - DNA, 2016 bp, Bradyrhizobium japonicum; identical to SEQ ID NO: 4912
  CDS (1)..(2016)

SEQ ID NO: 21289 - protein, 671 aa, Bradyrhizobium japonicum; identical to SEQ ID NO: 4913

SEQ ID NO: 21290 - DNA, 2064 bp, Bradyrhizobium japonicum; identical to SEQ ID NO: 4914
  CDS (1)..(2064)

SEQ ID NO: 21291 - protein, 687 aa, Bradyrhizobium japonicum; identical to SEQ ID NO: 4915

SEQ ID NO: 21292 - DNA, 1359 bp, Bradyrhizobium japonicum; identical to SEQ ID NO: 4916
  CDS (1)..(1359)

SEQ ID NO: 21293 - protein, 452 aa, Bradyrhizobium japonicum; identical to SEQ ID NO: 4917

SEQ ID NO: 21294 - DNA, 1356 bp, Bradyrhizobium japonicum; identical to SEQ ID NO: 4918
  CDS (1)..(1356)

SEQ ID NO: 21295 - protein, 451 aa, Bradyrhizobium japonicum; identical to SEQ ID NO: 4919

SEQ ID NO: 21296 - DNA, 1977 bp, Bradyrhizobium japonicum; identical to SEQ ID NO: 4920
  CDS (1)..(1977)

SEQ ID NO: 21297 - protein, 658 aa, Bradyrhizobium japonicum; identical to SEQ ID NO: 4921

SEQ ID NO: 21298 - DNA, 1512 bp, Bacteroides thetaiotaomicron; identical to SEQ ID NO: 4922
  CDS (1)..(1512)

SEQ ID NO: 21299 - protein, 503 aa, Bacteroides thetaiotaomicron; identical to SEQ ID NO: 4923

SEQ ID NO: 21300 - DNA, 1512 bp, Bacteroides thetaiotaomicron; identical to SEQ ID NO: 4924
  CDS (1)..(1512)

SEQ ID NO: 21301 - protein, 503 aa, Bacteroides thetaiotaomicron; identical to SEQ ID NO: 4925

SEQ ID NO: 21302 - DNA, 2748 bp, Pagrus major; identical to SEQ ID NO: 4926
  CDS (188)..(2341): n means a or g or c or t/u

SEQ ID NO: 21303 - protein, 717 aa, Pagrus major; identical to SEQ ID NO: 4927

SEQ ID NO: 21304 - DNA, 4010 bp, Pagrus major; identical to SEQ ID NO: 4928
  CDS (389)..(3928): n means a or g or c or t/u

SEQ ID NO: 21305 - protein, 1179 aa, Pagrus major; identical to SEQ ID NO: 4929

SEQ ID NO: 21306 - DNA, 1359 bp, Staphylococcus epidermidis; identical to SEQ ID NO: 4930
  CDS (1)..(1359)

SEQ ID NO: 21307 - protein, 452 aa, Staphylococcus epidermidis; identical to SEQ ID NO: 4931

SEQ ID NO: 21308 - DNA, 1359 bp, Staphylococcus epidermidis; identical to SEQ ID NO: 4932
  CDS (1)..(1359)

SEQ ID NO: 21309 - protein, 452 aa, Staphylococcus epidermidis; identical to SEQ ID NO: 4933

SEQ ID NO: 21310 - DNA, 3465 bp, Staphylococcus epidermidis; identical to SEQ ID NO: 4934
  CDS (4)..(3465)

SEQ ID NO: 21311 - protein, 1153 aa, Staphylococcus epidermidis; identical to SEQ ID NO: 4935

SEQ ID NO: 21312 - DNA, 1338 bp, Wigglesworthia glossinidia brevipalpis; identical to SEQ ID NO: 4936
  CDS (1)..(1338)

SEQ ID NO: 21313 - protein, 445 aa, Wigglesworthia glossinidia brevipalpis; identical to SEQ ID NO: 4937

SEQ ID NO: 21314 - DNA, 1362 bp, Synechococcus elongatus; identical to SEQ ID NO: 4938
  CDS (1)..(1362)

SEQ ID NO: 21315 - protein, 453 aa, Synechococcus elongatus; identical to SEQ ID NO: 4939

SEQ ID NO: 21316 - DNA, 1371 bp, Streptococcus mutans; identical to SEQ ID NO: 4940
  CDS (1)..(1371)

SEQ ID NO: 21317 - protein, 456 aa, Streptococcus mutans; identical to SEQ ID NO: 4941

SEQ ID NO: 21318 - DNA, 1371 bp, Streptococcus agalactiae; identical to SEQ ID NO: 4942
  CDS (1)..(1371)

SEQ ID NO: 21319 - protein, 456 aa, Streptococcus agalactiae; identical to SEQ ID NO: 4943

SEQ ID NO: 21320 - DNA, 2085 bp, Shewanella oneidensis; identical to SEQ ID NO: 4944
  CDS (1)..(2085)

SEQ ID NO: 21321 - protein, 694 aa, Shewanella oneidensis; identical to SEQ ID NO: 4945

SEQ ID NO: 21322 - DNA, 4554 bp, Shewanella oneidensis; identical to SEQ ID NO: 4946
  CDS (1)..(4554)

SEQ ID NO: 21323 - protein, 1517 aa, Shewanella oneidensis; identical to SEQ ID NO: 4947

SEQ ID NO: 21324 - DNA, 1368 bp, Oceanobacillus iheyensis; identical to SEQ ID NO: 4948
  CDS (1)..(1368)

SEQ ID NO: 21325 - protein, 455 aa, Oceanobacillus iheyensis; identical to SEQ ID NO: 4949

SEQ ID NO: 21326 - DNA, 1341 bp, Oceanobacillus iheyensis; identical to SEQ ID NO: 4950
  CDS (1)..(1341)

SEQ ID NO: 21327 - protein, 446 aa, Oceanobacillus iheyensis; identical to SEQ ID NO: 4951

SEQ ID NO: 21328 - DNA, 3444 bp, Oceanobacillus iheyensis; identical to SEQ ID NO: 4952
  CDS (1)..(3444)

SEQ ID NO: 21329 - protein, 1147 aa, Oceanobacillus iheyensis; identical to SEQ ID NO: 4953

SEQ ID NO: 21330 - DNA, 1464 bp, Leptospira interrogans; identical to SEQ ID NO: 4954
  CDS (1)..(1464)

SEQ ID NO: 21331 - protein, 487 aa, Leptospira interrogans; identical to SEQ ID NO: 4955

SEQ ID NO: 21332 - DNA, 2381 bp, Corynebacterium efficiens; identical to SEQ ID NO: 4956
  CDS (982)..(2352)

SEQ ID NO: 21333 - protein, 456 aa, Corynebacterium efficiens; identical to SEQ ID NO: 4957

SEQ ID NO: 21334 - DNA, 3609 bp, Corynebacterium efficiens; identical to SEQ ID NO: 4958
  CDS (1)..(3609)

SEQ ID NO: 21335 - protein, 1202 aa, Corynebacterium efficiens; identical to SEQ ID NO: 4959

SEQ ID NO: 21336 - DNA, 3507 bp, Corynebacterium efficiens; identical to SEQ ID NO: 4960
  CDS (1)..(3507)

SEQ ID NO: 21337 - protein, 1168 aa, Corynebacterium efficiens; identical to SEQ ID NO: 4961

SEQ ID NO: 21338 - DNA, 3477 bp, Brucella suis; identical to SEQ ID NO: 4962
  CDS (1)..(3477)

SEQ ID NO: 21339 - protein, 1158 aa, Brucella suis; identical to SEQ ID NO: 4963

SEQ ID NO: 21340 - DNA, 2004 bp, Brucella suis; identical to SEQ ID NO: 4964
  CDS (1)..(2004)

SEQ ID NO: 21341 - protein, 667 aa, Brucella suis; identical to SEQ ID NO: 4965

SEQ ID NO: 21342 - DNA, 1359 bp, Brucella suis; identical to SEQ ID NO: 4966
  CDS (1)..(1359)

SEQ ID NO: 21343 - protein, 452 aa, Brucella suis; identical to SEQ ID NO: 4967

SEQ ID NO: 21344 - DNA, 1965 bp, Bifidobacterium longum; identical to SEQ ID NO: 4968
  CDS (1)..(1965)

SEQ ID NO: 21345 - protein, 654 aa, Bifidobacterium longum; identical to SEQ ID NO: 4969

SEQ ID NO: 21346 - DNA, 10011 bp, Plasmodium falciparum; identical to SEQ ID NO: 4970
  CDS (1)..(10011)

SEQ ID NO: 21347 - protein, 3336 aa, Plasmodium falciparum; identical to SEQ ID NO: 4971

SEQ ID NO: 21348 - DNA, 1533 bp, Metallosphaera sedula; identical to SEQ ID NO: 4972
  CDS (1)..(1533)

SEQ ID NO: 21349 - protein, 510 aa, Metallosphaera sedula; identical to SEQ ID NO: 4973

SEQ ID NO: 21350 - DNA, 3559 bp, Gallus gallus; identical to SEQ ID NO: 4974
  CDS (1)..(3537): s means g or c

SEQ ID NO: 21351 - protein, 1178 aa, Gallus gallus; identical to SEQ ID NO: 4975
  misc_feature (566)..(566): Xaa can be Ala or Pro

SEQ ID NO: 21352 - DNA, 1365 bp, Streptococcus pyogenes; identical to SEQ ID NO: 4976
  CDS (1)..(1365)

SEQ ID NO: 21353 - protein, 454 aa, Streptococcus pyogenes; identical to SEQ ID NO: 4977

SEQ ID NO: 21354 - DNA, 1344 bp, Chlorobium tepidum; identical to SEQ ID NO: 4978
  CDS (1)..(1344)

SEQ ID NO: 21355 - protein, 447 aa, Chlorobium tepidum; identical to SEQ ID NO: 4979

SEQ ID NO: 21356 - DNA, 7589 bp, Alopecurus myosuroides; identical to SEQ ID NO: 4980
  CDS (157)..(7119)

SEQ ID NO: 21357 - protein, 2320 aa, Alopecurus myosuroides; identical to SEQ ID NO: 4981

SEQ ID NO: 21358 - DNA, 4439 bp, Drosophila melanogaster; identical to SEQ ID NO: 4982
  CDS (417)..(4010)

SEQ ID NO: 21359 - protein, 1197 aa, Drosophila melanogaster; identical to SEQ ID NO: 4983

SEQ ID NO: 21360 - DNA, 1362 bp, Staphylococcus aureus; identical to SEQ ID NO: 4984
  CDS (1)..(1362)

SEQ ID NO: 21361 - protein, 453 aa, Staphylococcus aureus; identical to SEQ ID NO: 4985

SEQ ID NO: 21362 - DNA, 3453 bp, Staphylococcus aureus; identical to SEQ ID NO: 4986
  CDS (1)..(3453)

SEQ ID NO: 21363 - protein, 1150 aa, Staphylococcus aureus; identical to SEQ ID NO: 4987

SEQ ID NO: 21364 - DNA, 2028 bp, Xanthomonas campestris; identical to SEQ ID NO: 4988
  CDS (1)..(2028)

SEQ ID NO: 21365 - protein, 675 aa, Xanthomonas campestris; identical to SEQ ID NO: 4989

SEQ ID NO: 21366 - DNA, 3648 bp, Xanthomonas axonopodis; identical to SEQ ID NO: 4990
  CDS (1)..(3648)

SEQ ID NO: 21367 - protein, 1215 aa, Xanthomonas axonopodis; identical to SEQ ID NO: 4991

SEQ ID NO: 21368 - DNA, 2028 bp, Xanthomonas axonopodis; identical to SEQ ID NO: 4992
  CDS (1)..(2028)

SEQ ID NO: 21369 - protein, 675 aa, Xanthomonas axonopodis; identical to SEQ ID NO: 4993

SEQ ID NO: 21370 - DNA, 1494 bp, Methanosarcina mazei; identical to SEQ ID NO: 4994
  CDS (1)..(1494)

SEQ ID NO: 21371 - protein, 497 aa, Methanosarcina mazei; identical to SEQ ID NO: 4995

SEQ ID NO: 21372 - DNA, 1897 bp, Amycolatopsis mediterranei; identical to SEQ ID NO: 4996
  CDS (101)..(1897)

SEQ ID NO: 21373 - protein, 598 aa, Amycolatopsis mediterranei; identical to SEQ ID NO: 4997

SEQ ID NO: 21374 - DNA, 2381 bp, Corynebacterium efficiens; identical to SEQ ID NO: 4998
  CDS (577)..(2352)

SEQ ID NO: 21375 - protein, 591 aa, Corynebacterium efficiens; identical to SEQ ID NO: 4999

SEQ ID NO: 21376 - DNA, 7223 bp, Oryza sativa; identical to SEQ ID NO: 5000
  CDS (1)..(6804)

SEQ ID NO: 21377 - protein, 2267 aa, Oryza sativa; identical to SEQ ID NO: 5001

SEQ ID NO: 21378 - DNA, 1482 bp, Methanosarcina acetivorans; identical to SEQ ID NO: 5002
  CDS (1)..(1482)

SEQ ID NO: 21379 - protein, 493 aa, Methanosarcina acetivorans; identical to SEQ ID NO: 5003

SEQ ID NO: 21380 - DNA, 2511 bp, Homo sapiens; identical to SEQ ID NO: 5004
  CDS (47)..(2233)

SEQ ID NO: 21381 - protein, 728 aa, Homo sapiens; identical to SEQ ID NO: 5005

SEQ ID NO: 21382 - DNA, 4190 bp, Pichia angusta; identical to SEQ ID NO: 5006
  CDS (275)..(3802)

SEQ ID NO: 21383 - protein, 1175 aa, Pichia angusta; identical to SEQ ID NO: 5007

SEQ ID NO: 21384 - DNA, 1353 bp, Clostridium perfringens; identical to SEQ ID NO: 5008
  CDS (1)..(1353)

SEQ ID NO: 21385 - protein, 450 aa, Clostridium perfringens; identical to SEQ ID NO: 5009

SEQ ID NO: 21386 - DNA, 1368 bp, Ralstonia solanacearum; identical to SEQ ID NO: 5010
  CDS (1)..(1368)

SEQ ID NO: 21387 - protein, 455 aa, Ralstonia solanacearum; identical to SEQ ID NO: 5011

SEQ ID NO: 21388 - DNA, 1371 bp, Ralstonia solanacearum; identical to SEQ ID NO: 5012
  CDS (1)..(1371)

SEQ ID NO: 21389 - protein, 456 aa, Ralstonia solanacearum; identical to SEQ ID NO: 5013

SEQ ID NO: 21390 - DNA, 2139 bp, Ralstonia solanacearum; identical to SEQ ID NO: 5014
  CDS (1)..(2139)

SEQ ID NO: 21391 - protein, 712 aa, Ralstonia solanacearum; identical to SEQ ID NO: 5015

SEQ ID NO: 21392 - DNA, 3459 bp, Rhizobium meliloti; identical to SEQ ID NO: 5016
  CDS (1)..(3459)

SEQ ID NO: 21393 - protein, 1152 aa, Rhizobium meliloti; identical to SEQ ID NO: 5017

SEQ ID NO: 21394 - DNA, 1350 bp, Rhizobium meliloti; identical to SEQ ID NO: 5018
  CDS (1)..(1350)

SEQ ID NO: 21395 - protein, 449 aa, Rhizobium meliloti; identical to SEQ ID NO: 5019

SEQ ID NO: 21396 - DNA, 1677 bp, Brassica napus; identical to SEQ ID NO: 5020
  CDS (34)..(1641)

SEQ ID NO: 21397 - protein, 535 aa, Brassica napus; identical to SEQ ID NO: 5021

SEQ ID NO: 21398 - DNA, 1542 bp, Sulfolobus tokodaii; identical to SEQ ID NO: 5022
  CDS (1)..(1542)

SEQ ID NO: 21399 - protein, 513 aa, Sulfolobus tokodaii; identical to SEQ ID NO: 5023

SEQ ID NO: 21400 - DNA, 2085 bp, Rhizobium loti; identical to SEQ ID NO: 5024
  CDS (1)..(2085)

SEQ ID NO: 21401 - protein, 694 aa, Rhizobium loti; identical to SEQ ID NO: 5025

SEQ ID NO: 21402 - DNA, 1962 bp, Rhizobium loti; identical to SEQ ID NO: 5026
  CDS (1)..(1962)

SEQ ID NO: 21403 - protein, 653 aa, Rhizobium loti; identical to SEQ ID NO: 5027

SEQ ID NO: 21404 - DNA, 3459 bp, Rhizobium loti; identical to SEQ ID NO: 5028
  CDS (1)..(3459)

SEQ ID NO: 21405 - protein, 1152 aa, Rhizobium loti; identical to SEQ ID NO: 5029

SEQ ID NO: 21406 - DNA, 2013 bp, Rhizobium loti; identical to SEQ ID NO: 5030
  CDS (1)..(2013)

SEQ ID NO: 21407 - protein, 670 aa, Rhizobium loti; identical to SEQ ID NO: 5031

SEQ ID NO: 21408 - DNA, 1347 bp, Pasteurella multocida; identical to SEQ ID NO: 5032
  CDS (1)..(1347)

SEQ ID NO: 21409 - protein, 448 aa, Pasteurella multocida; identical to SEQ ID NO: 5033

SEQ ID NO: 21410 - DNA, 4000 bp, Brachydanio rerio; identical to SEQ ID NO: 5034
  CDS (25)..(3567)

SEQ ID NO: 21411 - protein, 1180 aa, Brachydanio rerio; identical to SEQ ID NO: 5035

SEQ ID NO: 21412 - DNA, 1386 bp, Streptomyces sp; identical to SEQ ID NO: 5036
  CDS (1)..(1386)

SEQ ID NO: 21413 - protein, 461 aa, Streptomyces sp; identical to SEQ ID NO: 5037

SEQ ID NO: 21414 - DNA, 1344 bp, Gamma; identical to SEQ ID NO: 5038
  CDS (1)..(1344)

SEQ ID NO: 21415 - protein, 447 aa, Gamma; identical to SEQ ID NO: 5039

SEQ ID NO: 21416 - DNA, 4218 bp, Mycobacterium smegmatis; identical to SEQ ID NO: 5040
  CDS (600)..(3983)

SEQ ID NO: 21417 - protein, 1127 aa, Mycobacterium smegmatis; identical to SEQ ID NO: 5041

SEQ ID NO: 21418 - DNA, 1722 bp, Myxococcus xanthus; identical to SEQ ID NO: 5042
  CDS (1)..(1722)

SEQ ID NO: 21419 - protein, 573 aa, Myxococcus xanthus; identical to SEQ ID NO: 5043

SEQ ID NO: 21420 - DNA, 6966 bp, Brassica napus; identical to SEQ ID NO: 5044
  CDS (1)..(6966)

SEQ ID NO: 21421 - protein, 2321 aa, Brassica napus; identical to SEQ ID NO: 5045

SEQ ID NO: 21422 - DNA, 7128 bp, Arabidopsis thaliana; identical to SEQ ID NO: 5046
  CDS (1)..(7128)

SEQ ID NO: 21423 - protein, 2375 aa, Arabidopsis thaliana; identical to SEQ ID NO: 5047

SEQ ID NO: 21424 - DNA, 3579 bp, Aspergillus niger; identical to SEQ ID NO: 5048
  CDS (1)..(3579)

SEQ ID NO: 21425 - protein, 1192 aa, Aspergillus niger; identical to SEQ ID NO: 5049

SEQ ID NO: 21426 - DNA, 1482 bp, Methanosarcina barkeri; identical to SEQ ID NO: 5050
  CDS (1)..(1482)

SEQ ID NO: 21427 - protein, 493 aa, Methanosarcina barkeri; identical to SEQ ID NO: 5051

SEQ ID NO: 21428 - DNA, 1845 bp, Streptomyces coelicolor; identical to SEQ ID NO: 5052
  CDS (1)..(1845)

SEQ ID NO: 21429 - protein, 614 aa, Streptomyces coelicolor; identical to SEQ ID NO: 5053

SEQ ID NO: 21430 - DNA, 1941 bp, Streptomyces coelicolor; identical to SEQ ID NO: 5054
  CDS (1)..(1941)

SEQ ID NO: 21431 - protein, 646 aa, Streptomyces coelicolor; identical to SEQ ID NO: 5055

SEQ ID NO: 21432 - DNA, 1293 bp, Bacillus subtilis; identical to SEQ ID NO: 5056
  CDS (1)..(1293)

SEQ ID NO: 21433 - protein, 430 aa, Bacillus subtilis; identical to SEQ ID NO: 5057

SEQ ID NO: 21434 - DNA, 1323 bp, Lactobacillus plantarum; identical to SEQ ID NO: 5058
  CDS (1)..(1323)

SEQ ID NO: 21435 - protein, 440 aa, Lactobacillus plantarum; identical to SEQ ID NO: 5059

SEQ ID NO: 21436 - DNA, 1620 bp, Glycine max; identical to SEQ ID NO: 5060
  CDS (1)..(1620)

SEQ ID NO: 21437 - protein, 539 aa, Glycine max; identical to SEQ ID NO: 5061

SEQ ID NO: 21438 - DNA, 3622 bp, Lactococcus lactis; identical to SEQ ID NO: 5062
  CDS (105)..(3518)

SEQ ID NO: 21439 - protein, 1137 aa, Lactococcus lactis; identical to SEQ ID NO: 5063

SEQ ID NO: 21440 - DNA, 3375 bp, Streptomyces coelicolor; identical to SEQ ID NO: 5064
  CDS (1)..(3375)

SEQ ID NO: 21441 - protein, 1124 aa, Streptomyces coelicolor; identical to SEQ ID NO: 5065

SEQ ID NO: 21442 - DNA, 8001 bp, Drosophila melanogaster; identical to SEQ ID NO: 5066
  CDS (177)..(7625)

SEQ ID NO: 21443 - protein, 2482 aa, Drosophila melanogaster; identical to SEQ ID NO: 5067

SEQ ID NO: 21444 - DNA, 2397 bp, Drosophila melanogaster; identical to SEQ ID NO: 5068
  CDS (74)..(2170)

SEQ ID NO: 21445 - protein, 698 aa, Drosophila melanogaster; identical to SEQ ID NO: 5069

SEQ ID NO: 21446 - DNA, 4311 bp, Pseudomonas fluorescens; identical to SEQ ID NO: 5070
  CDS (125)..(3766)

SEQ ID NO: 21447 - protein, 1213 aa, Pseudomonas fluorescens; identical to SEQ ID NO: 5071

SEQ ID NO: 21448 - DNA, 1755 bp, Streptomyces venezuelae; identical to SEQ ID NO: 5072
  CDS (1)..(1755)

SEQ ID NO: 21449 - protein, 584 aa, Streptomyces venezuelae; identical to SEQ ID NO: 5073

SEQ ID NO: 21450 - DNA, 4391 bp, Drosophila melanogaster; identical to SEQ ID NO: 5074
  CDS (417)..(3962)

SEQ ID NO: 21451 - protein, 1181 aa, Drosophila melanogaster; identical to SEQ ID NO: 5075

SEQ ID NO: 21452 - DNA, 9422 bp, Ovis aries; identical to SEQ ID NO: 5076
  CDS (320)..(7360)

SEQ ID NO: 21453 - protein, 2346 aa, Ovis aries; identical to SEQ ID NO: 5077

SEQ ID NO: 21454 - DNA, 7452 bp, Homo sapiens; identical to SEQ ID NO: 5078
  CDS (1)..(7452)

SEQ ID NO: 21455 - protein, 2483 aa, Homo sapiens; identical to SEQ ID NO: 5079

SEQ ID NO: 21456 - DNA, 2546 bp, Homo sapiens; identical to SEQ ID NO: 5080
  CDS (133)..(2310)

SEQ ID NO: 21457 - protein, 725 aa, Homo sapiens; identical to SEQ ID NO: 5081

SEQ ID NO: 21458 - DNA, 3953 bp, Homo sapiens; identical to SEQ ID NO: 5082
  CDS (39)..(3575)

SEQ ID NO: 21459 - protein, 1178 aa, Homo sapiens; identical to SEQ ID NO: 5083

SEQ ID NO: 21460 - DNA, 4456 bp, Pichia pastoris; identical to SEQ ID NO: 5084
  CDS (700)..(4269)

SEQ ID NO: 21461 - protein, 1189 aa, Pichia pastoris; identical to SEQ ID NO: 5085

SEQ ID NO: 21462 - DNA, 3945 bp, Rattus norvegicus; identical to SEQ ID NO: 5086
  CDS (35)..(3571)

SEQ ID NO: 21463 - protein, 1178 aa, Rattus norvegicus; identical to SEQ ID NO: 5087

SEQ ID NO: 21464 - DNA, 3858 bp, Xenopus laevis; identical to SEQ ID NO: 5088
  CDS (33)..(3566)

SEQ ID NO: 21465 - protein, 1177 aa, Xenopus laevis; identical to SEQ ID NO: 5089

SEQ ID NO: 21466 - DNA, 3468 bp, Agrobacterium vitis; identical to SEQ ID NO: 5090
  CDS (1)..(3468)

SEQ ID NO: 21467 - protein, 1155 aa, Agrobacterium vitis; identical to SEQ ID NO: 5091

SEQ ID NO: 21468 - DNA, 1341 bp, Geobacter sulfurreducens; identical to SEQ ID NO: 5092
  CDS (1)..(1341)

SEQ ID NO: 21469 - protein, 446 aa, Geobacter sulfurreducens; identical to SEQ ID NO: 5093

SEQ ID NO: 21470 - DNA, 3447 bp, Geobacter sulfurreducens; identical to SEQ ID NO: 5094
  CDS (1)..(3447)

SEQ ID NO: 21471 - protein, 1148 aa, Geobacter sulfurreducens; identical to SEQ ID NO: 5095

SEQ ID NO: 21472 - DNA, 7496 bp, Homo sapiens; identical to SEQ ID NO: 5096
  CDS (120)..(7496)

SEQ ID NO: 21473 - protein, 2458 aa, Homo sapiens [sequence omitted]

SEQ ID NO: 21474 - DNA, 2172 bp, Emericella nidulans; identical to SEQ ID NO: 5098
  CDS (1)..(2172)

SEQ ID NO: 21475 - protein, 723 aa, Emericella nidulans; identical to SEQ ID NO: 5099

SEQ ID NO: 21476 - DNA, 3384 bp, Mycobacterium paratuberculosis; identical to SEQ ID NO: 5100
  CDS (1)..(3384)

SEQ ID NO: 21477 - protein, 1127 aa, Mycobacterium paratuberculosis; identical to SEQ ID NO: 5101

SEQ ID NO: 21478 - DNA, 1992 bp, Mycobacterium paratuberculosis; identical to SEQ ID NO: 5102
  CDS (1)..(1992)

SEQ ID NO: 21479 - protein, 663 aa, Mycobacterium paratuberculosis; identical to SEQ ID NO: 5103

SEQ ID NO: 21480 - DNA, 2016 bp, Mycobacterium paratuberculosis; identical to SEQ ID NO: 5104
  CDS (1)..(2016)

SEQ ID NO: 21481 - protein, 671 aa, Mycobacterium paratuberculosis; identical to SEQ ID NO: 5105

SEQ ID NO: 21482 - DNA, 3228 bp, Mycobacterium paratuberculosis; identical to SEQ ID NO: 5106
  CDS (1)..(3228)

SEQ ID NO: 21483 - protein, 1075 aa, Mycobacterium paratuberculosis; identical to SEQ ID NO: 5107

SEQ ID NO: 21484 - DNA, 1824 bp, Mycobacterium paratuberculosis; identical to SEQ ID NO: 5108
  CDS (1)..(1824)

SEQ ID NO: 21485 - protein, 607 aa, Mycobacterium paratuberculosis; identical to SEQ ID NO: 5109

SEQ ID NO: 21486 - DNA, 1320 bp, Treponema denticola; identical to SEQ ID NO: 5110
  CDS (1)..(1320)

SEQ ID NO: 21487 - protein, 439 aa, Treponema denticola; identical to SEQ ID NO: 5111

SEQ ID NO: 21488 - DNA, 2076 bp, Wolbachia pipientis wMel; identical to SEQ ID NO: 5112
  CDS (1)..(2076)

SEQ ID NO: 21489 - protein, 691 aa, Wolbachia pipientis wMel; identical to SEQ ID NO: 5113

SEQ ID NO: 21490 - DNA, 1338 bp, Bacillus cereus; identical to SEQ ID NO: 5114
  CDS (1)..(1338)

SEQ ID NO: 21491 - protein, 445 aa, Bacillus cereus; identical to SEQ ID NO: 5115

SEQ ID NO: 21492 - DNA, 6696 bp, Ashbya gossypii; identical to SEQ ID NO: 5116
  CDS (1)..(6696)

SEQ ID NO: 21493 - protein, 2231 aa, Ashbya gossypii; identical to SEQ ID NO: 5117

SEQ ID NO: 21494 - DNA, 3516 bp, Ashbya gossypii; identical to SEQ ID NO: 5118
  CDS (1)..(3516)

SEQ ID NO: 21495 - protein, 1171 aa, Ashbya gossypii; identical to SEQ ID NO: 5119

SEQ ID NO: 21496 - DNA, 5460 bp, Ashbya gossypii; identical to SEQ ID NO: 5120
  CDS (1)..(5460)

SEQ ID NO: 21497 - protein, 1819 aa, Ashbya gossypii; identical to SEQ ID NO: 5121

SEQ ID NO: 21498 - DNA, 1347 bp, uncultured marine gamma proteobacterium EBAC20E09; identical to SEQ ID NO: 5122
  CDS (1)..(1347)

SEQ ID NO: 21499 - protein, 448 aa, uncultured marine gamma proteobacterium EBAC20E09; identical to SEQ ID NO: 5123

SEQ ID NO: 21500 - DNA, 1338 bp, Thermus thermophilus; identical to SEQ ID NO: 5124
  CDS (1)..(1338)

SEQ ID NO: 21501 - protein, 445 aa, Thermus thermophilus; identical to SEQ ID NO: 5125

SEQ ID NO: 21502 - DNA, 3678 bp, Desulfovibrio vulgaris; identical to SEQ ID NO: 5126
  CDS (1)..(3678)

SEQ ID NO: 21503 - protein, 1225 aa, Desulfovibrio vulgaris; identical to SEQ ID NO: 5127

SEQ ID NO: 21504 - DNA, 1416 bp, Desulfovibrio vulgaris; identical to SEQ ID NO: 5128
  CDS (1)..(1416)

SEQ ID NO: 21505 - protein, 471 aa, Desulfovibrio vulgaris; identical to SEQ ID NO: 5129

SEQ ID NO: 21506 - DNA, 3441 bp, Listeria monocytogenes str; identical to SEQ ID NO: 5130
  CDS (1)..(3441)

SEQ ID NO: 21507 - protein, 1146 aa, Listeria monocytogenes str; identical to SEQ ID NO: 5131

SEQ ID NO: 21508 - DNA, 3516 bp, Oleomonas sagaranensis; identical to SEQ ID NO: 5132
  CDS (1)..(3516)

SEQ ID NO: 21509 - protein, 1171 aa, Oleomonas sagaranensis; identical to SEQ ID NO: 5133

SEQ ID NO: 21510 - DNA, 2016 bp, Caenorhabditis elegans; identical to SEQ ID NO: 5134
  CDS (1)..(2016)

SEQ ID NO: 21511 - protein, 671 aa, Caenorhabditis elegans; identical to SEQ ID NO: 5135

SEQ ID NO: 21512 - DNA, 1350 bp, Bacillus amyloliquefaciens; identical to SEQ ID NO: 5136
  CDS (1)..(1350)

SEQ ID NO: 21513 - protein, 449 aa, Bacillus amyloliquefaciens; identical to SEQ ID NO: 5137

SEQ ID NO: 21514 - DNA, 3549 bp, Rhodopseudomonas palustris; identical to SEQ ID NO: 5138
  CDS (1)..(3549)

SEQ ID NO: 21515 - protein, 1182 aa, Rhodopseudomonas palustris; identical to SEQ ID NO: 5139

SEQ ID NO: 21516 - DNA, 3312 bp, Rhodopseudomonas palustris; identical to SEQ ID NO: 5140
  CDS (1)..(3312)

SEQ ID NO: 21517 - protein, 1103 aa, Rhodopseudomonas palustris; identical to SEQ ID NO: 5141

SEQ ID NO: 21518 - DNA, 1983 bp, Rhodopseudomonas palustris; identical to SEQ ID NO: 5142
  CDS (1)..(1983)

SEQ ID NO: 21519 - protein, 660 aa, Rhodopseudomonas palustris; identical to SEQ ID NO: 5143

SEQ ID NO: 21520 - DNA, 1353 bp, Rhodopseudomonas palustris; identical to SEQ ID NO: 5144
  CDS (1)..(1353)

SEQ ID NO: 21521 - protein, 450 aa, Rhodopseudomonas palustris; identical to SEQ ID NO: 5145

SEQ ID NO: 21522 - DNA, 2016 bp, Rhodopseudomonas palustris; identical to SEQ ID NO: 5146
  CDS (1)..(2016)

SEQ ID NO: 21523 - protein, 671 aa, Rhodopseudomonas palustris; identical to SEQ ID NO: 5147

SEQ ID NO: 21524 - DNA, 2016 bp, Rhodopseudomonas palustris; identical to SEQ ID NO: 5148
  CDS (1)..(2016)

SEQ ID NO: 21525 - protein, 671 aa, Rhodopseudomonas palustris; identical to SEQ ID NO: 5149

SEQ ID NO: 21526 - DNA, 3426 bp, Corynebacterium diphtheriae; identical to SEQ ID NO: 5150
  CDS (1)..(3426)

SEQ ID NO: 21527 - protein, 1141 aa, Corynebacterium diphtheriae; identical to SEQ ID NO: 5151

SEQ ID NO: 21528 - DNA, 1785 bp, Corynebacterium diphtheriae; identical to SEQ ID NO: 5152
  CDS (1)..(1785)

SEQ ID NO: 21529 - protein, 594 aa, Corynebacterium diphtheriae; identical to SEQ ID NO: 5153

SEQ ID NO: 21530 - DNA, 1479 bp, Bdellovibrio bacteriovorus; identical to SEQ ID NO: 5154
  CDS (1)..(1479)

SEQ ID NO: 21531 - protein, 492 aa, Bdellovibrio bacteriovorus; identical to SEQ ID NO: 5155

SEQ ID NO: 21532 - DNA, 1503 bp, Bdellovibrio bacteriovorus; identical to SEQ ID NO: 5156
  CDS (1)..(1503)

SEQ ID NO: 21533 - protein, 500 aa, Bdellovibrio bacteriovorus; identical to SEQ ID NO: 5157

SEQ ID NO: 21534 - DNA, 1362 bp, Parachlamydia sp; identical to SEQ ID NO: 5158
  CDS (1)..(1362)

SEQ ID NO: 21535 - protein, 453 aa, Parachlamydia sp; identical to SEQ ID NO: 5159

SEQ ID NO: 21536 - DNA, 1506 bp, Methanococcus maripaludis; identical to SEQ ID NO: 5160
  CDS (1)..(1506)

SEQ ID NO: 21537 - protein, 501 aa, Methanococcus maripaludis; identical to SEQ ID NO: 5161

SEQ ID NO: 21538 - DNA, 1719 bp, Streptomyces antibioticus; identical to SEQ ID NO: 5162
  CDS (1)..(1719)

SEQ ID NO: 21539 - protein, 572 aa, Streptomyces antibioticus; identical to SEQ ID NO: 5163

SEQ ID NO: 21540 - DNA, 1344 bp, Photobacterium profundum; identical to SEQ ID NO: 5164
  CDS (1)..(1344)

SEQ ID NO: 21541 - protein, 447 aa, Photobacterium profundum; identical to SEQ ID NO: 5165

SEQ ID NO: 21542 - DNA, 26 bp, Primer
ttatttttcctgaagaccgagttttt

SEQ ID NO: 21543 - DNA, 24 bp, Primer
atgctggataaaattgttattgcc

SEQ ID NO: 21544 - DNA, 1059 bp, Escherichia coli K12
  CDS (1)..(1059)
atgaataagcgcgatgcaatcaatcatattcggcagtttggcgggcgtcttgatcgcttccgtaaatcggtcggcggctcaggcgacggcggtcgtaacgcaccaaaacgcgcgaaatcctcgccaaaaccggtaaatcgcaaaaccaacgttttcaacgaacaggtgcgctatgccttccacggcgcattgcaggatctgaaaagcaaaccgttcgccacgtttttaacggtgatggttatcgccatttctctgacgctgcccagcgtctgttatatggtgtacaaaaacgttaaccaggcggcgacgcagtattatccgtcaccgcaaatcactgtttatctgcaaaaaacgctggacgatgacgctgctgcgggcgtggtggcacagttgcaggccgagcaaggcgtggagaaagtgaactatctttctcgtgaagacgcactgggtgagttccgtaactggtctggttttggtggtgcgctggatatgctggaagaaaacccgcttccggcagtggcggtggtgatcccgaaactcgatttccaggggacggaatcactgaatacgctgcgtgatcgtatcacgcagattaacggcattgacgaagtgcggatggatgacagctggtttgcccgtctggcggcgttgaccgggctggtcgggcgcgtttcggcgatgatcggcgtgttgatggtggcggccgtgttcctcgtcatcggtaacagtgtgcgtctgagtatctttgctcgccgtgactccattaacgtacagaaactgattggtgcgacagatggattcatcctgcgcccgttcctgtatggtggcgcactgctgggattttctggcgcattgttgtcattaattttgtcagaaattctggtgctgcgattgtcatcggcggttgcggaagtggcacaggttttcggaacgaagtttgatatcaatggcttatcattcgatgaatgcctgctattgctgctggtatgctcgatgattggctgggtggcagcgtggcttgccacggtacaacatttacgccactttacgcctgaataa

SEQ ID NO: 21545 - protein, 352 aa, Escherichia coli K12
MNKRDAINHIRQFGGRLDRFRKSVGGSGDGGRNAPKRAKSSPKPVNRKTNVFNEQVRYAFHGALQDLKSKPFATFLTVMVIAISLTLPSVCYMVYKNVNQAATQYYPSPQITVYLQKTLDDDAAAGVVAQLQAEQGVEKVNYLSREDALGEFRNWSGFGGALDMLEENPLPAVAVVIPKLDFQGTESLNTLRDRITQINGIDEVRMDDSWFARLAALTGLVGRVSAMIGVLMVAAVFLVIGNSVRLSIFARRDSINVQKLIGATDGFILRPFLYGGALLGFSGALLSLILSEILVLRLSSAVAEVAQVFGTKFDINGLSFDECLLLLLVCSMIGWVAAWLATVQHLRHFTPE

SEQ ID NO: 21546 - DNA, 897 bp, Bacillus halodurans
  CDS (1)..(897)
atgaaatttagaaccctgtctcgtcacgttcgcgaaggaacaaaaaacctagggcgaaatggttggatgacattcgcttcgatcagcgccgttgctgttatgttgtttgtggttggtgcctttattctcatgatcatgaatatgaaccaagtggcaaccacggtcgaggacgatgtagagataaatgtatacatagagctaacagctgataaaacacaacaggaagctcttgaagccgaaattcaaacaatccctaacattgagagtgttacatacgtttctcgtgatgaagggttggatcaactcatcggtagtttagatgaggagactgctccagtatttgaatctctccgtgaggaaaacccgttaaatgacaagtttgttgtccgtgcgacaaatccgcaattaacggagcaaattgccgatcaaatcgaagcgatgaaccatgtcgattatgtccgcttcgggcgtgaagttgtcaatcggctttttacgatcacgaactttgttcgcacaggtgggctcgtgctgatcattggaatgatgctcacagcgatgtttttgatttcgaacacgatcaagttaaccatctttgctagaaaacgagagattcaaattatgaaacttgttggagccacaaatggtttcatccgctggccattttttatcgaaggaattttactcggtgtcatcggtgctctcataccgattgcgatactatggggcggatactactatgtgtacaacaattttggtggacaagttcaaaactttttattttcgttaacccctgtaacaccatcgatcttacaagtggctgtagtgctagtcgcagttggggcgtttatcggaatgtggggaagcgtcatgtctgttcgcaagtttcttaaagtttaa

SEQ ID NO: 21547 - protein, 298 aa, Bacillus halodurans
MKFRTLSRHVREGTKNLGRNGWMTFASISAVAVMLFVVGAFILMIMNMNQVATTVEDDVEINVYIELTADKTQQEALEAEIQTIPNIESVTYVSRDEGLDQLIGSLDEETAPVFESLREENPLNDKFVVRATNPQLTEQIADQIEAMNHVDYVRFGREVVNRLFTITNFVRTGGLVLIIGMMLTAMFLISNTIKLTIFARKREIQIMKLVGATNGFIRWPFFIEGILLGVIGALIPIAILWGGYYYVYNNFGGQVQNFLFSLTPVTPSILQVAVVLVAVGAFIGMWGSVMSVRKFLKV

SEQ ID NO: 21548 - DNA, 954 bp, Yersinia pestis
  CDS (1)..(954)
atggcgaataatgcgcgaaaagcaaaaaccaaggcgctaaagggcggttggcgtgagcagtggcgctattcgtgggtcaatgcgattgccgatatgatgcgtcagcctatggcgacgctattaacggtgatggtgatatctatttcgctaacgctgccaagcgtatgttatatcgtgtggaagaacgttagccaggcggcggagcaatggtatccaacaccgcaactgacagtctatctggataaagcactggacgataacgcggctgagaatgttgtcgtgacgctgaaagctgaagccggtgttgagaaggtcaattacctgtcgcgggaagaggcgatgggtgagttccgcaactggtctggttttggcggtgcgctggatatgctggaagagaatccgttacctgccgtcgctattattactcccaagttaaatttccaaagtgctgaaacgctgaatacattgcgtgatcgcattagccaggttgaaggggtggcggaagtccgtatggacgacagctggtttgcccgtttagcggcactgacgggcttggtcggtcaggttgcagcaatggttggcgtactgatggtggtcgctgtattcctggtgatcggtaacagcgtcaggctgagtatctttagccgtcgggatacgatcaacgtcatgaagttacttggtgctactgatgggttcattttacggccattcttgaatggcggtgcgatgttagggttcggtggtgcggtattatcgttgatactgtcagaggcattggtatggcaattggggtcagttgtcaaacaggtggcgaccgtgtttggtacccaatttactctgcatggtctgagctgggatgaaagcctgttactggtattaatctcagcaatgattggctggattgccgcgtggttggcgacggttcaacatttacgccgatttacaccgcaataa

SEQ ID NO: 21549 - protein, 317 aa, Yersinia pestis
MANNARKAKTKALKGGWREQWRYSWVNAIADMMRQPMATLLTVMVISISLTLPSVCYIVWKNVSQAAEQWYPTPQLTVYLDKALDDNAAENVVVTLKAEAGVEKVNYLSREEAMGEFRNWSGFGGALDMLEENPLPAVAIITPKLNFQSAETLNTLRDRISQVEGVAEVRMDDSWFARLAALTGLVGQVAAMVGVLMVVAVFLVIGNSVRLSIFSRRDTINVMKLLGATDGFILRPFLNGGAMLGFGGAVLSLILSEALVWQLGSVVKQVATVFGTQFTLHGLSWDESLLLVLISAMIGWIAAWLATVQHLRRFTPQ

SEQ ID NO: 21550 - DNA, 885 bp, Listeria innocua
  CDS (1)..(885)
atgaaatttaggactgtaggaagacatataagagaaagttttaagagcctttaccggaatggttggatgacctttgcagcagcaagtgcagtaacagtaacacttatcttagtcagcgtgttttttgcaatattgatcaacatgaacaagcttgcaacagatgtagaaaacaatgtacaaattaacgtacatatttctctaagcgcagacaagaaacagcagcaagaacttgagaaaaacattgagaagattaatggagttgatagtgtcagtttttcttccaaggatgatgagttgaagaaattagttggcgcgtacggcaaaaacttcgaattgtttaaacaagataatccactatacgatgtgttcgttgtagaggctaaagagccaacacaaacgaaggcgattgctcaaaaagtagaaaaattacagtacgtagataatgtagaatatggtgagaaaacagtcgacaaattgtttgataccttaaaatggggacgatatgctggtattatcctaagcattggattattactaacagcgatgttcttaatatcaaacacaattaagattgcgattttctcccgtcgtagagaaatagaaattatgaaattagtaggagcgaccaactggttcatacgctggcctttcgttttagaaggtgcatggcttgggttaattggttcgattgtcccggttgtattaacatttataggctatgttaatatttacaacttggtaaatccgaagttggtgacaagttcactatcacttctgcctccaacaccgttcgcctatcaaatcagtgctttgattattgcaatcggagttctaataggaatttggggtagtgttatctctatccgtagattcttgaaagtctaa

SEQ ID NO: 21551 - protein, 294 aa, Listeria innocua
MKFRTVGRHIRESFKSLYRNGWMTFAAASAVTVTLILVSVFFAILINMNKLATDVENNVQINVHISLSADKKQQQELEKNIEKINGVDSVSFSSKDDELKKLVGAYGKNFELFKQDNPLYDVFVVEAKEPTQTKAIAQKVEKLQYVDNVEYGEKTVDKLFDTLKWGRYAGIILSIGLLLTAMFLISNTIKIAIFSRRREIEIMKLVGATNWFIRWPFVLEGAWLGLIGSIVPVVLTFIGYVNIYNLVNPKLVTSSLSLLPPTPFAYQISALIIAIGVLIGIWGSVISIRRFLKV

SEQ ID NO: 21552 - DNA, 903 bp, Nostoc sp. PCC 7120
  CDS (1)..(903)
atgtttaaatttctcacgaaacttgactatctactgaaggaaaccttcttgggtttgctgcgcggtggttggatgaattgggctgccgtcagtactgttacagtattactgtttttattcggcttgagtttgcaaacttcttggcaagtagaaaagctgctcaatcagtttggtagccagttagaagtatctgtttatcttgattctggtaggtcagcgcaaactattgaaccgtttgtggtgcaaatgccggatgtggtagggatgcaaattattactaaagagcaagcctggactaaattagttaaagaactaggaattgctgatattgaaggtgctacacaacagctaggggaaaatcctttagtggatgagattaaggtcaaagcacgtaactctcagtctgtgccgattttagcaactcaattggctaaattacagggagttgatacggttcagtatatcgatgaggcggttaaacgcatcgcccagttgcatcgaggactcaattggatgacgctgacaatcacaatgattttgactttaacagcgatcgctgtcactacaacaactattcgtctaattgtgatggcacgtcggcgggaaattgaaattatgcagttagtgggagcaacttcggcctggatttatctaccgtttattttacaggggatagcttttggtttatttggtggtgcgatcgcttggagttttatatctgtaatccaacagtttaccgggaagttactcaccaatcaaccagaatttattcaatttattagcaatggtttacaactcacggccacacaggttttgctactacctttaattttgttaagctttggtgcaacagtaggattaatgggtagcttatttgctgtccgacgttttgccaaaagttag

SEQ ID NO: 21553 - protein, 300 aa, Nostoc sp. PCC 7120
MFKFLTKLDYLLKETFLGLLRGGWMNWAAVSTVTVLLFLFGLSLQTSWQVEKLLNQFGSQLEVSVYLDSGRSAQTIEPFVVQMPDVVGMQIITKEQAWTKLVKELGIADIEGATQQLGENPLVDEIKVKARNSQSVPILATQLAKLQGVDTVQYIDEAVKRIAQLHRGLNWMTLTITMILTLTAIAVTTTTIRLIVMARRREIEIMQLVGATSAWIYLPFILQGIAFGLFGGAIAWSFISVIQQFTGKLLTNQPEFIQFISNGLQLTATQVLLLPLILLSFGATVGLMGSLFAVRRFAKS

SEQ ID NO: 21554 - DNA, 1056 bp, Salmonella enterica subsp. enterica serovar Typhi
  CDS (1)..(1056)
atgaataggcgcgacgcgattaaccaaatcaggcagttcggcggacggctggatcgactgcgtaagtctcgcggcggaacaggcggcgggcgcaacgcgccaggacgccagaagccgacgccgaaaccgaactcacgtaaaacaaatgtttttaatgaacaggtgcgctatgcttggcacggtgcgctgcaagatctgaaaagcaaaccgctggcgacgtttctgacggtgatggtgatcgccatctccctgacgctgcccagcgtctgttacatggtctataagaacgtcaaccaggcggcgactcagtactatccgtcgccgcagatcaccgtttatctgcaaaaaacgctggatgatgacgcggcggcgcgggtcgttgggcagcttcaggccgagcagggcgttgagaaggtcaactacctgtcccgtgaggacgcgctgggcgaattccgcaactggtcgggttttggcggcgcgctggacatgctggaagagaacccgctaccggcggtggcggtggtgatccccaagctggactttcaaagtaccgcctcgcttaatacgctgcgcgaccgtatctcgcagattaacggcattgacgaagtccgcatggatgatagctggtttgcgcgtctggcggcgctcaccgggctggtgggccgcgtgtcggcgatgattggcgtgctgatggtcgcggcggtcttcctcgttatcggcaacagcgtgcgcctgagcatttttgcccgtcgcgacaccattaacgtgcaaaagctgattggcgcgaccgatggctttatcctgcgtccgttcctctacggcggcgcattgctcggtttttccggcgcgtttctttcactgatattgtctgaaattttggtgatgcgtttatcatcggcggtgactgaagtggcgcaggtcttcggcacgaagtttgatctcaatggtttatcgttcgatgagtgcctgttgctgctgctggtctgttccatgatcggctggatcgccgcttggctggctacggtgcaacatttacgttactttactcccgattga

SEQ ID NO: 21555 - protein, 351 aa, Salmonella enterica subsp. enterica serovar Typhi
MNRRDAINQIRQFGGRLDRLRKSRGGTGGGRNAPGRQKPTPKPNSRKTNVFNEQVRYAWHGALQDLKSKPLATFLTVMVIAISLTLPSVCYMVYKNVNQAATQYYPSPQITVYLQKTLDDDAAARVVGQLQAEQGVEKVNYLSREDALGEFRNWSGFGGALDMLEENPLPAVAVVIPKLDFQSTASLNTLRDRISQINGIDEVRMDDSWFARLAALTGLVGRVSAMIGVLMVAAVFLVIGNSVRLSIFARRDTINVQKLIGATDGFILRPFLYGGALLGFSGAFLSLILSEILVMRLSSAVTEVAQVFGTKFDLNGLSFDECLLLLLVCSMIGWIAAWLATVQHLRYFTPD

SEQ ID NO: 21556 - DNA, 939 bp, Xylella fastidiosa
  CDS (1)..(939)
atgaataaatctgctattaaggctgcacactcacgattggctgtctgggttggttaccatattcacagtatcgcgtttagcctccattgtgtgatgcgcaaacctttggcgacattgctgacggtcatggcattgactctggcgcttgcattgcccctaggtttgtcaatcgtgttaggtaaccttagggtgttggctgacagcgtgcagcaatcccggcagattaatctgtttttgaagaccaatgtggatgttgcggcggctgagcgtctggctgagaagctgcgtggtcgtcccgatgttgctgcggtggtggttcgtactccagagcagggattggctgagttacgcgaaggtgcgaagctgggtgaggcgatagatgcgcttggtaaaaatccgttgccgagtttgttggtggttattccatccctatctgctgtagatagcgaggtggcgcgggtgttacaggcacttccagaggctgatttggtgcagtacgacgtgttatggcagcgtcgactggatgcttggctaggcttaggtcaatatttggtgcatatactttcagctctgctcggctttggtgctgtaatggtggttggcaataccgtgcggctggatatccagtctaggcgccatgagatcgcggtgctacatctgcttggtgctagcgatggttttattcgtcgtccttacctgtatttggggacgtggtactgtttggctgcttctcttgctgcgtttggtttgctaggtctgattggcgtggtgttgcgtgtgccactgatggtgttgacggatagttataacagtcgtttcgcccttcatgggttgggcatctccgaaggtgccatgattcttggaggtattctccttttgggttggcttggtgtatggctggtgacgggacattttttacgtcaaatgcgccccgcgtaa

SEQ ID NO: 21557 - protein, 312 aa, Xylella fastidiosa
MNKSAIKAAHSRLAVWVGYHIHSIAFSLHCVMRKPLATLLTVMALTLALALPLGLSIVLGNLRVLADSVQQSRQINLFLKTNVDVAAAERLAEKLRGRPDVAAVVVRTPEQGLAELREGAKLGEAIDALGKNPLPSLLVVIPSLSAVDSEVARVLQALPEADLVQYDVLWQRRLDAWLGLGQYLVHILSALLGFGAVMVVGNTVRLDIQSRRHEIAVLHLLGASDGFIRRPYLYLGTWYCLAASLAAFGLLGLIGVVLRVPLMVLTDSYNSRFALHGLGISEGAMILGGILLLGWLGVWLVTGHFLRQMRPA

SEQ ID NO: 21558 - DNA, 918 bp, Neisseria meningitidis
  CDS (1)..(918)
atgagcatcatccactacctctcgctgcacgtcgaatccgcgcgcaccgcgctcaaacagcttctgcgccaacctttcggcacactgcttaccctcataatgctcgccgtcgccatgaccctgccgctgtttatgtacttgggcatccaaagcgggcaaagcgtgttgggcaaactcaatgagtcgccgcaaatcaccgtctatatggaaaccgccgccgcacaaagcgacagcgataccgtccgcagcctgctggtgcgcgacaaacggctcgacaacatccgctttatcagcaaagaagacggtttggaagaattacagtccaatctcgaccaaaatctgatttccatgcttgacggtaaccccctgccggatgtctttatcgttacccccgacccggcaaccacgcccgcccaaatgcaggcaatctaccgggacattaccaaactgcctatggtcgaatccgccaacatggatacggaatgggtacagacactgtaccaaatcaacgaattcatccgtaaaatcttatggtttctttccctgacgctggggatggcgttcgtccttgtcgcgcacaacaccatccgactgcaaatcctcagccgaaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgccccttggtcgatgccatcttcaaaccctacggacttaatatcggctggcgtttcttctacccgggagaaatcgcactggtgttcggcttcgtcatcgcactggggatattcggcgcgtggcttgccaccacccagcacctgctcggcttcaaagccaaaaaataa

SEQ ID NO: 21559 - protein, 305 aa, Neisseria meningitidis
MSIIHYLSLHVESARTALKQLLRQPFGTLLTLIMLAVAMTLPLFMYLGIQSGQSVLGKLNESPQITVYMETAAAQSDSDTVRSLLVRDKRLDNIRFISKEDGLEELQSNLDQNLISMLDGNPLPDVFIVTPDPATTPAQMQAIYRDITKLPMVESANMDTEWVQTLYQINEFIRKILWFLSLTLGMAFVLVAHNTIRLQILSRKEEIEITKLLGAPASFIRRPFLYQAMWQSILSAAVSLGLCGWLLSAVRPLVDAIFKPYGLNIGWRFFYPGEIALVFGFVIALGIFGAWLATTQHLLGFKAKK

SEQ ID NO: 21560 - DNA, 906 bp, Clostridium acetobutylicum
  CDS (1)..(906)
atgagagttagtacattaaagttattttttatagatgctcttaaaagtttaaaaagaaataagactataagtactgcagcagcagcaacagtagcggcaactctttttatactaggagtatgtttattggtgcttcttaacgtaaaaacaggaataagcgatgtaagatccaaagttcaggtacaggtttactttaaagatgatataacaatagatgaacaaaaaattgttttaaataagttggcggacgtaccaggcataacaggaataaaattcgaaagtaaaagtgatgctttagctaaatttaaacaacaactaggaaatgataataaaacattagttgaaggtatggatactagaaatcctatgcctaattcatatgttgtaagtgtttcggattctgattatgcatcaggtgtggttaaagctcttaaagataagaatggatctactttagatggaatagagaagatacaggatggaagagaattagtaaataagataaccactataacaaatacagttcaatgggttggaattgctatatttattatattggcgggtgtgtcattgttcttaattggaaatactataaaacttacagtatattcaagacgtagagaaatagggataatgaaatatataggtgcgacagattggtttataagacttccttttgtaatagagggaatgattataggtatagcaggagcgcttgtaacaattttggttgtatataacttgtatagagttctctttaataagataagaagtagtttcttaacaatgaatataatacagccttcatatgtattgacttttatgtcctgggaatttattttagcaggaatgtttattggagcattaggaagtattgtagttataagaaagtttcttgatgtgtag

SEQ ID NO: 21561 - protein, 301 aa, Clostridium acetobutylicum
MRVSTLKLFFIDALKSLKRNKTISTAAAATVAATLFILGVCLLVLLNVKTGISDVRSKVQVQVYFKDDITIDEQKIVLNKLADVPGITGIKFESKSDALAKFKQQLGNDNKTLVEGMDTRNPMPNSYVVSVSDSDYASGVVKALKDKNGSTLDGIEKIQDGRELVNKITTITNTVQWVGIAIFIILAGVSLFLIGNTIKLTVYSRRREIGIMKYIGATDWFIRLPFVIEGMIIGIAGALVTILVVYNLYRVLFNKIRSSFLTMNIIQPSYVLTFMSWEFILAGMFIGALGSIVVIRKFLDV

SEQ ID NO: 21562 - DNA, 990 bp, Streptococcus pneumoniae
  CDS (1)..(990)
atgtcattgccattgaaaatggccgtgtcgttcgtgacgaatcaaaaggagagtatggatacgatgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacgctccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagctttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttag

SEQ ID NO: 21563 - protein, 329 aa, Streptococcus pneumoniae
MSLPLKMAVSFVTNQKESMDTMISRFFRHLFEALKSLKRNGWMTVAAVSSVMITLTLVAIFASVIFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANAPNDVKTIAEDAKKIEGVSEVQDGGANTERLFKLASFIRVWGLGIAALLIFIAAFLISNTIRITIISRSREIQIMRLVGAKNSYIRGPFLLEGAFIGLLGAIAPSVLVFIVYQIVYQSVNKSLVGQNLSMISPDLFSPLMIALLFVIGVFIGSLGSGISMRRFLKI

SEQ ID NO: 21564 - DNA, 993 bp, Vibrio cholerae
  CDS (1)..(993)
atggccgttaagccgggcaatcaaaaaatcagcaaaaccaccaaaagtaccaaaagcaaaccgcgtgatgtgaagcgagccaaaaccgacagttttctcgccattcatttcaaacaggcgaaagcatcgtttgccgccttgtggcgacgtccactgggcaacattttgactttggcggtaatttctatggcgttggcgctacccgccagtttgtacttgctgagtaaaaatatcgcctcggtggctgagcgagtggctgagccttctcagctcagtgtttatctgcacatcgatacaccagaacctcggatcatcgttttgaaagatgatttggagcggcgtgatgaaattgccaaagtgaaatacatctcaccgcagcaaggtttggatgatttaagccagtatgctggctttgagcaagcgatcagcctactcgataacgccaccttgcccgcggtattagtggtgacgcctaaagtggacagtcgagagcagatccaaacgcttgccaaagccctacaagcagaagagggggtgaccgatgtgcgcatggatgaagattggtttgcccgtttagatgcgattcgccatttggcgactatcgtggtgattagcttatccagcttgatgttgatgtcggtttttttgattgtgggcaatacgctacgttttaacgtacaagccaacaaagaagaaatccaaaccatgaaactcatcggtgcgaccgatgcgtatattctgcgtccttatctctattcagggatgtggtttggtttactcggcgccgtggcagcctggctattaacggccttgatgacgattttactcaatggtgcggtggaagcgctcgctcaattgtatgacagccgtttccgtttgattggcctcggctgggatgaatcattactgcttttaatgctcggcgtctttttaggctgcgtggcggcgaaagtgtcggcgaaacgccatctaaaagaaattgaacctgtttaa

SEQ ID NO: 21565 - protein, 330 aa, Vibrio cholerae
MAVKPGNQKISKTTKSTKSKPRDVKRAKTDSFLAIHFKQAKASFAALWRRPLGNILTLAVISMALALPASLYLLSKNIASVAERVAEPSQLSVYLHIDTPEPRIIVLKDDLERRDEIAKVKYISPQQGLDDLSQYAGFEQAISLLDNATLPAVLVVTPKVDSREQIQTLAKALQAEEGVTDVRMDEDWFARLDAIRHLATIVVISLSSLMLMSVFLIVGNTLRFNVQANKEEIQTMKLIGATDAYILRPYLYSGMWFGLLGAVAAWLLTALMTILLNGAVEALAQLYDSRFRLIGLGWDESLLLLMLGVFLGCVAAKVSAKRHLKEIEPV

SEQ ID NO: 21566 - DNA, 936 bp, Lactococcus lactis subsp. lactis
  CDS (1)..(936)
atgattagaaatttcttcaaacaccttttggagtcgctcaaaaacttaaaacgtaatggttggatgacagttgcggctgtttcatcagtaacaattactttagttttagttggacttttcctttcagttatcttgaatacttcaaaaatatctaatgggattgaaaacaatgttcggattgttgcctacatgaaattagatgttcatgatcaagagacaaaaattcaagatccaaaagataataaaaaaacaatcaataatcctgaccacctgaagatttacgattcaatcaaaaaagttcctaatgtaaaaacagttgaattctcaagtaaagaagctcagttgaaagaactgacaaaggccttaggaaataactggaatctctttaaaggtgatgccaatccactttacgatgcttatattgttgaagctgataaaccagcaaatgtaaaatcagtcacttcaaaaatatcaaaactttcaggaattgaaaaagctacttatggtggtgcaaatactgcaaaacttttccaaattgctcagggaattcgaacttggggaactgcagcggctattctgttaattttcgttgctgtcttcttgatttctaacaccattcgaattactatcctatcaagacaacgtgaaattcaaattatgcgtctggttggggctaaaaatggttatatccgttggcctttcttcttggaaggcgcttgggttggacttttaggttcaattattccaggacttattgttgcttgggcttatcgtcttgcttttgttagcttgacaccaagtcttcagtcacaaaaacttgcaatgtttgctcctaaagagttcattcctgcaatagttggattgatggccgtgattggtattttgattggttcatttggagccctcttatcaatgcgtcgtttccttaaaatttaa

SEQ ID NO: 21567 - protein, 311 aa, Lactococcus lactis subsp. lactis
MIRNFFKHLLESLKNLKRNGWMTVAAVSSVTITLVLVGLFLSVILNTSKISNGIENNVRIVAYMKLDVHDQETKIQDPKDNKKTINNPDHLKIYDSIKKVPNVKTVEFSSKEAQLKELTKALGNNWNLFKGDANPLYDAYIVEADKPANVKSVTSKISKLSGIEKATYGGANTAKLFQIAQGIRTWGTAAAILLIFVAVFLISNTIRITILSRQREIQIMRLVGAKNGYIRWPFFLEGAWVGLLGSIIPGLIVAWAYRLAFVSLTPSLQSQKLAMFAPKEFIPAIVGLMAVIGILIGSFGALLSMRRFLKI

SEQ ID NO: 21568 - DNA, 882 bp, Clostridium acetobutylicum
  CDS (1)..(882)
atgataattaacaccttgaaattattttttaaagatgcattaaaaaatagtattagaaatatctctattactattgcttctataactacggttttatgcagcatatttattttagaaatattttttcttttgctatgtaatattaaactaggaatttccggagctgcccctaaccgagaaatacaggtgtttctaaataacaatataaaagtcgcagataggcaaagaatacataataaaataatggcattagatggtatcgttaatattgattttgagagcaaacagaaaatctcatactatttaaaaaagcacttaggtaacagatacaaaaatatattattaaattctctacccgaatcatatacggttagagttaatagtgaagaaaacattccgattataattgctaagattagttgtttaaaaggaatatcagaggttgataaaaatgcttctatcgaaaaagaacttacggctattattagagtagctcaattgattggaattcctctttttattatattctcagtaatatcaatttttttgattaaaaacacaatattacttactatatattcaagacgtgaagaaattagtgtaatgaagtaccttggtgcaacagattggtttattagatggcccttcatttttcaaggaatgataatttgtttttcaggcactatgatatcattaataataatttttttattgtacagttttatatataaaaatatcgcttcttattcaatagaagtattcttaactttaatacccccatcttttatacttacaaccatgtcatggttttttttgcttactggaacaattataggagctctaataagtggctttactataaaaaagttcttaaatatataa

SEQ ID NO: 21569 - protein, 293 aa, Clostridium acetobutylicum
MIINTLKLFFKDALKNSIRNISITIASITTVLCSIFILEIFFLLLCNIKLGISGAAPNREIQVFLNNNIKVADRQRIHNKIMALDGIVNIDFESKQKISYYLKKHLGNRYKNILLNSLPESYTVRVNSEENIPIIIAKISCLKGISEVDKNASIEKELTAIIRVAQLIGIPLFIIFSVISIFLIKNTILLTIYSRREEISVMKYLGATDWFIRWPFIFQGMIICFSGTMISLIIIFLLYSFIYKNIASYSIEVFLTLIPPSFILTTMSWFFLLTGTIIGALISGFTIKKFLNI

SEQ ID NO: 21570 - DNA, 891 bp, Bacillus subtilis
  CDS (1)..(891)
atgattaaaattctcgggcgccacttgcgtgagagttttaaatctctcgggagaaacacatggatgacatttgcatccattagtgctgtaaccgttacgctgattttagtcggcgtgtttttagtgattatgctgaatttgaataacatggccacgaatgcagaaaaacaagtcgaaatcaaagtgctgattgatctgactgcagatcagaaggcacaggacaagcttcagaacgatattaaggaactgaagggcattcagagtgtcactttttcatctaaagaaaaagagcttgaccagctggttgacagttttggtgacagcggaaaatccctgacaatgaaggatcaggaaaacccgcttaatgatgcgtttgtcgtcaaaacgacagatccgcatgatacgccgaacgtggcgaaaaagatcgaaaaaatggatcatgtttataaagtcacttatggaaaagaagaggtcagccgtttgtttaaagtggtcggcgtttcccgcaacatcggaatcgcgttaattatcggcctggtatttacggcgatgttcttaatttccaacaccattaaaattacaattttcgcaagaagaaaagaaattgaaatcatgaagcttgtcggcgcgacaaactggtttatccgctggccgtttttccttgaaggattgctgctaggcgtattcggttctgtgattccgattgcactggtgctgagcacttaccaatacgtcatcggatgggtcgttccaaaggttcaaggatcatttgtctctcttcttccttataatccatttgtattccaagtttcgctagtgctgattgcaatcggcgcagtaattggagtatggggaagtctgacttccatccgcaagtttctgcgagtataa

SEQ ID NO: 21571 - protein, 296 aa, Bacillus subtilis
MIKILGRHLRESFKSLGRNTWMTFASISAVTVTLILVGVFLVIMLNLNNMATNAEKQVEIKVLIDLTADQKAQDKLQNDIKELKGIQSVTFSSKEKELDQLVDSFGDSGKSLTMKDQENPLNDAFVVKTTDPHDTPNVAKKIEKMDHVYKVTYGKEEVSRLFKVVGVSRNIGIALIIGLVFTAMFLISNTIKITIFARRKEIEIMKLVGATNWFIRWPFFLEGLLLGVFGSVIPIALVLSTYQYVIGWVVPKVQGSFVSLLPYNPFVFQVSLVLIAIGAVIGVWGSLTSIRKFLRV

SEQ ID NO: 21572 - DNA, 1008 bp, Pseudomonas aeruginosa
  CDS (1)..(1008)
atgagcgccaacgatcttccccgtggccccgaagagggcgcaccggaacgcaagacccgcgagaaaccgagccaggagcagaccgactggagcggctcgttcagcgcctacctggaaagccatcgcgccagcctggtggacagcctgcgccggttgttcggccacccgttcggcagcttcttcacctgcctggtgatgggtatcaccctgagcctgccgatgggcctctcgctgctgctgaacaatgtcgaacggctcggcggctcctggcagcgggcggcgcagatatccctgttcctcgacctgaagaccagcgaaaatcagggccaggacctgcgcgagcagatcgagcgcctgccggacgtgatcgaggcccaattgatcagccgcgagcaggcgctcagcgaattgcaggaacagtccggcctgggcgaagcgctcaaggagctgccggagaacccgctgccgccggtgatctcggtcacgcccaagcagatcgaccgggctggcctggaggcactgcgccagcagctcgcggagctgcctcatgtgcagcaggcgcagctcgacctggtatgggtcgagcgcctgagcgcgatcctcaagctcggcgaacgcttcgtcttcggcctgaccatcctgctggtgctgaccctcttgctggtggtgggcaacaccatccgcctgcacatcgaaaatcgccgtaacgaaatcgaggtgatcaagctggtcggcgggacggacggttacgtgcgccggccattcctgtacatgggcgcgttgtacggcctgggcgcgggcatcctgtcctgggcgctgctggcctattcgctgaactggctgaacggttcggtggtcaacctttcagggctgtacggcagcgacttcggcttgcagggcgtgccgctggacgacggcctgtcgctgaccgttggcgcggtgctgcttggctgggtcggcgcctggctggccgtggcccgccacctgcgcgagctggcgccgcgctga

SEQ ID NO: 21573 - protein, 335 aa, Pseudomonas aeruginosa
MSANDLPRGPEEGAPERKTREKPSQEQTDWSGSFSAYLESHRASLVDSLRRLFGHPFGSFFTCLVMGITLSLPMGLSLLLNNVERLGGSWQRAAQISLFLDLKTSENQGQDLREQIERLPDVIEAQLISREQALSELQEQSGLGEALKELPENPLPPVISVTPKQIDRAGLEALRQQLAELPHVQQAQLDLVWVERLSAILKLGERFVFGLTILLVLTLLLVVGNTIRLHIENRRNEIEVIKLVGGTDGYVRRPFLYMGALYGLGAGILSWALLAYSLNWLNGSVVNLSGLYGSDFGLQGVPLDDGLSLTVGAVLLGWVGAWLAVARHLRELAPR

SEQ ID NO: 21574 - DNA, 894 bp, Caulobacter crescentus
  CDS (1)..(894)
atgagcgagttctttcaggtctctcgctggaagccgggccccttgctgccgccgcgcgacgcccgtgacggggcgctggtgttcgtggtcgcggtgctgtgcttcctggcgtgtctgacggccttcgccgccctggcggccaatcgcgccgcgcacggctggacggcgcagctgagcggctcggcgaccgtggtggtccgggcgcgcagcaatgagacgcccgacagcgccgccgcccgcgccgccgagaccctggccggcgttcgcggcgtgatcgaggcccaggccttgccgcgcgagaaggccgaagcgttgctggcgccgtggatcggggccgaggccctggtcgacgacctgcccacgccgcgcctggtcacgcttgaactcgatccaaaggcgccgccgacggcgggcattctggaccgggcgctgcgggcggcgggggtcgacgccacggtcgacgaccacagccggtggatcgccgatatcgaacgcgccgccaacatcgcgcggttcgcggccctgggcgtgttcgccctgatcgcagcggccacggcggcggtgatcgccttcgccacgcgggcgggtctggcggcgcggcgcgatgtgattgaggtgctgcacttctcgggcgccgaagcgcgtttcatcgcgagcctgttccagaaccggttcgcgaccatgggggcgctggcggggttgctgggcggcgcggcggcggccatcattggcgcgctcgcgcgttacttcgccggcggcgtaggcgtcgcaccggttctgccgctggcctggattgacctgctggccgccctgcccgcgccggtgctggcggccttgatcgccggcgtctcggcccgcctggcggcgtcgcgcatcgtgagggagatgccgtga

SEQ ID NO: 21575 - protein, 297 aa, Caulobacter crescentus
MSEFFQVSRWKPGPLLPPRDARDGALVFVVAVLCFLACLTAFAALAANRAAHGWTAQLSGSATVVVRARSNETPDSAAARAAETLAGVRGVIEAQALPREKAEALLAPWIGAEALVDDLPTPRLVTLELDPKAPPTAGILDRALRAAGVDATVDDHSRWIADIERAANIARFAALGVFALIAAATAAVIAFATRAGLAARRDVIEVLHFSGAEARFIASLFQNRFATMGALAGLLGGAAAAIIGALARYFAGGVGVAPVLPLAWIDLLAALPAPVLAALIAGVSARLAASRIVREMP

SEQ ID NO: 21576 - DNA, 933 bp, Haemophilus influenzae
  CDS (1)..(933)
atgagccgatcaacggatgcatctgtttttgttcaaacagcctatactttgcgtgcagtatgggcggatttgtggcaacgtaaatttggcacgctgctcacgattttagtgattgccgtttcgcttacgatcccgactgtgagctatttaatgtggaaaaatttgcatttagccaccactcaattttatcctgaaagtgaattgactatttatcttcataaaaatttaagtgaggaaaacgcaaatttagtggtagagaaaatccgtcagcaaaaaggcgtggaatcactgaattatgtctctcgtcaagaaagtttaaaagaattcaaaagttggtctggctttggtgaagaattggaaattttagatgataatccattgcctgcggtcgttatagtaaaaccgacgagcgaatttaatgtttcagaaaaacgtgacgaattacgaaccaatttaaataaaattaaaggcgtgcaagaagttcgcttagataacgattggatggaaaaattgaccgcactttcttggttaatcgcccatgtggcaattttctgcactgtattaatgacgatagcggtatttttagttattggtaacagtattcgctctgatgtgtatagtagccgatcaagtattgatgtgatgaaattgcttggtgcaacagatcaatttatccttcgtccttatctttatacagggatgatttatgccctgttaggtgggttagttgcagcaatttttagtagctttattatcagctattttacttctgcggtgaaatatgtaacggatatttttgccgtccaattcagtttgaatggattaggcgttggcgaatttgtattcttattagtgtgctgtttaattatgggctatgttggggcgtggattgccgcgacaaggcatattgcgatgatggagaggaaagaataa

SEQ ID NO: 21577 - protein, 310 aa, Haemophilus influenzae
MSRSTDASVFVQTAYTLRAVWADLWQRKFGTLLTILVIAVSLTIPTVSYLMWKNLHLATTQFYPESELTIYLHKNLSEENANLVVEKIRQQKGVESLNYVSRQESLKEFKSWSGFGEELEILDDNPLPAVVIVKPTSEFNVSEKRDELRTNLNKIKGVQEVRLDNDWMEKLTALSWLIAHVAIFCTVLMTIAVFLVIGNSIRSDVYSSRSSIDVMKLLGATDQFILRPYLYTGMIYALLGGLVAAIFSSFIISYFTSAVKYVTDIFAVQFSLNGLGVGEFVFLLVCCLIMGYVGAWIAATRHIAMMERKE

SEQ ID NO: 21578 - DNA, 1026 bp, Pseudomonas putida
  CDS (1)..(1026)
atgagcactacacgtacgccgaaggtttccgagcgggttgcaccaaagcccgctgacccgcaaccggcgaagaaaaaacgcggcgaagacgatgatggcccggatttccgcacgctgttgcatgcctggctggaaagccaccgtgccagcatggccgacagcctgcgccgcttgggcaagcaaccgattggcagctttttcacctgcctggtgatggcggtggcgctgagcatgcccatgggcctgtcgttgctgctgaagaacatcgagcagctcggcggctcgtggcagcgcgccgcgcagatttcgctgttcctcaagctggatgccggcagccgtgatggtgaggcgctgcgggatgagatcaagggcatgcccggcgtggcggacgcgcaatatgtcagccgcgagcaggcgctggaggaattccagcagcagtccggcttgggcgaggccctgcgtgaactgcccgacaacccgttgcctggcgtggtggttgtgaccccgaccgaggtcgacaaaccggccctggaagcgttgcgtcagcgtctgtcggagctgccacgggttgaagtggcgcagctggacctggtgtgggtcgagcgcctggcggccattctcaagctgggtgaccgtttcgtcttcggcttggccgtgatgctgatttctgccctgctgttagtaatcggtaacacaattcgtctacacattgaaaaccgccggatcgagatcgaagtgatcaagctggtcggcggcaccgacgcctacgtacgccggcctttcctgtacatgggtgccctctatggcctgggtgcgggcctgttggcgtggggcatcctggcgtttggcctgaactggctgaacgaggcggttgtagggctttccgggctgtatggcagtgatttcgccctggggggggtgccggcgtccgatggtctgtccctcttgatcggagcagtgttgttggggtatatcggtgcatggatcgcagtcgctcgtcacctgaacgagctggcgccgcgatag

SEQ ID NO: 21579 - protein, 341 aa, Pseudomonas putida
MSTTRTPKVSERVAPKPADPQPAKKKRGEDDDGPDFRTLLHAWLESHRASMADSLRRLGKQPIGSFFTCLVMAVALSMPMGLSLLLKNIEQLGGSWQRAAQISLFLKLDAGSRDGEALRDEIKGMPGVADAQYVSREQALEEFQQQSGLGEALRELPDNPLPGVVVVTPTEVDKPALEALRQRLSELPRVEVAQLDLVWVERLAAILKLGDRFVFGLAVMLISALLLVIGNTIRLHIENRRIEIEVIKLVGGTDAYVRRPFLYMGALYGLGAGLLAWGILAFGLNWLNEAVVGLSGLYGSDFALGGVPASDGLSLLIGAVLLGYIGAWIAVARHLNELAPR

SEQ ID NO: 21580 - DNA, 969 bp, Erwinia carotovora subsp
  CDS (1)..(969)
atggcaaataacgtccgtaatgcgaaaaagcctgtcgcaaaagcgaaagcactgcgcggcggttggcaggaacaatggcgctatgcctggacaaatacgctggctgatatgctgcgccagccgctggccacctttctgaccgtgatggttatcgctatctcgctggcgctgcccagcatctgctatctggtgtggaaaaacgtcagtcaggctgcaacacagtggtatccatcgcctcaactgacggtgtatctggataaatcgctggatgacaacgcggcgcaggcggttatcacgcagcttcaatctgaagatggcgtcgataaagttaattacctgtcgcgcaatgaggcgatgggcgaattccgcaactggtccggttttggcggcgcgctggatatgctggaagaaaacccgttacccgcggtggcaatcattacgccaaaaatgagttttcaggattccaccacgctgacaacgttgcgcgatcgcgtggcatcgacgcagggcgttgatgaagttcgaatggacgacagctggtttgctcgtctggtggcgctaactaatctggttgggcaaatttccgccatgattggcgtcctgatggttgttgctgtctttttggtgatcggcaacagcgtgcgtctgagtattttcagtcgccgtgaaaccatcaacgtgatgaagttgattggtgcgacggacggctttattctgcgtccgttcctgaatggcggagctgcaatgggcgtgggcggggcggtgctgtcgctgattttatcgcaggcgctggtctggaagctggatgctgtggtggcacaggttgctgctgttttcggtacgacgtttgccgtcaaagggttgagctgggacgagtccctgctgctactgctcatcgctggcatgattggctggcttgccgcctggctggcaacagtgcaacatttacgccgttttacaccacagtaa

SEQ ID NO: 21581 - protein, 322 aa, Erwinia carotovora subsp
MANNVRNAKKPVAKAKALRGGWQEQWRYAWTNTLADMLRQPLATFLTVMVIAISLALPSICYLVWKNVSQAATQWYPSPQLTVYLDKSLDDNAAQAVITQLQSEDGVDKVNYLSRNEAMGEFRNWSGFGGALDMLEENPLPAVAIITPKMSFQDSTTLTTLRDRVASTQGVDEVRMDDSWFARLVALTNLVGQISAMIGVLMVVAVFLVIGNSVRLSIFSRRETINVMKLIGATDGFILRPFLNGGAAMGVGGAVLSLILSQALVWKLDAVVAQVAAVFGTTFAVKGLSWDESLLLLLIAGMIGWLAAWLATVQHLRRFTPQ

SEQ ID NO: 21582 - DNA, 933 bp, Photobacterium profundum
  CDS (1)..(933)
atgcccgtggcgcgtaaacaaactggcttttttgcgattcataagcagcagtgctttgaagcactgaatgatctttttaagcgtccgttaggtaatattttaacactcgcggtcttagcgtttgccttaacgttaccttcaacgttttatttattagcaaaaaacgtcaccttggtggcacaggcttggcaaaacccgacacaacttacgttgtatttagataataatgcttcagagcaagtcggtgctgatttttctgagcagctacaatcgtggtctgaaatcgaagcggtcacgtatatttcacccgatcaaggccttgaagatttcagagagcatgcaggttttgagcaagcactcagtttactggatgagaatccattacctgctgtcattattgtgcgcccagcacctgattggcaaaataatgaacaagcagcacaactcgccactaaaattcgcactgagcctacggttgatgaagtgcgattagacagtgactggctacaacggttagctgcgattcaggatctatctgttaccttggcgttactgatgtctgggttaatgctgtttgcggtctttttaattgtgggaaacaccctacgtcttcaagtgttgaatcagaaagatagaattcaagtgatgaagatggtgggagcgacagatagctttattctgcgaccttatttatatgtaggtgtttggttcggtttaattggggccgttattgcgtgggtgctaacgacaattgtgactatacttcttgacagtgccgttgaaaaactcgcgatgttatacgacagtaattttcgtttagtgggtttaagttgggatgaaagcctgattttaatgatgactgcggccttccttggattgcttgctgctcgcttctctgcggggcgtcatttgaaagaaattgaacctatctaa

SEQ ID NO: 21583 - protein, 310 aa, Photobacterium profundum
MPVARKQTGFFAIHKQQCFEALNDLFKRPLGNILTLAVLAFALTLPSTFYLLAKNVTLVAQAWQNPTQLTLYLDNNASEQVGADFSEQLQSWSEIEAVTYISPDQGLEDFREHAGFEQALSLLDENPLPAVIIVRPAPDWQNNEQAAQLATKIRTEPTVDEVRLDSDWLQRLAAIQDLSVTLALLMSGLMLFAVFLIVGNTLRLQVLNQKDRIQVMKMVGATDSFILRPYLYVGVWFGLIGAVIAWVLTTIVTILLDSAVEKLAMLYDSNFRLVGLSWDESLILMMTAAFLGLLAARFSAGRHLKEIEPI

SEQ ID NO: 21584 - DNA, 753 bp, Bdellovibrio bacteriovorus
  CDS (1)..(753)
atgacggtttatctttctcaggatctgtccgagaaaggccgtcaggacattgaaagcaaaatcaaagaaaatgagaatgtggccgccgtgaagttcgtcacgcaagagcaggctttgggggattttcgcacccagatggccagttatgctccggatatcactcaggatgaggaactgctgcgtctgatcccggccagcctcctggttcaattaaaatccaatgtggctgcggccgagcagaccgctgttttacaaaacatggccggaaagcttcgtcagctcgagggcgtggacgaagtcagttatggccaggactgggttgaaaagtatgcggcattggtcaacgccattgaactgacgttgcgggctttgtgcgtggtgattctgatggcgtccctttttgtgatgtccaatgcgatccgcgcttccgtagcggcaagaaaagatgagattgtggtcctggagatgatcggggccactccgtccatgatccgtaagcccttccttgttgaaggagcggtactgggggtggtttcctccgttttatcattgggtctttgctttgccgtttatatcggtatcaaaaatttactgacgacgaaactgagctttctgcaactgggggagcacattcagttccttggcccgttgttgctggtgactttcgttgtcgccggcacaggtctgggggccttgggttcttatctgtgtgtgcgccgtatgaatgacggctttgccggaagtcaggggtag

SEQ ID NO: 21585 - protein, 250 aa, Bdellovibrio bacteriovorus
MTVYLSQDLSEKGRQDIESKIKENENVAAVKFVTQEQALGDFRTQMASYAPDITQDEELLRLIPASLLVQLKSNVAAAEQTAVLQNMAGKLRQLEGVDEVSYGQDWVEKYAALVNAIELTLRALCVVILMASLFVMSNAIRASVAARKDEIVVLEMIGATPSMIRKPFLVEGAVLGVVSSVLSLGLCFAVYIGIKNLLTTKLSFLQLGEHIQFLGPLLLVTFVVAGTGLGALGSYLCVRRMNDGFAGSQG

SEQ ID NO: 21586 - DNA, 903 bp, Corynebacterium diphtheriae
  CDS (1)..(903)
atgaaacttggatttgtattccgtgaagcgttccgaggcctcggccgaaacatcacgatgaccattgcgttgatcatcaccaccgcgatttcgctcgcgctgctggcaaccggctttttggttaccaacatgaccaaagaaaccaaagatatctaccttgaccgtgtggaggtcatggttcagctcaacgagaatatctccgctaatgacaaggattgttcaagtcaagcgtgccgtgacgtgcgagataagctcgatggtgccgatggtattgagacagtaacctatcgttcccgtcaacagtcttatgaccgtttcgttgaagttttcaaagacaccgacccccaactggtcgcagaaacttcacctgacgcgcttcctgcggcactccacgttcgtctcgaagaccccctagacacaaagcctcttgaccaggttcgcgacatggaacaggtagataccatcgtcgaccaagtcgatgaccttcgcggtgctactgacaatctcgacgcgatcagaaactccaccttcattttcgctgcaatccaagcgattgccgccatcttcctgatcgtcaacatggtccagatcgccgcatttaatcgtcgtgaagaaatctccatcatgcgcatggtgggtgcttcccgctggtacacccaagccccctttgtaatcgaagcaatggtggcagcactgttcggcgcaatcttgtctggccttgcgcttttcggtggcaaggtgtgggtggttgataagactctcaaaggcctttacgattcacagctcatcgcacgagtaagcaatgccgatatttgggcagtagctcccgtcgttgcagtcattggcattatctttgcagctatcactgctcaggcaacattacggtggtacgtgcgtaagtaa

SEQ ID NO: 21587 - protein, 300 aa, Corynebacterium diphtheriae
MKLGFVFREAFRGLGRNITMTIALIITTAISLALLATGFLVTNMTKETKDIYLDRVEVMVQLNENISANDKDCSSQACRDVRDKLDGADGIETVTYRSRQQSYDRFVEVFKDTDPQLVAETSPDALPAALHVRLEDPLDTKPLDQVRDMEQVDTIVDQVDDLRGATDNLDAIRNSTFIFAAIQAIAAIFLIVNMVQIAAFNRREEISIMRMVGASRWYTQAPFVIEAMVAALFGAILSGLALFGGKVWVVDKTLKGLYDSQLIARVSNADIWAVAPVVAVIGIIFAAITAQATLRWYVRK

SEQ ID NO: 21588 - DNA, 855 bp, Thermus thermophilus
  CDS (1)..(855)
atgtacgccatccgcgaggggctaaagcaggttttccgccaccccacggcaagcctcgccaccttcttcaccgccctggtctccttcaccctgctctacttcctggggctcctcctctggaacctggagcgggtggtccagaccatggagcgggagctggaggtggccgccttcctcggccccaaggcggacgtggaaggccttctcgccgagatccaggagtggcccgaggtggcctccgcccggctccagaccaaggaggaggccctggcccagctggtcctggactacccctacctggcggaggccaaggatctggtggaaaaccccctgcccgacaccctgcgcctgcggcttagggaacccgaggcggtgcggcgggtggcggagcgcctcgcccgcctccccggggtggagggggtggagtacgggggagagatcacggaaaggctcgtccagctcctccagggtagccgcgtggccatgctggtcctcgtggggcttctcctcctcaacaccttcttcagcgtcatgggctccatccgcctctcggtggagagccggcgggaggccctgggcatcatgctcctcgtgggcgccacccggcggttcatccaggcccccttcgtcgtggagggaacgctcctcaccttgggagcggggcttctcgccgtggccgtgggggccttcctctaccgggccctggcccaggcggtccagaccctcctgcccttcgtccccgtcctctcccccgaggacctggggcggacggcgggcctcgtcctcctcctggccctcgtcctgggcgcaggcggggcttttgccgcaagccgggcccacctgcgggaggtgtga

SEQ ID NO: 21589 - protein, 284 aa, Thermus thermophilus
MYAIREGLKQVFRHPTASLATFFTALVSFTLLYFLGLLLWNLERVVQTMERELEVAAFLGPKADVEGLLAEIQEWPEVASARLQTKEEALAQLVLDYPYLAEAKDLVENPLPDTLRLRLREPEAVRRVAERLARLPGVEGVEYGGEITERLVQLLQGSRVAMLVLVGLLLLNTFFSVMGSIRLSVESRREALGIMLLVGATRRFIQAPFVVEGTLLTLGAGLLAVAVGAFLYRALAQAVQTLLPFVPVLSPEDLGRTAGLVLLLALVLGAGGAFAASRAHLREV

SEQ ID NO: 21590 - DNA, 894 bp, Bacillus cereus
  CDS (1)..(894)
atgaaggctaagacccttagtcgacatttgcgagaaggtgtaaagaatctatcacgtaacggatggatgacgtttgcttctgttagtgcagtaacagttacattattacttgtaggtgtctttttaacagcgattatgaatatgaaccattttgcgacgaaagtagagcaagatgtagaaattcgtgtacacattgatccagcagcaaaagaagctgatcaaaagaaattagaagatgatatgagtaagattgcaaaagtagactctattaaatattcttctaaagaagaagagttaaaacgtttaattaaaagcttaggcgatagcggaaagacatttgagttatttgaacaagataacccacttaaaaacgtattcgttgtaaaagcaaaagaaccaacagatacagcaacaattgcgaaaaagattgaaaaaatgcagtttgtaagtaatgttcagtacggaaaagggcaagttgaacgattatttgatactgtaaaaactggtcgtaacatcgggattgtgttaattgctggtcttttattcacagcgatgttcttaatctctaatacaattaaaattacaatttatgctcgtagtacagaaatcgaaattatgaaacttgtaggtgcaacaaactggtttattcgttggccgttcttattagagggattattcctaggagtattaggatcaattattccaattggcttaattctagttacgtataattcgttgcaaggtgtgtttaacgaaaaacttggcggaacaattttcgaacttctaccatacagcccattcgtattccaattagctggtttactagtgttaatcggggctttaatcggtatgtggggaagtgtaatgtcaattcgtcgcttcttaaaagtataa

SEQ ID NO: 21591 - protein, 297 aa, Bacillus cereus
MKAKTLSRHLREGVKNLSRNGWMTFASVSAVTVTLLLVGVFLTAIMNMNHFATKVEQDVEIRVHIDPAAKEADQKKLEDDMSKIAKVDSIKYSSKEEELKRLIKSLGDSGKTFELFEQDNPLKNVFVVKAKEPTDTATIAKKIEKMQFVSNVQYGKGQVERLFDTVKTGRNIGIVLIAGLLFTAMFLISNTIKITIYARSTEIEIMKLVGATNWFIRWPFLLEGLFLGVLGSIIPIGLILVTYNSLQGVFNEKLGGTIFELLPYSPFVFQLAGLLVLIGALIGMWGSVMSIRRFLKV

SEQ ID NO: 21592 - DNA, 951 bp, Geobacter sulfurreducens
  CDS (1)..(951)
atgtcccgaaacaagaactctaagcggcccaccctttccggcgatgctcccggggggcggctcggctattttctcggcagggcgatcctcaatcttcgtcagaatgtcatggtgaacgtgttgacaatcggcaccatatcgctggctctgcttatcgtctcactgtttctgctggtgttcgtaaacctcgagtcaactgccgaggagtggagcggcaagatccaggttaccgcctatttcgaccaggaactgcccccccaggagctaaaccagctcatgaatcgcatcaaagcgattgaagggacttcacgcgtttcctacgtgaataagaacgaggcgatgaagcggttcagatccagactgaaggggcaggaaaccctcctggacggcgtacctgccgacgtgttgcctgcttcggtggagattgcccttaaacggtccagccgccaggaaggtgcaattgaacactacgttgcccagcttaaaaaggtccccggaatcaatgaggtgcaatatggggaagaatgggtccgccgtttcaatgcctttatgaattttctccgttttctcggagcgcttttaggggcgttccttgtgctggcggtactgttcatcgtttccaatacgatcagacttaccatctacgcccggaaggatgaactggaggttatggaactggtaggtgccacgcggttttttatcaaggcgccgtttctcgtggaagggatgattcagggcgctgccggttcaatttgcacacttatcattcttgttgccgcctactttggcttcttgcacggtgtacctaactttatccccatatcaggtacctttaccgggttctctttcctgcccccggtacatattgccggtattttcatcggcggcatcgtgctcgggcttcttggcagtctcacctcgctcaggcgtttcagcgacaatcagtcatga

SEQ ID NO: 21593 - protein, 316 aa, Geobacter sulfurreducens
MSRNKNSKRPTLSGDAPGGRLGYFLGRAILNLRQNVMVNVLTIGTISLALLIVSLFLLVFVNLESTAEEWSGKIQVTAYFDQELPPQELNQLMNRIKAIEGTSRVSYVNKNEAMKRFRSRLKGQETLLDGVPADVLPASVEIALKRSSRQEGAIEHYVAQLKKVPGINEVQYGEEWVRRFNAFMNFLRFLGALLGAFLVLAVLFIVSNTIRLTIYARKDELEVMELVGATRFFIKAPFLVEGMIQGAAGSICTLIILVAAYFGFLHGVPNFIPISGTFTGFSFLPPVHIAGIFIGGIVLGLLGSLTSLRRFSDNQS

SEQ ID NO: 21594 - DNA, 969 bp, Vibrio vulnificus
  CDS (1)..(969)
atggccgcgaataaacgccttaaaaagccagcgagcaaatcgacctcgaatcgccctaagacagacggttttgtttcgattcatatcaagcaagccaaagcctccttcaaagcgatctggcatcgcccgctggggaatattttaaccttagcggtcatctccatggcattagccatgccggcctgtttgtatttgcttggtaaaaacatcgccgttgccacctcgcatgtcacgtcgccagcacaagtgagtgcctacttgcgtgaaggagtaccagaagctcgagtcatggtgctcaaagatgagttggaaacgcagcaagatgttgaattggtggagtacatctctccgcagcaaggcttagagcatctcagccagtattccggttttgaccaagcgttaagcttactggaagattatgccctaccgggcgtcttggtgatcaccccagcggtggaagagaacaacgctatcaaagcgttggcgcaacaactgcgtcaagaagaagacattactgatgtgcgtctagacgaagattggttaacacggttagatgcaataaaaacggtcgcgacaattattgtcatgaccttgacactgttaatgttgggtgctgtatttttaatcgttggcaataccttgcgctttaatgtgctcgccaacaaagaagaaattcaaaccatgaaactcattggtgcgacagacaactttattctgcgcccctacttatattcaggaatgtggtttggtttactcggcgcggtatcagcgtggtgttttaccgcgctgattacggtgttgttgaatggtgccgttgcggatctcgcggctttatacgacagccaatttcgtcttattggcctaagctgggatgaatccttgttgcttgtgatgacaggaaccttcttaggttgtgtggcagcaaaagtatcggcgcagcgccatttaaaagaaattgaacctgtttaa

SEQ ID NO: 21595 - protein, 322 aa, Vibrio vulnificus
MAANKRLKKPASKSTSNRPKTDGFVSIHIKQAKASFKAIWHRPLGNILTLAVISMALAMPACLYLLGKNIAVATSHVTSPAQVSAYLREGVPEARVMVLKDELETQQDVELVEYISPQQGLEHLSQYSGFDQALSLLEDYALPGVLVITPAVEENNAIKALAQQLRQEEDITDVRLDEDWLTRLDAIKTVATIIVMTLTLLMLGAVFLIVGNTLRFNVLANKEEIQTMKLIGATDNFILRPYLYSGMWFGLLGAVSAWCFTALITVLLNGAVADLAALYDSQFRLIGLSWDESLLLVMTGTFLGCVAAKVSAQRHLKEIEPV

SEQ ID NO: 21596 - DNA, 888 bp, Porphyromonas gingivalis
  CDS (1)..(888)
atgtcacaaaagaacaagaagcggtcttctgcctttttccattcaaggtttttggccattatgagtattgccgttgtcctcttccttctggggactatcggcatcattgagtttgtcggcagaggaataggcaattccgtgagagaagacctctccttcaatctgctcttatcctccgacatggatgaaacgcaggcacaagagctacagcgacagatagcggccacacccttcgtcaaagatgtcagctatatctctgccgatcaagccctcgaagagatgaaaaaagaattgggcgaagacgatccggccaagatgctcggctataatcccctgcaagcggaaatgtgcgttcacctcaaagcccaatacacccatccggacagtctgaaaaccatagactctgccatccgcacatggaatggagtggacaatctggaatacagggcggatatgttcgacatagtacaccgcaatacacgccgtatcggtctcgttctgctcgctctatcagccttgctccttctgatcagctacatacagatcaacaacaccacccgtttgttgatctattcgaagcgattcagcatccgtaccatgacgctggtgggtgccacgcctcgctttatccgtaagcctttcgttcgctacagtatgctcaatggactcgtggcagctttgctcgccatactactcctcggtatagccctctatgcaactgatgaatacgcattcaacaggagtttacgccccttcttaacgatggaaaacctcctgaccatagccgaaggcatgttacttgtaggtatactgatctctgccttttcggcacgtgctgcaacgaacaaatatatccgcatggatggaggcaaaatgcacctcgtataa

SEQ ID NO: 21597 - protein, 295 aa, Porphyromonas gingivalis
MSQKNKKRSSAFFHSRFLAIMSIAVVLFLLGTIGIIEFVGRGIGNSVREDLSFNLLLSSDMDETQAQELQRQIAATPFVKDVSYISADQALEEMKKELGEDDPAKMLGYNPLQAEMCVHLKAQYTHPDSLKTIDSAIRTWNGVDNLEYRADMFDIVHRNTRRIGLVLLALSALLLLISYIQINNTTRLLIYSKRFSIRTMTLVGATPRFIRKPFVRYSMLNGLVAALLAILLLGIALYATDEYAFNRSLRPFLTMENLLTIAEGMLLVGILISAFSARAATNKYIRMDGGKMHLV

SEQ ID NO: 21598 - DNA, 975 bp, Photorhabdus luminescens
  CDS (1)..(975)
atggttaaaaatgtgcgtaaggcagcggggaaagtaacacgatcgagaagtaaagttttacaaggaggatggcgtgagcagtggcgctatgcttggatgaatacgttgacagatatgtcacgtcagccgttggcaactttgttgaccgtgatggtgattgctatctccctgacattaccaagtgtttgttacattgtgtggaagaatgtcagccaggctgcggaaaaatggtatcccacccctcaactgacggtatatctcgataaatcactggatgatagcagtgcgcagaaattaataagtgagttgaaagcgcttgatggtgtggacaatgtcaactatctctcacgtcaggaagcaatgacagaattccgcgcttggtctggctttggtggcgcgttggatatgttggaagagaatccgttgcccgcggtggctattatcacaccgaaaatcgattttcagagttcacagacgctgaccacgctgcgtgatagagtttctcaggttaaaggtattgaagaagttcggatggatgatagctggtttgcccgtctggcggcgctgactggtcttatcggtcagattgtgacagtaatcggtattttgatgatcgttgcgctgtttttggtcatcggtaatagtgtgcgtctcagtattttcagtcatcgtgatacgattaacgtgatgaagcttattggtgcaacggatggctttattttgcgcccgttcctcaatggtggtgtgttgctaggggctttgggggcaattttatcgttaattttatctgcactattggtgtggaaactttctgatgttgtaacagaggttgccagcgtgtttggtacgacatttaatttacatgggctttcatgggatgagtccctgctattagttttgctctctgcaatgattggttgggtcgctgcttggttggcgacaactcagcatttgcgtcattttacgccagaataa

SEQ ID NO: 21599 - protein, 324 aa, Photorhabdus luminescens
MVKNVRKAAGKVTRSRSKVLQGGWREQWRYAWMNTLTDMSRQPLATLLTVMVIAISLTLPSVCYIVWKNVSQAAEKWYPTPQLTVYLDKSLDDSSAQKLISELKALDGVDNVNYLSRQEAMTEFRAWSGFGGALDMLEENPLPAVAIITPKIDFQSSQTLTTLRDRVSQVKGIEEVRMDDSWFARLAALTGLIGQIVTVIGILMIVALFLVIGNSVRLSIFSHRDTINVMKLIGATDGFILRPFLNGGVLLGALGAILSLILSALLVWKLSDVVTEVASVFGTTFNLHGLSWDESLLLVLLSAMIGWVAAWLATTQHLRHFTPE

SEQ ID NO: 21600 - DNA, 882 bp, Gloeobacter violaceus
  CDS (1)..(882)
atgattcaacgcgtcacaacccaggtagactatctgttgcgcgaggcgtttaccggcctgcggcgcaacctctggatgatctggtccgccgtgagcaccctggctgtgctgctgtttttgttggggctgggactgcgggcttcctggcagttgcaggacgcggtctccgatctgggcagccgcctggaaatctcgatttacttggatcccggtgtgcgtgccgctgctgtggagccggatttgcgcacgctggtgggtgtcgacgaaattaaaagcgtctcaaaggaacaggcctgggcggccctgaaaaaagacctcggagtgcgaagcgatccgggcgaaagcctggggggcaacccgctggtcgacagcctgcgggtgcgcatcgcccagccggaggcggtggcgcccctggccgcccagatccagcagatcgaaggggtggaggaggtgagctacggctcggaggcggcccagaggctcgatcagatccagcaggcgatgcgctgggtgggactggccctcaccgccgttctcggggtggcgaccgtggcggtgatcacttcgaccatccggctcatcgtccagtcgcggcgcaaagaaatcgaagtgatgcagttggtgggggccacccccctgcgcatttcgatgccgttcatcctcgaagggctcgcctttggaattgccggggcgctgatcgcctgggggttgatcgaagccaccagccgtgttgtcgcccaaaaacagctcgaattgctgccgtttttgcaatggcagccctcggagcccgctgccttcaccctaccgctcatcttacttggtgtgggcgtcgccctcggcatgctcggcagtctgatcgccgtgcgtcgggctatccgttga

SEQ ID NO: 21601 - protein, 293 aa, Gloeobacter violaceus
MIQRVTTQVDYLLREAFTGLRRNLWMIWSAVSTLAVLLFLLGLGLRASWQLQDAVSDLGSRLEISIYLDPGVRAAAVEPDLRTLVGVDEIKSVSKEQAWAALKKDLGVRSDPGESLGGNPLVDSLRVRIAQPEAVAPLAAQIQQIEGVEEVSYGSEAAQRLDQIQQAMRWVGLALTAVLGVATVAVITSTIRLIVQSRRKEIEVMQLVGATPLRISMPFILEGLAFGIAGALIAWGLIEATSRVVAQKQLELLPFLQWQPSEPAAFTLPLILLGVGVALGMLGSLIAVRRAIR

SEQ ID NO: 21602 - DNA, 909 bp, Chromobacterium violaceum
  CDS (1)..(909)
atgaaacactttctctatctgaactggcaaagcgccaagcaggcgctggccaagatcgtccgccagccgttcggcagcctgctgaccctgctgatgctggcgctggcgctggcgctgcccttgtcgctgtatctcgccgtcagcagcgtgcaggagtgggtgggccgcctcaccgccacgccgcagatcacgctgttcatggaacaggccgccgagcaggccgacatcgccgcggtcaacagcaccctgtcgcaccatcccaaggtgaagagcttcactttcgtcagcaagggccaggcgctgcaggatctggaaaagcgcaacggcctgaccggcctgtccgacgggctggacgccaatccgctgccggacgccttcgtggtgacgccgaaatcgctggagccgcgcgagctggacatgctgcagaaggagttgtccggcctgccgatggtggagctggcgcaattcgacgccagctgggccaaacgcctgtacggcatggtggagatgggcaagaagctgacctggttcctggccgccgcgctgggcctggcgctggtgctggtcacccacaacgcgatccggatgcagatcctggcgcgccaggacgagatcgaggtctccaaactgatcggcgccaccgacagcttcatccgccgccccttcatgtaccacgcgctgtggcagggcgtgctggcggcgctgctggcctggggcctctccagctggctggcggcgatggccaacccggccatccgcgagttcgcgatgctttacggcgagcgggtggagctgcgcgcgctgaacctgcccgagctggccgcgctgatcggcgtttccgccgcgctggcgatgctgggcgcccgcctcgcggccgaccatcatctgcgcaaggtggaaccgaaataa

SEQ ID NO: 21603 - protein, 302 aa, Chromobacterium violaceum
MKHFLYLNWQSAKQALAKIVRQPFGSLLTLLMLALALALPLSLYLAVSSVQEWVGRLTATPQITLFMEQAAEQADIAAVNSTLSHHPKVKSFTFVSKGQALQDLEKRNGLTGLSDGLDANPLPDAFVVTPKSLEPRELDMLQKELSGLPMVELAQFDASWAKRLYGMVEMGKKLTWFLAAALGLALVLVTHNAIRMQILARQDEIEVSKLIGATDSFIRRPFMYHALWQGVLAALLAWGLSSWLAAMANPAIREFAMLYGERVELRALNLPELAALIGVSAALAMLGARLAADHHLRKVEPK

SEQ ID NO: 21604 - DNA, 894 bp, Mycobacterium bovis
  CDS (1)..(894)
atgcgtttcggtttcctgctaaatgaggtcctgaccggctttcgtcgcaatgtcaccatgacgatcgcgatgatcctgacgaccgcgatctcggtcggattgttcggcggcggtatgttggtggtccggttggccgacagctcccgggccatctatctcgaccgggtggaatctcaggtctttctcaccgaagacgtttccgccaacgactcgtcctgcgataccactgcgtgcaaagcgttacgggagaagatcgaaacgcgatccgacgtcaaagcggtgcgtttccttaaccgccagcaggcctatgacgatgccatccgcaagtttccccagttcaaggacgtggcgggcaaggattcgttcccggcgtcgttcattgtcaagctggagaaccccgagcagcacaaggactttgacaccgctatgaaggggcagcccggcgtcttggacgtgctgaatcaaaaggagctgattgaccggctgttcgcggtccttgatggtttgagcagtgccgcgttcgcggtcgcgctggttcaggccatcggggcgattctgttgatcgccaacatggtccaagtggctgcctatacgcggcgcaccgaaatcggcatcatgcgcttggtcggtgccagccgctggtacacccagctgccgttcctagtggaggcgatgctggccgcgacgatgggtgtcggcatcgccgtagcgggcttgatggtggtgcgggctttgttcctggagaatgcgctcaaccagttttatcaagccaatctcattgccaaggttgactatgcggacatcctcttcatcacgccgtggctgctgctgttgggcgtggcgatgtcggggttgacggcttacttaacgctgcgcctctacgtgcggcgatag

SEQ ID NO: 21605 - protein, 297 aa, Mycobacterium bovis
MRFGFLLNEVLTGFRRNVTMTIAMILTTAISVGLFGGGMLVVRLADSSRAIYLDRVESQVFLTEDVSANDSSCDTTACKALREKIETRSDVKAVRFLNRQQAYDDAIRKFPQFKDVAGKDSFPASFIVKLENPEQHKDFDTAMKGQPGVLDVLNQKELIDRLFAVLDGLSSAAFAVALVQAIGAILLIANMVQVAAYTRRTEIGIMRLVGASRWYTQLPFLVEAMLAATMGVGIAVAGLMVVRALFLENALNQFYQANLIAKVDYADILFITPWLLLLGVAMSGLTAYLTLRLYVRR

SEQ ID NO: 21606 - DNA, 939 bp, Haemophilus ducreyi
  CDS (1)..(939)
atggttcgttcatttcatagccattttggcgcacaaacacgctacacgctacgtactgtctggcaagatctgatgcaacgtaaatttggcacctttctcacgatattagtgattgcggcctcactcactatgccgatagtaagctatttgttgtggaaaaatacccatcaagccgccagtgaattctatccagaacctgagctaaccatttatttacataaaaatttagcagaacatgacgtaaatgctgtggttgaacaaatccgccattttgatacggataaaatcgaatcactcaactatatttcccgacaacaaagtttagaagagtttcgttcttggtcaggttttggcgaagctttagatattattgatgataatcctttgcctgctgtcgttaccttaaaaccaaaatcgacttttacaaataatgattcaatgttagctttacgcaatggcttacaagcaattaaaggcgtgcaagaagttcgtttagataatgattggcttgccaaactaacttcattaacgtggttaattgcccgcattgcgattatctgcactattttaatgctcacttccgtttttttagtgattggcaatacggtgcggacggatgttgctaatagtaaagcctcaattgaagtacaacagttattaggtgctactgactactttattgctcgtgcttttctatgtaaagggatgctttatggtttagcaggcagtgctttggcggcgttattcagtaacttacttattaagtattttactggcgtagtcaaatatgtaacggatatttttactgtcaaatttgagttaaatggcctagtattcagtgagtttttcttcatcgtgactgtgtgtgtctttatggggtggctttctgcaaaactggcaacaaatcgttatatttatcggattggatccaaatattaa

SEQ ID NO: 21607 - protein, 312 aa, Haemophilus ducreyi
MVRSFHSHFGAQTRYTLRTVWQDLMQRKFGTFLTILVIAASLTMPIVSYLLWKNTHQAASEFYPEPELTIYLHKNLAEHDVNAVVEQIRHFDTDKIESLNYISRQQSLEEFRSWSGFGEALDIIDDNPLPAVVTLKPKSTFTNNDSMLALRNGLQAIKGVQEVRLDNDWLAKLTSLTWLIARIAIICTILMLTSVFLVIGNTVRTDVANSKASIEVQQLLGATDYFIARAFLCKGMLYGLAGSALAALFSNLLIKYFTGVVKYVTDIFTVKFELNGLVFSEFFFIVTVCVFMGWLSAKLATNRYIYRIGSKY

SEQ ID NO: 21608 - DNA, 909 bp, Bordetella pertussis
  CDS (1)..(909)
atgaaggcctggttgcgacaacaccgctacgcgctggcgatcaccctgcgccggctggcggcccagccgttctcgtcgctggccaacctgctggtcatggcgctggcgctggccctgccgctgctgggcagcgccatcctggtttcggtccagcccctggcgcgccaggtatcggtcacccccgagctgaccgtgttcatgcagacccaggcccccgccacggcggccggcgcggtggccgagcgcatcggccgcgactacgccagccagatcgccgcggtgcgggtggtgccgcgcgaccaggcgctggcggcgctgcgcgacaaccccgcctgggagcaggccctggccgtgctgcccggcaatccgctgcccgacgcggtggtggtgacgctggccgacggcgagaacctggccgggcgcgccggcgcgctggcgcaggactggggcaaatgggacggcgtggaccaggtgcaactggacagcgcctgggtgcagcggctggaagcgctgctgcgctttgcccgcatcgggctggcgttcctggcggcctgcgtggcggtggtagtgctggccaccgtgttcaataccgtgcgcatgcaggccatgacccagcgcgaggaaatcgccgtggcgcgcctggtgggagcgaccgagtccttcgtgcgccgcccgttcctgtaccagggcgccctgaccggcgccgtatcggccctgatcgccatcggcgcggcggccatggcgctgaccccgctcaacgatgcgctgctggggctggcgcgcagctatggggccgaattcgccctgcacctgcccggcctgccggtgctggccgtggccgtcatcgccgccggcgtgctgggcgcgctgtcggcgcgctggtcagtgacccgcagtacgcgcttttaa

SEQ ID NO: 21609 - protein, 302 aa, Bordetella pertussis
MKAWLRQHRYALAITLRRLAAQPFSSLANLLVMALALALPLLGSAILVSVQPLARQVSVTPELTVFMQTQAPATAAGAVAERIGRDYASQIAAVRVVPRDQALAALRDNPAWEQALAVLPGNPLPDAVVVTLADGENLAGRAGALAQDWGKWDGVDQVQLDSAWVQRLEALLRFARIGLAFLAACVAVVVLATVFNTVRMQAMTQREEIAVARLVGATESFVRRPFLYQGALTGAVSALIAIGAAAMALTPLNDALLGLARSYGAEFALHLPGLPVLAVAVIAAGVLGALSARWSVTRSTRF

SEQ ID NO: 21610 - DNA, 918 bp, Streptomyces avermitilis
  CDS (1)..(918)
atgcgcgcccagttcgttctgtcggagatcggtgtcggtctccgtcgcaatctgacgatgaccttcgcggtcgtcgtctcggtggccctctccctcgccctgttcggcggttcgctcctgatgagcgaccaggtgagcacgatgaagggctactggtacgacaaggtcaacgtctcgatcttcctctgcaacaagagcgacgcggagtccgaccccaactgtgccaagggggcggtcaccaccgagcagaagaagcagatcaagagcgacctcgacaagatgcccgtcgtcgagaaggtgacgcccgagtcggccgacgacgcgtacaagcactacaaggagcagttcggcgactccccgctggccagctcgctcaccccggaccagatgcaggagtccttccgcatcaagctgaaggaccccgagaagtaccaggtcatcgcgaccgccttcgacggccgtgacggtgtgcagtcggtgcaggaccagaagggcattctcgacaacctcttcggactgctgaacctgatgaaccgggcggcgctcgcgctgatggcgctcatgctgatcgtcgccctgctgctgatcgtcaacaccgtgcgcgtctcggcgttcagccgccgccgggagaccggcatcatgcggctcgtgggcgcctccggcttctacatccaggcgccgttcatcatggaggcggccgtcgcgggtctgatcggcggtggtgtggcctgcctcttcctggtcgtcggccgctacttcaccatcgaccacggcatggctctgtccgagaagctgaacctgatcaacttcgtgggctgggacgccgtgctgaccaagctgccgctgatcctcgccgcgagtgtgctgatgcccgggctcgccgcgttcttcgcgttgcgcaagtacttgaaggtgtga

SEQ ID NO: 21611 - protein, 305 aa, Streptomyces avermitilis
MRAQFVLSEIGVGLRRNLTMTFAVVVSVALSLALFGGSLLMSDQVSTMKGYWYDKVNVSIFLCNKSDAESDPNCAKGAVTTEQKKQIKSDLDKMPVVEKVTPESADDAYKHYKEQFGDSPLASSLTPDQMQESFRIKLKDPEKYQVIATAFDGRDGVQSVQDQKGILDNLFGLLNLMNRAALALMALMLIVALLLIVNTVRVSAFSRRRETGIMRLVGASGFYIQAPFIMEAAVAGLIGGGVACLFLVVGRYFTIDHGMALSEKLNLINFVGWDAVLTKLPLILAASVLMPGLAAFFALRKYLKV

SEQ ID NO: 21612 - DNA, 921 bp, Nitrosomonas europaea
  CDS (1)..(921)
atgagcaactggttatcccaacatggctatgcgctgatacgtgcactcaggcagcttgccggaacgccgatgaccagcttgctgagcatcatcgttttcagcatcgtcctgagtctgccggccggtatcttcatcctgctggaaaatttgcgcgcactatccgggcacgcaacggattcgcagcagatgaccctcatcctggatactgcggcgggttcggctgatgtggaactgatcaatacccgactggaggaaatgactgtaattgaaggtttccagttcatttcccgggaagtcgccctgcaggaattgcaacgggaaagcgggatggctgaggtaatgcgtaatctcgaacagaatccgctgccggatgcattcgtggtcaaccttggcagcctgtccgccggtgaaattgaaaaaatgcaggccatgatgcaagcctggcccaagatcgctcatgtactggtggataccgactgggccagaaaactggatgccatgctcgatgttggcaggctggtcgtcatcatgctgacatcagtatttggcacgacactcgtcatcgtcatgttcaacaccatccgcttgcagatactgacgcggcgcgatgaaatcgagctgtccaagctgattggtgctacggatagttatatccgtcgtccatttctttattttggcgcgatacaggggctggcaggtgctgcgctggcctggctgctgctttattttacaatcatcaaattgaatgaagctttgtccgaactggcccggttatatgccaccacgttcacactcgatcctctttcctggcaggacagcctgattctgatcttattctccggcacattggggtggattggggcgcgctggtcagtcgcccggcattttgcacaaatcgaccacgaaagtgccatttcctga

SEQ ID NO: 21613 - protein, 306 aa, Nitrosomonas europaea
MSNWLSQHGYALIRALRQLAGTPMTSLLSIIVFSIVLSLPAGIFILLENLRALSGHATDSQQMTLILDTAAGSADVELINTRLEEMTVIEGFQFISREVALQELQRESGMAEVMRNLEQNPLPDAFVVNLGSLSAGEIEKMQAMMQAWPKIAHVLVDTDWARKLDAMLDVGRLVVIMLTSVFGTTLVIVMFNTIRLQILTRRDEIELSKLIGATDSYIRRPFLYFGAIQGLAGAALAWLLLYFTIIKLNEALSELARLYATTFTLDPLSWQDSLILILFSGTLGWIGARWSVARHFAQIDHESAIS

SEQ ID NO: 21614 - DNA, 885 bp, Enterococcus faecalis
  CDS (1)..(885)
atgattagaacattcttttctcatttatttgaaagtatcaaaagtttaaaacggaacggttggatgactgttgcctcagcaagtgcggttacaattacattagttttagttggtatttttatgggcgttatttttaatgcaacgaaacttgctgatgatatcgaaaaaaacgtgacagtgtctgtctttgtcgatattggtacaaaacaaaatgaaatgaaaacattagaaaaacaacttaaaggattagacaatgttgaagatatttcttattcaaacaaagatcaacaattgaaaaaaatccaagaacaaatgggggatgcctggaatcttttcgaaggcgacagtaacccattatacgacgtgtattatgtccgtgcaaaaacaccagaagacacgaaagatattgcgaaacaagcagctaaattcccaagtgtttttaaagccgattacggtggtgtaaactcagacaaaatctttaaaatcgctcaaaccgttcgaacttggggcttagcagctgctgcattacttttattcgttgcagtgttcttaatttccaacactattcggattacgattttatctcgtcaaaaagaaatccaaattatgcgtcttgtaggagccaaaaacagtttcattcgttggccgttcttcttagaaggtgcttggattgggttgattggcgcaatcgtgccagtcattattatgacgttaggctaccatcaagtttataacatgttcaacccgcagttattgcgttcgaattattcattaattcgtccagaagattttatctggaaagtcaatctattaatgattgcaacaggaatgattattggatcactaggttcagttatttcaatgcgtcgtttcttgaaaatttaa

SEQ ID NO: 21615 - protein, 294 aa, Enterococcus faecalis
MIRTFFSHLFESIKSLKRNGWMTVASASAVTITLVLVGIFMGVIFNATKLADDIEKNVTVSVFVDIGTKQNEMKTLEKQLKGLDNVEDISYSNKDQQLKKIQEQMGDAWNLFEGDSNPLYDVYYVRAKTPEDTKDIAKQAAKFPSVFKADYGGVNSDKIFKIAQTVRTWGLAAAALLLFVAVFLISNTIRITILSRQKEIQIMRLVGAKNSFIRWPFFLEGAWIGLIGAIVPVIIMTLGYHQVYNMFNPQLLRSNYSLIRPEDFIWKVNLLMIATGMIIGSLGSVISMRRFLKI

SEQ ID NO: 21616 - DNA, 828 bp, Coxiella burnetii
  CDS (1)..(828)
atgacaatcgctgttattggagtggcaatggctttgccgacagggttttatttattcttacaaaatttccaaactttaagtaaaccatggaatggaaagcccactatttcactttacctcaaattaaatacgcccgatgcaaaaataaatcaactgatcacccaacttaaaaatcgcagcgatatttcaaacatccaatatacttccgcagaaaatgggcttagtgagttaaaaaaatcgatggtgttggatgatgttattaacaccctctcatccaatccgctaccgcccgtgctcaccattatccctactaaaaataatcccgccgcattacaacagttactattgaatttaaaaacctttccgctggttgacgtcgcgcaattagattttgcatgggtggaacgcttgcaccacttgattacgcttgggcaacgcataacggacactttagcaattctattaagcgtcggtgttattctcattatcggtaacactattcgcctcaccacggacaattatcggcaagaaattaccattctcaagctggtcggggcaacgctctctttcattcggcgcccgcttttatatcgcggttttttttacggcttcctaggcggctgcgtagcgtggtttttggtaagtattttactgttagaaaccgcctccccagcctcattgctagcggccacttacaattaccactatgttatccatggattaagcataaaaacgggagtttttattattttaatttctatcctcatggggctatgcggctcctggcttgccatttatcggcacttaaacgccgtagaacgtctttaa

SEQ ID NO: 21617 - protein, 275 aa, Coxiella burnetii
MTIAVIGVAMALPTGFYLFLQNFQTLSKPWNGKPTISLYLKLNTPDAKINQLITQLKNRSDISNIQYTSAENGLSELKKSMVLDDVINTLSSNPLPPVLTIIPTKNNPAALQQLLLNLKTFPLVDVAQLDFAWVERLHHLITLGQRITDTLAILLSVGVILIIGNTIRLTTDNYRQEITILKLVGATLSFIRRPLLYRGFFYGFLGGCVAWFLVSILLLETASPASLLAATYNYHYVIHGLSIKTGVFIILISILMGLCGSWLAIYRHLNAVERL

SEQ ID NO: 21618 - DNA, 912 bp, Tropheryma whipplei
  CDS (1)..(912)
atgtttacctttatcctcagcgagctgatccataatgtacgccgcagcgcatctatggtctcctctgtgattatcgtcacatttatatctctcacatttgtcggaacagccgctctcatgcagttacaaatcgtgcacatgaaaagcttctggtacgatcgcgcccaggttgccatttttctctgcaccgagcattcatctcaatcaacctgcagtgccggtaaggctaccgaagagcagaaagacagcgtgcgtcaacgtcttgattcctcggttataaagccactaattgaaaagtattattttgaaaatcatgagcaagcctacaaaaacttcaaagaacaattcaagaacaacaaaatcgtcgagctgacaacacccgaccagcttaacgaaactttttgggtcaagctgcacaacccttcccagtcgaccgttattatcgaagccttcaacgatataagtggggttgattcggttgtcgatcagaggcagtatctaaatcagattttttatattctaaatcttgccagcgtaacatccatctcaattgcggctgtaatgctgattgcggctgtaatgctgattgcaactacaatacgtctttctgcttttacaagacgcaaggaaatcgagattatgcgccttgttggtgccagtaatttctttgtccaggcaccattcgtccttgaggggatttttgccgcatcaatcggtgctctattgtcgagcattgcaatcgtgtctatcgcacaattctttattacggactatcttgctatcaagttacccgttgtctcatttttctctgttggtgattctttgataatcgttccgattatttttgggattgccattctcctttcgggattatctgcaaaattctcgatttctcgttcacttcgggtctaa

SEQ ID NO: 21619 - protein, 303 aa, Tropheryma whipplei
MFTFILSELIHNVRRSASMVSSVIIVTFISLTFVGTAALMQLQIVHMKSFWYDRAQVAIFLCTEHSSQSTCSAGKATEEQKDSVRQRLDSSVIKPLIEKYYFENHEQAYKNFKEQFKNNKIVELTTPDQLNETFWVKLHNPSQSTVIIEAFNDISGVDSVVDQRQYLNQIFYILNLASVTSISIAAVMLIAAVMLIATTIRLSAFTRRKEIEIMRLVGASNFFVQAPFVLEGIFAASIGALLSSIAIVSIAQFFITDYLAIKLPVVSFFSVGDSLIIVPIIFGIAILLSGLSAKFSISRSLRV

SEQ ID NO: 21620 - DNA, 903 bp, Myxococcus xanthus
  CDS (1)..(903)
atgagcgcgctgtcgaaggtgacgtacttctgccgctcggcggcggtggggctgaagcattcgcccttcgtgcacttcatcgcggtgacgaccatcgccatcgccttgttctccgcgggcatggcccggggcgcggcgcgggtgctggacaacctcctggcgtcgctcggcggcgaggtggaggtgacggtgtatctgtcgccggagctggacgcggacgaggtccacggggtgcgtgccctcgtgctggcgctcagcggcggtgaggtgacgctggtgtcgccggacgccgcgctctcacggctgcgcacggagctgggcgacctgggcgaggcgctggcggaactgccagagaacccgctgccggtgtcgctggagctgcgcgtgccgccggagcggcgcaacccggacgcgctcctggcgttggcgaaggcgctgcgagcggcgcctggcgtggccggcgtggactatggcgaggcggcggtgcagcggctgtccgccatcgcccgggcgctgcgcttcggttcgctggtggccttcgcggtggtgctgggcgccaccgtggtcatcgtggcggcgacgctgcagttggccatctattcgcggcgcggcgagattgaaatccagaagctggtgggcgccacggaccgcttcgtcaaggcgcccttcctgctggagggactgctccagggcgtgttgggcgcggcggtggcgctcttcgggctctgggccttcggccgggtgctcgggcccacgttgggcgcgctcttcgcctttctgttggggcccggcgtcgcggcgccgtgggtggagccccggctggcgctggagctgctgtgcgctggctgcggcctgggactgggcggcagcttcgtcgccgtggggcgcttcctccgcgtatga

SEQ ID NO: 21621 - protein, 300 aa, Myxococcus xanthus
MSALSKVTYFCRSAAVGLKHSPFVHFIAVTTIAIALFSAGMARGAARVLDNLLASLGGEVEVTVYLSPELDADEVHGVRALVLALSGGEVTLVSPDAALSRLRTELGDLGEALAELPENPLPVSLELRVPPERRNPDALLALAKALRAAPGVAGVDYGEAAVQRLSAIARALRFGSLVAFAVVLGATVVIVAATLQLAIYSRRGEIEIQKLVGATDRFVKAPFLLEGLLQGVLGAAVALFGLWAFGRVLGPTLGALFAFLLGPGVAAPWVEPRLALELLCAGCGLGLGGSFVAVGRFLRV

SEQ ID NO: 21622 - DNA, 939 bp, Streptococcus pyogenes
  CDS (1)..(939)
atggttacgatgattagatactttttccgtcatatttgggaatccattaaaaatcttaaacgcaacttttggatgacatttgcttcagttagtatggtggctgttacattgactttagttggtgtttttgcggcgacattgttgaatatacagcgtgttgcttcgggtgttgaaaataatgtccatatcaatacctacttacaagttgattcaactgatgctgcaaaagttattcaaaatactgccggtgaacctgttaataacgataactaccacagtgtttacgacaaaattgctcagataaaaggtgtcaaaaagattacattttctagcaaggatgaacaattgaaaaaattgcaagaaaccttaggtgatgtttggaatatgtatgaccaagacactaatccgctccaagatatctatcttattgagacccagacgcctaaacaagttaaggcgatcactaaaaagatcagaacgattgaaggcgtagaagccgcagattatggagggattaactccgataaactatttaagttttcaacattaattcaaacttgggggctgatcggaacagcaatgctattatttgtagctgtctttctcatttcaaacactattcgtatgactattatgtctcgtaaacgtgacattgaaattatgcggttagttggtgctaaaaattcttatattcgagggcctttcttttttgaaggggcttgggttggcttgttaggagctgttttaccatctcttctgatttattatggatatgatcttgtttataagcattttgcacaagaattacaacgtaataatctctcgatgtatccgcttgatccttatgtatattacctgattggtgctttgtttgtcataggtattatgattggttcgcttggttcagtgctttctatgagacgttatttaaaattctaa

SEQ ID NO: 21623 - protein, 312 aa, Streptococcus pyogenes
MVTMIRYFFRHIWESIKNLKRNFWMTFASVSMVAVTLTLVGVFAATLLNIQRVASGVENNVHINTYLQVDSTDAAKVIQNTAGEPVNNDNYHSVYDKIAQIKGVKKITFSSKDEQLKKLQETLGDVWNMYDQDTNPLQDIYLIETQTPKQVKAITKKIRTIEGVEAADYGGINSDKLFKFSTLIQTWGLIGTAMLLFVAVFLISNTIRMTIMSRKRDIEIMRLVGAKNSYIRGPFFFEGAWVGLLGAVLPSLLIYYGYDLVYKHFAQELQRNNLSMYPLDPYVYYLIGALFVIGIMIGSLGSVLSMRRYLKF

SEQ ID NO: 21624 - DNA, 969 bp, Vibrio parahaemolyticus
  CDS (1)..(969)
atggcaggtaacaagcactcccaaaagaaagggaaaggccgcagtgccaagcgtgcaaataccgatggttttttctctgtccatgcaaaacaagcaaaatcctcttttagcgccttatggcaacgaccactaggcaacattctgactctagcggtcatctccatggcacttgccatgccagcttgtttgtatctattgggcaaaaacgtggcaggcgctgccgaagatgtggcatctccctcgcaagttagtgcttacttagtggaaggcatgccggatgcgcgtgtgatggttctcaaagatcaaattgaaacttggcctcttgtaaaagaagtggaatatatttctccacagcaaggtttggccgatttaagccagtacgcgggttttgaccaagcactgagcttgctaagcggttatgcgttaccgggcgtgttggtgattacgcctgaatctgatatcaaaacagacattcaagccctagcaaaagaagtaggtcaacaacaagatgtgaccgatgttaggctagatgaagactggcttgcgcgcttaaatgccatcaaaaccctagcaggcattattgtcgtgactctgacaatcctgatgttgggtgcggtatttttaatcgttggtaacacattacgttttaatgtactggcgaataaagaagagattcaaaccatgaagcttatcggtgcgaccgacggcttcattttgcgtccgtacctgtacacaggtatgtggtttggtgtattaggtgctgtcattgcgtggtttgtcacggcgttagtgaccattgtgatgaacagcgccgtagaagatcttgccgcgttgtatgacagccaattccgtttgattggcctaagttgggatgaatctttgctgctgattatcaccggtagccttttaggttgtattgccgcgcgcatttcagcgcagcgccacttaaaagaaattgaaccagtttaa

SEQ ID NO: 21625 - protein, 322 aa, Vibrio parahaemolyticus
MAGNKHSQKKGKGRSAKRANTDGFFSVHAKQAKSSFSALWQRPLGNILTLAVISMALAMPACLYLLGKNVAGAAEDVASPSQVSAYLVEGMPDARVMVLKDQIETWPLVKEVEYISPQQGLADLSQYAGFDQALSLLSGYALPGVLVITPESDIKTDIQALAKEVGQQQDVTDVRLDEDWLARLNAIKTLAGIIVVTLTILMLGAVFLIVGNTLRFNVLANKEEIQTMKLIGATDGFILRPYLYTGMWFGVLGAVIAWFVTALVTIVMNSAVEDLAALYDSQFRLIGLSWDESLLLIITGSLLGCIAARISAQRHLKEIEPV

SEQ ID NO: 21626 - DNA, 1035 bp, Pseudomonas syringae
  CDS (1)..(1035)
atgagtgccacacgcagccccaaggtttcagagcgcgtcgcgcccagagccgccgatccttcgccgcaaaagcagaaaaaaccgcgccacgatcatgatgatgacggccctgacttcagcgcgctgttgtctgcctggctggagagtcatcggtccagtctgctcgacagcctgcgtcgtctgaccaagcagccgatcggcagcttctttacctgtctggtgatggccattgccctgagcctgcccatgggcctgtcattgttgttgagcaatgtcgagcgcctgggtggttcgtggcagcgtgcggcgcagatttcgatttatctgaatctggatgccagcaccactgatggcacccgcatgcgcgatgagatcaaggccatgcccggcgtggcagatgccgagtacatcagcagcgaacaggcattgggcgagttcaagcaacagtccggcttgggcgaggcgctcaaggaattgccggagaacccgttgccaggcgtagtgctggtcactccggacgaagtggacaagcccgcactggaagccttgcgcacccggctcgccggcctgccgaaagtggagcaggcgcaactggatctggtctgggtcgaacgactggcggcgatcctcaaactgggtgaccggttcgttttcggcttgacggttctgctggtctcggctttgctgttggtaattggtaacacgatacgtctacacatcgaaaaccgccgtaccgaaatcgaagtcatcaaactggtgggcggcaccgacagctacgtgcgcagacccttcctttatatgggcgcgctgtacggtttcggggcagggatcctgtcctggggggttctggcgtatggtcttaactggctgaacggtgcggtcgtcgggctggcgggtctgtatggaagcgactttgcgctggcgggtgttccgacgggtgatggtctttcgctcttgcttggagccgttctgttagggtatatcggtgcctggattgcggtcgctcgtcacttgcgtgaactggcgccccgctaa

SEQ ID NO: 21627 - protein, 344 aa, Pseudomonas syringae
MSATRSPKVSERVAPRAADPSPQKQKKPRHDHDDDGPDFSALLSAWLESHRSSLLDSLRRLTKQPIGSFFTCLVMAIALSLPMGLSLLLSNVERLGGSWQRAAQISIYLNLDASTTDGTRMRDEIKAMPGVADAEYISSEQALGEFKQQSGLGEALKELPENPLPGVVLVTPDEVDKPALEALRTRLAGLPKVEQAQLDLVWVERLAAILKLGDRFVFGLTVLLVSALLLVIGNTIRLHIENRRTEIEVIKLVGGTDSYVRRPFLYMGALYGFGAGILSWGVLAYGLNWLNGAVVGLAGLYGSDFALAGVPTGDGLSLLLGAVLLGYIGAWIAVARHLRELAPR

SEQ ID NO: 21628 - DNA, 924 bp, Clostridium tetani
  CDS (1)..(924)
atgcaagagacgaacagagaggtgcatacggatatgaagattagtagtataaagtattttatatcggattcactaaaaagtataagaagaaataaaactataagccttgcttcagctactacagttgcagctacattatttatattaggtgtatttatgctatcagcattaaacgtgcagcaggtaataaaaaatgtagaatctaaagtagaaataagtatatttatgagagaggacataaccattggtcaacaaaaagagttagaaactaaaataaagaaaatagacaaaattgtagatgtttcctatgtaagtaaagaaaaagcagtagaaaaatttaaacagcaaataggggacgataataaggacttagtaaaagggttagaaaaagaaaatcctctaccaagttcgtacatagtaaaagtaaaagacccaagtatggtaactgatgtagttaatgaaataaaagatttaaaagggattgaaaaaatacaagagggaaagaaaatagttgataaaatcgtagccattaccaaaactataaaatgggtgggtatggtgttatttgttatacttataggtgtatctttatttttgataggaaatacaataaaaataactgtatattcaagaagaagagaaataggtattatgaagtacataggagctacagattggtttattagatggccttttgtcatagaaggagcaatacttggtttaacaggggctttagttggtctgttagttctttactatttatataatgctttatattcaagaatggcttcagcagtatatttagtacaatttataaaaccatcatatatattaacatcaatatcttggcagtttatattactaggtattctaataggagctataggaagtatattatctataagaaagttcttagcagtttaa

SEQ ID NO: 21629 - protein, 307 aa, Clostridium tetani
MQETNREVHTDMKISSIKYFISDSLKSIRRNKTISLASATTVAATLFILGVFMLSALNVQQVIKNVESKVEISIFMREDITIGQQKELETKIKKIDKIVDVSYVSKEKAVEKFKQQIGDDNKDLVKGLEKENPLPSSYIVKVKDPSMVTDVVNEIKDLKGIEKIQEGKKIVDKIVAITKTIKWVGMVLFVILIGVSLFLIGNTIKITVYSRRREIGIMKYIGATDWFIRWPFVIEGAILGLTGALVGLLVLYYLYNALYSRMASAVYLVQFIKPSYILTSISWQFILLGILIGAIGSILSIRKFLAV

SEQ ID NO: 21630 - DNA, 969 bp, Bradyrhizobium japonicum
  CDS (1)..(969)
atgagtaagcccgacgagcgcggcgtgctggtcgacctcggacaggagcgtccgcagcttccggccaaggcgcgcaacatgtcgccgatcgtgccgcgcgcctcgatccacggccgtgcgctggttgccgtcgtcgccatcatgaccttcctcgcttcgatgaccacgggcacggtgctgctggtcagcgcctccgccgccgaatggcagtcggacgtcgcgagcgaaatcaccatccaggttcgtccgcagtccgggcgtgacctcgagcgcgacaccgccgcggtgaccgaggcgatgcgcgcgcaagccggtatcgtcgaggtcaagccgttcaccaaggacgagagcggcaagctgctcgagccctggctcggcaccggactgtcgatggacgatctgccggttccgcgcatgatcatcgcgcgcgtgcagcccggcacggcgctcgatctcgccgccttgcgcgcccgcgtgacgcaagtggcgccaagcgccagtgtcgacgatcaccgcgcctggatcgagcgcatgcgctcgatgaccaacgcaaccgtgctcgccggtctcggcatcctcgcgctcgtcatcatcgcgacgatcatctcggtctcgttcgcgacccgcggcgccatggcggcgaaccgtccgatcgtcgaggtcctgcatttcgtcggcgccggcgaccgctacatcgccaaccgctttctgcgccatttcctcaggctgggcctggagggcggcgtgatcggcggcggcgccgccatgctggtgttcggcttctccgagtcgatcgccggctggttttcggggacgcccgtcggcgaccagttcgcggccctgctcggcaccttctcgctgcggccctccggctatgtcgtgctcgcggtgcaggcggtgctgatcggcgccatcaccgccgtcgcctcgcgccagacgctgttcgcgacgctgaatgatgtggattga

SEQ ID NO: 21631 - protein, 322 aa, Bradyrhizobium japonicum
MSKPDERGVLVDLGQERPQLPAKARNMSPIVPRASIHGRALVAVVAIMTFLASMTTGTVLLVSASAAEWQSDVASEITIQVRPQSGRDLERDTAAVTEAMRAQAGIVEVKPFTKDESGKLLEPWLGTGLSMDDLPVPRMIIARVQPGTALDLAALRARVTQVAPSASVDDHRAWIERMRSMTNATVLAGLGILALVIIATIISVSFATRGAMAANRPIVEVLHFVGAGDRYIANRFLRHFLRLGLEGGVIGGGAAMLVFGFSESIAGWFSGTPVGDQFAALLGTFSLRPSGYVVLAVQAVLIGAITAVASRQTLFATLNDVD

SEQ ID NO: 21632 - DNA, 936 bp, Streptococcus mutans
  CDS (1)..(936)
atgattagaagatttttccgtcatttatggcaatccattaaaaatttaaaacgtaatggctggatgactgttgcagcggttagctctgtaactattaccttgatcttggtcggtatctttgcagcctttctcttaaatactgaaaagttagcatctggtattgaaaaaaatgttcagattaatacttatttgcaagttgattctaaggataatgttaaatcttatgtagattcaaatgatgccaataaaacagttaacaatcctgattatcataaggtatatgatcaaattaaaaaaattgaacacgttaaatcaattaccttttcaagtaaggatgaacaattagagaaacttaagaaaaccatgggagacgattggaacttgtttgatggggattccaatcctttatatgatgtatacattgtgcagacaacttcacctagtgaagtcaaaacagtagctaaagctattgggaaaatttctggtgttgattcagttgcttatggcggcacagatactgatcgtatttttggtttggctaactttgttcggacatggggacttgcaggaactggcctcctagttttggttgctatctttttgatttccaatacgattcgtataactattttgtcacgtcgtaatgaaattcaaatcatgcgtttagttggtgccaaaaatggctatatcagaacgccattcttctttgaaggagcttgggttggtcttattggagcgattattccagcggttgttgtaggttacttatatatctttgcatttgagcaattcaatccaaatcttgctgctcaaaatctctctctttatgaaccaagtcctttcatcttttaccttattggtgccatgtttatcgttggtattttgattggggctttaggctcaattttatcaatgagacgattcttgaagatataa

SEQ ID NO: 21633 - protein, 311 aa, Streptococcus mutans
MIRRFFRHLWQSIKNLKRNGWMTVAAVSSVTITLILVGIFAAFLLNTEKLASGIEKNVQINTYLQVDSKDNVKSYVDSNDANKTVNNPDYHKVYDQIKKIEHVKSITFSSKDEQLEKLKKTMGDDWNLFDGDSNPLYDVYIVQTTSPSEVKTVAKAIGKISGVDSVAYGGTDTDRIFGLANFVRTWGLAGTGLLVLVAIFLISNTIRITILSRRNEIQIMRLVGAKNGYIRTPFFFEGAWVGLIGAIIPAVVVGYLYIFAFEQFNPNLAAQNLSLYEPSPFIFYLIGAMFIVGILIGALGSILSMRRFLKI

SEQ ID NO: 21634 - DNA, 930 bp, Streptococcus agalactiae
  CDS (1)..(930)
atggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagacatgtttcattgtatcctatggatattatggttccagcaattattggtggtatggtgattattggtattattattggctcacttgggtctgtcctatcaatgagacgttaccttaagatttaa

SEQ ID NO: 21635 - protein, 309 aa, Streptococcus agalactiae
MVIMINFFRHFWESLKNLKRNFWMTFASVTSVTITLLLVGLFSSVLLNVEKLTTDVSGNFTISAFLNVDSTDAQKQVKDKDGKLKDNPDYHKVYDKIKRISGVEKVTYSSKAEQLKEVQKEYGSDVIDDTYKDALLDVYVVGTSSAKVSKSVSEAIGRIEGVDYTKEPIDSTKLSNLTDNIRIWGFGGVALLIVLAIFLISNTIRMSIMSRRTDIEIMRLVGAKNSYIRGPFFFEGAWVGILGAIVPSLIFYFGYQFVFNKFNPKFETRHVSLYPMDIMVPAIIGGMVIIGIIIGSLGSVLSMRRYLKI

SEQ ID NO: 21636 - DNA, 966 bp, Shewanella oneidensis
  CDS (1)..(966)
atgagtgacaatgctaagttaacgcgcagcaagttgccgatatcgggacgtatcgtgatgttttttattcgtcatgtgcagcaagcgatggcgagtatgggtgaactgtggcgcagcccagtttcttctttgatgaccatggctgttctcggggtaagtttaagcttacccgcggcgctgcaggtattagttaaaaatgccgagacgattactagctcttggaacagcgcggcggagatttcactgtttatcgatgaaaaccgtagcgagcagaccatccaaagcttgctgactcgcattcgcacttatccagaagtggaaaaggtgcagtatatcgaccgcaatcaagcgcttgaggaatttcagcgtctgtcggggtttggtgaagccttagcctatctcgataaaaacccgcttcccgcagtgattaccgtaacacctactcagcgttattcgacgcccgtgggtgcccgtgaactcttaactaagcttgagcgcgagcctgaaatcagttttggccgcttggatattgaatggttagagcggctgcaggccgtggtgcgtttactcgaacgcacggtaatggcgattgcggccttactcgtcttggcggtggtattagtaataggtaacacgattcgcttagccattatgaatcggcgaagtgagatagaagtgatgaagttagtcggggcaacagaagcctttattcagcgcccattcctttacactggtatttggtatggcgtcattggcggtatattggcttgggttatcataaacttattggtctggtatctggattctgccctagcggaactgctgggtttgtacggtagccaattagagatgaagtcactgacctttaccgagttgctgcaattagtaggcttagcctccttcttagggtggctaggctcctatctgtcggtaaggcaacatttaagatcaatagaaccctcataa

SEQ ID NO: 21637 - protein, 321 aa, Shewanella oneidensis
MSDNAKLTRSKLPISGRIVMFFIRHVQQAMASMGELWRSPVSSLMTMAVLGVSLSLPAALQVLVKNAETITSSWNSAAEISLFIDENRSEQTIQSLLTRIRTYPEVEKVQYIDRNQALEEFQRLSGFGEALAYLDKNPLPAVITVTPTQRYSTPVGARELLTKLEREPEISFGRLDIEWLERLQAVVRLLERTVMAIAALLVLAVVLVIGNTIRLAIMNRRSEIEVMKLVGATEAFIQRPFLYTGIWYGVIGGILAWVIINLLVWYLDSALAELLGLYGSQLEMKSLTFTELLQLVGLASFLGWLGSYLSVRQHLRSIEPS

SEQ ID NO: 21638 - DNA, 894 bp, Oceanobacillus iheyensis
  CDS (1)..(894)
atgaagtttagaacgttaatgagacatatccgtgaaggaataaaaaatatatttagaaatggttggatgacgtttgcgtcagtagctgctgttacaacaactttgatacttgtagctgtatttttagcactagtgttaaatttagatcaaatggcaactaatatcgaagaagacgttcaaatcagtacgataatagaccgtactgcagatgaacagcagattgttgagttaggggaagaattaaaacaaatagatggtgttgaaaaagtacaattttcatcaagagatgatgaattatcgaagttgatggatagtatgggagaagaaggagaagcttggggaatgttcgaacaagataatccattacaccatacatattatgttgatccaatgacacctgaacaaacggagcaaattgcttcacaaattgaatctttaaattatgtagatgaggttctatatggacaagatgtagtacaaaaattgttcgagtttaatagttatgcaaggacaattggattaggtttgattgtagctcttgtatttactgctatattcctaatctcaaatactatcaaaatcacaattattgcacgtagtacagaaataggcattcaaaaactagtgggcgctaaaaatagttttattcgttggccattttttattgaaggagctttgctcggtattctcggatcaatcataccgattactgtaatattgagtggttattactatatatacactaattttaatgactctataacaattccatttgtggaattattaccatttaatccatttgcttggcaattagctggaatggtacttctaattggtgctgtaattggtgtatggggaagcgtaatgagtgtacgtaagttcttaaaagtctga

SEQ ID NO: 21639 - protein, 297 aa, Oceanobacillus iheyensis
MKFRTLMRHIREGIKNIFRNGWMTFASVAAVTTTLILVAVFLALVLNLDQMATNIEEDVQISTIIDRTADEQQIVELGEELKQIDGVEKVQFSSRDDELSKLMDSMGEEGEAWGMFEQDNPLHHTYYVDPMTPEQTEQIASQIESLNYVDEVLYGQDVVQKLFEFNSYARTIGLGLIVALVFTAIFLISNTIKITIIARSTEIGIQKLVGAKNSFIRWPFFIEGALLGILGSIIPITVILSGYYYIYTNFNDSITIPFVELLPFNPFAWQLAGMVLLIGAVIGVWGSVMSVRKFLKV

SEQ ID NO: 21640 - DNA, 903 bp, Corynebacterium efficiens
  CDS (1)..(903)
atgtctgttacctatgttctccgtgaatccctgcgcgggatggcccgcaatctcaccatgacgctcgccctggtgatcaccacctccatctccctggcgctgctggccaccggtttcctggtggccaacatgaccgagcgcaccaaggacatctacctcgaccgcgtggaggtgatgatccagttggatgaggacacctccgccaatgatcccgactgcgtggaggaggcctgcgctgaggtccgctccgaactcgaggcgctcgacgggatcgactccatcacctaccgctcccgggagcagtcctatgagcgtttcgtggaggtcttcgaatacaccgatccggtgctggtggccgaaacctcaccggatgccctgccggcggccttccatgtgcgactggcggatcccctggcggtggacatcctcgaccccgtccgcgagctcccccaggttgcagccgtgatcgaccaggtcgatgatctccgcggtgccaccgacaaccttgactccatccgcaatgccaccttcctcgtcgccgcggtgcagatcctcgcctccaccttcctcatcgcgaacatggtgcagatcgccgcctattcccgccgggaggaaacggagatcatgcgtatcgtcggtgcctcccgctggtactccgaggctccctttgtcctggaggcggtgctgtccacgttgatcggtgcggtgctggcggttgtcgggctgttcctgggcaaggaactggtcatcgacaaggcgctgcgtggactctatgaatcccagctgatcgccccgatcaccaacgccgatatctggacggtggcgccggttgtctctgtcatcggtgtggtggtggccggcctgatcgcgcagctgacgttgcggttctacgtacgtaaataa

SEQ ID NO: 21641 - protein, 300 aa, Corynebacterium efficiens
MSVTYVLRESLRGMARNLTMTLALVITTSISLALLATGFLVANMTERTKDIYLDRVEVMIQLDEDTSANDPDCVEEACAEVRSELEALDGIDSITYRSREQSYERFVEVFEYTDPVLVAETSPDALPAAFHVRLADPLAVDILDPVRELPQVAAVIDQVDDLRGATDNLDSIRNATFLVAAVQILASTFLIANMVQIAAYSRREETEIMRIVGASRWYSEAPFVLEAVLSTLIGAVLAVVGLFLGKELVIDKALRGLYESQLIAPITNADIWTVAPVVSVIGVVVAGLIAQLTLRFYVRK

SEQ ID NO: 21642 - DNA, 855 bp, Chlorobium tepidum
  CDS (1)..(855)
atgaaagaggggttttcagggattggccgggccaaacttcctgcttttgtgaccatagctgtcggctttttctcactgctgttgctgggcctgttcggcacggtctccctcagcttttatcaggtgattcaggaggtgcgctctcgcgttgaactggaggttttctttgatgaaactgtcaacgacgatcaggcgcgctcgctcggagaaaagatgcaggcgattcccggagtggctgcaacgcactatatctcgcgggatgaagccgcatcgaggttcaggcgtgattttggagaggatgtcgtgaccattctgggcatgaatcccctccctcgctcggtgacgctgaatatcgatcagcgttacgctcttccggacagcatcgccgttatcagaaagaagctcgaagccttgcatcaggggcttgacattcggtacaatcaggagtatctgacaggcatcgagaagaatgcgcggctttttacgctcattactgccggagttggcggggtgatcgccctggcgaccatcattctgaacgcttttaccgtccggcttgccatgtacgcccggcgtgaccgcatcaaaaccatgaggctggtcggcgcgacccgctggttcatcagtgcgccgtttcttatcgagggtgcggtgctcgggctggtttcgggtgggctggctgcgcttggtctctggctcattttcgagcaggcgcttttgcgctacgaaccggcgatctaccagatactgcatccatcgacttacgtgatctatccgggacttgtcctgctcggcattgtgctcggttttttcggcagcacctggtcggtggcccgcttcctgcgcgtttcctga

SEQ ID NO: 21643 - protein, 284 aa, Chlorobium tepidum
MKEGFSGIGRAKLPAFVTIAVGFFSLLLLGLFGTVSLSFYQVIQEVRSRVELEVFFDETVNDDQARSLGEKMQAIPGVAATHYISRDEAASRFRRDFGEDVVTILGMNPLPRSVTLNIDQRYALPDSIAVIRKKLEALHQGLDIRYNQEYLTGIEKNARLFTLITAGVGGVIALATIILNAFTVRLAMYARRDRIKTMRLVGATRWFISAPFLIEGAVLGLVSGGLAALGLWLIFEQALLRYEPAIYQILHPSTYVIYPGLVLLGIVLGFFGSTWSVARFLRVS

SEQ ID NO: 21644 - DNA, 903 bp, Corynebacterium glutamicum
  CDS (1)..(903)
atggcttttggatatgtactgcgtgaagctgttcgcggcatgggccgcaacgtcaccatgaccatcgcgctcatcatcaccacctctatttccttggcacttcttgccactggatttttggtgaccaacatgaccgaccgcaccaaggacatctacctggatcgcgtcgaagtgatgatccaactcgatgaggacacctctgccaacgatcccgaatgcaccgcggagtcctgcaccgaagttcgtgatgtcttagaaggactcgacggcatcgattccatcacctaccgttcccgcgaggcctcctacgaacgattcgtagaagttttcaaagatactgacccagttctcgtcgctgaaacctctcccgacgcattgccagcagcgttccacgtccgacttgaagatccacttgccgttgagattctcgatccggtccgcgatcttcctcaagtaagcaacgtgatcgaccaggtggatgatctgcgcggagcaaccgaaaaccttgactccatccgcaacgccaccttcctcatcgcggctgtgcaagttttggcatcgatcttcctgattgccaacatggtgcaaatcgctgcattcaatcgtcgtgaagaaactgaaatcatgcgcatcgtcggcgcatcgcggttctacactcagggaccattcgtcttcgaagcgattctatccaccctcattggtgcggttttcgccgtcggcgcgctcttcttgggtaaagaactcgtcattgataaagcactccgcggactctacgattcccagctcatcgcaccagttaccaccacagatatttggctggtcgcaccgataatttccggcattggcgtggtgatcgccggcattatcgcacaactcaccctgcgcttctacgtgaggaaataa

SEQ ID NO: 21645 - protein, 300 aa, Corynebacterium glutamicum
MAFGYVLREAVRGMGRNVTMTIALIITTSISLALLATGFLVTNMTDRTKDIYLDRVEVMIQLDEDTSANDPECTAESCTEVRDVLEGLDGIDSITYRSREASYERFVEVFKDTDPVLVAETSPDALPAAFHVRLEDPLAVEILDPVRDLPQVSNVIDQVDDLRGATENLDSIRNATFLIAAVQVLASIFLIANMVQIAAFNRREETEIMRIVGASRFYTQGPFVFEAILSTLIGAVFAVGALFLGKELVIDKALRGLYDSQLIAPVTTTDIWLVAPIISGIGVVIAGIIAQLTLRFYVRK

SEQ ID NO: 21646 - DNA, 951 bp, Xanthomonas campestris
  CDS (1)..(951)
atgagcaagctcgccaataccgaatcggtggccccctcgcggttcggcgtgtggatcgaccaccatctgcacagcatcgccttcagcctgggccgcgccatgcgcaagccctgggccaccttgctcaccatcgtggtgatggcgctggcgctggcattgccgctggggctgtcgatcgcgctggacaacgtcaagctgctggctggtagcgtgcagcagtcgcgcgaaatcaatctgttcctcaaggtggacgtggccgccgatgcggccgagcgcctggccggcgagctgcgcgcgcgtgcggacattgcccaggtggccgtgcgcacgccggcgcagggcctggccgacctgcgcgaaaacgccaagctggacgaagcgatcgatgcactcggcgacaacccgctgcctacgctgctgatcgtcaccccggccgatgccaccgacgatgcgcagctggccgccgccttgcaggctttgccgcagaccgaccaggtgcaacacgacgcgctgtggcgcaagcggctagatggctggctgcatttcggcgaacggctggtgcaggtgctctcggccttgctcggcattggcgcggtgctggtggtcggcaataccgtgcggctggatatccagtcgcggcgcgaagagatcggcgtgctgcagctgctgggtgccagcgatggcttcatccgccgcccgttcctgtatctgggcgcgtggtacgggctgggtgccggcgcggtcgcgcttgctctgatcgccgcttccgggtttgcattgcgtacgccgctggccacgctggccgacagctacggcagttcctttaccctgcacggactggatctgctgcattctgcgatggtgttggtgggtaccctggtgctgggttggctgggtgcctggctggtcaccggccacttcctccgtcagacccgccccaccgagacctga

SEQ ID NO: 21647 - protein, 316 aa, Xanthomonas campestris
MSKLANTESVAPSRFGVWIDHHLHSIAFSLGRAMRKPWATLLTIVVMALALALPLGLSIALDNVKLLAGSVQQSREINLFLKVDVAADAAERLAGELRARADIAQVAVRTPAQGLADLRENAKLDEAIDALGDNPLPTLLIVTPADATDDAQLAAALQALPQTDQVQHDALWRKRLDGWLHFGERLVQVLSALLGIGAVLVVGNTVRLDIQSRREEIGVLQLLGASDGFIRRPFLYLGAWYGLGAGAVALALIAASGFALRTPLATLADSYGSSFTLHGLDLLHSAMVLVGTLVLGWLGAWLVTGHFLRQTRPTET

SEQ ID NO: 21648 - DNA, 951 bp, Xanthomonas axonopodis
  CDS (1)..(951)
atgagcaagcccgccaataccgaaaccgtcgcgccgtcgcggttcggcgtgtggatcgaccatcatctgcacagcatcgccttcagcctgggccgtgcgatgcgcaagccgtgggccaccttgttgaccatcgtggtgatggccctggcgctggccctgccgttggggctgtcgatcgcgctggataacgtcaagctgctggccggcagcgtgcagcagtcgcgcgagatcaatctgttcctgaaggtcgacgtggccgccgatgcggcgcaggcgctggccggcgagctgcgtgcacgtccggatgtggccaaggtcacgctgcgcacgcccgaacagggtttggccgagctgcgcgaaagcgccaagctcgatgaagcggccgatgcgctgggcgacaacccgctgcccaccttgttgatcgtcactcccgccgatgcgaccgacgacgcgcagctggccggtgcgctacaggcgctgccgcagaccgatcaggtgcagcacgacgcgctgtggcgcaagcgcctggatggctggttgcatttcggcgagcgcctggtccaggtgttgtctgccctgctcgggatcggtgcggtgctggtggtcggcaacaccgtgcggctggatatccagtcgcggcgcgaagaaatcggcgtgctgcagttgctcggcgccagcgatggcttcatccgtcgtccgttcttgtatctgggcgcgtggtacggactcggcgccggcgctgtcgcgctcgctctgatcgccgcctcgggcctggcattgcgtgcgccgttggcgacattggccgacagttacggcagttcttttaccctgcatgggctggatctgttgcattctgcgatggtgctggtcggcaccttagtcctgggttggttgggtgcctggctggtgaccggccatttccttcgccagacccgtcctaccgagacctga

SEQ ID NO: 21649 - protein, 316 aa, Xanthomonas axonopodis
MSKPANTETVAPSRFGVWIDHHLHSIAFSLGRAMRKPWATLLTIVVMALALALPLGLSIALDNVKLLAGSVQQSREINLFLKVDVAADAAQALAGELRARPDVAKVTLRTPEQGLAELRESAKLDEAADALGDNPLPTLLIVTPADATDDAQLAGALQALPQTDQVQHDALWRKRLDGWLHFGERLVQVLSALLGIGAVLVVGNTVRLDIQSRREEIGVLQLLGASDGFIRRPFLYLGAWYGLGAGAVALALIAASGLALRAPLATLADSYGSSFTLHGLDLLHSAMVLVGTLVLGWLGAWLVTGHFLRQTRPTET

SEQ ID NO: 21650 - DNA, 888 bp, Thermoanaerobacter tengcongensis
  CDS (1)..(888)
atgctctttagaaattttagatacttcataaaagaaggttttagcaatctggctagaaacagattgatgactgtagcttctgtcacctctgtgatggctgctcttgtcatactcggaatgtttttgctgataatcttaaatgtaaaccatatggcatatcaagttgaatctcagctggaacttaaggcttttctaaaagatgacctttcgggagagcagatacaaagaataggagaagagatcaagggaatagatggagtttcttctgtggttttcgaatcaaaagagcaggctttgcagaaatttaaaaagcagctgggggaaaaaagctatcttttagaaggtcttgagaaggacaaccccctcccacagtcctatatagttaaagtaaaagacgctaatctcataaaagatattgccgatgaaataaaagggataaatggtgttgacaaagtaagctatggacaggatgtggtggaaaagcttctcggcataatcaggattataagaattgtaggacttgcaataattagcattttgtttgtcatctcaattgtcataatttctaacacaattaaattaggcgtttttgcaaggagaagagaaataaacataatgaagtacatcggagcgacagactggttcataaggtggccctttttaatagaagggatagttttgggtttgctgggggcactgctttcagtaggtgttctggctttgatgtacgggtatactttggactatgtcaacagccgtttgatagtttttaacttactgcctttgtccgatgtcatcaaggacatggctttgtattttgcgcttttagggtctttgattggcgctattggcagcggcctttctataaagaggttcttaaatgtctaa

SEQ ID NO: 21651 - protein, 295 aa, Thermoanaerobacter tengcongensis
MLFRNFRYFIKEGFSNLARNRLMTVASVTSVMAALVILGMFLLIILNVNHMAYQVESQLELKAFLKDDLSGEQIQRIGEEIKGIDGVSSVVFESKEQALQKFKKQLGEKSYLLEGLEKDNPLPQSYIVKVKDANLIKDIADEIKGINGVDKVSYGQDVVEKLLGIIRIIRIVGLAIISILFVISIVIISNTIKLGVFARRREINIMKYIGATDWFIRWPFLIEGIVLGLLGALLSVGVLALMYGYTLDYVNSRLIVFNLLPLSDVIKDMALYFALLGSLIGAIGSGLSIKRFLNV

SEQ ID NO: 21652 - DNA, 933 bp, Clostridium perfringens
  CDS (1)..(933)
atgttcagaaaggaggatatgaatatgaagtttagtactataggatatttcatatcagatgctttcaaaagtttaaagagaaatagaacaataagtatagcttctatagcaactgttcttactacattatttatatttggagcatttttattaactgctttaaatgttaaaaatggggttacagatgttcaagacaaagttgaggttaaggttttccttaaagatgacgtaacacaagagcaaagggatgcagttgaagcaaaacttaagactgttcaaggggtaaaagaagtagaatttgaatctaaagatcaagcttttgcaaagatggaaggttcaagtgattataataaagagattttagctggatatagcaaagaaaataacccattaccagcttcatatatagtaagattagaaagcccagaagtagcttcaagcgttgaaagcgctatgaaaactaatgataaatttatggctggtgtagaagatgtaggtaatgacgaagagcttataggtactataaactcctttgtaaaagttattaatacagtaggattagttttaggtgtagtattcgtaggtgtatcactattcctaatagtaaatacaataaagataacagtttactcaagaagaagagaagtaggaataatgaaattcgttggggcaactgactggttcataagatggcctttcgtaatagaaggggttataatcggacttgtaggtggtattctttcaacacttttattattcgcaggatataacttcttatatggaaaaattgtatcttcatcatcactatatatgccacaatttgtacaaccaatgtatgttttaacaacaatgtcatggcagtttatactagcaggtattgttattggtgcaataggtagtataatagctttaagaaaattcttagacgtttaa

SEQ ID NO: 21653 - protein, 310 aa, Clostridium perfringens
MFRKEDMNMKFSTIGYFISDAFKSLKRNRTISIASIATVLTTLFIFGAFLLTALNVKNGVTDVQDKVEVKVFLKDDVTQEQRDAVEAKLKTVQGVKEVEFESKDQAFAKMEGSSDYNKEILAGYSKENNPLPASYIVRLESPEVASSVESAMKTNDKFMAGVEDVGNDEELIGTINSFVKVINTVGLVLGVVFVGVSLFLIVNTIKITVYSRRREVGIMKFVGATDWFIRWPFVIEGVIIGLVGGILSTLLLFAGYNFLYGKIVSSSSLYMPQFVQPMYVLTTMSWQFILAGIVIGAIGSIIALRKFLDV

SEQ ID NO: 21654 - DNA, 954 bp, Aeromonas hydrophila
  CDS (1)..(954)
atggctatcgttcgtcataaacaaccgccgctgcgccggttcatgatgtactgggtcgaccatgcccgtcaggctttctccagcctgggcgagctgtggcgcaatccgctcgcctccctgatgacgctggcggtgcttggcgtcagcctggcgctgccctcctgcttccacgtgctgctgaaaaatgccgaggtggtggaagggagctggcagaccagttcccagatctccctctatttgcgcaaggatctgcccgagcagagcattctcgacatgaagcagcggatcctgctctatcccgaggtggagtccgtcacctacatgagccgggatgaggcgctcaaggagtttcgcgagatctccggtttcggcgatgcgctcgattacctcgacagcaacccgctgccgcctgtgctgagcgtcattcccgatccccgctggcagaatccggaaggggccgccgagctgctcaacaagctgaacaacgaggatggcgtcgaacagggcaagctggatctgcagtggctgacccgcttgcaggggatcatgaacctgctgcgccacaccatcaccggcatagccgtgctgctgctctccgccgtgctgctgatcgtcggcaataccctgcgcctgaacatcctcaaccagcgatccgagatcgaagtgctcaagctggtgggggcgaccgacgccttcattcaccgtcccttcctttataccggcatctggttcggggtcatcggcggcatgctggcctggtggctgaccgaggtgatggtgatctggagcgagggtgtggtgaatgagctggccgggctctacaacagcaatttccggctggtcggcatgggggcggtggatgggattaatctgattctgctaggggctctactggggctgatcgcctcctggttctcggtccatcgccacattcgcgacatagaaccatcctga

SEQ ID NO: 21655 - protein, 317 aa, Aeromonas hydrophila
MAIVRHKQPPLRRFMMYWVDHARQAFSSLGELWRNPLASLMTLAVLGVSLALPSCFHVLLKNAEVVEGSWQTSSQISLYLRKDLPEQSILDMKQRILLYPEVESVTYMSRDEALKEFREISGFGDALDYLDSNPLPPVLSVIPDPRWQNPEGAAELLNKLNNEDGVEQGKLDLQWLTRLQGIMNLLRHTITGIAVLLLSAVLLIVGNTLRLNILNQRSEIEVLKLVGATDAFIHRPFLYTGIWFGVIGGMLAWWLTEVMVIWSEGVVNELAGLYNSNFRLVGMGAVDGINLILLGALLGLIASWFSVHRHIRDIEPS

SEQ ID NO: 21656 - DNA, 936 bp, Pasteurella multocida
  CDS (1)..(936)
atgagttcgcgccgtgtgcatgcgccattttgggtgcaaatacaatatgtgttaaaagctgtatgggctgatttattaaagcgccgttttggcaccttactgacaattttagtgatcagtgtttccctaaccattccaacagtaagctatttattgtggaaaaatattcaccaagctacgactcagttttatccggaaagtgagctcactgtgtatttacacaaaaccttgagtgaagaagatgccaatttggtggtggaaaaaattcgccaacaaaacggtgtcgcctcgttaaattacatttcacgtcaagagagtttgaatgcgtttcgtgattggtcggggtttggtaatgagttagatgtattagatgataaccctttgcccgcggtagtgatgatcagaccgacgaaagaatataatgaatcgcaaaaacgcaatgagctacgccaaaatttagataaaattaaaggtgtacaagaagtccgtttagacaatgattggttggaaaaattgaccgcactgacttggttagtggcacatgtggcgatcttttgtgcggtgctgatgaccttggcggttttcttggtgattggtaacagtattcgctcggatgtgtacagtagccaagccaccattgaagtgatgaaactgcttggcgccaccgatcaatttgttttacgccctttcttatatacgggcatgatttatgccttgttaggtggcttttttgcttgtgtgttaagtagtttagtgattggttatttcactagtgccgtcaagtatgtgaccgatatttttgcggtacattttgagttaaacggggtaaatctggcggagtttttatttctgatgatcatttgcacgttggtgggctaccttggtgcttggttagcggcaactcgccatattaaaatgcttgagcgaaaaaattaa

SEQ ID NO: 21657 - protein, 311 aa, Pasteurella multocida
MSSRRVHAPFWVQIQYVLKAVWADLLKRRFGTLLTILVISVSLTIPTVSYLLWKNIHQATTQFYPESELTVYLHKTLSEEDANLVVEKIRQQNGVASLNYISRQESLNAFRDWSGFGNELDVLDDNPLPAVVMIRPTKEYNESQKRNELRQNLDKIKGVQEVRLDNDWLEKLTALTWLVAHVAIFCAVLMTLAVFLVIGNSIRSDVYSSQATIEVMKLLGATDQFVLRPFLYTGMIYALLGGFFACVLSSLVIGYFTSAVKYVTDIFAVHFELNGVNLAEFLFLMIICTLVGYLGAWLAATRHIKMLERKN

SEQ ID NO: 21658 - DNA, 918 bp, Streptomyces coelicolor
  CDS (1)..(918)
atgcgcgcccagttcgtagtctcggagatcggagtcggtcttcgccgcaatctgacgatgaccttcgcggtcatcgtctcggtcgccctgtccctggccctgttcggcggttcgctgctgatgagcgaccaggtcaacaacatgaagggctactggtacgacaaggtcaacgtctcggtcttcctctgcaacaagagcgacgccgagtccgaccccaactgcgccaagggcgcggtgaccgaggaccagaagaagcagatcatgtccgacctcgacgagatggccgtcgtcgagaaggtgacgtacgagtcgcaggacgaggcgtacaagcactacaaggagcagttcggcgactccccgctggccagctccctcacgccggaccagatgcaggagtcgtaccggatcaagctgcaggacccggagaagtaccaggtcatcgcgaccgccttcgacggccgggacggcgtgcagtccgtgcaggaccagaagggcatcctggacaacctcttcggcctgctcaacggcatgaactgggccgcccgcgcggtgatggccctgatgctcgtggtcgccctgatgctgatcgtcaacaccgtccgcgtctcggcgttcagccggcgccgcgagaccggcatcatgcgcctcgtcggcgcgtcgggcttctacatccaggcgccgttcatcatggaggcggccgtcgccggtctcatcggcggtggtgtcgcctgcggattcctggtgatcgccaggtacttcatcatcgatcacggactcgcgctgtccgagaagctgaacctgatcaacttcatcggctgggacgccgtcctgacgaagctgccgctcatcctggccacgagcctgctgatgcccgcgttggccgcgttcttcgcgttgcgcaagtacctgaaggtgtga

SEQ ID NO: 21659 - protein, 305 aa, Streptomyces coelicolor
MRAQFVVSEIGVGLRRNLTMTFAVIVSVALSLALFGGSLLMSDQVNNMKGYWYDKVNVSVFLCNKSDAESDPNCAKGAVTEDQKKQIMSDLDEMAVVEKVTYESQDEAYKHYKEQFGDSPLASSLTPDQMQESYRIKLQDPEKYQVIATAFDGRDGVQSVQDQKGILDNLFGLLNGMNWAARAVMALMLVVALMLIVNTVRVSAFSRRRETGIMRLVGASGFYIQAPFIMEAAVAGLIGGGVACGFLVIARYFIIDHGLALSEKLNLINFIGWDAVLTKLPLILATSLLMPALAAFFALRKYLKV

SEQ ID NO: 21660 - DNA, 876 bp, Cytophaga johnsonae
  CDS (1)..(876)
atgagttctaactttgataaatttcaaaaacgcaggttaatttcctcttatttttcggtagtattaagtgtcttcttagttttattccttttgggagtactaggattatttatcattaattctaaaaaactggctgacgattttaaagaaaaaatcgctatgacagttttctttaaaaatgaggcaaatgacagtattatcaaagcttttaactctgaattaaaaagagctccttttgctctttcgtatgtttatgtaacaaaagaaaaagctgcaaaagaacatactgatattattggagaagatttcctgacctttttaggagaaaatcctttattgaactcatacgacattcatttaaaagcagattacgttgaacgtgacagcattttaaaaatagaaagtgctttgcgtaaaaacacgatgatcgaagatatcgtgtatgacaaacaattggtgaatctggtaaatgacaatatcaaaaaagttagtatgtggattttaatcataagcggtttccttactgtaatagccgttttattaattaacagttcacttcgtttgtctatacattctaatcgttttattattaaaaccatgcagatggtgggcgcaacaaaatcgtttattcgtaagccttttgtaatgcgaagcgtaaaactgggaatgctgggtgctttattggcaatcatagccttaattggtcttttattttatgtagaaacgaatttccctggtttaggaattttagaagacaaagctttaattggattagtattattggccgttttcggattaggcgttttaattacatgggtaagtacgcattttgcaacacagcgattcctgaatttaagaactgacgatctttattag

SEQ ID NO: 21661 - protein, 291 aa, Cytophaga johnsonae
MSSNFDKFQKRRLISSYFSVVLSVFLVLFLLGVLGLFIINSKKLADDFKEKIAMTVFFKNEANDSIIKAFNSELKRAPFALSYVYVTKEKAAKEHTDIIGEDFLTFLGENPLLNSYDIHLKADYVERDSILKIESALRKNTMIEDIVYDKQLVNLVNDNIKKVSMWILIISGFLTVIAVLLINSSLRLSIHSNRFIIKTMQMVGATKSFIRKPFVMRSVKLGMLGALLAIIALIGLLFYVETNFPGLGILEDKALIGLVLLAVFGLGVLITWVSTHFATQRFLNLRTDDLY

SEQ ID NO: 21662 - DNA, 21 bp, Primer
atgaataagcgcgatgcaatc

SEQ ID NO: 21663 - DNA, 24 bp, Primer
ttattcaggcgtaaagtggcgtaa

SEQ ID NO: 21664 - DNA, 1581 bp, Saccharomyces cerevisiae; identical to SEQ ID NO: 17
  CDS (1)..(1581)

SEQ ID NO: 21665 - protein, 526 aa, Saccharomyces cerevisiae; identical to SEQ ID NO: 18

SEQ ID NO: 21666 - DNA, 1578 bp, Neurospora crassa; identical to SEQ ID NO: 19
  CDS (1)..(1578)

SEQ ID NO: 21667 - protein, 525 aa, Neurospora crassa; identical to SEQ ID NO: 20

SEQ ID NO: 21668 - DNA, 1491 bp, Brucella melitensis; identical to SEQ ID NO: 21
  CDS (1)..(1491)

SEQ ID NO: 21669 - protein, 496 aa, Brucella melitensis; identical to SEQ ID NO: 22

SEQ ID NO: 21670 - DNA, 1497 bp, Agrobacterium tumefaciens; identical to SEQ ID NO: 23
  CDS (1)..(1497)

SEQ ID NO: 21671 - protein, 498 aa, Agrobacterium tumefaciens; identical to SEQ ID NO: 24

SEQ ID NO: 21672 - DNA, 1545 bp, Caulobacter crescentus; identical to SEQ ID NO: 25
  CDS (1)..(1545)

SEQ ID NO: 21673 - protein, 514 aa, Caulobacter crescentus; identical to SEQ ID NO: 26

SEQ ID NO: 21674 - DNA, 1479 bp, Escherichia coli; identical to SEQ ID NO: 27
  CDS (1)..(1479)

SEQ ID NO: 21675 - protein, 492 aa, Escherichia coli; identical to SEQ ID NO: 28

SEQ ID NO: 21676 - DNA, 1476 bp, Halobacterium sp. NRC-1; identical to SEQ ID NO: 29
  CDS (1)..(1476)

SEQ ID NO: 21677 - protein, 491 aa, Halobacterium sp. NRC-1; identical to SEQ ID NO: 30

SEQ ID NO: 21678 - DNA, 1672 bp, Acetobacter aceti; identical to SEQ ID NO: 31
  CDS (61)..(1536)

SEQ ID NO: 21679 - protein, 491 aa, Acetobacter aceti; identical to SEQ ID NO: 32

SEQ ID NO: 21680 - DNA, 1566 bp, Schizosaccharomyces pombe; identical to SEQ ID NO: 33
  CDS (1)..(1566)

SEQ ID NO: 21681 - protein, 521 aa, Schizosaccharomyces pombe; identical to SEQ ID NO: 34

SEQ ID NO: 21682 - DNA, 1857 bp, Clostridium thermosaccharolyticum, Clostridium tartarivorum; identical to SEQ ID NO: 35
  CDS (1)..(1497)

SEQ ID NO: 21683 - protein, 498 aa, Clostridium thermosaccharolyticum, Clostridium tartarivorum; identical to SEQ ID NO: 36

SEQ ID NO: 21684 - DNA, 1494 bp, Pseudomonas aeruginosa; identical to SEQ ID NO: 37
  CDS (1)..(1494)

SEQ ID NO: 21685 - protein, 497 aa, Pseudomonas aeruginosa; identical to SEQ ID NO: 38

SEQ ID NO: 21686 - DNA, 1912 bp, Porphyromonas gingivalis; identical to SEQ ID NO: 39
  CDS (136)..(1431)

SEQ ID NO: 21687 - protein, 431 aa, Porphyromonas gingivalis; identical to SEQ ID NO: 40

SEQ ID NO: 21688 - DNA, 1497 bp, Porphyromonas gingivalis; identical to SEQ ID NO: 41
  CDS (1)..(1497)

SEQ ID NO: 21689 - protein, 498 aa, Porphyromonas gingivalis; identical to SEQ ID NO: 42

SEQ ID NO: 21690 - DNA, 1296 bp, Porphyromonas gingivalis; identical to SEQ ID NO: 43
  CDS (1)..(1296)

SEQ ID NO: 21691 - protein, 431 aa, Porphyromonas gingivalis; identical to SEQ ID NO: 44

SEQ ID NO: 21692 - DNA, 1317 bp, Mycoplasma gallisepticum; identical to SEQ ID NO: 45
  CDS (1)..(1317)

SEQ ID NO: 21693 - protein, 438 aa, Mycoplasma gallisepticum; identical to SEQ ID NO: 46

SEQ ID NO: 21694 - DNA, 1578 bp, Neurospora crassa; identical to SEQ ID NO: 47
  CDS (1)..(1578)

SEQ ID NO: 21695 - protein, 525 aa, Neurospora crassa; identical to SEQ ID NO: 48

SEQ ID NO: 21696 - DNA, 1533 bp, Bordetella pertussis; identical to SEQ ID NO: 49
  CDS (1)..(1533)

SEQ ID NO: 21697 - protein, 510 aa, Bordetella pertussis; identical to SEQ ID NO: 50

SEQ ID NO: 21698 - DNA, 1515 bp, Bacillus cereus; identical to SEQ ID NO: 51
  CDS (1)..(1515)

SEQ ID NO: 21699 - protein, 504 aa, Bacillus cereus; identical to SEQ ID NO: 52

SEQ ID NO: 21700 - DNA, 1515 bp, Bacillus anthracis; identical to SEQ ID NO: 53
  CDS (1)..(1515)

SEQ ID NO: 21701 - protein, 504 aa, Bacillus anthracis; identical to SEQ ID NO: 54

SEQ ID NO: 21702 - DNA, 1494 bp, Pseudomonas syringae; identical to SEQ ID NO: 55
  CDS (1)..(1494)

SEQ ID NO: 21703 - protein, 497 aa, Pseudomonas syringae; identical to SEQ ID NO: 56

SEQ ID NO: 21704 - DNA, 1494 bp, Pseudomonas putida; identical to SEQ ID NO: 57
  CDS (1)..(1494)

SEQ ID NO: 21705 - protein, 497 aa, Pseudomonas putida; identical to SEQ ID NO: 58

SEQ ID NO: 21706 - DNA, 1314 bp, Clostridium tetani; identical to SEQ ID NO: 59
  CDS (1)..(1314)

SEQ ID NO: 21707 - protein, 437 aa, Clostridium tetani; identical to SEQ ID NO: 60

SEQ ID NO: 21708 - DNA, 1500 bp, Bacteroides thetaiotaomicron; identical to SEQ ID NO: 61
  CDS (1)..(1500)

SEQ ID NO: 21709 - protein, 499 aa, Bacteroides thetaiotaomicron; identical to SEQ ID NO: 62

SEQ ID NO: 21710 - DNA, 1287 bp, Shewanella oneidensis; identical to SEQ ID NO: 63
  CDS (1)..(1287)

SEQ ID NO: 21711 - protein, 428 aa, Shewanella oneidensis; identical to SEQ ID NO: 64

SEQ ID NO: 21712 - DNA, 1515 bp, Oceanobacillus iheyensis; identical to SEQ ID NO: 65
  CDS (1)..(1515)

SEQ ID NO: 21713 - protein, 504 aa, Oceanobacillus iheyensis; identical to SEQ ID NO: 66

SEQ ID NO: 21714 - DNA, 1524 bp, Corynebacterium efficiens; identical to SEQ ID NO: 67
  CDS (1)..(1524)

SEQ ID NO: 21715 - protein, 507 aa, Corynebacterium efficiens; identical to SEQ ID NO: 68

SEQ ID NO: 21716 - DNA, 1509 bp, Corynebacterium efficiens; identical to SEQ ID NO: 69
  CDS (1)..(1509)

SEQ ID NO: 21717 - protein, 502 aa, Corynebacterium efficiens; identical to SEQ ID NO: 70

SEQ ID NO: 21718 - DNA, 1515 bp, Xanthomonas campestris; identical to SEQ ID NO: 71
  CDS (1)..(1515)

SEQ ID NO: 21719 - protein, 504 aa, Xanthomonas campestris; identical to SEQ ID NO: 72

SEQ ID NO: 21720 - DNA, 1617 bp, Clostridium kluyveri; identical to SEQ ID NO: 73
  CDS (1)..(1617)

SEQ ID NO: 21721 - protein, 538 aa, Clostridium kluyveri; identical to SEQ ID NO: 74

SEQ ID NO: 21722 - DNA, 1563 bp, Geobacter sulfurreducens; identical to SEQ ID NO: 75
  CDS (1)..(1563)

SEQ ID NO: 21723 - protein, 520 aa, Geobacter sulfurreducens; identical to SEQ ID NO: 76

SEQ ID NO: 21724 - DNA, 1596 bp, Geobacter sulfurreducens; identical to SEQ ID NO: 77
  CDS (1)..(1596)

SEQ ID NO: 21725 - protein, 531 aa, Geobacter sulfurreducens; identical to SEQ ID NO: 78

SEQ ID NO: 21726 - DNA, 1515 bp, Bacillus cereus; identical to SEQ ID NO: 79
  CDS (1)..(1515)

SEQ ID NO: 21727 - protein, 504 aa, Bacillus cereus; identical to SEQ ID NO: 80

SEQ ID NO: 21728 - DNA, 1971 bp, Ashbya gossypii; identical to SEQ ID NO: 4398
  CDS (1)..(1971)

SEQ ID NO: 21729 - protein, 656 aa, Ashbya gossypii; identical to SEQ ID NO: 4399

SEQ ID NO: 21730 - DNA, 1290 bp, Leptospira interrogans; identical to SEQ ID NO: 4400
  CDS (1)..(1290)

SEQ ID NO: 21731 - protein, 429 aa, Leptospira interrogans; identical to SEQ ID NO: 4401

SEQ ID NO: 21732 - DNA, 1335 bp, Thermus thermophilus; identical to SEQ ID NO: 4402
  CDS (1)..(1335)

SEQ ID NO: 21733 - protein, 444 aa, Thermus thermophilus; identical to SEQ ID NO: 4403

SEQ ID NO: 21734 - DNA, 1560 bp, Rhodopseudomonas palustris; identical to SEQ ID NO: 4404
  CDS (1)..(1560)

SEQ ID NO: 21735 - protein, 519 aa, Rhodopseudomonas palustris; identical to SEQ ID NO: 4405

SEQ ID NO: 21736 - DNA, 1554 bp, Corynebacterium diphtheriae; identical to SEQ ID NO: 4406
  CDS (1)..(1554)

SEQ ID NO: 21737 - protein, 517 aa, Corynebacterium diphtheriae; identical to SEQ ID NO: 4407

SEQ ID NO: 21738 - DNA, 1488 bp, Bdellovibrio bacteriovorus; identical to SEQ ID NO: 4408
  CDS (1)..(1488)

SEQ ID NO: 21739 - protein, 495 aa, Bdellovibrio bacteriovorus; identical to SEQ ID NO: 4409

SEQ ID NO: 21740 - DNA, 1509 bp, Corynebacterium glutamicum; identical to SEQ ID NO: 4410
  CDS (1)..(1509)

SEQ ID NO: 21741 - protein, 502 aa, Corynebacterium glutamicum; identical to SEQ ID NO: 4411

SEQ ID NO: 21742 - DNA, 27 bp, Primer
atgacaatttctaatttgttaaagcag

SEQ ID NO: 21743 - DNA, 23 bp, Primer
ctagtcaactggttcccagctgt

SEQ ID NO: 21744 - DNA, 840 bp, Saccharomyces cerevisiae; identical to SEQ ID NO: 899
  CDS (1)..(840)

SEQ ID NO: 21745 - protein, 279 aa, Saccharomyces cerevisiae; identical to SEQ ID NO: 900

SEQ ID NO: 21746 - DNA, 840 bp, Saccharomyces cerevisiae; identical to SEQ ID NO: 901
  CDS (1)..(840)

SEQ ID NO: 21747 - protein, 279 aa, Saccharomyces cerevisiae; identical to SEQ ID NO: 902

SEQ ID NO: 21748 - DNA, 915 bp, Saccharomyces cerevisiae; identical to SEQ ID NO: 903
  CDS (1)..(915)

SEQ ID NO: 21749 - protein, 304 aa, Saccharomyces cerevisiae; identical to SEQ ID NO: 904

SEQ ID NO: 21750 - DNA, 1182 bp, Neurospora crassa; identical to SEQ ID NO: 905
  CDS (1)..(1182)

SEQ ID NO: 21751 - protein, 393 aa, Neurospora crassa; identical to SEQ ID NO: 906

SEQ ID NO: 21752 - DNA, 1263 bp, Emericella nidulans (Aspergillus nidulans); identical to SEQ ID NO: 907
  CDS (1)..(1263)

SEQ ID NO: 21753 - protein, 420 aa, Emericella nidulans (Aspergillus nidulans); identical to SEQ ID NO: 908

SEQ ID NO: 21754 - DNA, 927 bp, Saccharomyces cerevisiae (Baker's yeast); identical to SEQ ID NO: 909
  CDS (1)..(927)

SEQ ID NO: 21755 - protein, 308 aa, Saccharomyces cerevisiae (Baker's yeast); identical to SEQ ID NO: 910

SEQ ID NO: 21756 - DNA, 24 bp, Primer
atgtcaaactacgaagccttgctg

SEQ ID NO: 21757 - DNA, 24 bp, Primer
tcacagggcgcgctttactaaaat

SEQ ID NO: 21758 - DNA, 426 bp, Saccharomyces cerevisiae; identical to SEQ ID NO: 4170
  CDS (1)..(426)

SEQ ID NO: 21759 - protein, 141 aa, Saccharomyces cerevisiae; identical to SEQ ID NO: 4171

SEQ ID NO: 21760 - DNA, 23 bp, Primer
atgaaatgtcacgcgaaacggac

SEQ ID NO: 21761 - DNA, 23 bp, Primer
ctaggaaaggaggtggttacgaa

SEQ ID NO: 21762 - DNA, 210 bp, Saccharomyces cerevisiae
  CDS (1)..(210)
atgactgaaactgacaagaaacaagaacaagaaaaccacgcggagtgcgaggacaaacctaagccatgttgcgtttgtaagccagaaaaggaggagcgggatacatgcatcttattcaatggacaagactctgaaaaatgcaaggaattcattgaaaagtacaaagagtgcatgaagggttatggcttcgaagttccaagtgcaaattag

SEQ ID NO: 21763 - protein, 69 aa, Saccharomyces cerevisiae
MTETDKKQEQENHAECEDKPKPCCVCKPEKEERDTCILFNGQDSEKCKEFIEKYKECMKGYGFEVPSAN

SEQ ID NO: 21764 - DNA, 192 bp, Caenorhabditis elegans
  CDS (1)..(192)
atgccagcagagccacaaaaatccacagaagccggcagcgtggcaccggagaagaagctgaaagcgtgctgcgcgtgtcctgaaacgaaacgagtccgtgacgcttgcatcatcgaaaacggcgaggagaagtgcggaaaactgatcgaagcccataaagcctgcatgcgagccgccggatttaatatttaa

SEQ ID NO: 21765 - protein, 63 aa, Caenorhabditis elegans
MPAEPQKSTEAGSVAPEKKLKACCACPETKRVRDACIIENGEEKCGKLIEAHKACMRAAGFNI

SEQ ID NO: 21766 - DNA, 168 bp, Candida glabrata
  CDS (1)..(168)
atgtctgaaccacagaaagaagataaaccaaagccatgctgtgtctgtcttcctgagaaggaagctagagaccagtgcttgctatttgatggccaagaatctgcaaagtgcaaagaactgattgagaagtacaagagttgcatgaagacctacgggtttaacatctag

SEQ ID NO: 21767 - protein, 55 aa, Candida glabrata
MSEPQKEDKPKPCCVCLPEKEARDQCLLFDGQESAKCKELIEKYKSCMKTYGFNI

SEQ ID NO: 21768 - DNA, 240 bp, Oryza sativa
  CDS (1)..(240)
atgggtagcacagaacacccaattcctgcgcagtcacctgcttgcccaactgtgagcgaaggggggtcggctgctccagctcctgctactgattcaaagccaaagaagaagatatgctgtgcgtgccctgatacgaagaggctgagagacgagtgcatcgtcgagcatggggaatctgcgtgcaccaagtggatcgaagctcacaagcggtgcctccgagctgagggttttaatgtctga

SEQ ID NO: 21769 - protein, 79 aa, Oryza sativa
MGSTEHPIPAQSPACPTVSEGGSAAPAPATDSKPKKKICCACPDTKRLRDECIVEHGESACTKWIEAHKRCLRAEGFNV

SEQ ID NO: 21770 - DNA, 366 bp, Podospora anserina
  CDS (2)..(244)
aatgtcctccgcccaagctaccgccagctcaatcgcctccagcgccccggttgcgccggtgatcacccagtcagctgctgctgctgctgctgacaagcccaagccctgctgcgtgtgcaaagacgaaaaggccaagcgcgacgagtgcatgctcttctccaaggctgccgacccacaaaaggactgcttgtcgaccattgatcagtataggagttgtatggctgggtttggattcaaggtttaggagcaggaggaagggagaggatggggaagtgtataatatggttacgatatgggattgaaatggatggactgggggaatgaatgaataccagaggcgttctaaattgaggtttaaagatgggg

SEQ ID NO: 21771 - protein, 80 aa, Podospora anserina
MSSAQATASSIASSAPVAPVITQSAAAAAADKPKPCCVCKDEKAKRDECMLFSKAADPQKDCLSTIDQYRSCMAGFGFKV

SEQ ID NO: 21772 - DNA, 195 bp, Ashbya gossypii
  CDS (1)..(195)
atgcctgaatcctcttctgtgccaggtgtttcacaaggtagtagtaccgacaagccaaagccatgctgtgtgtgcaagcccgagaaggaagcgagagacagctgtctgctgttcaacggcgtggatgcggtcaagtgccaggaactggtgcaaaagtacaaggactgcatgaaaggctacggctttgaggtgtaa

SEQ ID NO: 21773 - protein, 64 aa, Ashbya gossypii
MPESSSVPGVSQGSSTDKPKPCCVCKPEKEARDSCLLFNGVDAVKCQELVQKYKDCMKGYGFEV

SEQ ID NO: 21774 - DNA, 229 bp, Rattus norvegicus
  CDS (38)..(229)
tgcgcgtgtgcgatcgttactgctttcctctggaaagatgccgggactggctgccgctagccctgccccgcccgaggctcaggagaagaagcctctgaagccctgctgtgcctgcccggagaccaagaaggcgcgtgatgcgtgcatcattgagaaaggagaagaacactgtggacatctcatcgaggcccacaaggagtgcatgagagcgctgggatttaagatatga

SEQ ID NO: 21775 - protein, 63 aa, Rattus norvegicus
MPGLAAASPAPPEAQEKKPLKPCCACPETKKARDACIIEKGEEHCGHLIEAHKECMRALGFKI

SEQ ID NO: 21776 - DNA, 201 bp, Plasmodium yoelii yoelii
  CDS (1)..(201)
atgggattaggtttaactaagccattaaatacaactgaggaaagtaaaacgtgtgcaaaaaaaaagaaaatatgttgtgtatgcttagatacaaaaaaattaagagatgaatgtattgttaatttaggagaagaacaatgtaagaaatatattaatgatcataatcagtgcctaagaaatgaagggtttgatatcaaataa

SEQ ID NO: 21777 - protein, 66 aa, Plasmodium yoelii yoelii
MGLGLTKPLNTTEESKTCAKKKKICCVCLDTKKLRDECIVNLGEEQCKKYINDHNQCLRNEGFDIK

SEQ ID NO: 21778 - DNA, 237 bp, Neurospora crassa
  CDS (1)..(237)
atggcctcccaaagcttttcccttaccgcccttccttccgctgccgctccggcgcaaattgcgaccccttccagtgatgctcccgcgaagcccaagccctgctgcgtgtgcaaagaagagaaggccaagcgcgatgattgcatgcttttctccaagtccgatgacccccagaaggactgcgtgtcgacgatagaccagtaccgcgcttgcatggctggtttcggcttcaaggtctaa

SEQ ID NO: 21779 - protein, 78 aa, Neurospora crassa
MASQSFSLTALPSAAAPAQIATPSSDAPAKPKPCCVCKEEKAKRDDCMLFSKSDDPQKDCVSTIDQYRACMAGFGFKV

SEQ ID NO: 21780 - DNA, 323 bp, Schistosoma japonicum
  CDS (61)..(267)
atttagggcgggaatatatggtgtactaccatccagtcaggaagggactggacatgctcaatgtcatcaagcacgcaaaatatgtccagtcagcatgttaaaaaggtactcttagatgatcaagacaaacctttaaaaccctgctgtgcatgtccggaaacgcgtctcaagcgtgaccagtgcattctaatgcacggcgaagaaatgtgtgctgatctgatcatggaacataaagaatgtttacgaaagcttggttttacaatgtagtgtaataagatctcttgaaatacaattagttcctcaaaaaaaaaaaaaaaaaaaaa

SEQ ID NO: 21781 - protein, 68 aa, Schistosoma japonicum
MSSSTQNMSSQHVKKVLLDDQDKPLKPCCACPETRLKRDQCILMHGEEMCADLIMEHKECLRKLGFTM

SEQ ID NO: 21782 - DNA, 204 bp, Plasmodium falciparum
  CDS (1)..(204)
atgggtatgagcttgaacaaaccaataaataacacgaatgaagcaaataaaggagaagttaaaaaaaaaaaaatttgttgtgtttgtttagaaaccaaaaagttaagagatgaatgtattgttaaattgggggaagagcagtgtaagaaatttatcgatgatcataataaatgtttaaggagtgaaggttttgatattaaatag

SEQ ID NO: 21783 - protein, 67 aa, Plasmodium falciparum
MGMSLNKPINNTNEANKGEVKKKKICCVCLETKKLRDECIVKLGEEQCKKFIDDHNKCLRSEGFDIK

SEQ ID NO: 21784 - DNA, 225 bp, Arabidopsis thaliana
  CDS (1)..(225)
atgactgatcagccagcacaaaatggattgattcctccacccacttcagagccaagcaaggctgctgcctcagcagagacgaaaccaaagaagaggatatgttgtgcttgccctgataccaagaagctgagagatgagtgcattgtcgagcatggtgaatcggcttgcactaaatggatcgaggctcataaaatttgtctccgagcagaaggtttcaacgtctga

SEQ ID NO: 21785 - protein, 74 aa, Arabidopsis thaliana
MTDQPAQNGLIPPPTSEPSKAAASAETKPKKRICCACPDTKKLRDECIVEHGESACTKWIEAHKICLRAEGFNV

SEQ ID NO: 21786 - DNA, 459 bp, Chlamydomonas reinhardtii
  CDS (172)..(417)
ccacatacttcacataccccggcactaatacaacaattcttcatacacagcgaccataattacctgccatcgcgctggcgtccggtacataatcgcgaccatcaacatatccaatccgataccttcgctctctagccgtgcgcgcgtgcgcagtcggcaaagccctttgatatgggcgcatcaggctccaagccggagggtgccggccctggcccggcgcttccgacaccgtcacccgctccccccggtgtacccattggccccgacggcaagcccaagaagatttgctgcagctgccctgacaccaagaagctccgggacacctgcatcgctgagcgcggcgaggagcacgcctactgccaagcgctgatcgaggcgcacaaggcgtgcctgcgggtggaggggttcaaggtgtgaggggctgcggcggctcacggcgcggcgcctcaccgcgtcagc

SEQ ID NO: 21787 - protein, 81 aa, Chlamydomonas reinhardtii
MGASGSKPEGAGPGPALPTPSPAPPGVPIGPDGKPKKICCSCPDTKKLRDTCIAERGEEHAYCQALIEAHKACLRVEGFKV

SEQ ID NO: 21788 - DNA, 213 bp, Schizosaccharomyces pombe
  CDS (1)..(213)
atgtcgtcgtctactgaacctagcactgctacgaaggtttctgagccagctcctattgcttctgaagaaaagccaaagccttgttgcgcttgtcctgagaccaaacaagctcgcgacgcgtgcatgttacagtcttcaaatggtcctatagagtgcgcgaaactcattgaggcgcataaaaaatgtatggctcaatacggttacgaggtataa

SEQ ID NO: 21789 - protein, 70 aa, Schizosaccharomyces pombe
MSSSTEPSTATKVSEPAPIASEEKPKPCCACPETKQARDACMLQSSNGPIECAKLIEAHKKCMAQYGYEV

SEQ ID NO: 21790 - DNA, 488 bp, Drosophila melanogaster
  CDS (59)..(325)
accgaattgtggtgaaatatccgtctcgaaccgcttttgaccgatacccgattgaagaatgggcaacagtgcatctcaaggagttgcagctccaagtgtttcggcggcccacccgttgaccaccgcatccgcagccaccgcatccacaaccaccgcatccgcagccaccgcatccggcgagaagcccaagtgcaaggcctgttgcgcctgcccggagaccaagagggcacgtgacgcctgcattgtggagaacggcgaggagaattgcttggcgctgatagaggcgcacaagaagtgcatgcgcgatgccggcttcaatatctagatataccgacacatcctgggatgaggacaccaggattataggataacactagtcctgcacacactccccccagtgccactcctcggatccccagccccttcaactgtttgtttttgttgcatctcaagctaattatagaactaaattaattaaaaaaaaaaaa

SEQ ID NO: 21791 - protein, 88 aa, Drosophila melanogaster
MGNSASQGVAAPSVSAAHPLTTASAATASTTTASAATASGEKPKCKACCACPETKRARDACIVENGEENCLALIEAHKKCMRDAGFNI

SEQ ID NO: 21792 - DNA, 25 bp, Primer
atgactgaaactgacaagaaacaag

SEQ ID NO: 21793 - DNA, 25 bp, Primer
ctaatttgcacttggaacttcgaag

SEQ ID NO: 21794 - DNA, 1980 bp, Saccharomyces cerevisiae; identical to SEQ ID NO: 13
  CDS (1)..(1980)

SEQ ID NO: 21795 - protein, 659 aa, Saccharomyces cerevisiae; identical to SEQ ID NO: 14

SEQ ID NO: 21796 - DNA, 26 bp, Primer
atggatagtacgaatttgaacaaacg

SEQ ID NO: 21797 - DNA, 26 bp, Primer
ttagagtatttccagatctgaatctg

SEQ ID NO: 21798 - DNA, 2577 bp, Saccharomyces cerevisiae; identical to SEQ ID NO: 81
  CDS (1)..(2577)

SEQ ID NO: 21799 - protein, 858 aa, Saccharomyces cerevisiae; identical to SEQ ID NO: 82

SEQ ID NO: 21800 - DNA, 1065 bp, Geobacter sulfurreducens; identical to SEQ ID NO: 4186
  CDS (1)..(1065)

SEQ ID NO: 21801 - protein, 354 aa, Geobacter sulfurreducens; identical to SEQ ID NO: 170

SEQ ID NO: 21802 - DNA, 1143 bp, Nostoc sp. PCC 7120; identical to SEQ ID NO: 103
  CDS (1)..(1143)

SEQ ID NO: 21803 - protein, 380 aa, Nostoc sp. PCC 7120; identical to SEQ ID NO: 104

SEQ ID NO: 21804 - DNA, 1056 bp, Archaeoglobus fulgidus; identical to SEQ ID NO: 4190
  CDS (1)..(1056)

SEQ ID NO: 21805 - protein, 351 aa, Archaeoglobus fulgidus; identical to SEQ ID NO: 94

SEQ ID NO: 21806 - DNA, 969 bp, Caulobacter crescentus; identical to SEQ ID NO: 4192
  CDS (1)..(969)

SEQ ID NO: 21807 - protein, 322 aa, Caulobacter crescentus; identical to SEQ ID NO: 106

SEQ ID NO: 21808 - DNA, 3525 bp, Candida albicans; identical to SEQ ID NO: 4194
  CDS (338)..(3106): n means a or g or c or t/u

SEQ ID NO: 21809 - protein, 922 aa, Candida albicans; identical to SEQ ID NO: 4195

SEQ ID NO: 21810 - DNA, 1041 bp, Streptomyces coelicolor; identical to SEQ ID NO: 4196
  CDS (1)..(1041)

SEQ ID NO: 21811 - protein, 346 aa, Streptomyces coelicolor; identical to SEQ ID NO: 4197

SEQ ID NO: 21812 - DNA, 1128 bp, Deinococcus radiodurans; identical to SEQ ID NO: 4198
  CDS (1)..(1128)

SEQ ID NO: 21813 - protein, 375 aa, Deinococcus radiodurans; identical to SEQ ID NO: 100

SEQ ID NO: 21814 - DNA, 1065 bp, Clostridium acetobutylicum; identical to SEQ ID NO: 101
  CDS (1)..(1065)

SEQ ID NO: 21815 - protein, 354 aa, Clostridium acetobutylicum; identical to SEQ ID NO: 102

SEQ ID NO: 21816 - DNA, 954 bp, Methanococcus jannaschii; identical to SEQ ID NO: 4202
  CDS (1)..(954)

SEQ ID NO: 21817 - protein, 317 aa, Methanococcus jannaschii; identical to SEQ ID NO: 86

SEQ ID NO: 21818 - DNA, 960 bp, Bacillus subtilis; identical to SEQ ID NO: 4204
  CDS (1)..(960)

SEQ ID NO: 21819 - protein, 319 aa, Bacillus subtilis; identical to SEQ ID NO: 92

SEQ ID NO: 21820 - DNA, 1056 bp, Thermotoga maritima; identical to SEQ ID NO: 4206
  CDS (1)..(1056)

SEQ ID NO: 21821 - protein, 351 aa, Thermotoga maritima; identical to SEQ ID NO: 96

SEQ ID NO: 21822 - DNA, 1854 bp, Schizosaccharomyces pombe; identical to SEQ ID NO: 4208
  CDS (1)..(1854)

SEQ ID NO: 21823 - protein, 617 aa, Schizosaccharomyces pombe; identical to SEQ ID NO: 4209

SEQ ID NO: 21824 - DNA, 1158 bp, Gloeobacter violaceus; identical to SEQ ID NO: 4210
  CDS (1)..(1158)

SEQ ID NO: 21825 - protein, 385 aa, Gloeobacter violaceus; identical to SEQ ID NO: 168

SEQ ID NO: 21826 - DNA, 1038 bp, Chromobacterium violaceum; identical to SEQ ID NO: 165
  CDS (1)..(1038)

SEQ ID NO: 21827 - protein, 345 aa, Chromobacterium violaceum; identical to SEQ ID NO: 166

SEQ ID NO: 21828 - DNA, 2100 bp, Neurospora crassa; identical to SEQ ID NO: 4214
  CDS (1)..(2100)

SEQ ID NO: 21829 - protein, 699 aa, Neurospora crassa; identical to SEQ ID NO: 126

SEQ ID NO: 21830 - DNA, 2469 bp, Neurospora crassa; identical to SEQ ID NO: 123
  CDS (1)..(2469)

SEQ ID NO: 21831 - protein, 822 aa, Neurospora crassa; identical to SEQ ID NO: 124

SEQ ID NO: 21832 - DNA, 1101 bp, Mycobacterium bovis; identical to SEQ ID NO: 4218
  CDS (1)..(1101)

SEQ ID NO: 21833 - protein, 366 aa, Mycobacterium bovis; identical to SEQ ID NO: 164

SEQ ID NO: 21834 - DNA, 1098 bp, Rhodopirellula baltica; identical to SEQ ID NO: 4220
  CDS (1)..(1098)

SEQ ID NO: 21835 - protein, 365 aa, Rhodopirellula baltica; identical to SEQ ID NO: 162

SEQ ID NO: 21836 - DNA, 1011 bp, uncultured Acidobacteria bacterium; identical to SEQ ID NO: 4222
  CDS (1)..(1011)

SEQ ID NO: 21837 - protein, 336 aa, uncultured Acidobacteria bacterium; identical to SEQ ID NO: 130

SEQ ID NO: 21838 - DNA, 951 bp, Bacillus cereus; identical to SEQ ID NO: 159
  CDS (1)..(951)

SEQ ID NO: 21839 - protein, 316 aa, Bacillus cereus; identical to SEQ ID NO: 160

SEQ ID NO: 21840 - DNA, 963 bp, Bacillus anthracis; identical to SEQ ID NO: 157
  CDS (1)..(963)

SEQ ID NO: 21841 - protein, 320 aa, Bacillus anthracis; identical to SEQ ID NO: 158

SEQ ID NO: 21842 - DNA, 1032 bp, Streptomyces avermitilis; identical to SEQ ID NO: 4228
  CDS (1)..(1032)

SEQ ID NO: 21843 - protein, 343 aa, Streptomyces avermitilis; identical to SEQ ID NO: 156

SEQ ID NO: 21844 - DNA, 1065 bp, Streptomyces avermitilis; identical to SEQ ID NO: 115
  CDS (1)..(1065)

SEQ ID NO: 21845 - protein, 354 aa, Streptomyces avermitilis; identical to SEQ ID NO: 116

SEQ ID NO: 21846 - DNA, 1116 bp, Streptomyces avermitilis; identical to SEQ ID NO: 4232
  CDS (1)..(1116)

SEQ ID NO: 21847 - protein, 371 aa, Streptomyces avermitilis; identical to SEQ ID NO: 152

SEQ ID NO: 21848 - DNA, 1161 bp, Streptomyces avermitilis; identical to SEQ ID NO: 4234
  CDS (1)..(1161)

SEQ ID NO: 21849 - protein, 386 aa, Streptomyces avermitilis; identical to SEQ ID NO: 150

SEQ ID NO: 21850 - DNA, 972 bp, Pseudomonas syringae; identical to SEQ ID NO: 4236
  CDS (1)..(972)

SEQ ID NO: 21851 - protein, 323 aa, Pseudomonas syringae; identical to SEQ ID NO: 148

SEQ ID NO: 21852 - DNA, 972 bp, Pseudomonas putida; identical to SEQ ID NO: 4238
  CDS (1)..(972)

SEQ ID NO: 21853 - protein, 323 aa, Pseudomonas putida; identical to SEQ ID NO: 146

SEQ ID NO: 21854 - DNA, 1020 bp, Leptospira interrogans; identical to SEQ ID NO: 143
  CDS (1)..(1020)

SEQ ID NO: 21855 - protein, 339 aa, Leptospira interrogans; identical to SEQ ID NO: 144

SEQ ID NO: 21856 - DNA, 828 bp, Chlorobium tepidum; identical to SEQ ID NO: 139
  CDS (1)..(828)

SEQ ID NO: 21857 - protein, 275 aa, Chlorobium tepidum; identical to SEQ ID NO: 140

SEQ ID NO: 21858 - DNA, 1071 bp, Methanosarcina mazei; identical to SEQ ID NO: 119
  CDS (1)..(1071)

SEQ ID NO: 21859 - protein, 356 aa, Methanosarcina mazei; identical to SEQ ID NO: 120

SEQ ID NO: 21860 - DNA, 1056 bp, Fusobacterium nucleatum; identical to SEQ ID NO: 137
  CDS (1)..(1056)

SEQ ID NO: 21861 - protein, 351 aa, Fusobacterium nucleatum; identical to SEQ ID NO: 138

SEQ ID NO: 21862 - DNA, 1065 bp, Legionella pneumophila; identical to SEQ ID NO: 127
  CDS (1)..(1065)

SEQ ID NO: 21863 - protein, 354 aa, Legionella pneumophila; identical to SEQ ID NO: 128

SEQ ID NO: 21864 - DNA, 1071 bp, Methanosarcina acetivorans; identical to SEQ ID NO: 117
  CDS (1)..(1071)

SEQ ID NO: 21865 - protein, 356 aa, Methanosarcina acetivorans; identical to SEQ ID NO: 118

SEQ ID NO: 21866 - DNA, 972 bp, Ralstonia solanacearum; identical to SEQ ID NO: 4252
  CDS (1)..(972)

SEQ ID NO: 21867 - protein, 323 aa, Ralstonia solanacearum; identical to SEQ ID NO: 136

SEQ ID NO: 21868 - DNA, 1008 bp, Rhizobium loti; identical to SEQ ID NO: 4254
  CDS (1)..(1008)

SEQ ID NO: 21869 - protein, 335 aa, Rhizobium loti; identical to SEQ ID NO: 134

SEQ ID NO: 21870 - DNA, 1095 bp, Rhizobium loti; identical to SEQ ID NO: 4256
  CDS (1)..(1095)

SEQ ID NO: 21871 - protein, 364 aa, Rhizobium loti; identical to SEQ ID NO: 132

SEQ ID NO: 21872 - DNA, 1116 bp, Streptomyces coelicolor; identical to SEQ ID NO: 4258
  CDS (1)..(1116)

SEQ ID NO: 21873 - protein, 371 aa, Streptomyces coelicolor; identical to SEQ ID NO: 142

SEQ ID NO: 21874 - DNA, 2910 bp, Saccharomyces cerevisiae; identical to SEQ ID NO: 109
  CDS (1)..(2910)

SEQ ID NO: 21875 - protein, 969 aa, Saccharomyces cerevisiae; identical to SEQ ID NO: 110

SEQ ID NO: 21876 - DNA, 2580 bp, Saccharomyces cerevisiae; identical to SEQ ID NO: 4262
  CDS (1)..(2580)

SEQ ID NO: 21877 - protein, 859 aa, Saccharomyces cerevisiae; identical to SEQ ID NO: 4263

SEQ ID NO: 21878 - DNA, 1164 bp, Synechocystis sp; identical to SEQ ID NO: 4264
  CDS (1)..(1164)

SEQ ID NO: 21879 - protein, 387 aa, Synechocystis sp; identical to SEQ ID NO: 88

SEQ ID NO: 21880 - DNA, 1143 bp, Synechocystis sp; identical to SEQ ID NO: 89
  CDS (1)..(1143)

SEQ ID NO: 21881 - protein, 380 aa, Synechocystis sp; identical to SEQ ID NO: 90

SEQ ID NO: 21882 - DNA, 2412 bp, Schizosaccharomyces pombe; identical to SEQ ID NO: 107
  CDS (1)..(2412)

SEQ ID NO: 21883 - protein, 803 aa, Schizosaccharomyces pombe; identical to SEQ ID NO: 108

SEQ ID NO: 21884 - DNA, 1122 bp, Mycobacterium leprae; identical to SEQ ID NO: 4270
  CDS (1)..(1122)

SEQ ID NO: 21885 - protein, 373 aa, Mycobacterium leprae; identical to SEQ ID NO: 98

SEQ ID NO: 21886 - DNA, 25 bp, Primer
atgtcgtccttatccacttcatttg

SEQ ID NO: 21887 - DNA, 26 bp, Primer
ttaattgtaacggctatatctactgg

SEQ ID NO: 21888 - DNA, 1041 bp, Saccharomyces cerevisiae; identical to SEQ ID NO: 951
  CDS (1)..(1041)

SEQ ID NO: 21889 - protein, 346 aa, Saccharomyces cerevisiae; identical to SEQ ID NO: 952

SEQ ID NO: 21890 - DNA, 672 bp, Nostoc sp. PCC 7120; identical to SEQ ID NO: 953
  CDS (1)..(672)

SEQ ID NO: 21891 - protein, 223 aa, Nostoc sp. PCC 7120; identical to SEQ ID NO: 954

SEQ ID NO: 21892 - DNA, 720 bp, Nostoc sp. PCC 7120; identical to SEQ ID NO: 955
  CDS (1)..(720)

SEQ ID NO: 21893 - protein, 239 aa, Nostoc sp. PCC 7120; identical to SEQ ID NO: 956

SEQ ID NO: 21894 - DNA, 774 bp, Agrobacterium tumefaciens; identical to SEQ ID NO: 957
  CDS (1)..(774)

SEQ ID NO: 21895 - protein, 257 aa, Agrobacterium tumefaciens; identical to SEQ ID NO: 958

SEQ ID NO: 21896 - DNA, 993 bp, Archaeoglobus fulgidus; identical to SEQ ID NO: 959
  CDS (1)..(993)

SEQ ID NO: 21897 - protein, 330 aa, Archaeoglobus fulgidus; identical to SEQ ID NO: 960

SEQ ID NO: 21898 - DNA, 1011 bp, Arabidopsis thaliana (mouse-ear cress); identical to SEQ ID NO: 961
  CDS (1)..(1011)

SEQ ID NO: 21899 - protein, 336 aa, Arabidopsis thaliana (mouse-ear cress); identical to SEQ ID NO: 962

SEQ ID NO: 21900 - DNA, 894 bp, Streptomyces coelicolor; identical to SEQ ID NO: 963
  CDS (1)..(894)

SEQ ID NO: 21901 - protein, 297 aa, Streptomyces coelicolor; identical to SEQ ID NO: 964

SEQ ID NO: 21902 - DNA, 897 bp, Schizosaccharomyces pombe; identical to SEQ ID NO: 965
  CDS (1)..(897)

SEQ ID NO: 21903 - protein, 298 aa, Schizosaccharomyces pombe; identical to SEQ ID NO: 966

SEQ ID NO: 21904 - DNA, 1038 bp, Homo sapiens (Human); identical to SEQ ID NO: 967
  CDS (1)..(1038)

SEQ ID NO: 21905 - protein, 345 aa, Homo sapiens (Human); identical to SEQ ID NO: 968

SEQ ID NO: 21906 - DNA, 1764 bp, Neurospora crassa; identical to SEQ ID NO: 969
  CDS (1)..(1764)

SEQ ID NO: 21907 - protein, 587 aa, Neurospora crassa; identical to SEQ ID NO: 970

SEQ ID NO: 21908 - DNA, 924 bp, Rhodopirellula baltica; identical to SEQ ID NO: 971
  CDS (1)..(924)

SEQ ID NO: 21909 - protein, 307 aa, Rhodopirellula baltica; identical to SEQ ID NO: 972

SEQ ID NO: 21910 - DNA, 744 bp, Streptomyces avermitilis; identical to SEQ ID NO: 973
  CDS (1)..(744)

SEQ ID NO: 21911 - protein, 247 aa, Streptomyces avermitilis; identical to SEQ ID NO: 974

SEQ ID NO: 21912 - DNA, 897 bp, Streptomyces avermitilis; identical to SEQ ID NO: 975
  CDS (1)..(897)

SEQ ID NO: 21913 - protein, 298 aa, Streptomyces avermitilis; identical to SEQ ID NO: 976

SEQ ID NO: 21914 - DNA, 855 bp, Leptospira interrogans; identical to SEQ ID NO: 977
  CDS (1)..(855)

SEQ ID NO: 21915 - protein, 284 aa, Leptospira interrogans; identical to SEQ ID NO: 978

SEQ ID NO: 21916 - DNA, 828 bp, Chlorobium tepidum; identical to SEQ ID NO: 979
  CDS (1)..(828)

SEQ ID NO: 21917 - protein, 275 aa, Chlorobium tepidum; identical to SEQ ID NO: 980

SEQ ID NO: 21918 - DNA, 693 bp, Pyrobaculum aerophilum; identical to SEQ ID NO: 981
  CDS (1)..(693)

SEQ ID NO: 21919 - protein, 230 aa, Pyrobaculum aerophilum; identical to SEQ ID NO: 982

SEQ ID NO: 21920 - DNA, 1140 bp, Homo sapiens (Human); identical to SEQ ID NO: 983
  CDS (1)..(1140)

SEQ ID NO: 21921 - protein, 379 aa, Homo sapiens (Human); identical to SEQ ID NO: 984

SEQ ID NO: 21922 - DNA, 1140 bp, Homo sapiens (Human); identical to SEQ ID NO: 985
  CDS (1)..(1140)

SEQ ID NO: 21923 - protein, 379 aa, Homo sapiens (Human); identical to SEQ ID NO: 986

SEQ ID NO: 21924 - DNA, 1056 bp, Drosophila melanogaster (Fruit fly); identical to SEQ ID NO: 987
  CDS (1)..(1056)

SEQ ID NO: 21925 - protein, 351 aa, Drosophila melanogaster (Fruit fly); identical to SEQ ID NO: 988

SEQ ID NO: 21926 - DNA, 726 bp, Geobacter sulfurreducens; identical to SEQ ID NO: 989
  CDS (1)..(726)

SEQ ID NO: 21927 - protein, 241 aa, Geobacter sulfurreducens; identical to SEQ ID NO: 990

SEQ ID NO: 21928 - DNA, 24 bp, Primer
atgtcaggtgtaagctctgttatg

SEQ ID NO: 21929 - DNA, 23 bp, Primer
ttaaaaccacctaccagcagcct

SEQ ID NO: 21930 - DNA, 924 bp, Saccharomyces cerevisiae; identical to SEQ ID NO: 736
  CDS (1)..(924)

SEQ ID NO: 21931 - protein, 307 aa, Saccharomyces cerevisiae; identical to SEQ ID NO: 737

SEQ ID NO: 21932 - DNA, 25 bp, Primer
atggttcagcaactaagcctttttg

SEQ ID NO: 21933 - DNA, 27 bp, Primer
ttatattagaatatttccatgtgctac

SEQ ID NO: 21934 - DNA, 336 bp, Saccharomyces cerevisiae; identical to SEQ ID NO: 3552
  CDS (1)..(336)

SEQ ID NO: 21935 - protein, 111 aa, Saccharomyces cerevisiae; identical to SEQ ID NO: 3553

SEQ ID NO: 21936 - DNA, 28 bp, Primer
atgactaaaagtatatatattatcatcg

SEQ ID NO: 21937 - DNA, 24 bp, Primer
ctaattcctgatgccaagtaacga

SEQ ID NO: 21938 - DNA, 1716 bp, Saccharomyces cerevisiae; identical to SEQ ID NO: 230
  CDS (1)..(1716)

SEQ ID NO: 21939 - protein, 571 aa, Saccharomyces cerevisiae; identical to SEQ ID NO: 231

SEQ ID NO: 21940 - DNA, 2817 bp, Neurospora crassa; identical to SEQ ID NO: 1285
  CDS (1)..(2817)

SEQ ID NO: 21941 - protein, 938 aa, Neurospora crassa; identical to SEQ ID NO: 239

SEQ ID NO: 21942 - DNA, 2658 bp, Mus musculus; identical to SEQ ID NO: 1287
  CDS (1)..(2658)

SEQ ID NO: 21943 - protein, 885 aa, Mus musculus; identical to SEQ ID NO: 245

SEQ ID NO: 21944 - DNA, 2583 bp, Xenopus laevis; identical to SEQ ID NO: 246
  CDS (1)..(2583)

SEQ ID NO: 21945 - protein, 860 aa, Xenopus laevis; identical to SEQ ID NO: 247

SEQ ID NO: 21946 - DNA, 2568 bp, Homo sapiens; identical to SEQ ID NO: 1291
  CDS (1)..(2568)

SEQ ID NO: 21947 - protein, 855 aa, Homo sapiens; identical to SEQ ID NO: 241

SEQ ID NO: 21948 - DNA, 2625 bp, Homo sapiens; identical to SEQ ID NO: 242
  CDS (1)..(2625)

SEQ ID NO: 21949 - protein, 874 aa, Homo sapiens; identical to SEQ ID NO: 243

SEQ ID NO: 21950 - DNA, 2076 bp, Caenorhabditis elegans; identical to SEQ ID NO: 1295
  CDS (1)..(2076)

SEQ ID NO: 21951 - protein, 691 aa, Caenorhabditis elegans; identical to SEQ ID NO: 235

SEQ ID NO: 21952 - DNA, 1782 bp, Schizosaccharomyces pombe; identical to SEQ ID NO: 1297
  CDS (1)..(1782)

SEQ ID NO: 21953 - protein, 593 aa, Schizosaccharomyces pombe; identical to SEQ ID NO: 237

SEQ ID NO: 21954 - DNA, 26 bp, Primer
atgaatgatcctcgtgaaattttagc

SEQ ID NO: 21955 - DNA, 25 bp, Primer
ttatattatctcaagatcgctggca

SEQ ID NO: 21956 - DNA, 642 bp, Saccharomyces cerevisiae; identical to SEQ ID NO: 993
  CDS (1)..(642)

SEQ ID NO: 21957 - protein, 213 aa, Saccharomyces cerevisiae; identical to SEQ ID NO: 994

SEQ ID NO: 21958 - DNA, 543 bp, Caenorhabditis elegans; identical to SEQ ID NO: 995
  CDS (1)..(543)

SEQ ID NO: 21959 - protein, 180 aa, Caenorhabditis elegans; identical to SEQ ID NO: 996

SEQ ID NO: 21960 - DNA, 552 bp, Schizosaccharomyces pombe; identical to SEQ ID NO: 997
  CDS (1)..(552)

SEQ ID NO: 21961 - protein, 183 aa, Schizosaccharomyces pombe; identical to SEQ ID NO: 998

SEQ ID NO: 21962 - DNA, 822 bp, Neurospora crassa; identical to SEQ ID NO: 999
  CDS (1)..(822)

SEQ ID NO: 21963 - protein, 273 aa, Neurospora crassa; identical to SEQ ID NO: 1000

SEQ ID NO: 21964 - DNA, 636 bp, Oryza sativa (Rice); identical to SEQ ID NO: 1001
  CDS (1)..(636)

SEQ ID NO: 21965 - protein, 211 aa, Oryza sativa (Rice); identical to SEQ ID NO: 1002

SEQ ID NO: 21966 - DNA, 831 bp, Oryza sativa (Rice); identical to SEQ ID NO: 1003
  CDS (1)..(831)

SEQ ID NO: 21967 - protein, 276 aa, Oryza sativa (Rice); identical to SEQ ID NO: 1004

SEQ ID NO: 21968 - DNA, 633 bp, Arabidopsis thaliana (Mouse-ear cress); identical to SEQ ID NO: 1005
  CDS (1)..(633)

SEQ ID NO: 21969 - protein, 210 aa, Arabidopsis thaliana (Mouse-ear cress); identical to SEQ ID NO: 1006

SEQ ID NO: 21970 - DNA, 573 bp, Brugia malayi (Filarial nematode worm); identical to SEQ ID NO: 1007
  CDS (1)..(573)

SEQ ID NO: 21971 - protein, 190 aa, Brugia malayi (Filarial nematode worm); identical to SEQ ID NO: 1008

SEQ ID NO: 21972 - DNA, 612 bp, Drosophila melanogaster (Fruit fly); identical to SEQ ID NO: 1009
  CDS (1)..(612)

SEQ ID NO: 21973 - protein, 203 aa, Drosophila melanogaster (Fruit fly); identical to SEQ ID NO: 1010

SEQ ID NO: 21974 - DNA, 528 bp, Encephalitozoon cuniculi; identical to SEQ ID NO: 1011
  CDS (1)..(528)

SEQ ID NO: 21975 - protein, 175 aa, Encephalitozoon cuniculi; identical to SEQ ID NO: 1012

SEQ ID NO: 21976 - DNA, 558 bp, Homo sapiens (Human); identical to SEQ ID NO: 1013
  CDS (1)..(558)

SEQ ID NO: 21977 - protein, 185 aa, Homo sapiens (Human); identical to SEQ ID NO: 1014

SEQ ID NO: 21978 - DNA, 558 bp, Mus musculus (Mouse); identical to SEQ ID NO: 1015
  CDS (1)..(558)

SEQ ID NO: 21979 - protein, 185 aa, Mus musculus (Mouse); identical to SEQ ID NO: 1016

SEQ ID NO: 21980 - DNA, 558 bp, Xenopus laevis (African clawed frog); identical to SEQ ID NO: 1017
  CDS (1)..(558)

SEQ ID NO: 21981 - protein, 185 aa, Xenopus laevis (African clawed frog); identical to SEQ ID NO: 1018

SEQ ID NO: 21982 - DNA, 23 bp, Primer
atgtcactaccggcacatttgca

SEQ ID NO: 21983 - DNA, 29 bp, Primer
ttaaatattgaattcttcttcatcatttt

SEQ ID NO: 21984 - DNA, 264 bp, Saccharomyces cerevisiae; identical to SEQ ID NO: 172
  CDS (1)..(264)

SEQ ID NO: 21985 - protein, 87 aa, Saccharomyces cerevisiae; identical to SEQ ID NO: 173

SEQ ID NO: 21986 - DNA, 258 bp, Pectinaria gouldii; identical to SEQ ID NO: 1023
  CDS (1)..(258)

SEQ ID NO: 21987 - protein, 85 aa, Pectinaria gouldii; identical to SEQ ID NO: 217

SEQ ID NO: 21988 - DNA, 264 bp, Schizosaccharomyces pombe; identical to SEQ ID NO: 178
  CDS (1)..(264)

SEQ ID NO: 21989 - protein, 87 aa, Schizosaccharomyces pombe; identical to SEQ ID NO: 179

SEQ ID NO: 21990 - DNA, 249 bp, Guillardia theta nucleomorph; identical to SEQ ID NO: 1027
  CDS (1)..(249)

SEQ ID NO: 21991 - protein, 82 aa, Guillardia theta nucleomorph; identical to SEQ ID NO: 189

SEQ ID NO: 21992 - DNA, 252 bp, Drosophila melanogaster; identical to SEQ ID NO: 194
  CDS (1)..(252)

SEQ ID NO: 21993 - protein, 83 aa, Drosophila melanogaster [sequence omitted]

SEQ ID NO: 21994 - DNA, 246 bp, Anopheles gambiae; identical to SEQ ID NO: 1031
  CDS (1)..(243)

SEQ ID NO: 21995 - protein, 80 aa, Anopheles gambiae; identical to SEQ ID NO: 207

SEQ ID NO: 21996 - DNA, 270 bp, Giardia lamblia; identical to SEQ ID NO: 204
  CDS (1)..(270)

SEQ ID NO: 21997 - protein, 89 aa, Giardia lamblia; identical to SEQ ID NO: 205

SEQ ID NO: 21998 - DNA, 249 bp, Oryza sativa; identical to SEQ ID NO: 1035
  CDS (1)..(249)

SEQ ID NO: 21999 - protein, 82 aa, Oryza sativa; identical to SEQ ID NO: 1036

SEQ ID NO: 22000 - DNA, 246 bp, Danio rerio; identical to SEQ ID NO: 214
  CDS (1)..(246)

SEQ ID NO: 22001 - protein, 81 aa, Danio rerio; identical to SEQ ID NO: 215

SEQ ID NO: 22002 - DNA, 258 bp, Branchiostoma belcheri tsingtaunese; identical to SEQ ID NO: 1039
  CDS (1)..(258)

SEQ ID NO: 22003 - protein, 85 aa, Branchiostoma belcheri tsingtaunese; identical to SEQ ID NO: 203

SEQ ID NO: 22004 - DNA, 252 bp, Ceratitis capitata; identical to SEQ ID NO: 200
  CDS (1)..(252)

SEQ ID NO: 22005 - protein, 83 aa, Ceratitis capitata; identical to SEQ ID NO: 201

SEQ ID NO: 22006 - DNA, 249 bp, Plasmodium falciparum; identical to SEQ ID NO: 198
  CDS (1)..(249)

SEQ ID NO: 22007 - protein, 82 aa, Plasmodium falciparum; identical to SEQ ID NO: 199

SEQ ID NO: 22008 - DNA, 249 bp, Arabidopsis thaliana; identical to SEQ ID NO: 208
  CDS (1)..(249)

SEQ ID NO: 22009 - protein, 82 aa, Arabidopsis thaliana; identical to SEQ ID NO: 209

SEQ ID NO: 22010 - DNA, 252 bp, Ictalurus punctatus; identical to SEQ ID NO: 212
  CDS (1)..(252)

SEQ ID NO: 22011 - protein, 83 aa, Ictalurus punctatus; identical to SEQ ID NO: 213

SEQ ID NO: 22012 - DNA, 252 bp, Spodoptera frugiperda; identical to SEQ ID NO: 1049
  CDS (1)..(252)

SEQ ID NO: 22013 - protein, 83 aa, Spodoptera frugiperda; identical to SEQ ID NO: 197

SEQ ID NO: 22014 - DNA, 273 bp, Homo sapiens; identical to SEQ ID NO: 1051
  CDS (1)..(273)

SEQ ID NO: 22015 - protein, 90 aa, Homo sapiens; identical to SEQ ID NO: 193

SEQ ID NO: 22016 - DNA, 201 bp, Homo sapiens; identical to SEQ ID NO: 1053
  CDS (1)..(201)

SEQ ID NO: 22017 - protein, 66 aa, Homo sapiens; identical to SEQ ID NO: 191

SEQ ID NO: 22018 - DNA, 252 bp, Rattus norvegicus; identical to SEQ ID NO: 1055
  CDS (1)..(252)

SEQ ID NO: 22019 - protein, 83 aa, Rattus norvegicus; identical to SEQ ID NO: 177

SEQ ID NO: 22020 - DNA, 267 bp, Caenorhabditis elegans; identical to SEQ ID NO: 1057
  CDS (1)..(267)

SEQ ID NO: 22021 - protein, 88 aa, Caenorhabditis elegans; identical to SEQ ID NO: 219

SEQ ID NO: 22022 - DNA, 264 bp, Candida albicans; identical to SEQ ID NO: 220
  CDS (1)..(264)

SEQ ID NO: 22023 - protein, 87 aa, Candida albicans; identical to SEQ ID NO: 221

SEQ ID NO: 22024 - DNA, 332 bp, Cyanophora paradoxa; identical to SEQ ID NO: 1061
  CDS (1)..(249)

SEQ ID NO: 22025 - protein, 82 aa, Cyanophora paradoxa; identical to SEQ ID NO: 223

SEQ ID NO: 22026 - DNA, 252 bp, Mus musculus; identical to SEQ ID NO: 1063
  CDS (1)..(252)

SEQ ID NO: 22027 - protein, 83 aa, Mus musculus; identical to SEQ ID NO: 225

SEQ ID NO: 22028 - DNA, 264 bp, Neurospora crassa; identical to SEQ ID NO: 226
  CDS (1)..(264)

SEQ ID NO: 22029 - protein, 87 aa, Neurospora crassa; identical to SEQ ID NO: 227

SEQ ID NO: 22030 - DNA, 252 bp, Homo sapiens; identical to SEQ ID NO: 1067
  CDS (1)..(252)

SEQ ID NO: 22031 - protein, 83 aa, Homo sapiens; identical to SEQ ID NO: 181

SEQ ID NO: 22032 - DNA, 294 bp, Homo sapiens; identical to SEQ ID NO: 182
  CDS (1)..(294)

SEQ ID NO: 22033 - protein, 97 aa, Homo sapiens; identical to SEQ ID NO: 183

SEQ ID NO: 22034 - DNA, 246 bp, Zea mays; identical to SEQ ID NO: 184
  CDS (1)..(246)

SEQ ID NO: 22035 - protein, 81 aa, Zea mays; identical to SEQ ID NO: 185

SEQ ID NO: 22036 - DNA, 264 bp, Schizosaccharomyces pombe; identical to SEQ ID NO: 178
  CDS (1)..(264)

SEQ ID NO: 22037 - protein, 87 aa, Schizosaccharomyces pombe; identical to SEQ ID NO: 179

SEQ ID NO: 22038 - DNA, 25 bp, Primer
atggaaaacgataagggccaattag

SEQ ID NO: 22039 - DNA, 24 bp, Primer
ttaacgtgagtaagaccagacgtt

SEQ ID NO: 22040 - DNA, 3885 bp, Saccharomyces cerevisiae
  CDS (820)..(3459)
cgtgtgaattgtgcagtaaatatacctatatataaaactattactttatctgcagccatctatattaaaaaataagtatttttgtgtataacaatagatttctatatatatatgtatatatatatatatatataaatttagattaaccacaatatcattttatcgctgcatttttttcatcttctttcgttccttcgcgtttcttttctcgtatataataagcttttgcacattgcctgcgatacgtccgaaaagggaacgttttttcccgatcagaccgccccagaacttctcgaagaaaagtgcccgagggcagagcagcaagacctaaaaaattcgtgccggggtttgagctagaaaaagagggctaaagataaacatccgatcgctatctacggtaattgcgcactctgttaccctgaactgcatttcttttttccttctaaaaattgtggagagaggaagataatttcccaaatgtaccattagcacacttgagaatgtatattggatgtatgaagcttgatgaataggagaaaaaaaaaaacaaagaaaagaaggaaaaagaaaaataagtggtgcctgcacatatttgaatatctactgtaaatagtataacactgcttagctaatttttttctggtcatctggtctctaaagagaaacataagaaaaagataggaacattgaaaggcggtgaaaaggaaacttccttgctactgatatatctataagcatagaagtacgcaagcaaacaagaaaacaaacaagaactacgcatttaaatttcttctgaataacgcaatattgcgggtataaatggaaatgaacatggatatggatatggatatggaactcgcatccatagtttcttctttaagcgccctgtcccatagtaacaacaacggcggtcaggccgccgcggccggcattgtgaacggcggtgctgctggatcacagcaaattggcggcttcagaaggtcgagtttcaccacggcaaatgaagtagattcagagatcttgctgcttcacggttccagtgaatcttcaccgatcttcaagaaaaccgccctatcagttggtactgctccgccattctccacgaactcgaaaaagttttttggtaacggcggcaattattaccagtacagatcaaccgacactgcctccctgtcatccgcatcgtacaataactatcatactcatcatactgcggctaatctcgggaaaaacaacaaggtcaaccatcttctgggccagtattcagcttccattgctggtcccgtttactacaatggcaatgacaacaacaactctggtggggaagggttttttgagaagttcggaaaatctttgattgacggtacaagggaactggaatctcaagatagacccgacgctgtcaatactcagtcccaattcatatcaaaaagcgtctctaacgccagcttagacacacagaatactttcgagcaaaatgtcgagtctgacaaaaacttcaacaaattgaataggaacactactaacagtggttcgctttaccactccagttcaaattcaggctcatctgcgtctttagagtccgaaaatgctcattaccccaagagaaatatctggaacgtagccaacacaccagtatttagacctagtaacaatccagccgctgttggggccacaaatgtcgcgcttcctaaccaacaagatgggcctgcaaataacaatttccccccctacatgaacggcttcccacccaatcagtttcatcagggccctcattaccaaaacttccccaactacttgatcggatctccttcaaatttcatctcccagatgatttcagtacagattccagcaaatgaagacaccgaagactcaaatggtaagaaaaagaagaaggcaaacagaccttcttctgtttcttcaccttcgtcccctccaaacaattctccgttcccgtttgcctaccccaacccaatgatgtttatgccacctccaccactctctgctccccagcaacaacagcaacagcaacaacaacaacaacaagaagaccaacaacagcaacagcaacaggagaatccttatatttactaccctactccaaatcctatacctgtcaaaatgcccaaggacgaaaaaaccttcaagaaaagaaataacaagaatcatcctgcaaataactccaacaacgccaacaaacaggcaaatccttatctagaaaattctatacccacaaagaatacctctaaaaagaatgcttcttccaaatctaatgagtcaacggccaacaaccataaatctcactctcattctcatcctcattctcaaagtctacagcaacagcagcaaacgtatcatcgatcgccgttgttagagcaactaagaaacagtagttctgacaaaaattcaaactcgaacatgtcactaaaagacatctttggccattccttagagttttgcaaagatcaacatggttcacggttcattcagcgcgagttggccacctcaccagcctcagaaaaggaggtcatattcaatgaaattcgcgatgacgccattgagctttcgaacgatgtatttggtaattacgtcattcagaagttttttgaatttggtagcaaaattcaaaaaaatactttggttgatcaatttaaaggtaacatgaaacagttatctctacaaatgtacgcatgtcgtgtaattcaaaaggcgttagaatatattgattccaatcaaagaattgagttagtcctggaattatctgactccgttttgcaaatgatcaaagatcagaacggtaatcacgtaattcaaaaggccatcgaaacaattcctatcgaaaaattaccttttatcttaagttctttaactggccacatttaccatctatctacccactcctacggctgtagggtcattcaaagattgttagaatttggttcgagcgaagatcaggaaagcattttaaacgaattgaaagatttcataccatatctaattcaagaccaatatggtaactatgtcattcaatatgttttgcaacaagatcagttcaccaataaggaaatggtcgatatcaaacaggaaatcatagaaactgtggccaataatgttgtcgaatactctaaacataaatttgcctccaacgtggtcgaaaaatctattctttatggctctaaaaatcagaaggatttaataatttctaagattttaccaagagacaaaaatcatgctttgaatctggaagacgattctccaatgattttaatgatcaaggatcaatttgccaactatgtgattcaaaaattagttaatgtctctgagggtgagggtaagaaattgatcgtcattgccattagagcatatttggataaactaaacaaatctaactccctaggaaatagacatttagccagtgttgagaaacttgcagcattggttgaaaatgcggaggtgtgattagtgttatcatcgttctcctttcactttttactattttttttttttttttttttttttttttttcctccatttgtctttcacttactctattttattttgttttattttgatatctactcttgtccataacatttatgttcccctatattcattatttgcttttttccattacctactttttgtacctcatctctatttttctgcaaaaatctttgcgctcttacgctcttcttatttctgcaacagatagagaatttaacattgtgtatttgaaatcatttgactgagaatactgttgtcatgtctttttacatagaaggaactaaaaaaatttaaaaaaaaaaaacacaaataacattatatttactgtacataataaatcaagcctgtttctaaccgtttatagaagtagttcttatatgt

SEQ ID NO: 22041 - protein, 879 aa, Saccharomyces cerevisiae
MEMNMDMDMDMELASIVSSLSALSHSNNNGGQAAAAGIVNGGAAGSQQIGGFRRSSFTTANEVDSEILLLHGSSESSPIFKKTALSVGTAPPFSTNSKKFFGNGGNYYQYRSTDTASLSSASYNNYHTHHTAANLGKNNKVNHLLGQYSASIAGPVYYNGNDNNNSGGEGFFEKFGKSLIDGTRELESQDRPDAVNTQSQFISKSVSNASLDTQNTFEQNVESDKNFNKLNRNTTNSGSLYHSSSNSGSSASLESENAHYPKRNIWNVANTPVFRPSNNPAAVGATNVALPNQQDGPANNNFPPYMNGFPPNQFHQGPHYQNFPNYLIGSPSNFISQMISVQIPANEDTEDSNGKKKKKANRPSSVSSPSSPPNNSPFPFAYPNPMMFMPPPPLSAPQQQQQQQQQQQQEDQQQQQQQENPYIYYPTPNPIPVKMPKDEKTFKKRNNKNHPANNSNNANKQANPYLENSIPTKNTSKKNASSKSNESTANNHKSHSHSHPHSQSLQQQQQTYHRSPLLEQLRNSSSDKNSNSNMSLKDIFGHSLEFCKDQHGSRFIQRELATSPASEKEVIFNEIRDDAIELSNDVFGNYVIQKFFEFGSKIQKNTLVDQFKGNMKQLSLQMYACRVIQKALEYIDSNQRIELVLELSDSVLQMIKDQNGNHVIQKAIETIPIEKLPFILSSLTGHIYHLSTHSYGCRVIQRLLEFGSSEDQESILNELKDFIPYLIQDQYGNYVIQYVLQQDQFTNKEMVDIKQEIIETVANNVVEYSKHKFASNVVEKSILYGSKNQKDLIISKILPRDKNHALNLEDDSPMILMIKDQFANYVIQKLVNVSEGEGKKLIVIAIRAYLDKLNKSNSLGNRHLASVEKLAALVENAEV

SEQ ID NO: 22042 - DNA, 3228 bp, Saccharomyces cerevisiae
  CDS (1)..(3228)
atggacaacaaaagactgtataacggtaacctatccaacattcctgaggttatagatcctggaattacaattccaatttatgaagaggatattagaaatgatacacgcatgaatacaaatgctcgttctgtgagagtctctgacaagagaggtcgttctagctccacttccccacagaaaattggctcctatcgtactcgtgcgggcaggttttcagatactctaaccaatctactcccttcgattagcgctaagctacaccattcaaagaagagtacccctgtagttgttgtgcctcctacgagcagtactccagacagtttaaattccacgacatacgctcccagagtgtctagcgattcttttacggtggctactccgctgtcattacagtctactacgaccagaacaagaacaagaaataacacagtatcttctcagatcactgcaagttcttctttgactactgatgtgggcaatgccacgagtgcaaatatttggagtgctaatgcagaaagtaatacttcttccagtcctttgtttgattatcctctcgccacttcttattttgagccattgactagattcaagtccactgataattatacgctgcctcaaacagctcaactaaacagttttctggagaaaaatgggaatccaaacatatggtcgagtgcaggaaatagtaacactgaccaccttaatactccgatagttaacaggcagcgctctcaatctcaatctaccacaaacagggtttatactgacgcgccctactatcaacagcctgcacagaattaccaggttcaagtgcctcctagagttccaaaaagtacttcaatatcccctgttatccttgatgacgtcgatccagcctcgataaattggattacagcaaaccaaaaagtaccactagtcaatcaaatatcggcgcttttgcccactaacacaatatctatttcaaacgtgtttccattacagcctactcaacaacatcaacagaacgctgtaaatttgacgagtacttccttagcgactttatgttcacagtatggtaaagtgctttctgcgaggacactaagaggcctgaatatggcattagtagagttttccacagttgaaagtgcaatatgtgctttggaagctctacaaggtaaggaactgtctaaagtaggggcaccaagtacggtatcttttgcgcgagtcttacccatgtatgaacaacctcttaacgttaatggcttcaacaacactcccaagcaaccgctgttgcaagaacagttgaatcacggggtgctcaattatcagctgcaacaatcgctacaacagccggagctacaacaacaaccaacttcatttaatcaaccaaatcttacatattgtaatcccactcagaatttgagccatctgcaattatcttcaaacgaaaatgaaccttaccctttcccgttgcctccaccatcattatcggatagtaaaaaggatatattacacactataagttcttttaagttagaatatgatcatctagagttgaatcatctcttgcagaatgccttgaaaaataaaggagtgtctgatacaaattattttggtcccctgcctgagcacaactccaaagttccaaagagaaaggatacgttcgatgcaccaaaattgcgggaactgagaaagcagtttgactcgaactcattatctactattgaaatggagcaattggcaatcgtcatgctggaccaattaccagaattaagttcagactatttgggtaataccgttattcaaaaattgtttgaaaactcgtcaaatatcatcagggatattatgttgaggaagtgtaataaatatctcacatctatgggtgttcacaaaaacggtacttgggtttgtcagaagatcatcaaaatggcaaacacgccaaggcagataaatcttgtaacttcaggtgtaagcgattactgtactccactcttcaacgaccagtttggaaattatgttattcaaggtattttaaagtttggttttccctggaatagtttcatttttgaaagcgttttatctcatttttggacaatagttcaaaacaggtatggatctcgtgctgtaagggcttgtctagaagcagattccattattacccaatgccaattgctgactatcacttcactgataattgtgctttctccttatctagctacggatacgaatggcactttactgatcacttggctattggatacttgcactttacctaacaagaacttgattttatgtgataaactggtaaataaaaatctggttaaactatgttgtcataaattaggctctcttactgtcttaaagattctcaatttaagaggtggtgaagaagaggcactgtcgaagaataaaattatccatgcaatatttgatggtccaatttctagtgattctatcttgttccagatactagatgagggtaattatggtccaacatttatttataaggttttaacctcgagaattcttgacaatagcgttagagatgaagctataacaaagattcgtcaactgattttaaattccaatatcaatttacaaagtcgccagttactggaggaagttgggctatcatcagcaggaatatcacccaaacaatcctccaagaatcatcgtaaacagcatcctcaggggtttcattctcctggtcgcgccagaggcgtttctgtttccagtgtgagaagttcaaattcaaggcataatagcgttatacaaatgaacaatgcaggtccaacgccagcattgaactttaacccagccccgatgagtgaaataaattcctacttcaacaatcaacaagtggtgtactccggaaatcaaaatcaaaatcagaacggtaattctaacggattagatgaattgaattcacaatttgattcatttagaattgctaatggaacaaatttatccctacctatagttaacttaccaaatgtaagtaataataataacaattataataattctggttattcgagtcaaatgaatcctctaagccgctcagtgagtcataataacaataataataccaataactacaacaataatgataatgataacaataataataacaataacaataataataataataataataataataataataataataatagtaataatagtaataataataataataatgatacaagtttgtaccgctacaggtcatacggatattag

SEQ ID NO: 22043 - protein, 1075 aa, Saccharomyces cerevisiae
MDNKRLYNGNLSNIPEVIDPGITIPIYEEDIRNDTRMNTNARSVRVSDKRGRSSSTSPQKIGSYRTRAGRFSDTLTNLLPSISAKLHHSKKSTPVVVVPPTSSTPDSLNSTTYAPRVSSDSFTVATPLSLQSTTTRTRTRNNTVSSQITASSSLTTDVGNATSANIWSANAESNTSSSPLFDYPLATSYFEPLTRFKSTDNYTLPQTAQLNSFLEKNGNPNIWSSAGNSNTDHLNTPIVNRQRSQSQSTTNRVYTDAPYYQQPAQNYQVQVPPRVPKSTSISPVILDDVDPASINWITANQKVPLVNQISALLPTNTISISNVFPLQPTQQHQQNAVNLTSTSLATLCSQYGKVLSARTLRGLNMALVEFSTVESAICALEALQGKELSKVGAPSTVSFARVLPMYEQPLNVNGFNNTPKQPLLQEQLNHGVLNYQLQQSLQQPELQQQPTSFNQPNLTYCNPTQNLSHLQLSSNENEPYPFPLPPPSLSDSKKDILHTISSFKLEYDHLELNHLLQNALKNKGVSDTNYFGPLPEHNSKVPKRKDTFDAPKLRELRKQFDSNSLSTIEMEQLAIVMLDQLPELSSDYLGNTVIQKLFENSSNIIRDIMLRKCNKYLTSMGVHKNGTWVCQKIIKMANTPRQINLVTSGVSDYCTPLFNDQFGNYVIQGILKFGFPWNSFIFESVLSHFWTIVQNRYGSRAVRACLEADSIITQCQLLTITSLIIVLSPYLATDTNGTLLITWLLDTCTLPNKNLILCDKLVNKNLVKLCCHKLGSLTVLKILNLRGGEEEALSKNKIIHAIFDGPISSDSILFQILDEGNYGPTFIYKVLTSRILDNSVRDEAITKIRQLILNSNINLQSRQLLEEVGLSSAGISPKQSSKNHRKQHPQGFHSPGRARGVSVSSVRSSNSRHNSVIQMNNAGPTPALNFNPAPMSEINSYFNNQQVVYSGNQNQNQNGNSNGLDELNSQFDSFRIANGTNLSLPIVNLPNVSNNNNNYNNSGYSSQMNPLSRSVSHNNNNNTNNYNNNDNDNNNNNNNNNNNNNNNNNNNNNSNNSNNNNNNDTSLYRYRSYGY

SEQ ID NO: 22044 - DNA, 3656 bp, Saccharomyces cerevisiae
  CDS (706)..(3372)
ggagtgaattgtgatttgtgaattatatctgtccaataccgttgccttgttgggagctcagatagaaaagacatcttaattccagacagtctattctctgtctatttctctttgtgactgcaaattttaatttgtgacgccttttcttattactcatgtatttgtcactcttgacgattgttttttttctatattttttttgttctggggtcctccagagaataaaaaataatgatcaatatagtagatagtatagttatattcttattcgttgcaccttgtttaacaaatcactcagactcaaagagaatatcggttggttatctctctccgaaggtgaacagcaaacagtacctcacgtcttttttttgaatagtttttttttttgttgaaacagaaaaaaaactttcttccgtatattacattgtacattatttttattgtattttagtttccaacgttaggatttgagccgtcattaatattattcgtttttgtacactattccagacgatttatttttagtacacttaaaattcctgttgatattgtccactagttctcttttcatattttattttcgcttattctttaggttcttttaagagtctctgttcattttccgttcttactgtttctttgtcctcgatatcttttaagaaagagagaactaagcgctgtaacatttttaagtggacctacgttatgtctacaaaaggtttgaaagaagaaatcgatgatgtaccatcagtagaccctgtcgtttcagaaacagtcaattctgctttagagcagttgcaactagatgatccagaggaaaacgccacctctaatgcatttgcgaataaagtttctcaagattctcaattcgctaatggccctccgtcgcaaatgtttccacatccacaaatgatgggtggaatgggcttcatgccctactctcaaatgatgcaggttcctcataatccttgtccattttttccgccccctgattttaatgatccaacagcaccattgagtagctcgcccttgaatgcaggcggtccaccaatgttattcaagaatgactcacttccatttcaaatgctgtcttcgggtgctgcggtagcaactcaaggtggacaaaatctaaacccattgataaatgacaattcaatgaaggtattgccaatcgcatcggctgatccgttatggactcattcaaacgtaccaggatcagcatctgtagccattgaagaaaccaccgctactctacaagaaagcctaccatctaagggcagggagtctaataataaggctagttcgttcagaagacaaacttttcatgctttatcaccaactgaccttatcaatgcggccaacaatgtaaccttgtcaaaggacttccaatctgacatgcagaatttttctaaggctaagaaaccgtctgtaggagctaacaatactgcaaaaaccagaactcaatccatatcttttgataatactccctcctcaacgtcatttatacccccaaccaatagtgtttctgagaaattatccgatttcaaaatagaaacctcgaaggaggatttgattaataaaactgcaccagctaaaaaagagagtcctacaacttatggtgcagcatatccatatgggggacctttacttcaaccaaatcctattatgccaggccacccacataatatatcctcccctatctatggtattagatcaccttttcctaattcttatgaaatgggcgcgcaatttcaacctttctctccgattttaaatcctacgagtcattcactaaatgcaaattctccaattcctctaacccaatcgccaattcatcttgcaccagttttaaaccctagttcaaattctgttgccttttcagatatgaagaatgatggtggtaagcccaccaccgataacgacaaggcgggtccaaatgttaggatggatttaataaatcctaatcttgggccatcaatgcaacctttccacatattacctccccagcaaaacaccccccctcctccctggctttatagcactccacctcccttcaacgcaatggttccgcctcatttgttggctcaaaatcatatgccgttaatgaatagcgccaataataaacatcatggtcgtaataacaatagcatgtcaagtcataatgacaatgacaacattggtaattctaattacaacaataaagacacaggtcgttctaacgttggtaaaatgaaaaatatgaaaaacagttatcatggctactataataacaataataataataataataataacaataataataataacagtaatgctaccaacagcaacagcgcggaaaaacaacgtaaaattgaggagtcgtcgagatttgcggacgcagttttagaccaatatatcggaagtattcactcattgtgtaaagaccaacatggttgtcgttttctgcaaaagcagttggatattctcggcagtaaggcggcggacgcaatttttgaagaaactaaggattatacggttgaattgatgactgattcattcggtaattatttgatccagaagctattggaagaggttaccacagaacaaagaatcgtactcacaaaaatatcttcccctcattttgtcgaaatttccttaaaccctcatggtactagggcattacaaaaactcattgaatgcatcaaaacagatgaagaagcacagattgttgttgattctttacgcccttatactgtccagttgagtaaggatttaaatggtaatcatgttattcaaaaatgtttgcaaaggttgaagcctgaaaacttccagtttatctttgacgcaatctctgatagctgtattgatattgctactcatagacacgggtgttgcgttttgcaacgttgtctagatcatgggactacagaacaatgtgacaatctgtgtgataagttgctagcccttgttgataaattaactttggatccatttggcaactatgtggtgcaatatataattaccaaagaggctgagaagaacaaatatgattatacgcataaaattgtccacctgttgaaaccaagagccatcgaactttctatccataaatttggatcaaatgtgattgaaaaaatcttgaagacagctattgtttcggagccaatgattctggaaattttaaataatggtggcgagacgggtattcaatcattgttgaatgatagctacggaaattacgttttacagacagcattagacatttctcataagcaaaatgactatctctataaaagactatcagagattgtggcgcctttactggtgggccccataagaaatacacctcatggtaaaagaatcatcggaatgttacatttagattcatagttgatacatatatcctcagtttagctttttttacgttagcctcatataatatcttttgtacaatactaaaatacatcattttttttttcgttgaggatcaaatgaatatccaaagcaaaaaaaataggaattttcactttatggtatactggtaaatagtgttgaagaaataagagaaggagatgccctagaaaacagaatgttcttatttaaataagtaaactcaaaagaaaaaaaaaaggaaggaagtttttgagaacttttatctatacaaacgtatacgt

SEQ ID NO: 22045 - protein, 888 aa, Saccharomyces cerevisiae
MSTKGLKEEIDDVPSVDPVVSETVNSALEQLQLDDPEENATSNAFANKVSQDSQFANGPPSQMFPHPQMMGGMGFMPYSQMMQVPHNPCPFFPPPDFNDPTAPLSSSPLNAGGPPMLFKNDSLPFQMLSSGAAVATQGGQNLNPLINDNSMKVLPIASADPLWTHSNVPGSASVAIEETTATLQESLPSKGRESNNKASSFRRQTFHALSPTDLINAANNVTLSKDFQSDMQNFSKAKKPSVGANNTAKTRTQSISFDNTPSSTSFIPPTNSVSEKLSDFKIETSKEDLINKTAPAKKESPTTYGAAYPYGGPLLQPNPIMPGHPHNISSPIYGIRSPFPNSYEMGAQFQPFSPILNPTSHSLNANSPIPLTQSPIHLAPVLNPSSNSVAFSDMKNDGGKPTTDNDKAGPNVRMDLINPNLGPSMQPFHILPPQQNTPPPPWLYSTPPPFNAMVPPHLLAQNHMPLMNSANNKHHGRNNNSMSSHNDNDNIGNSNYNNKDTGRSNVGKMKNMKNSYHGYYNNNNNNNNNNNNNNNSNATNSNSAEKQRKIEESSRFADAVLDQYIGSIHSLCKDQHGCRFLQKQLDILGSKAADAIFEETKDYTVELMTDSFGNYLIQKLLEEVTTEQRIVLTKISSPHFVEISLNPHGTRALQKLIECIKTDEEAQIVVDSLRPYTVQLSKDLNGNHVIQKCLQRLKPENFQFIFDAISDSCIDIATHRHGCCVLQRCLDHGTTEQCDNLCDKLLALVDKLTLDPFGNYVVQYIITKEAEKNKYDYTHKIVHLLKPRAIELSIHKFGSNVIEKILKTAIVSEPMILEILNNGGETGIQSLLNDSYGNYVLQTALDISHKQNDYLYKRLSEIVAPLLVGPIRNTPHGKRIIGMLHLDS

SEQ ID NO: 22046 - DNA, 2046 bp, Schizosaccharomyces pombe
  CDS (1)..(2046)
atgaccgagcagtcttctaaatctcatccatcctttatgtctacagaatattcgcttccagtcttttcttcacagtactctgatattgagaataaagatgtattgaaatcgaattcttgggatccatatgccgctaatgcgccgattgctttgtctgagatcccttcatcttctaaatccggaaaaacaaatggttcaaaagccgctgtggaaagcggtttggcatccggcgctttcggaaaccgtactgggaacatgaaccggaatactagcatgagtggatacacgttcggatcttcgaatttcgttccctataaccttctttctaacactccttctttcactacttctcactcttcatcaacaacttttgttccgcctgcgactatgggcggtggattgaataatttgtcatctccatcttcttctttatacttgcctggctctgcttcataccaaagaagtaactctaaaaatagctcggcttctatcttacaaatgaatacgacgttagatgacatccccatacttttacgtcgtcctggattgtcttcgtacacgcccggaccttctacttctcgccgaagcatctcttcgtcgtcgaatcttggaggtaatcctggcttgatcgccaataatccttcggcttctaaaaactttgcctttacttcaggttcttcgtcgactaataattctactacttcttcttcatcaatggccaatggtctgcaatctatttcaaagcattcagcggccttccctctactttctaatgccacttctttctttggtgaaaatttaactccgtctttggctgcctcaacggccagtacgggcagtactgacagctctggctcaaatatcgctaacacactcattgctccgacaccgactatttctcctccttcggctaatactgtaggaaatccgagtcctgctgatacccctgggtttaacgtgcctagtttgatatccgatgaccctagcgtgtcttcctctctctcttcttcggttgcatctctttcattgcaaaatagcaatattctttcgttctgtaaggatcaacatggctgtcgttatttacagcgacttctagaaaagaaaaatcaatctcacattgacgccgtttttgctgaaacccatccttatttagctgtgttaatggttgatgcatttggtaactatttgtgtcaaaaattgtttgagcatgcatctgaagctcaacgatctacgttcattcaaataattgcccctaaacttgttccaatatcgtttaatatgcacggaacccgtgctttacaaaagattattgatttagtctcttctcctgatcaaatttcttgtatcgtgaatgctttgcgtcctaatgtcgtgcttttgactaaggatttaaatggtaatcatgtcattcaaaaatgtctcaacaaattctctcaagaggactgtcagttcatttttgatgctatctgtgaagatccgttagatgtttctacacaccgccatggatgctgtgtcgttcaaagatgtttcgatcatgcatcacctgcgcagatcgagcaacttgtggaacacattgtcccccatgcgctcactctcgtacaagatgcattcggaaattacgttttacagtatgttttggaattaaacaacccaaaccatactgaggctattatctcatactttttatacaaagtgagagctctttcaactcaaaaatttagctctaatgtaatggaaaagtgtatattttttgctcccgctgctattaaggaaaaactgatttcggaactaatggatgaaaagcatcttcccaagttacttcgtgattctttcgctaattatgttattcaaacggcacttgataatgcgagtgtaaagcaacgcgcagagttggttgaacggattaaaccacttattccaagcataaagaatacgccctgtggtcgtcgcattctttcaaagttagaacgtcgtcatccgagctcgaaagaaaagcctattgtgtacagtaattctgaaagagttaatacttcctcttcagcttaa

SEQ ID NO: 22047 - protein, 681 aa, Schizosaccharomyces pombe
MTEQSSKSHPSFMSTEYSLPVFSSQYSDIENKDVLKSNSWDPYAANAPIALSEIPSSSKSGKTNGSKAAVESGLASGAFGNRTGNMNRNTSMSGYTFGSSNFVPYNLLSNTPSFTTSHSSSTTFVPPATMGGGLNNLSSPSSSLYLPGSASYQRSNSKNSSASILQMNTTLDDIPILLRRPGLSSYTPGPSTSRRSISSSSNLGGNPGLIANNPSASKNFAFTSGSSSTNNSTTSSSSMANGLQSISKHSAAFPLLSNATSFFGENLTPSLAASTASTGSTDSSGSNIANTLIAPTPTISPPSANTVGNPSPADTPGFNVPSLISDDPSVSSSLSSSVASLSLQNSNILSFCKDQHGCRYLQRLLEKKNQSHIDAVFAETHPYLAVLMVDAFGNYLCQKLFEHASEAQRSTFIQIIAPKLVPISFNMHGTRALQKIIDLVSSPDQISCIVNALRPNVVLLTKDLNGNHVIQKCLNKFSQEDCQFIFDAICEDPLDVSTHRHGCCVVQRCFDHASPAQIEQLVEHIVPHALTLVQDAFGNYVLQYVLELNNPNHTEAIISYFLYKVRALSTQKFSSNVMEKCIFFAPAAIKEKLISELMDEKHLPKLLRDSFANYVIQTALDNASVKQRAELVERIKPLIPSIKNTPCGRRILSKLERRHPSSKEKPIVYSNSERVNTSSSA

SEQ ID NO: 22048 - DNA, 2112 bp, Caenorhabditis elegans
  CDS (1)..(2112)
atggctgatccaaattgggcatatgcacccccaacaaattattatgcagaccattcaatagcaaagccgattatgatatccggcggccacccatctcaagatcagggccattcaccgaagtcggaatcattcggacaatcagttactactgcttttaatggaatggttgataatcttgtcggttccccatcttcgtctgttcaacaacgaaactatttcaccacaacaccgttccctatatcccgatcaccaaacgatcgaaatgacgacaaaatcatgggcaatggaagttacggtgtcccgattccaattccacaagacggagtgccgcagggcacacccgatttccaaatgacaccattcttgcaacaaggaggccatttaattggtggaagtccgaatggtcctgttcaggtctcgggaaattggtattctggaggtgctggcatattttcaacaatgcaacaggccgacccgtcgaatggaatgcctggcatggcagccgaattcgtgaacaatgagaacggaatgcctgggccaaatggaatgcaccaacaggcaatgatttctggatcccctccgtttccatatcaaaatatgatgaatttaacgacgagttttggagctatgggacttggaccgcaacaaattcagcagagggatccccaaatgttccaacaacccattcttcatgaaccaattcaaggaatggctcaaaacggatttggccagcaagtctttttcactcaaatgcagaatcagcaacatccacaaggacaagcgcaacaacaactgcaacaacttgcccaacagcatcagcagcaacaaaatagtcagcaattctttgggcaaggacccaatggaatgggtaacggtggagtcatgaatgactggagtcaacggagctttggaatgccacaacagcaagcacaacaaaatggtcttccgcccaacttctcccagaatcctccacgacgacgtggcccagaagatccgaatggtcaaaccccaaaaactctccaagatatcaaaaataacgtgattgagtttgccaaggatcagcatggctcacgtttcattcagcaaaagcttgagcgtgcttctcttcgtgacaaagccgccatattcacaccagtactggagaacgcagaggagctcatgacggacgtttttggaaactacgttatccaaaaattcttcgaatttggtaacaatgagcagcgcaaccagttggttggtacaattcgtggaaatgtgatgaagctcgcgttgcaaatgtacggctgtcgagtgattcaaaaagcgttggaatacgttgaagaaaagtaccagcacgagattctcggcgaaatggaaggacaagtgttgaaatgtgtcaaggatcagaacggcaatcacgttattcaaaaagtgatagaacgtgttgagccggaacgccttcagtttattattgacgcattcacgaagaataatagtgacaatgtctatacactatccgttcatccatacggttgtcgtgttattcaacgtgttctcgaatattgcaatgaagagcagaagcagccagtgttagacgctcttcagattcatttgaaacaacttgttcttgatcaatacggaaactatgtcatccaacatgtcattgaacatggaagtcccagcgacaaggaacaaatcgtgcaagacgtgatttcggatgatttgctcaaattcgctcaacacaaatttgcttcaaatgttattgagaaatgtctcacgttcggaggacatgcagaaagaaacctgataattgacaaagtttgtggagacccgaatgacccatcaccaccactactacaaatgatgaaggatccattcgccaactacgttgtccagaagatgcttgacgttgccgatccacaacaccgaaagaagatcacgctgactatcaagccccacattgcaactctgcgcaagtacaactttggaaagcacatcctgctgaaactcgagaagtactttgcaaagcaagcgcccgccaactcttccaactcatcttccaacgaccaaatctacgagcacagcccgttcgacatcccactcggagctgattttagtaatcacccgttttaa

SEQ ID NO: 22049 - protein, 703 aa, Caenorhabditis elegans
MADPNWAYAPPTNYYADHSIAKPIMISGGHPSQDQGHSPKSESFGQSVTTAFNGMVDNLVGSPSSSVQQRNYFTTTPFPISRSPNDRNDDKIMGNGSYGVPIPIPQDGVPQGTPDFQMTPFLQQGGHLIGGSPNGPVQVSGNWYSGGAGIFSTMQQADPSNGMPGMAAEFVNNENGMPGPNGMHQQAMISGSPPFPYQNMMNLTTSFGAMGLGPQQIQQRDPQMFQQPILHEPIQGMAQNGFGQQVFFTQMQNQQHPQGQAQQQLQQLAQQHQQQQNSQQFFGQGPNGMGNGGVMNDWSQRSFGMPQQQAQQNGLPPNFSQNPPRRRGPEDPNGQTPKTLQDIKNNVIEFAKDQHGSRFIQQKLERASLRDKAAIFTPVLENAEELMTDVFGNYVIQKFFEFGNNEQRNQLVGTIRGNVMKLALQMYGCRVIQKALEYVEEKYQHEILGEMEGQVLKCVKDQNGNHVIQKVIERVEPERLQFIIDAFTKNNSDNVYTLSVHPYGCRVIQRVLEYCNEEQKQPVLDALQIHLKQLVLDQYGNYVIQHVIEHGSPSDKEQIVQDVISDDLLKFAQHKFASNVIEKCLTFGGHAERNLIIDKVCGDPNDPSPPLLQMMKDPFANYVVQKMLDVADPQHRKKITLTIKPHIATLRKYNFGKHILLKLEKYFAKQAPANSSNSSSNDQIYEHSPFDIPLGADFSNHPF

SEQ ID NO: 22050 - DNA, 2463 bp, Debaryomyces hansenii
  CDS (1)..(2463)
atgtcttcagaaacaatatggtcgaataatggtacgtcgccgttgcagtcttcgacgggtaccaatcagtatcgaagtgtattagatcaagtggatccagaggtggccaagatgttggccaactcgaattcgaatccgatgatttccggcgataatgacggtaatagcagaaggttttcgttcaatgatggtagtgatatggatgggaacttttttgggttcaaaaagggttccttatctgcaattacggcgccagctgggggttatgctggtagtaataacgggagcaacacaggtcctcagcgtataaactttggtgctgcatcgatcagtggagggattgccagtagacatccgccgcaggatagctttttgcagaagttttcgtctgtagcagatgctactagagatattgagttatccaataacttggggaaaatatctcttgacgcaccaagctcgagaagaactagctttaacaacacagacgcatctaataatatgacgccgttgggagaagtgggtggtatcttaggtacgcctcacggttctttaaatgaaaacttgaatatgcctgttccaagaacgtccagacatcaatcaatcagcgaaaaaattgataactacaacaatagttcgccgattcaagctggtgctgctttatcagttaattcagatttaaacagtaatgcgaacgaccagacttcagctattcgtcacccacaagctccccatacgttttggaacccagcaacggctacatccttcacccctaacaattcatatgggtattttatggaaaataatgggttgcaaggagctcctgttcctccgcaaaactttaatccttacaatcgtaatggtcctagtgctccaccaattagtcccccaccatttatgattccctcgcctccagcacagttcatggatcctggcttatacaatatgatgacatatggtatcaatgatgactctcctgatggcgagcatcaagaggacaaggataacagtgatgatgccaaaaatggtgatttgaataatcgactggaaacaaagcagaaggatgtatcaagaaagggacatactcctggtattggtttaatgaatcgtcaagccggagctggagcaggatttatgtttcaaccttttaatccttactccctttatcagcagtcgtcgccgcctgtgggtatgtcaccagtggctgatccaaactctggaaattcattacttgatgatggtacctcaaagaatgtacctccaacccaactgacacgtccatcacacgcagctccttcaaatggtaacaagcgcaagggtaacccaagaaacgcttcttcgtctggtaaaggaactaaccatatttacagatcacctttacttgaggaaatccgttccaatttcaagggtaaagaatattttttgaaagatatctatgggcatgccgttgaatttacgaaagatcagcatggatcgcgttttatccaacaaaagttgccagaatctagtgatgaagaaaaagaagtgattttcaatgaaattagagatatatcgtatgatttgatgactgatgttttcggtaattatgtcatacaaaagtatttcgaacatggatccccaattcaaaagaaaatcttgttggactgtatgattggtcatatttatgaattgtctttacagacatttggctgtcgtgttgtacaaagggccttagaggcgattgatttagacggacaaatccaaattattgaagaattaaaagactacattttggtatgtgcaaaggaccaaaatggtaatcatgttattcaaaagtctattgaaacaattccatttgatcgtattgagtttgtcttagaatccttagataatcaaatataccacttgtcaacccatccttatggttgcagagtgattcagcgtttattagagcattcggatgctgaagacagaaagaaaatattaggagaattgaatagatttattttctatttgattcaagaccaatatggtaattatgttatgcaacatactttagaacgaggtaacccagaagatagggaagagattttgaaaattgttttaggatccgttgttaacttttcgaaacataagtttgcttcaaatgttattgaaaaatgtatcaagtttggtactttagatcaaagaagacgcatactacatgaagtcatgattggaaatgaagactacaacgttgaaactgtcagtgacgattcagctttagcattaatgatgaaggaccaatatgctaattatgtgattcagaaattggttgaaggtttcgatgcaaagagcgacgagaagaaaattttggttgtaaaattgagacaatatttaaaacaaatttcttcaaaaaataattatgggaagcatttagcttcagttgaaaaaatgattatagttgcagaaacagcgttagttgaggcagaaagaagtacataa

SEQ ID NO: 22051 - protein, 820 aa, Debaryomyces hansenii
MSSETIWSNNGTSPLQSSTGTNQYRSVLDQVDPEVAKMLANSNSNPMISGDNDGNSRRFSFNDGSDMDGNFFGFKKGSLSAITAPAGGYAGSNNGSNTGPQRINFGAASISGGIASRHPPQDSFLQKFSSVADATRDIELSNNLGKISLDAPSSRRTSFNNTDASNNMTPLGEVGGILGTPHGSLNENLNMPVPRTSRHQSISEKIDNYNNSSPIQAGAALSVNSDLNSNANDQTSAIRHPQAPHTFWNPATATSFTPNNSYGYFMENNGLQGAPVPPQNFNPYNRNGPSAPPISPPPFMIPSPPAQFMDPGLYNMMTYGINDDSPDGEHQEDKDNSDDAKNGDLNNRLETKQKDVSRKGHTPGIGLMNRQAGAGAGFMFQPFNPYSLYQQSSPPVGMSPVADPNSGNSLLDDGTSKNVPPTQLTRPSHAAPSNGNKRKGNPRNASSSGKGTNHIYRSPLLEEIRSNFKGKEYFLKDIYGHAVEFTKDQHGSRFIQQKLPESSDEEKEVIFNEIRDISYDLMTDVFGNYVIQKYFEHGSPIQKKILLDCMIGHIYELSLQTFGCRVVQRALEAIDLDGQIQIIEELKDYILVCAKDQNGNHVIQKSIETIPFDRIEFVLESLDNQIYHLSTHPYGCRVIQRLLEHSDAEDRKKILGELNRFIFYLIQDQYGNYVMQHTLERGNPEDREEILKIVLGSVVNFSKHKFASNVIEKCIKFGTLDQRRRILHEVMIGNEDYNVETVSDDSALALMMKDQYANYVIQKLVEGFDAKSDEKKILVVKLRQYLKQISSKNNYGKHLASVEKMIIVAETALVEAERST

SEQ ID NO: 22052 - DNA, 2793 bp, Kluyveromyces lactis
  CDS (1)..(2793)
atgtcactttcagagcaactgaacggctggaataccgctgtttctgacgataaggataataatacccagattgattctgaattagcatcaatagtctcgtcgctttcggcactgtcaaatccgaatgtacagcaacaagcacagcagcaggttcaacagcagcaagtacaggcgcagcagcagcaacagattggtgggttcagaagggcctctttcaatagtaatacgggaagcgatgtggactcagagatctttttcaatacacagaattctcccatgttgaggagaactactctgtctgtaggcgggatgtctctgcctgagaactcttcgtcccacgctcagaatagattgaatgccatgaaccattactctgccagtatcgctggtggtctgacagctcaattccaaaataataataatccgaacttgaacagttacaacggaagcgtgactaattctaattcgatcggtgtcaataatagttcagttacatctggatttttcgaaaggtttggtcgtgccttagctgagggtactcgtgaagtggaattgaatgtgggtgtgggtagtgttaacgttggtgggcctccttcgagttcgaatcacgctggtactggctcgagaagagcatctgcaaccacaggcttggagcatttatcgagagtcggatctaatacgacgctgcatggtgcaagaagaatgtcggatacctctgaagtgttggactccgttagtgaaagtttatcgatgcaaaataatgagcctaattctactaccatttggaacgtggctgctgcacccgtattcagacctcagaatgccgaacacatgcaacaacaataccactaccaacaacaacagcagcagcagcaatctccactgcatcaacgtcagcctcaattccagcctcaattctcttaccgtcgttctaaggacggcaaaactgctccttttccaagtgaccaggacattgatccaaatgaccctgcctcgtttgctaatcagcaggcagctcctttcaactatggttatcctgggtttaatcaatttggaatgcccatgtttttacctcctgtgctgtctccaccaccacaaccattcccaggtatgaatggatccaacgataacagtcaagatgtcgagactactgatggtgttaccaaagaggcttccgcttctagaaagaaccaacacgagtccgaattatcagagacatcaggtgaaacaggtaatcatccaacgatgatgccacatccaatggctccttatccattccccagtccatatcctttcatgtatgctccaatcaaagaagatgacacagaaaataataaggatagtgaaactgttaaacctcctttgagccctactttcttgccaccaaatccttacatgttcatgcctccatctatgcaaccacgtccaggtaacttacaagacgctccaagctcccctccatccgcagacaatggttccggttctaacaagagaaataacgattctaaatactctggcaaaaataaatcaaatccatacctgcacgcaggtaaggctcaatattcacaattctctccgccaccaagtagggcaggtatggcagtgcccccaaacactttgcaaagttcttcaggttcaggtgcaaacaaacagggtcgccaaggtaaaaatgctcgccagaataacaaacagcctatcgttagatccccattattggaggaattcaggaacaattcttccaataaagtttacaaacttagcgatatttacggctccgctttagagttctgtaaagatcaacatggttccagatttatccaacaggaattggcaacagcttctgatgctgataaggaagtaatcttcaatgagattagagaccaatgtataccattatctcatgacgtgttcggtaactatgtcattcaaaaattctttgaacatggtacaaaaacacaaagggaggtattagtggatcaattcagaggcaaaatggagaacttgtcgttagaaatgtatgcttgccgtgttatacaaaaggcatttgaattcctaaatgaagatcaaaaggttgatctcgtatctgaactttcccattgtgttttagctatgatcaaagaccagaatggtaaccatgttatacaaaaagccatcgagtgtattccgattgaaaaattaccatttattctccaaagtttaagaggacaaatctatcatttatcaacgcattcttacggttgccgtgtagttcaaagactattggaatttggaactctaaaggaccaagatgatattttgaatgacttggatgaattcatcccattcttgatccaggatcaatacggtaactacgtaattcagcatattttacagcatggaactgaagatacgagcagtcacataggaatgagtaaacaaaatatcatcgatatcattcgtaagaatgttgttgaatattcaaaacacaaatttgcctccaatgttgttgaaaagtcagtagtttacggatccaaaaaccagataagacagattttggatcaaattctaccaagagacgaagagcacgccgctgatttggaagataatgcaccattgattctaatgatgcgggatcaatacgcgaactacgttgttcaaaagctcgtgggtgtcgcaactggtgaagatgagaggttgattgttatttccatcagatcctatttggataaatccaataaaaataacactttgggtaacaggcatttggctagtgttgaaaagttagcaactttggtggaaaaaattcagatatag

SEQ ID NO: 22053 - protein, 930 aa, Kluyveromyces lactis
MSLSEQLNGWNTAVSDDKDNNTQIDSELASIVSSLSALSNPNVQQQAQQQVQQQQVQAQQQQQIGGFRRASFNSNTGSDVDSEIFFNTQNSPMLRRTTLSVGGMSLPENSSSHAQNRLNAMNHYSASIAGGLTAQFQNNNNPNLNSYNGSVTNSNSIGVNNSSVTSGFFERFGRALAEGTREVELNVGVGSVNVGGPPSSSNHAGTGSRRASATTGLEHLSRVGSNTTLHGARRMSDTSEVLDSVSESLSMQNNEPNSTTIWNVAAAPVFRPQNAEHMQQQYHYQQQQQQQQSPLHQRQPQFQPQFSYRRSKDGKTAPFPSDQDIDPNDPASFANQQAAPFNYGYPGFNQFGMPMFLPPVLSPPPQPFPGMNGSNDNSQDVETTDGVTKEASASRKNQHESELSETSGETGNHPTMMPHPMAPYPFPSPYPFMYAPIKEDDTENNKDSETVKPPLSPTFLPPNPYMFMPPSMQPRPGNLQDAPSSPPSADNGSGSNKRNNDSKYSGKNKSNPYLHAGKAQYSQFSPPPSRAGMAVPPNTLQSSSGSGANKQGRQGKNARQNNKQPIVRSPLLEEFRNNSSNKVYKLSDIYGSALEFCKDQHGSRFIQQELATASDADKEVIFNEIRDQCIPLSHDVFGNYVIQKFFEHGTKTQREVLVDQFRGKMENLSLEMYACRVIQKAFEFLNEDQKVDLVSELSHCVLAMIKDQNGNHVIQKAIECIPIEKLPFILQSLRGQIYHLSTHSYGCRVVQRLLEFGTLKDQDDILNDLDEFIPFLIQDQYGNYVIQHILQHGTEDTSSHIGMSKQNIIDIIRKNVVEYSKHKFASNVVEKSVVYGSKNQIRQILDQILPRDEEHAADLEDNAPLILMMRDQYANYVVQKLVGVATGEDERLIVISIRSYLDKSNKNNTLGNRHLASVEKLATLVEKIQI

SEQ ID NO: 22054 - DNA, 3285 bp, Kluyveromyces lactis
  CDS (1)..(3285)
atggagaagaggaaagcttccggcgattctatgtcaggattgtccaacattccggaagttatcgatccaggagtgacaattcccatatacgaagatgatttcaccttaagtggtggcaataatatagaccagctaccaatccagccacagaagctaggttcttatagatccaaggcagggaaattctccaacacgctatcgaatcttttacctagtatcagtgcgaaattgcatcataataagaagggttcaaagggtagtagtgccgtgggagaaggtaaccattctggtgagttaagctcggatgatgcgactgcaaataccagtgaacagacttcgaagtcgggttctatagctcagattaatttgtcagtgcctggacatatcaccccgccacttgacgtagattacaatcaagctattcatcttccggatagttcaagtcttttggtcccatcacaaccaaggctttccggtgattcgttcacttttgccacaaacagcgtcccgcttcaaccaactgcatcaaataccatttccagaactaggaacaataccgtttcatctcaaattactggcccttctaacgtcaacgggttggtcccaaatgtcggcaatgtttggttccctaacgatatgagtgtgaatccaatgtctcctcctggcattcaaacaactactaatccaactaatgtcaataataataataataataacaacagccatttagcaccaggtacgtatagtccttatgaggcaactggtaactatttcgatctgaacacaagttctaataacattaataacttgggtgtacctggagcaacaacagctggtgcccatcagttccaatctcaacaaattggaggggtttggaattcgagacctaggtctcaatcaaatgcgtccagtatctataccgacgctccaacctacgaccagatggatactagatctagggcttctactttcattataccaccttctatggatccacaactaaaagccactgctgcttctaccaacccaattgttcaagatgacatggattccagatcgatcaattgggtgacaactgatccatcagtaccatcgatcaaccacatttcaaacttattaccaactaataccatatccatctctaatgtcttttcattgcaacagcagcagcctcatttgtccaatactgtcaatttgacgagtacaagtttggcaacgttgtgcttgaaatttggaactgtcatttcagcacggaccttgaggggcgttaatatggcaattgttgaatttgcctctgtggaagctgccatcaaggcaaaagaggctttgaatggtaaagaagtatctctagtcggtgctccaagtactgtttcctttgcaaaagtcttacctatgcatcaacaactacctcagactcagcaaactcaacagcaaaataaccatcaatctactgccatcaaccctcagtccctgctacaagaacagttattctcaggcgcagtccaattccaacagcaaggtaacgtatccgttccttcttttactggcaatacgcacgcacaatcgagctctcaagcatttgtgtcacctaccaatccatcctcaagtaattctgagaaggaacaatgtccattcccactaccaccaccatctttcaaggagaatatcactttgttgaacgatactattaataagtttggtatcaattatgatacatctcagtaccagcatatcattgcaaacgcaattgaatacaatggaacaagtgatactactgatttcggtccattacctgagcccttatctacaagggagttcgatgccccaaggcttcgtgaattacgaaaaagtattgattctggacaaatgtcagatttggaaattgaacagctagttctagctatgttggatgaaataccagaactgagttcggactatttaggtaatactatagtacagaaactatttgaacatgcctcttccgtcattaaagatattatgttaagaaagacaagcgtatatttgacatcgatgggtgtacacaagaatggtacttgggcatgtcaaaagatgattacaaacgcagataccccaagacaaaaaatgtatgtggcaaacggagtctataagtattgtaccccattgttcaacgatcaatttggtaactacgttattcaatgtgtgttgaagtttggtttcccttggaacaactttatcttcgagaatattgtttccaacttctggaatatcgtgcaaaatagatatggagctcgtgcagtcagagcttgtttggaagcccatgacataattactcaagaacaactcttattacttagtgctatgattgtgttttttgtgaaatatttagccaccaatagcaatggggcccttttggttacgtggttcttagacacttgtactttgccaaaaagacactcaatacttgctgaggcattattaccaaatattttcgaattagggtgtcataagcttgcctcattaacaattttgaaaatcttgaactatcgtggtgatgaagttgccaaaagggctatattagatactatcttcggccctatggataacgaaatatcttctaaaccacctcagctcttatatcagttgttgagtgacacgaattatggaccatcttttgtttataaagttttgtctattcctatgttggaaggagacgttagacaccatgttatcgaacaagttcgctacattttgaccacagaatctaatatcacacagcatcgcagactcttggaagaagtgggcttgaatgcaataaacaatcaaccatctaccgctcaaaccaagccaagaatgagtatttcccatgtttttggtaatgaccatcctcaacatatgaggactgtttccgtcaacagtgtcaggtcggcatcttctagaccaagagcctcctcgaacgcacaatctcaacagcaacccatccaatcttctcaggtccaagctcagttacctcaacaatcccaatctcaacctcagcatcaacctcagcaagcgtccatttctggcatctctgggcaagcaagctactacacctaccctggcatgtttcccgcttcacaaccgtatcagtattccacgtcaaccagtggtctgaatgatgatttagtgtcaaattttgatatgctgacattcaataatggcacgcaaatatccttgccgcaactaacaatgaatggtcaaccactcccccattctcagaatagacatcataatggacagtttggtgatggaatgttcaaccactga

SEQ ID NO: 22055 - protein, 1094 aa, Kluyveromyces lactis
MEKRKASGDSMSGLSNIPEVIDPGVTIPIYEDDFTLSGGNNIDQLPIQPQKLGSYRSKAGKFSNTLSNLLPSISAKLHHNKKGSKGSSAVGEGNHSGELSSDDATANTSEQTSKSGSIAQINLSVPGHITPPLDVDYNQAIHLPDSSSLLVPSQPRLSGDSFTFATNSVPLQPTASNTISRTRNNTVSSQITGPSNVNGLVPNVGNVWFPNDMSVNPMSPPGIQTTTNPTNVNNNNNNNNSHLAPGTYSPYEATGNYFDLNTSSNNINNLGVPGATTAGAHQFQSQQIGGVWNSRPRSQSNASSIYTDAPTYDQMDTRSRASTFIIPPSMDPQLKATAASTNPIVQDDMDSRSINWVTTDPSVPSINHISNLLPTNTISISNVFSLQQQQPHLSNTVNLTSTSLATLCLKFGTVISARTLRGVNMAIVEFASVEAAIKAKEALNGKEVSLVGAPSTVSFAKVLPMHQQLPQTQQTQQQNNHQSTAINPQSLLQEQLFSGAVQFQQQGNVSVPSFTGNTHAQSSSQAFVSPTNPSSSNSEKEQCPFPLPPPSFKENITLLNDTINKFGINYDTSQYQHIIANAIEYNGTSDTTDFGPLPEPLSTREFDAPRLRELRKSIDSGQMSDLEIEQLVLAMLDEIPELSSDYLGNTIVQKLFEHASSVIKDIMLRKTSVYLTSMGVHKNGTWACQKMITNADTPRQKMYVANGVYKYCTPLFNDQFGNYVIQCVLKFGFPWNNFIFENIVSNFWNIVQNRYGARAVRACLEAHDIITQEQLLLLSAMIVFFVKYLATNSNGALLVTWFLDTCTLPKRHSILAEALLPNIFELGCHKLASLTILKILNYRGDEVAKRAILDTIFGPMDNEISSKPPQLLYQLLSDTNYGPSFVYKVLSIPMLEGDVRHHVIEQVRYILTTESNITQHRRLLEEVGLNAINNQPSTAQTKPRMSISHVFGNDHPQHMRTVSVNSVRSASSRPRASSNAQSQQQPIQSSQVQAQLPQQSQSQPQHQPQQASISGISGQASYYTYPGMFPASQPYQYSTSTSGLNDDLVSNFDMLTFNNGTQISLPQLTMNGQPLPHSQNRHHNGQFGDGMFNH

SEQ ID NO: 22056 - DNA, 2418 bp, Kluyveromyces lactis
  CDS (1)..(2418)
atgaatattgacccagtttctgttccagaaaccattaatgcggctttaggccaattgcatttggatgatgttgttgaaaaaccaaactcaaactctaatactcaagaaccagatcaggagactggaaacgatgccgcgccaatagcagccgcaactgaaacaattagtaacaacagaggtaacggtaacaatgctactagcgctacaaacggtggtactattccacaacagttgcagcagcaagagtttttcatgggtgattcgttagtaccaggtccatcaggccccggaccagcacctatgttcgctccccacatgatgaatccattcatgccgtaccatcctatgatgcacatgcctcattctggattctttcccggtgcacaggatcaaatgtttccaccacctgattccagcgctgctgttgatttcaacctaagcttgtcaccaagtggaggtagtgctgttcccggtgcaggaaacatgaccggaggtgttaatgattctgccatcccaggttctgacctgatgatgcattatccccaacagtatatgaaccataatgggcaaaggccaatgttctggatgaatccggatttgaattctagtgccatcgacgacaccactgcaggcgaagatccgcagaatcaggattcctttgtgcgcggtgcatcattcactttagaatcttctgaacaggggaatgatgccaaggtgccaggtgctaacacttctagaagacaaactttccatgcagtgtcagctactgacttgttgaacaattctacttccagtcccactgaaacgacggatgccactggtaccaatgcatcagcaacatcacccgaagcttctgcctcgaaaaaagagatgcaggatcgtgtttatcctcaagctgctgcttacccttacaccggtgcattgctgcaaccaaatcctgtactatctggccatccactgggtcatcatccccatcctatcggttccccattccctggttacggttttaatacagctttctctcctgtcccgggccctactaacacgttgaatgcaggttctccagccatctccgcagatggcaaagaagcaaacagcagcggcgatccaagtggccaatctaaccgtcatgtacactctggaactaattccccaggattgagtcaacctggtagtctgccaatgtcaggacctaacccgtggatgtttgctgctcctcacggtagtcctaacttcctggttccacaccctcatcatccgggtcacgcaggccctccagctggccatcaaagaccacagagcaataaccctcaacatagaaaacgtcatttcaataacaatggttctagtcgtagcaatttcggaaatatgaaacctcatggtaaacctcaacgctttgaagatggttctcgttatcaagatgctgtattggaacaattcgttgggtcaatctactctttgtgtaaggatcaacacggttgcagatttttacaacgtcagttggatgaaaatggagaagaagtagcttctactatttactccgagataaaagaccacatatgcgaattgatgaatgatccatttggtaattatttgatgcaaaaactattcgaaaggattaaccagagggacagagtggaaattgtcaaaaattgttcgcctcagttcatggatatcgccttagatgctcatggtactagagctcttcagaaattagtggaatgcactgatactgaggaggaaacacagattttagtggcatccttgcaaccatccattttatccttgagcagagacttcaaaagtaaccatgttgttcaaaagatgctagaaaatttctcgaataaggatactcaattcatttatgatgccgcttgtgacgatataatcaagatcagtaatcacagaaatggatgctgcgttgttcaacgttgtttggattttggtaataccgaacagctcgatgcattgtgcggtaagattgtggagaaatcatttgaattgactatgaacccgtacggcaattacgtaatccagtacattctaactaaggaaaaggatcaagcaacgcctgatttcaagtacactaaaaagattgttgatgtgttaaaattcaatgccatcgacctttcactaaacaaatttggttccaatgtcgtggaatcaattttacgtactcctgctgtttctgatgttatgatcactaagatattgaacagtaacgatgaatcagggttgttgaagctcttgcacgacagctatggtaactacgtcttacagacagcgttagatattgtcaaggactccaatgcatctctcttttctctgctatctgactcgttgaaaccattgttagtcggtcaaatcagaaatactcctcatggtagaagaattgctgcccttctacaagcagaataa

SEQ ID NO: 22057 - protein, 805 aa, Kluyveromyces lactis
MNIDPVSVPETINAALGQLHLDDVVEKPNSNSNTQEPDQETGNDAAPIAAATETISNNRGNGNNATSATNGGTIPQQLQQQEFFMGDSLVPGPSGPGPAPMFAPHMMNPFMPYHPMMHMPHSGFFPGAQDQMFPPPDSSAAVDFNLSLSPSGGSAVPGAGNMTGGVNDSAIPGSDLMMHYPQQYMNHNGQRPMFWMNPDLNSSAIDDTTAGEDPQNQDSFVRGASFTLESSEQGNDAKVPGANTSRRQTFHAVSATDLLNNSTSSPTETTDATGTNASATSPEASASKKEMQDRVYPQAAAYPYTGALLQPNPVLSGHPLGHHPHPIGSPFPGYGFNTAFSPVPGPTNTLNAGSPAISADGKEANSSGDPSGQSNRHVHSGTNSPGLSQPGSLPMSGPNPWMFAAPHGSPNFLVPHPHHPGHAGPPAGHQRPQSNNPQHRKRHFNNNGSSRSNFGNMKPHGKPQRFEDGSRYQDAVLEQFVGSIYSLCKDQHGCRFLQRQLDENGEEVASTIYSEIKDHICELMNDPFGNYLMQKLFERINQRDRVEIVKNCSPQFMDIALDAHGTRALQKLVECTDTEEETQILVASLQPSILSLSRDFKSNHVVQKMLENFSNKDTQFIYDAACDDIIKISNHRNGCCVVQRCLDFGNTEQLDALCGKIVEKSFELTMNPYGNYVIQYILTKEKDQATPDFKYTKKIVDVLKFNAIDLSLNKFGSNVVESILRTPAVSDVMITKILNSNDESGLLKLLHDSYGNYVLQTALDIVKDSNASLFSLLSDSLKPLLVGQIRNTPHGRRIAALLQAE

SEQ ID NO: 22058 - DNA, 2736 bp, Candida glabrata
  CDS (1)..(2736)
atgatgcccaacgatggtgtatggggtagtccagcggatggtgcgcacgcagacctgctgcactccctttccaagaccaactccaggacgagtgatgaccacaatatgtccacgaacagttacctgagtctgtcttcgatggcgtatggtaacaatgcgaaccagggccaccttgtcgatgcgtctattgatgcagagctggcgtctatcgtctcctcgctgagtgcgctgtcgcacaccaacaccaacactatgccccaacagcagcaacagcaggcgtcgttgttgagttcccctaacttgcagaaaattggcaccgcgacatcttcgaacatcggggggttcaggagatctagtttcacaagtgatcataactacggtcccgagcacatcgtatccgaaaccccaacggcctcgctatctgtcggtaccgccccaccttactactatagctacagcaaccagaataatggcgggaacaccgcaggttccgctgggaacatgcaagggctgaccacttcgctgtcatcacaaagactgaactacttgaactccaaccagtactcagccagtatcgccggccctatcctgttccactcaaacaacaacggatctgtgtctggccagaataataaccaacagatgggcgccaacagtggtttctttgagaagtttggtaaaacaattgtggaaggcaccaaggagttggaatctgctaattacgctaatgataccgatactatccactcctccaagagttacacttcattgcacaataatgaaaacactccagtagtggaacctattccaaatcaccaacaagcagcctacttatcaacatctgctattgatgatacggcatcatcttcatcttcaaactcacagctgactttggaatcaccagactatgtgaactcgaatatgaatatgagaaagggcccgggaggagtttggaaaaatttcaccgactcacagtcgttcaagccgaaccacttcggtcctttgccttacccaaactttcaaagccctcatccaaattttcctatgtttaatcctttcttgcctatgggtattcaaaaccatccgcctggtttgaataacaataacaatgtgaatataaatcctgcaaatactaaccctggtaacgatacagttaatagagaccctaatcttgcaaatactgaaacacaacaagaacagataaacgcacagaacttgaatgaaaatggtgatcacaacttaaacaatagtaacgcatctccatactactactatcctattaatattccaaatgaagcacagcaacctataaatagtaacgcatctaccgcacctaaaaagaagagagggggtgataaaaaagcattgcataaacaacaacaaggtaatatgaatccatatctggactcacatcaccagttacaaagaccctttgcccaaaagaagggccagacaccaacatctccaccagcagcaagaccaatgtcaccactaagtaatcaaccgatcaacttttacaagaaacagcaacaaccaccatcagggcaatcagctggaacacaaagaactacatcgtctgcatcgaattctagctcacaaaattcaaagaatacagctaataacaataataacttccatagatctgctctattggaagaactaagagcaaatccaactaacactgatttgactttgaagagtatttatggtcacgctctagaattctgtaaagatcagcatggctctagattcattcaaaaagaattggctacagcacctcctccagagagagaacttgtgtttaacgaaatcagagaccatgctttatcattagcaaatgatgtttttggtaactacgttattcagaaattctttgaatatgggtccaagactcaaaaagatattttagtagagcaatttagaggtaagatggaagaactctctctgcaaatgtacgcttgtcgtgtcattcaaagagctttagagttcattgatgctcagcaaaggatagatcttgtaagagaactatctcactgtgtcttacagatgatcaaagatcaaaatggtaatcacgtaattcaaaaggcaattgaatgtataccaatcgatctgcttccatttatcttaaattctcttgaaggtcacatataccatctctcgactcactcatatggttgcagggttgtacaaagattacttgagtttggtaccttagaagatcaaaagagaatactagaagaactaaaagactttattccctatctgatccaggaccaatatggtaattacgtgattcagcatattttgcaacacggatctgatgtcaacttggcatcagagcatatgagagtgatcaaacaagaaataattaataatgtagcggataacattgttgaattttccaaacacaaatttgcttcaaatgtggtagagaaagccattatctatggcacagatgatcaaaagatacaactaatgaagatgatactaccaagagacaaggaacatgccgctaacctcgaggaagactctcctttaattttaatgatgcgtgatcaatttgcaaattacgttgtgcaaaaattggtagttgtctctcaaggtgacgacaagaaattaattgttgttgctataagagcttacctagataagctaaacaaatctgcatcttctggtaatagacatcttgctagtgttgagaaactggcatctttagttgaatctgttgaaatctga

SEQ ID NO: 22059 - protein, 911 aa, Candida glabrata
MMPNDGVWGSPADGAHADLLHSLSKTNSRTSDDHNMSTNSYLSLSSMAYGNNANQGHLVDASIDAELASIVSSLSALSHTNTNTMPQQQQQQASLLSSPNLQKIGTATSSNIGGFRRSSFTSDHNYGPEHIVSETPTASLSVGTAPPYYYSYSNQNNGGNTAGSAGNMQGLTTSLSSQRLNYLNSNQYSASIAGPILFHSNNNGSVSGQNNNQQMGANSGFFEKFGKTIVEGTKELESANYANDTDTIHSSKSYTSLHNNENTPVVEPIPNHQQAAYLSTSAIDDTASSSSSNSQLTLESPDYVNSNMNMRKGPGGVWKNFTDSQSFKPNHFGPLPYPNFQSPHPNFPMFNPFLPMGIQNHPPGLNNNNNVNINPANTNPGNDTVNRDPNLANTETQQEQINAQNLNENGDHNLNNSNASPYYYYPINIPNEAQQPINSNASTAPKKKRGGDKKALHKQQQGNMNPYLDSHHQLQRPFAQKKGQTPTSPPAARPMSPLSNQPINFYKKQQQPPSGQSAGTQRTTSSASNSSSQNSKNTANNNNNFHRSALLEELRANPTNTDLTLKSIYGHALEFCKDQHGSRFIQKELATAPPPERELVFNEIRDHALSLANDVFGNYVIQKFFEYGSKTQKDILVEQFRGKMEELSLQMYACRVIQRALEFIDAQQRIDLVRELSHCVLQMIKDQNGNHVIQKAIECIPIDLLPFILNSLEGHIYHLSTHSYGCRVVQRLLEFGTLEDQKRILEELKDFIPYLIQDQYGNYVIQHILQHGSDVNLASEHMRVIKQEIINNVADNIVEFSKHKFASNVVEKAIIYGTDDQKIQLMKMILPRDKEHAANLEEDSPLILMMRDQFANYVVQKLVVVSQGDDKKLIVVAIRAYLDKLNKSASSGNRHLASVEKLASLVESVEI

SEQ ID NO: 22060 - DNA, 2361 bp, Candida glabrata
  CDS (1)..(2361)
atgacagataagactcagaatcaagaaaaaattgatgacaaagttgttgcagaaactgtaaactcagctctagagcaactacatatggatgatgttgaatcaccagaaccaccagctacgggtgatcaaccaactcagcatgcaccaacggccatgcaatctacctctccatcacacatgttcccaccaccacaaatgtacggttttatgccctattcgcaaatgatgcacatgccacatccacaggggtttttccatccaccagaattccaagaaaatatgcccaatcccagtggcaatggaagaattccaactgtgttcaataactccaatgatgcttcaatgtttccgcctctcggtgcttcattcccacctcttggagtggtcccagatggagaaaacagcactggtataaatgatccatttgttccaagtaatgatcagttgtggaactcatcaaacctacaagcctcagctgctattgatgtcgcaggcaacacaggtgctgttccagaagataatggatcaaaactaactgaaaaagatgcagcaccaactgctggcgcatttagaagacagacatttcatgcaatttctactagtactattagtgactcagcaatatctgacggtattccaacgtctgtaaacgacctaccagaaaagaattttgaaactgccaagaatagaacacaatctatttctttcgataaagctgattcaacgctatctgaaggaaaagacacgaaagacaccgaaaagggtaccaatgccactgcagatattcaaaacgtcccagtgaactacacagccgcatatccatatggaggacctccatttcaaggcagtcccgttccaggggttggtccacaccagatacctcattcaggctatggtgtaagatcgccgttcccaggtgcatttggcgatttcggcgctccattccagtcattttcaccaactttaggaggcccagctcctcctatgcatccacattccccaattcctatgacccactcacctattcaaataggcccaatgcctgagtttatgaaaggtatgcgtcctgaatcgggagaaggaaaaaaggatgagaatgttgccatgattccacaagggtttcctgtcatgcaacaccagcaaaatggaactcccccaccatggatgtatggtaacccagcatttaatggcatgatgcctcactcagcagggatgaatcagggccctcaatctcaatatccaagatcaaaggatggcatgcacgacaagcacgacaaaggccattacaataacagacatagaggtagaagaaacaacaattattacaaccatgaagacagacaaagaaaaatggataactctcaatacgctgatgcgacattagaccaatttattggaaacatttattcgttatgcaaggaccaacatggctgcaggtttttgcaaaaacaacttgatgtccttggtaaaaaagcatcggatgctattttcgaagagaccaaagaatacactgtggaattaatgactgattcttttggtaattatttgattcagaagcttcttgaaagagttacagacgaccaacgtgtcgaacttgccaaaatagctgctccaaaaatggttgaaatttcgaaggatccacatggtactagagcacttcaaaagctcatcgaatgtataagcaccaaagaggaagccgaaattgtcgttaaatccttgcaacccgatactgttattttaagtaaggacttaaatggtaatcatgtaattcaaaaatgtttgcagaagttgaatccagaagattcacagtttatcttcgacgctgctggcaatgaatgtggtgaaatagccactcatagacatgggtgctgtgtattacagcgttgtttggatcacggaaccaagactcaatttaaagacctctgtgaaaagctactgaaatatatcgacatgctaacctttgatccttttggtaattatgtggttcaatatattatctccaaagaaacggagagaaatgattatgactacacttacaagatagtcaatcaattgaaacctagatttaccgaactttcggtacataagtttggatccaacgttgttgagaaggtattaagaactcctgtagtatcagaaactataataaatgaactgatcaacgaaggtagtgctgaggttcaagctctgttaaacgatagcttcggtaactatgtgctacagactgcattggatattagtcgcgacacaaatccttatatgtataagaaattggttgacttggttacaccactactagttggtaatattagaaacactcctcacggaaaaaggataatgggtatccttaatattgaataa

SEQ ID NO: 22061 - protein, 786 aa, Candida glabrata
MTDKTQNQEKIDDKVVAETVNSALEQLHMDDVESPEPPATGDQPTQHAPTAMQSTSPSHMFPPPQMYGFMPYSQMMHMPHPQGFFHPPEFQENMPNPSGNGRIPTVFNNSNDASMFPPLGASFPPLGVVPDGENSTGINDPFVPSNDQLWNSSNLQASAAIDVAGNTGAVPEDNGSKLTEKDAAPTAGAFRRQTFHAISTSTISDSAISDGIPTSVNDLPEKNFETAKNRTQSISFDKADSTLSEGKDTKDTEKGTNATADIQNVPVNYTAAYPYGGPPFQGSPVPGVGPHQIPHSGYGVRSPFPGAFGDFGAPFQSFSPTLGGPAPPMHPHSPIPMTHSPIQIGPMPEFMKGMRPESGEGKKDENVAMIPQGFPVMQHQQNGTPPPWMYGNPAFNGMMPHSAGMNQGPQSQYPRSKDGMHDKHDKGHYNNRHRGRRNNNYYNHEDRQRKMDNSQYADATLDQFIGNIYSLCKDQHGCRFLQKQLDVLGKKASDAIFEETKEYTVELMTDSFGNYLIQKLLERVTDDQRVELAKIAAPKMVEISKDPHGTRALQKLIECISTKEEAEIVVKSLQPDTVILSKDLNGNHVIQKCLQKLNPEDSQFIFDAAGNECGEIATHRHGCCVLQRCLDHGTKTQFKDLCEKLLKYIDMLTFDPFGNYVVQYIISKETERNDYDYTYKIVNQLKPRFTELSVHKFGSNVVEKVLRTPVVSETIINELINEGSAEVQALLNDSFGNYVLQTALDISRDTNPYMYKKLVDLVTPLLVGNIRNTPHGKRIMGILNIE

SEQ ID NO: 22062 - DNA, 2364 bp, Ashbya gossypii
  CDS (1)..(2364)
atggagacagcagcgcaggcggaacggatacgaggccagatgtctactacagagcacacgacagatccctgggcgggcagcgtggactatgggtctgcatctcggcggaatagcaacatggaccccgaactggcgtcgatcgtgtcttcgttatcggcgttgtcgacaggcccgggcgcgggggcgccacaacagcttggtgggttccggcgggcgtcgatgaactccaatagcagcgatgtggagtctgagctcttgtttgcgggcatgtcgcctactgttcggcgcacgacgctctctgttgggggcggggctggcggcggagggcggctggctatgctcgggcactacccggcgagcattgccgggacgttgccggcggggggccagggcggtacattcttcgagcggtttggacggacgttggcggaggcgacgcgcgaggtcgagacggggctcgggacgtactcggtccggcaggcgctgcgtgagtctgcggcgagcagcgcacaagatctcttggcgcgcccgggagtagcggccgctaccagcgatgagaacgcattacggaagatgtctgtgtcctcggagactgtcgagtctgtgagtgagagcatgtcgatgcacaacgagagcaatccatcgcacaacatctggaacgtagccaacgcaccggtgtttcggcccaaccacggagactcgggcggtgacccctattcctcggtctacggtggctttccgtacggtatgtttgggcagtatcccagtgggacaggcctaggtggtggtggggcctttgctgctggcggcacggttgccaaaggcgaggaagcctcccgagaagaaccacagggagacgcagccacggcaacgaacggccagtttgcttttcctgctggtgcaccctttctgtactttccagtcggttccaatggcggatctggggcggcgattccggcggtgctgcctccccagccatcacgccattcaccttctgagtcccagaaggggaaatcaaaagggaatccatacctgcagcagcacccgagaggctacaaggctccaggaatgccattgcagaactccaactcgaaggccgccccacagacctcgatttcaggcaagggtcatcatggccaccactactcatcttccaaacaatcttcgacccagaaccagcatcaggcaaaccaacaacagagccagtatcaacatcagtcttcttccggggccaccaagagaaatggtaaaaaccagcagcccataatgcggtctccgcttttggaagagtttcgcacaaaccctaccaacaagacatacaagctacatgaaatatatggctctgcgttagaattttgtaaggaccaacatggctccaggttcattcaacaagagctagcgactgcatctaatattgagaaggaggtaatattcaacgagatacgcgaccatgccattcaattatcgcacgatgtttttgggaactatgtcatccagaagtttttcgaatttgggaccaagacgcagaaagatatactagttgagcagtttaggggcaaactggaggcattgtcgttggaaatgtatgcttgtcgcgtcatacagagggcttttgagttcatagatgaggatcagaagattgaccttgtgatggagctatcttctagcgtgcttaccatgataaaagatcaaaatggcaatcatgtgatacaaaaaacaatcgaatgcatccccatgtcgaaactgccgttcatcttagaaagtttgcgcggtcagatataccatttgtcaactcacttctatggatgccgtgttgtccagcggcttttggagtacggtagtaaggcggatcaggaggagattttaaacgaacttgatcaatttattccatatttggttcaagatcagtacggcaactatgtcatccaacatattcttcagcatggtggtgacaatcctgcggaaaaccatatcgataagtcgaagcaagatattgtcgacactatcagcaaaaccgtagttgagttctcgaagcataagtttgcttccaatgtagtggagaagacgatattgtatggtagcgcgtcgcagaaaaggcaagttttggataaaatattgccgaaagatgaagagcacgcggcgacgttggaggatacctctccattaatattgatgatgcgtgaccagtatgctaattatgttgtacaaaagcttgttggtgttggtacaggtaatgataagaagctcattgtcatcgctatcagatcttatttggagaggctgaacaagaataacacgctagggaaccgacatttggcaagcgttgaaaaattggctgcattagtggaaaaggttaagctataa

SEQ ID NO: 22063 - protein, 787 aa, Ashbya gossypii
METAAQAERIRGQMSTTEHTTDPWAGSVDYGSASRRNSNMDPELASIVSSLSALSTGPGAGAPQQLGGFRRASMNSNSSDVESELLFAGMSPTVRRTTLSVGGGAGGGGRLAMLGHYPASIAGTLPAGGQGGTFFERFGRTLAEATREVETGLGTYSVRQALRESAASSAQDLLARPGVAAATSDENALRKMSVSSETVESVSESMSMHNESNPSHNIWNVANAPVFRPNHGDSGGDPYSSVYGGFPYGMFGQYPSGTGLGGGGAFAAGGTVAKGEEASREEPQGDAATATNGQFAFPAGAPFLYFPVGSNGGSGAAIPAVLPPQPSRHSPSESQKGKSKGNPYLQQHPRGYKAPGMPLQNSNSKAAPQTSISGKGHHGHHYSSSKQSSTQNQHQANQQQSQYQHQSSSGATKRNGKNQQPIMRSPLLEEFRTNPTNKTYKLHEIYGSALEFCKDQHGSRFIQQELATASNIEKEVIFNEIRDHAIQLSHDVFGNYVIQKFFEFGTKTQKDILVEQFRGKLEALSLEMYACRVIQRAFEFIDEDQKIDLVMELSSSVLTMIKDQNGNHVIQKTIECIPMSKLPFILESLRGQIYHLSTHFYGCRVVQRLLEYGSKADQEEILNELDQFIPYLVQDQYGNYVIQHILQHGGDNPAENHIDKSKQDIVDTISKTVVEFSKHKFASNVVEKTILYGSASQKRQVLDKILPKDEEHAATLEDTSPLILMMRDQYANYVVQKLVGVGTGNDKKLIVIAIRSYLERLNKNNTLGNRHLASVEKLAALVEKVKL

SEQ ID NO: 22064 - DNA, 6321 bp, Plasmodium falciparum
  CDS (515)..(6199)
ttatttttatacattttggtcatacaaaaaaaaaaaaaaaaaaaaaagaaaagaaaagaaaagaaaaaaatatttgttttataataatatagtatgtataacaatttttatattacataaatttttttgaaggtttgattttttcctcattctttattttttttttattttttttttttttgtgattactgattttttctatatatataatatatatatatacatatatatatttttatatttatccatgtagacagtatatttttaccttgctacgtaatatgaagaaaatattttataaaaatgtttttgtaaataaatttttttttttttttttttttttctttccttatttttaaacaaaaaaaaagaaaaaaaagatattaaaggaattaaagatttaacaagaatatttggaaaattttatatacatataagtctggaagatttgtatgtgtgtccataaataaataaataataaatattatatatatatatatatatatatatatgtatgtatatttgtttgtataacatattttattttatatgtagcaaaatggaaaatacgaaaaggaaggaaaatgataattgcaaggaatatgcgttaaatataagttcaaaaactaacaaggaaaaatataaatatgaagggaaaaaaaaagatgaaaagaaaaaaaaggatgaaggggaatacacaaatgatgataacaaatatgtgaatgatgagaacaaatatgtgaatgatgataacaaatatgtgaatgatgagaacaaatatgtgaatgatgagaacaaatatgtgaataatgataacaaatatgtgaataatgataacaaatatgtgaataatgataacaaatatacatatgatgaaaatacgaaaaaggataaagtagatataaatatagatatatataacgatgataaccaaagttataataataagaagcaaaaaaatgatgatgatgatattagtcataacaaacataaaaatggagatgacaaaatagataatatagacaatatagataataatattgaaaagggagataataatatatgtaacttttatgataaaaggaatgaagataataatacatatgctgattgtaataatatagttgagggaattaataataattttgagtgtagtggtaaaaaatgtaactatatagacaaacaacgagataaaacaaaaaaatatgatattataaatatgaaatgtgataataaatgtagtaataatatgaagaattcaacgaaaaataaaatgaatacccaaacaaataataacaaagatatgttaagtaatcaaataaggatgtgttcaaaaaatataaataataattatatttataataataataataataataatagtattattagtagtaattattattataactattataataatacaaatatgtataacgaattaaatatggtacataatgaaaaaaataatttgatagacatattagacaaagaattaaaaaaaaattgtaataattataatataggaaataataatatgaattgtaactataaaccaaattataactattttattaataaagatttattaaataataatatgacatatatatataattatcctatgatgaatacattaaattatagtaaagataataattattgtacatatctcgatgaaataaatagaataaatgaatgtacatataataccacacaaccaaatttaaataataatacaacatattctcctaattttaatgataattcaaatttgttgtataaccatgaatcatatattttgtctccttatgattattataattattattgttctggtcttatacctacatatccgatatttaactatagaaatgttataaatagtaataataataataataatataaatggtaatataaataataatataaatggtaatataaataataatataaatggtaatataaataataatatgaatggtaatataaataataatatgaatggtaatataaataataatatacatagtaatataaataataatagtaataataataatagtaataataatagtaataataataataaacattattatgataatacttattttaatcatattataccgagtaatacaaataataattctatagatacttacaatgaaaataataacaatcataaaatgttttataattataataaatataatatgtatgctccaaaaatatattatcatgataatatgcataatctatatcctattaataatattccatcgaattataatagtacggaaaataaaatattaaattgtaacaccataattccttatactggaacgaacaacaacaacaataataataataataataataataataacaataataataataataataataataataataataacaataacaataataataataatattctttcaaaaaatatagtaccatataatgcaaacgatataaataatttaattaatctaaacaatgataatataaataataattcccatatgaatcctaataataatacacaaatctttaattattttaattatgtatcaaatagtaatttcaatattcaaagatatttatcaaacaataataataataataataatttaaataatagtacagattatcaacaaaacatttcatactataatacatataattcaaattgttattcatcagcatcaaaaacatattattgtaatcaatatttaaatgaatatcctttatttcctgtctcttctattgatttatataacacggataatatgaactacacctcaaatcagttgtattactaccacgggaatgataacatgaacaacgaagaattaaaaaaaaaagcagaacaagaaaatactcataacaatgtaaatatgaacaaacgaggagtacaaaacaaaaaaaataactataataaggaaaactatttatctccaatatcgttcactggaaatatttgcaaaatagccaaggatcaaacgggttgtaggattttgcaaaggatactagaaaaaaagaatccaaaacatattgaagaaatatataatgaagcacttgatcatataattgaattgatggttgacccatttggtaattatttatgtcagaaacttatggaagtatgtacatctgagcaaatagaaaaaataattgataaatcatcagaccagttaataaacgcctccataagtgttcatggtacaaggaccgtccagaagcttatcgaaatgataaaaactccttctcaaattaaaaaaacaaccaaggctctaaaaaattcaataataactttgataaaagatattaatggaaaccatgtggttcagaaatgtttaattaccttaacgagtcatcagtgtgattttatatacgaagctattttaaataactgtgttgaagtatccacgcatagacacggctgttgtgtgattcagagatgcatagactctgcgaacgaggcacaaaaggaactgttcatcagaaatatttcgaacaatgccctggatttagtacaagatgcattcggaaattacgttgtacaatatattctgaatttaggaaatgagaaagtaaatttagaaatagccaataagttattaccaaatatcgaggaactagctgttcagaaattttcatctaatgttgtagagaaatgtctaataataggtaataacaaatgtaggaaactcataataaatgaaatattgaaaaaagataaagatatattaaaacaaataattttagatccatttggaaattatgttattcaaagagcattgtcagttgcttcagaacctgaattaacaaaattagttgaaggaatcaaaccatatataaaagaattacgtaatatatcatctggaaaaagaattgcatggaaattagctaaaaaacatcctttacttaatgccgatattaataatcaatatttttcaaatgataactcagataatgtttctttacaaaatcatgatatttcttctactaacaattctattaatattccaacaaacaattcggatattttcaaaaatgataaaaaaaaaaataatgatgaaaatattgtaaaaaagaattacaacaacaacaataataataataataataatgtcaaaactttcaatcattccaaaaattataatgccaaaaattttaataataatcctaatggaaacataaaaaattttactaatgataatatgaagtcttataattatgaacatatgagaaattataattttgatcctataagaaattataatatggataatatgaaaaattataatgtggataatatgaaaaattataatgtggataatatgaaaaattataatatggataatatgaaaaattataatatggataatatgaaaaattttaacaatgaatatgtcaaaaattttaacaatgaatatgtcaaaaattataacaatgaatatgtcaaaaattataacaatgaatatgtcaaaaattataacaatgaatatgtcaagaattatcatcataataatataaaaaatcatattaattgttctaataatagttatgcaaataattctaaaacatacaaaaaaaatacacaacaaaaaaaaaacctgcaatcttcgaatgacctctgtaatgttgtttcatataatgatcattccccacaaaatattgcacataaaaaaaataaccttcaagaaaaaatatcaaatgtatataacaaaagaaatgatgattcctctatgaataataacacgttttgttataaacaaggttatgtaccagatgatacaatgaaaacgcataacgaaaccaaaaataatgataaaatggatgagatggataatctcacaacaaatgaaagagaacatttaaacaaaatttattctaatcaagaagacaaccaaaacaagaaagatgatatttaccacacgcataagaggaatgatgaaagcaatatttatgaaaatcaaagaaattttaacaaaaataattttaaatatgtgattggtcaaaacttgcatagggatgataataacattcttgtatgtaataaaagtaaaactgatagggaaaataatgtaagaataaatataaatgaaaagaatgaagaaaaaaatgtagatggtcaggagaaaaatgaaaatattcaggaaaaaatagacaatgttcaggaaaaaaaagacaatattcaggaaaaaaatgaaaatattcaggaaaaaaaagataatgttcaggaaaaaaatgaaaatattcaggaaaaaaaagataatgttcaggaaaaaaatgaaaatattcaggaaaaaaaagataatgttcaggaaaaaaatgaaaatattcaggaaaaaaatgaaaatattcaggaaaaaaatgaaaatattcaggaaaaaaatgaaaatatccagagaaaaaaaaacaatgttcaggggaaaaatgaaaactcccaggaaaaacaagaaaatattcaggtgaaaaaagaatacgtaaatgagaaaaaggaatgcatagatgatgaagaacaaaaagaaccctttcacaataatgcaaacacccaaaacgataataaatgtaacaacaatgtgattaaaaaaagcagtgtccatttagataatgaaaaatatcattatgaaaataatataaatacagagaaagagcatattaggagcaaatcaaatcataacaggataaataacaatagttatgataacaaaatgatagaaaaacagaacaatgaaaattccaataagtatataatacaaaatgttcctaataataatagtagaatgtttcataaaaaaaatgatgaaaataaagatggtaccaaaaataaacatatggaaaataaaaataataaagtatataacaataatttcaataaaaatgaatataaaagaatacaaaacaatcaaatgaatatgaatcaaagctataatttttctcagaataaaaactatgtctacaataatagttataataattataacgaaaattatgtcaacttttatcccatgagaaataataatcaagattttaattcaaatatatgttcaagtaataagaataatcctaaattgacatatatatcaaataataaaaataatggagataattatatgaggaaaaaccccaaaaaaattacgaagaaatatagtaatgagtccaaattaatatgaactgatatgatcttaaatgcgagtgctttttttttttttttttttttttaatatgtttataaaattttataaaaaaaaaataaaataaaataggcaaatgattagacaaaaaaaaaaaaaaa

SEQ ID NO: 22065 - protein, 1894 aa, Plasmodium falciparum
MYICLYNIFYFICSKMENTKRKENDNCKEYALNISSKTNKEKYKYEGKKKDEKKKKDEGEYTNDDNKYVNDENKYVNDDNKYVNDENKYVNDENKYVNNDNKYVNNDNKYVNNDNKYTYDENTKKDKVDINIDIYNDDNQSYNNKKQKNDDDDISHNKHKNGDDKIDNIDNIDNNIEKGDNNICNFYDKRNEDNNTYADCNNIVEGINNNFECSGKKCNYIDKQRDKTKKYDIINMKCDNKCSNNMKNSTKNKMNTQTNNNKDMLSNQIRMCSKNINNNYIYNNNNNNNSIISSNYYYNYYNNTNMYNELNMVHNEKNNLIDILDKELKKNCNNYNIGNNNMNCNYKPNYNYFINKDLLNNNMTYIYNYPMMNTLNYSKDNNYCTYLDEINRINECTYNTTQPNLNNNTTYSPNFNDNSNLLYNHESYILSPYDYYNYYCSGLIPTYPIFNYRNVINSNNNNNNINGNINNNINGNINNNINGNINNNMNGNINNNMNGNINNNIHSNINNNSNNNNSNNNSNNNNKHYYDNTYFNHIIPSNTNNNSIDTYNENNNNHKMFYNYNKYNMYAPKIYYHDNMHNLYPINNIPSNYNSTENKILNCNTIIPYTGTNNNNNNNNNNNNNNNNNNNNNNNNNNNNNNNNNILSKNIVPYNANDINNLINLNNDNINNNSHMNPNNNTQIFNYFNYVSNSNFNIQRYLSNNNNNNNNLNNSTDYQQNISYYNTYNSNCYSSASKTYYCNQYLNEYPLFPVSSIDLYNTDNMNYTSNQLYYYHGNDNMNNEELKKKAEQENTHNNVNMNKRGVQNKKNNYNKENYLSPISFTGNICKIAKDQTGCRILQRILEKKNPKHIEEIYNEALDHIIELMVDPFGNYLCQKLMEVCTSEQIEKIIDKSSDQLINASISVHGTRTVQKLIEMIKTPSQIKKTTKALKNSIITLIKDINGNHVVQKCLITLTSHQCDFIYEAILNNCVEVSTHRHGCCVIQRCIDSANEAQKELFIRNISNNALDLVQDAFGNYVVQYILNLGNEKVNLEIANKLLPNIEELAVQKFSSNVVEKCLIIGNNKCRKLIINEILKKDKDILKQIILDPFGNYVIQRALSVASEPELTKLVEGIKPYIKELRNISSGKRIAWKLAKKHPLLNADINNQYFSNDNSDNVSLQNHDISSTNNSINIPTNNSDIFKNDKKKNNDENIVKKNYNNNNNNNNNNVKTFNHSKNYNAKNFNNNPNGNIKNFTNDNMKSYNYEHMRNYNFDPIRNYNMDNMKNYNVDNMKNYNVDNMKNYNMDNMKNYNMDNMKNFNNEYVKNFNNEYVKNYNNEYVKNYNNEYVKNYNNEYVKNYHHNNIKNHINCSNNSYANNSKTYKKNTQQKKNLQSSNDLCNVVSYNDHSPQNIAHKKNNLQEKISNVYNKRNDDSSMNNNTFCYKQGYVPDDTMKTHNETKNNDKMDEMDNLTTNEREHLNKIYSNQEDNQNKKDDIYHTHKRNDESNIYENQRNFNKNNFKYVIGQNLHRDDNNILVCNKSKTDRENNVRININEKNEEKNVDGQEKNENIQEKIDNVQEKKDNIQEKNENIQEKKDNVQEKNENIQEKKDNVQEKNENIQEKKDNVQEKNENIQEKNENIQEKNENIQEKNENIQRKKNNVQGKNENSQEKQENIQVKKEYVNEKKECIDDEEQKEPFHNNANTQNDNKCNNNVIKKSSVHLDNEKYHYENNINTEKEHIRSKSNHNRINNNSYDNKMIEKQNNENSNKYIIQNVPNNNSRMFHKKNDENKDGTKNKHMENKNNKVYNNNFNKNEYKRIQNNQMNMNQSYNFSQNKNYVYNNSYNNYNENYVNFYPMRNNNQDFNSNICSSNKNNPKLTYISNNKNNGDNYMRKNPKKITKKYSNESKLI

SEQ ID NO: 22066 - DNA, 2940 bp, Dictyostelium discoideum
  CDS (377)..(2764)
attaaaatcaatataaaatttttttaaaaaaaaaaaattaaaaaaaaaaaaaaaaaataatataaaattatataaatttaaacctggaaggaaaaaaaaaaaagaaaaaaaaaaaaaaaggaaaaaaaaaaaaaaaaaagcttgttaaataaaaaaaaaaaataaactgttatataaaatttaaaaattaaaaatagactcttcttttctttttttttttttatttccaatcccaaaatagagaacttcaaataaaatgcaaatcatttttttttttattttttttaatttttttatttttttttttttttctaaaatttttttattttttatttttttctaatttttttattttttaaattcattaactgatcacatgaaacctgtaaatcaatacaatcaacaacaacaacaacaacaacatcatcatcatcatcatcaccaacaatcacaacaacaacaacaacaacaacaatcacaacaacaacaaaggtcatcaattcatcatcaacaaccaccacaatatggtatatattcatcattacaacaacaacaattccaaaatggtggcaatggatataggggtcaaatcaacacaaatgatttttatataaatgagcaacaacaattacaacaacagcagcaacaacaacaccaccaccatcaacaaccaccacaacatcaccagcaacaacaacatgctcaaaaaccctatattactagtattcataatggtcatcaagttggagtttctcaacaaactcatatggtacctcaacaacaacaacaaacaactagtttacatcatcaacacccacaacaaattagagaattccaaccaaaaagaaaacctcttaccaataatactgtatctcaatccccacctcaacctgttaatattataaataatcatactcaatacaatagcaacaacaacaacaacaacaataataataatcaatattattcaagttcaccacaacaaaatataggtttatcaccaaattctttgtctccatcgatgattcaacaacaccaccaccatcaacaacaacaacaccaccaccatcatcaacatcatcatcaacaacaacatcacaatcaacaccctgtagttacattatcatcatcaccaacctcatcatctttgtcacattcaccatcaacaattgtcacattaaataataataatagtaatagtaatataaatagtaatataacaaataatgccactggtaataacggtggtatgaataaaccagtatcgattaatttgaacacttcaacacattcatcaccaaattcacaatcatcaccaaacacaccaaactctttatccacaccaacaccattaagcgcttctactgttgtggctaataataacaatggtaattttaatgatagtgctaatggtaatggattaaaacctgtagaaattaaccaaaccctatcaccctcttcaacaattgtagcaaacgcaccagctccaaatgtagttttatcgaacaattcaacaaatagtgttgtttcatcttcatcaccaccaccaacaacttcatctccatcatcattgtcatcgtcatcattgtcatcagcagcaacaaccaccaccacaacaaccaccaccacaacagcaacagcaactcaatcaactacaccaccaccaccaccagttacatctacaccatcatcaccaactcaacaacaaaccaatgaatatacaaccagatcacaattattagaagactttagaaacttaaagatgaaattagaattaagtgatattaaaggtcatatcgcagaatttagtaaagatcaagttggttcaagaatcattcaacaaaagatcgaaaatgcaagtcttgaagagaaacaattggtatttgatgaagttgttgttgctgtacactctttaatgaccgacgtatttggtaactatgttttacaaaagtttttcgagcatggtacaaccgaacaaaaacgtatccttgccgataaacttagtggtcatatactctcacttacacttcaaatgtatggttgtcgtgtcattcaaaaggcaattgaatccattgaattggataaacaaatccttttaatcggtgaattgaatggtcatatcgttcaatgtgttaccgatcaaaatggtaatcatgtcattcaaaagtgtatcgaaaagattccaacacatttgattcaattcatcattgattccttccatggccacatctatcaattggcaactcatccatatggctgtcgtgtaattcaaagaatcttggaacattgtgccgaaaaacaagtggctccaatccttgatgaattaatgcgttgtgccgtttcattggttcaagatcaatatggtaactatgtcatccaacacgtattggagaatggaacaccacgtgataagagtgcaatcgtatgcaaacttcaaggtcaaatctataatcttagtcaacacaagtttgcaagtaatgtcattgaaaaatgtgttcaacatggatgtacagccgagagaatcctcatcatcaatgagatattgggtgatgcaaactctccaaattcttcaaatgttttactcaaaatcttaaaggatccatacgcaaactatgttattcaaaagattttagatattgttgaacctgctcaacgtgatatgatcatcaatcgtattcaaccatttgttccaactcttaaaaaagtcactcctggaaaacatatcatttcaagaattgaaaaatattctgcaaataataattaaattaaattaaaattttaattattttaaaaaaatatatataaagatattatctttatatattttaattatgattgtttatcatattaatcaaatcaaatcatacatcacatacacataatcataaccatcatcactatcaaaactttatatataatcaattaaaatcaatataaaat

SEQ ID NO: 22067 - protein, 795 aa, Dictyostelium discoideum
MKPVNQYNQQQQQQQHHHHHHHQQSQQQQQQQQSQQQQRSSIHHQQPPQYGIYSSLQQQQFQNGGNGYRGQINTNDFYINEQQQLQQQQQQQHHHHQQPPQHHQQQQHAQKPYITSIHNGHQVGVSQQTHMVPQQQQQTTSLHHQHPQQIREFQPKRKPLTNNTVSQSPPQPVNIINNHTQYNSNNNNNNNNNNQYYSSSPQQNIGLSPNSLSPSMIQQHHHHQQQQHHHHHQHHHQQQHHNQHPVVTLSSSPTSSSLSHSPSTIVTLNNNNSNSNINSNITNNATGNNGGMNKPVSINLNTSTHSSPNSQSSPNTPNSLSTPTPLSASTVVANNNNGNFNDSANGNGLKPVEINQTLSPSSTIVANAPAPNVVLSNNSTNSVVSSSSPPPTTSSPSSLSSSSLSSAATTTTTTTTTTTATATQSTTPPPPPVTSTPSSPTQQQTNEYTTRSQLLEDFRNLKMKLELSDIKGHIAEFSKDQVGSRIIQQKIENASLEEKQLVFDEVVVAVHSLMTDVFGNYVLQKFFEHGTTEQKRILADKLSGHILSLTLQMYGCRVIQKAIESIELDKQILLIGELNGHIVQCVTDQNGNHVIQKCIEKIPTHLIQFIIDSFHGHIYQLATHPYGCRVIQRILEHCAEKQVAPILDELMRCAVSLVQDQYGNYVIQHVLENGTPRDKSAIVCKLQGQIYNLSQHKFASNVIEKCVQHGCTAERILIINEILGDANSPNSSNVLLKILKDPYANYVIQKILDIVEPAQRDMIINRIQPFVPTLKKVTPGKHIISRIEKYSANNN

SEQ ID NO: 22068 - DNA, 26 bp, Primer
atggaaatgaacatggatatggatat

SEQ ID NO: 22069 - DNA, 24 bp, Primer
tcacacctccgcattttcaaccaa

SEQ ID NO: 22070 - DNA, 1992 bp, Saccharomyces cerevisiae; identical to SEQ ID NO: 1301
  CDS (1)..(1992)

SEQ ID NO: 22071 - protein, 663 aa, Saccharomyces cerevisiae; identical to SEQ ID NO: 1302

SEQ ID NO: 22072 - DNA, 28 bp, Primer
atgaagttactttttaaaagatattcgt

SEQ ID NO: 22073 - DNA, 27 bp, Primer
ttatttttgttgcatttgcttagatct

SEQ ID NO: 22074 - DNA, 1470 bp, Saccharomyces cerevisiae; identical to SEQ ID NO: 3866
  CDS (1)..(1470)

SEQ ID NO: 22075 - protein, 489 aa, Saccharomyces cerevisiae; identical to SEQ ID NO: 3867

SEQ ID NO: 22076 - DNA, 1215 bp, Bacillus subtilis; identical to SEQ ID NO: 3868
  CDS (1)..(1215)

SEQ ID NO: 22077 - protein, 404 aa, Bacillus subtilis; identical to SEQ ID NO: 3869

SEQ ID NO: 22078 - DNA, 1224 bp, Methanobacterium thermoautotrophicum; identical to SEQ ID NO: 3870
  CDS (1)..(1224)

SEQ ID NO: 22079 - protein, 407 aa, Methanobacterium thermoautotrophicum; identical to SEQ ID NO: 3871

SEQ ID NO: 22080 - DNA, 1176 bp, Archaeoglobus fulgidus; identical to SEQ ID NO: 3872
  CDS (1)..(1176)

SEQ ID NO: 22081 - protein, 391 aa, Archaeoglobus fulgidus; identical to SEQ ID NO: 3873

SEQ ID NO: 22082 - DNA, 1479 bp, Xylella fastidiosa; identical to SEQ ID NO: 3874
  CDS (1)..(1479)

SEQ ID NO: 22083 - protein, 492 aa, Xylella fastidiosa; identical to SEQ ID NO: 3875

SEQ ID NO: 22084 - DNA, 1545 bp, Arabidopsis thaliana (mouse-ear cress); identical to SEQ ID NO: 3876
  CDS (1)..(1545)

SEQ ID NO: 22085 - protein, 514 aa, Arabidopsis thaliana (mouse-ear cress); identical to SEQ ID NO: 3877

SEQ ID NO: 22086 - DNA, 1287 bp, Salmonella enterica subsp. enterica serovar Typhi; identical to SEQ ID NO: 3878
  CDS (1)..(1287)

SEQ ID NO: 22087 - protein, 428 aa, Salmonella enterica subsp. enterica serovar Typhi; identical to SEQ ID NO: 3879

SEQ ID NO: 22088 - DNA, 1206 bp, Listeria monocytogenes; identical to SEQ ID NO: 3880
  CDS (1)..(1206)

SEQ ID NO: 22089 - protein, 401 aa, Listeria monocytogenes; identical to SEQ ID NO: 3881

SEQ ID NO: 22090 - DNA, 1413 bp, Nostoc sp. PCC 7120; identical to SEQ ID NO: 3882
  CDS (1)..(1413)

SEQ ID NO: 22091 - protein, 470 aa, Nostoc sp. PCC 7120; identical to SEQ ID NO: 3883

SEQ ID NO: 22092 - DNA, 1296 bp, Yersinia pestis; identical to SEQ ID NO: 3884
  CDS (1)..(1296)

SEQ ID NO: 22093 - protein, 431 aa, Yersinia pestis; identical to SEQ ID NO: 3885

SEQ ID NO: 22094 - DNA, 1206 bp, Listeria innocua; identical to SEQ ID NO: 3886
  CDS (1)..(1206)

SEQ ID NO: 22095 - protein, 401 aa, Listeria innocua; identical to SEQ ID NO: 3887

SEQ ID NO: 22096 - DNA, 1320 bp, Deinococcus radiodurans; identical to SEQ ID NO: 3888
  CDS (1)..(1320)

SEQ ID NO: 22097 - protein, 439 aa, Deinococcus radiodurans; identical to SEQ ID NO: 3889

SEQ ID NO: 22098 - DNA, 1266 bp, Bacillus halodurans; identical to SEQ ID NO: 3890
  CDS (1)..(1266)

SEQ ID NO: 22099 - protein, 421 aa, Bacillus halodurans; identical to SEQ ID NO: 3891

SEQ ID NO: 22100 - DNA, 1239 bp, Methanobacterium thermoautotrophicum; identical to SEQ ID NO: 3892
  CDS (1)..(1239)

SEQ ID NO: 22101 - protein, 412 aa, Methanobacterium thermoautotrophicum; identical to SEQ ID NO: 3893

SEQ ID NO: 22102 - DNA, 1305 bp, Neisseria meningitidis; identical to SEQ ID NO: 3894
  CDS (1)..(1305)

SEQ ID NO: 22103 - protein, 434 aa, Neisseria meningitidis; identical to SEQ ID NO: 3895

SEQ ID NO: 22104 - DNA, 1329 bp, Pseudomonas aeruginosa; identical to SEQ ID NO: 3896
  CDS (1)..(1329)

SEQ ID NO: 22105 - protein, 442 aa, Pseudomonas aeruginosa; identical to SEQ ID NO: 3897

SEQ ID NO: 22106 - DNA, 1533 bp, Caulobacter crescentus; identical to SEQ ID NO: 3898
  CDS (1)..(1533)

SEQ ID NO: 22107 - protein, 510 aa, Caulobacter crescentus; identical to SEQ ID NO: 3899

SEQ ID NO: 22108 - DNA, 1167 bp, Archaeoglobus fulgidus; identical to SEQ ID NO: 3900
  CDS (1)..(1167)

SEQ ID NO: 22109 - protein, 388 aa, Archaeoglobus fulgidus; identical to SEQ ID NO: 3901

SEQ ID NO: 22110 - DNA, 1533 bp, Ureaplasma urealyticum; identical to SEQ ID NO: 3902
  CDS (1)..(1533)

SEQ ID NO: 22111 - protein, 510 aa, Ureaplasma urealyticum; identical to SEQ ID NO: 3903

SEQ ID NO: 22112 - DNA, 1566 bp, Ureaplasma urealyticum; identical to SEQ ID NO: 3904
  CDS (1)..(1566)

SEQ ID NO: 22113 - protein, 521 aa, Ureaplasma urealyticum; identical to SEQ ID NO: 3905

SEQ ID NO: 22114 - DNA, 1530 bp, Sulfolobus solfataricus; identical to SEQ ID NO: 3906
  CDS (1)..(1530)

SEQ ID NO: 22115 - protein, 509 aa, Sulfolobus solfataricus; identical to SEQ ID NO: 3907

SEQ ID NO: 22116 - DNA, 1272 bp, Aquifex aeolicus; identical to SEQ ID NO: 3908
  CDS (1)..(1272)

SEQ ID NO: 22117 - protein, 423 aa, Aquifex aeolicus; identical to SEQ ID NO: 3909

SEQ ID NO: 22118 - DNA, 1434 bp, Mycobacterium tuberculosis; identical to SEQ ID NO: 3910
  CDS (1)..(1434)

SEQ ID NO: 22119 - protein, 477 aa, Mycobacterium tuberculosis; identical to SEQ ID NO: 3911

SEQ ID NO: 22120 - DNA, 1308 bp, Thermotoga maritima; identical to SEQ ID NO: 3912
  CDS (1)..(1308)

SEQ ID NO: 22121 - protein, 435 aa, Thermotoga maritima; identical to SEQ ID NO: 3913

SEQ ID NO: 22122 - DNA, 1242 bp, Lactococcus lactis subsp. lactis; identical to SEQ ID NO: 3914
  CDS (1)..(1242)

SEQ ID NO: 22123 - protein, 413 aa, Lactococcus lactis subsp. lactis; identical to SEQ ID NO: 3915

SEQ ID NO: 22124 - DNA, 1218 bp, Clostridium acetobutylicum; identical to SEQ ID NO: 3916
  CDS (1)..(1218)

SEQ ID NO: 22125 - protein, 405 aa, Clostridium acetobutylicum; identical to SEQ ID NO: 3917

SEQ ID NO: 22126 - DNA, 1350 bp, Agrobacterium tumefaciens; identical to SEQ ID NO: 3918
  CDS (1)..(1350)

SEQ ID NO: 22127 - protein, 449 aa, Agrobacterium tumefaciens; identical to SEQ ID NO: 3919

SEQ ID NO: 22128 - DNA, 1479 bp, Saccharomyces cerevisiae; identical to SEQ ID NO: 3920
  CDS (1)..(1479)

SEQ ID NO: 22129 - protein, 492 aa, Saccharomyces cerevisiae; identical to SEQ ID NO: 3921

SEQ ID NO: 22130 - DNA, 1500 bp, Saccharomyces cerevisiae; identical to SEQ ID NO: 3922
  CDS (1)..(1500)

SEQ ID NO: 22131 - protein, 499 aa, Saccharomyces cerevisiae; identical to SEQ ID NO: 3923

SEQ ID NO: 22132 - DNA, 1524 bp, Synechocystis sp.; identical to SEQ ID NO: 3924
  CDS (1)..(1524)

SEQ ID NO: 22133 - protein, 507 aa, Synechocystis sp.; identical to SEQ ID NO: 3925

SEQ ID NO: 22134 - DNA, 1602 bp, Oryza sativa (rice); identical to SEQ ID NO: 3926
  CDS (1)..(1602)

SEQ ID NO: 22135 - protein, 533 aa, Oryza sativa (rice); identical to SEQ ID NO: 3927

SEQ ID NO: 22136 - DNA, 1515 bp, Arabidopsis thaliana (mouse-ear cress); identical to SEQ ID NO: 3928
  CDS (1)..(1515)

SEQ ID NO: 22137 - protein, 504 aa, Arabidopsis thaliana (mouse-ear cress); identical to SEQ ID NO: 3929

SEQ ID NO: 22138 - DNA, 1545 bp, Lycopersicon esculentum (tomato); identical to SEQ ID NO: 3930
  CDS (1)..(1545)

SEQ ID NO: 22139 - protein, 514 aa, Lycopersicon esculentum (tomato); identical to SEQ ID NO: 3931

SEQ ID NO: 22140 - DNA, 1506 bp, Arabidopsis thaliana (mouse-ear cress); identical to SEQ ID NO: 3932
  CDS (1)..(1506)

SEQ ID NO: 22141 - protein, 501 aa, Arabidopsis thaliana (mouse-ear cress); identical to SEQ ID NO: 3933

SEQ ID NO: 22142 - DNA, 1605 bp, Caenorhabditis elegans; identical to SEQ ID NO: 3934
  CDS (1)..(1605)

SEQ ID NO: 22143 - protein, 534 aa, Caenorhabditis elegans; identical to SEQ ID NO: 3935

SEQ ID NO: 22144 - DNA, 1347 bp, Streptomyces coelicolor; identical to SEQ ID NO: 3936
  CDS (1)..(1347)

SEQ ID NO: 22145 - protein, 448 aa, Streptomyces coelicolor; identical to SEQ ID NO: 3937

SEQ ID NO: 22146 - DNA, 1539 bp, Schizosaccharomyces pombe; identical to SEQ ID NO: 3938
  CDS (1)..(1539)

SEQ ID NO: 22147 - protein, 512 aa, Schizosaccharomyces pombe; identical to SEQ ID NO: 3939

SEQ ID NO: 22148 - DNA, 1425 bp, Rhizobium etli; identical to SEQ ID NO: 3940
  CDS (1)..(1425)

SEQ ID NO: 22149 - protein, 474 aa, Rhizobium etli; identical to SEQ ID NO: 3941

SEQ ID NO: 22150 - DNA, 1311 bp, Azotobacter vinelandii; identical to SEQ ID NO: 3942
  CDS (1)..(1311)

SEQ ID NO: 22151 - protein, 436 aa, Azotobacter vinelandii; identical to SEQ ID NO: 3943

SEQ ID NO: 22152 - DNA, 1482 bp, Azorhizobium caulinodans; identical to SEQ ID NO: 3944
  CDS (1)..(1482)

SEQ ID NO: 22153 - protein, 493 aa, Azorhizobium caulinodans; identical to SEQ ID NO: 3945

SEQ ID NO: 22154 - DNA, 1317 bp, Azospirillum brasilense; identical to SEQ ID NO: 3946
  CDS (1)..(1317)

SEQ ID NO: 22155 - protein, 438 aa, Azospirillum brasilense; identical to SEQ ID NO: 3947

SEQ ID NO: 22156 - DNA, 1314 bp, Wolinella succinogenes; identical to SEQ ID NO: 3948
  CDS (1)..(1314)

SEQ ID NO: 22157 - protein, 437 aa, Wolinella succinogenes; identical to SEQ ID NO: 3949

SEQ ID NO: 22158 - DNA, 1320 bp, Photorhabdus luminescens (subsp. laumondii); identical to SEQ ID NO: 3950
  CDS (1)..(1320)

SEQ ID NO: 22159 - protein, 439 aa, Photorhabdus luminescens (subsp. laumondii); identical to SEQ ID NO: 3951

SEQ ID NO: 22160 - DNA, 1437 bp, Gloeobacter violaceus; identical to SEQ ID NO: 3952
  CDS (1)..(1437)

SEQ ID NO: 22161 - protein, 478 aa, Gloeobacter violaceus; identical to SEQ ID NO: 3953

SEQ ID NO: 22162 - DNA, 1311 bp, Chromobacterium violaceum; identical to SEQ ID NO: 3954
  CDS (1)..(1311)

SEQ ID NO: 22163 - protein, 436 aa, Chromobacterium violaceum; identical to SEQ ID NO: 3955

SEQ ID NO: 22164 - DNA, 1479 bp, Neurospora crassa; identical to SEQ ID NO: 3956
  CDS (1)..(1479)

SEQ ID NO: 22165 - protein, 492 aa, Neurospora crassa; identical to SEQ ID NO: 3957

SEQ ID NO: 22166 - DNA, 1365 bp, Neurospora crassa; identical to SEQ ID NO: 3958
  CDS (1)..(1365)

SEQ ID NO: 22167 - protein, 454 aa, Neurospora crassa; identical to SEQ ID NO: 3959

SEQ ID NO: 22168 - DNA, 1533 bp, Neurospora crassa; identical to SEQ ID NO: 3960
  CDS (1)..(1533)

SEQ ID NO: 22169 - protein, 510 aa, Neurospora crassa; identical to SEQ ID NO: 3961

SEQ ID NO: 22170 - DNA, 1473 bp, Synechococcus sp. (strain WH8102); identical to SEQ ID NO: 3962
  CDS (1)..(1473)

SEQ ID NO: 22171 - protein, 490 aa, Synechococcus sp. (strain WH8102); identical to SEQ ID NO: 3963

SEQ ID NO: 22172 - DNA, 1590 bp, Rhodopirellula baltica; identical to SEQ ID NO: 3964
  CDS (1)..(1590)

SEQ ID NO: 22173 - protein, 529 aa, Rhodopirellula baltica; identical to SEQ ID NO: 3965

SEQ ID NO: 22174 - DNA, 1479 bp, Prochlorococcus marinus (strain MIT 9313); identical to SEQ ID NO: 3966
  CDS (1)..(1479)

SEQ ID NO: 22175 - protein, 492 aa, Prochlorococcus marinus (strain MIT 9313); identical to SEQ ID NO: 3967

SEQ ID NO: 22176 - DNA, 1509 bp, Prochlorococcus marinus; identical to SEQ ID NO: 3968
  CDS (1)..(1509)

SEQ ID NO: 22177 - protein, 502 aa, Prochlorococcus marinus; identical to SEQ ID NO: 3969

SEQ ID NO: 22178 - DNA, 1497 bp, Oryza sativa (Rice); identical to SEQ ID NO: 3970
  CDS (1)..(1497)

SEQ ID NO: 22179 - protein, 498 aa, Oryza sativa (Rice); identical to SEQ ID NO: 3971

SEQ ID NO: 22180 - DNA, 1557 bp, Lotus japonicus; identical to SEQ ID NO: 3972
  CDS (1)..(1557)

SEQ ID NO: 22181 - protein, 518 aa, Lotus japonicus; identical to SEQ ID NO: 3973

SEQ ID NO: 22182 - DNA, 1233 bp, Bacillus cereus (strain ATCC 14579 / DSM 31); identical to SEQ ID NO: 3974
  CDS (1)..(1233)

SEQ ID NO: 22183 - protein, 410 aa, Bacillus cereus (strain ATCC 14579 / DSM 31); identical to SEQ ID NO: 3975

SEQ ID NO: 22184 - DNA, 1311 bp, Streptomyces avermitilis; identical to SEQ ID NO: 3976
  CDS (1)..(1311)

SEQ ID NO: 22185 - protein, 436 aa, Streptomyces avermitilis; identical to SEQ ID NO: 3977

SEQ ID NO: 22186 - DNA, 1341 bp, Streptomyces avermitilis; identical to SEQ ID NO: 3978
  CDS (1)..(1341)

SEQ ID NO: 22187 - protein, 446 aa, Streptomyces avermitilis; identical to SEQ ID NO: 3979

SEQ ID NO: 22188 - DNA, 1461 bp, Oryza sativa (japonica cultivar-group); identical to SEQ ID NO: 3980
  CDS (1)..(1461)

SEQ ID NO: 22189 - protein, 486 aa, Oryza sativa (japonica cultivar-group); identical to SEQ ID NO: 3981

SEQ ID NO: 22190 - DNA, 1440 bp, Oryza sativa (japonica cultivar-group); identical to SEQ ID NO: 3982
  CDS (1)..(1440)

SEQ ID NO: 22191 - protein, 479 aa, Oryza sativa (japonica cultivar-group); identical to SEQ ID NO: 3983

SEQ ID NO: 22192 - DNA, 1455 bp, Xylella fastidiosa (strain Temecula1 / ATCC 700964); identical to SEQ ID NO: 3984
  CDS (1)..(1455)

SEQ ID NO: 22193 - protein, 484 aa, Xylella fastidiosa (strain Temecula1 / ATCC 700964); identical to SEQ ID NO: 3985

SEQ ID NO: 22194 - DNA, 1326 bp, Pseudomonas syringae (pv. tomato); identical to SEQ ID NO: 3986
  CDS (1)..(1326)

SEQ ID NO: 22195 - protein, 441 aa, Pseudomonas syringae (pv. tomato); identical to SEQ ID NO: 3987

SEQ ID NO: 22196 - DNA, 1338 bp, Pseudomonas syringae (pv. tomato); identical to SEQ ID NO: 3988
  CDS (1)..(1338)

SEQ ID NO: 22197 - protein, 445 aa, Pseudomonas syringae (pv. tomato); identical to SEQ ID NO: 3989

SEQ ID NO: 22198 - DNA, 1332 bp, Pseudomonas putida (strain KT2440); identical to SEQ ID NO: 3990
  CDS (1)..(1332)

SEQ ID NO: 22199 - protein, 443 aa, Pseudomonas putida (strain KT2440); identical to SEQ ID NO: 3991

SEQ ID NO: 22200 - DNA, 1317 bp, Lactobacillus plantarum; identical to SEQ ID NO: 3992
  CDS (1)..(1317)

SEQ ID NO: 22201 - protein, 438 aa, Lactobacillus plantarum; identical to SEQ ID NO: 3993

SEQ ID NO: 22202 - DNA, 1533 bp, Bradyrhizobium japonicum; identical to SEQ ID NO: 3994
  CDS (1)..(1533)

SEQ ID NO: 22203 - protein, 510 aa, Bradyrhizobium japonicum; identical to SEQ ID NO: 3995

SEQ ID NO: 22204 - DNA, 1251 bp, Staphylococcus epidermidis; identical to SEQ ID NO: 3996
  CDS (1)..(1251)

SEQ ID NO: 22205 - protein, 416 aa, Staphylococcus epidermidis; identical to SEQ ID NO: 3997

SEQ ID NO: 22206 - DNA, 1236 bp, Streptococcus mutans; identical to SEQ ID NO: 3998
  CDS (1)..(1236)

SEQ ID NO: 22207 - protein, 411 aa, Streptococcus mutans; identical to SEQ ID NO: 3999

SEQ ID NO: 22208 - DNA, 1371 bp, Oceanobacillus iheyensis; identical to SEQ ID NO: 4000
  CDS (1)..(1371)

SEQ ID NO: 22209 - protein, 456 aa, Oceanobacillus iheyensis; identical to SEQ ID NO: 4001

SEQ ID NO: 22210 - DNA, 1293 bp, Leptospira interrogans; identical to SEQ ID NO: 4002
  CDS (1)..(1293)

SEQ ID NO: 22211 - protein, 430 aa, Leptospira interrogans; identical to SEQ ID NO: 4003

SEQ ID NO: 22212 - DNA, 1287 bp, Escherichia coli O6; identical to SEQ ID NO: 4004
  CDS (1)..(1287)

SEQ ID NO: 22213 - protein, 428 aa, Escherichia coli O6; identical to SEQ ID NO: 4005

SEQ ID NO: 22214 - DNA, 1326 bp, Corynebacterium efficiens; identical to SEQ ID NO: 4006
  CDS (1)..(1326)

SEQ ID NO: 22215 - protein, 441 aa, Corynebacterium efficiens; identical to SEQ ID NO: 4007

SEQ ID NO: 22216 - DNA, 1320 bp, Corynebacterium efficiens; identical to SEQ ID NO: 4008
  CDS (1)..(1320)

SEQ ID NO: 22217 - protein, 439 aa, Corynebacterium efficiens; identical to SEQ ID NO: 4009

SEQ ID NO: 22218 - DNA, 1302 bp, Brucella suis; identical to SEQ ID NO: 4010
  CDS (1)..(1302)

SEQ ID NO: 22219 - protein, 433 aa, Brucella suis; identical to SEQ ID NO: 4011

SEQ ID NO: 22220 - DNA, 1296 bp, Bifidobacterium longum; identical to SEQ ID NO: 4012
  CDS (1)..(1296)

SEQ ID NO: 22221 - protein, 431 aa, Bifidobacterium longum; identical to SEQ ID NO: 4013

SEQ ID NO: 22222 - DNA, 1392 bp, Acetobacter diazotrophicus (Gluconacetobacter diazotrophicus); identical to SEQ ID NO: 4014
  CDS (1)..(1392)

SEQ ID NO: 22223 - protein, 463 aa, Acetobacter diazotrophicus (Gluconacetobacter diazotrophicus); identical to SEQ ID NO: 4015

SEQ ID NO: 22224 - DNA, 1818 bp, Medicago truncatula (Barrel medic); identical to SEQ ID NO: 4016
  CDS (47)..(1531)

SEQ ID NO: 22225 - protein, 494 aa, Medicago truncatula (Barrel medic); identical to SEQ ID NO: 4017

SEQ ID NO: 22226 - DNA, 1654 bp, Phytophthora infestans (Potato late blight fungus); identical to SEQ ID NO: 4018
  CDS (16)..(1572)

SEQ ID NO: 22227 - protein, 518 aa, Phytophthora infestans (Potato late blight fungus); identical to SEQ ID NO: 4019

SEQ ID NO: 22228 - DNA, 1332 bp, Chlorobium tepidum; identical to SEQ ID NO: 4020
  CDS (1)..(1332)

SEQ ID NO: 22229 - protein, 443 aa, Chlorobium tepidum; identical to SEQ ID NO: 4021

SEQ ID NO: 22230 - DNA, 2716 bp, Chlamydomonas reinhardtii; identical to SEQ ID NO: 4022
  CDS (26)..(1654)

SEQ ID NO: 22231 - protein, 542 aa, Chlamydomonas reinhardtii; identical to SEQ ID NO: 4023

SEQ ID NO: 22232 - DNA, 2568 bp, Chlamydomonas reinhardtii; identical to SEQ ID NO: 4024
  CDS (106)..(1845)

SEQ ID NO: 22233 - protein, 579 aa, Chlamydomonas reinhardtii; identical to SEQ ID NO: 4025

SEQ ID NO: 22234 - DNA, 1296 bp, Dictyostelium discoideum (Slime mold); identical to SEQ ID NO: 4026
  CDS (1)..(1296)

SEQ ID NO: 22235 - protein, 431 aa, Dictyostelium discoideum (Slime mold); identical to SEQ ID NO: 4027

SEQ ID NO: 22236 - DNA, 1434 bp, Hebeloma cylindrosporum; identical to SEQ ID NO: 4028
  CDS (1)..(1434)

SEQ ID NO: 22237 - protein, 477 aa, Hebeloma cylindrosporum; identical to SEQ ID NO: 4029

SEQ ID NO: 22238 - DNA, 1251 bp, Staphylococcus aureus (strain MW2); identical to SEQ ID NO: 4030
  CDS (1)..(1251)

SEQ ID NO: 22239 - protein, 416 aa, Staphylococcus aureus (strain MW2); identical to SEQ ID NO: 4031

SEQ ID NO: 22240 - DNA, 1476 bp, Xanthomonas campestris (pv. campestris); identical to SEQ ID NO: 4032
  CDS (1)..(1476)

SEQ ID NO: 22241 - protein, 491 aa, Xanthomonas campestris (pv. campestris); identical to SEQ ID NO: 4033

SEQ ID NO: 22242 - DNA, 1365 bp, Azoarcus sp. BH72; identical to SEQ ID NO: 4034
  CDS (1)..(1365)

SEQ ID NO: 22243 - protein, 454 aa, Azoarcus sp. BH72; identical to SEQ ID NO: 4035

SEQ ID NO: 22244 - DNA, 1430 bp, Azoarcus sp. BH72; identical to SEQ ID NO: 4036
  CDS (24)..(1430)

SEQ ID NO: 22245 - protein, 468 aa, Azoarcus sp. BH72; identical to SEQ ID NO: 4037

SEQ ID NO: 22246 - DNA, 1317 bp, Pseudomonas stutzeri (Pseudomonas perfectomarina); identical to SEQ ID NO: 4038
  CDS (1)..(1317)

SEQ ID NO: 22247 - protein, 438 aa, Pseudomonas stutzeri (Pseudomonas perfectomarina); identical to SEQ ID NO: 4039

SEQ ID NO: 22248 - DNA, 2195 bp, Chlamydomonas reinhardtii; identical to SEQ ID NO: 4040
  CDS (28)..(1647)

SEQ ID NO: 22249 - protein, 539 aa, Chlamydomonas reinhardtii; identical to SEQ ID NO: 4041

SEQ ID NO: 22250 - DNA, 1494 bp, Oryza sativa (japonica cultivar-group); identical to SEQ ID NO: 4042
  CDS (1)..(1494)

SEQ ID NO: 22251 - protein, 497 aa, Oryza sativa (japonica cultivar-group); identical to SEQ ID NO: 4043

SEQ ID NO: 22252 - DNA, 1883 bp, Oryza sativa (japonica cultivar-group); identical to SEQ ID NO: 4044
  CDS (87)..(1580)

SEQ ID NO: 22253 - protein, 497 aa, Oryza sativa (japonica cultivar-group); identical to SEQ ID NO: 4045

SEQ ID NO: 22254 - DNA, 1437 bp, Emericella nidulans (Aspergillus nidulans); identical to SEQ ID NO: 4046
  CDS (1)..(1437)

SEQ ID NO: 22255 - protein, 478 aa, Emericella nidulans (Aspergillus nidulans); identical to SEQ ID NO: 4047

SEQ ID NO: 22256 - DNA, 1635 bp, Emericella nidulans (Aspergillus nidulans); identical to SEQ ID NO: 4048
  CDS (1)..(1635)

SEQ ID NO: 22257 - protein, 544 aa, Emericella nidulans (Aspergillus nidulans); identical to SEQ ID NO: 4049

SEQ ID NO: 22258 - DNA, 1215 bp, Methanosarcina acetivorans; identical to SEQ ID NO: 4050
  CDS (1)..(1215)

SEQ ID NO: 22259 - protein, 404 aa, Methanosarcina acetivorans; identical to SEQ ID NO: 4051

SEQ ID NO: 22260 - DNA, 1209 bp, Methanosarcina acetivorans; identical to SEQ ID NO: 4052
  CDS (1)..(1209)

SEQ ID NO: 22261 - protein, 402 aa, Methanosarcina acetivorans; identical to SEQ ID NO: 4053

SEQ ID NO: 22262 - DNA, 2239 bp, Methanosarcina mazei (Methanosarcina frisia); identical to SEQ ID NO: 4054
  CDS (537)..(1730)

SEQ ID NO: 22263 - protein, 397 aa, Methanosarcina mazei (Methanosarcina frisia); identical to SEQ ID NO: 4055

SEQ ID NO: 22264 - DNA, 1446 bp, Neurospora crassa; identical to SEQ ID NO: 4056
  CDS (1)..(1446)

SEQ ID NO: 22265 - protein, 481 aa, Neurospora crassa; identical to SEQ ID NO: 4057

SEQ ID NO: 22266 - DNA, 2689 bp, Tuber borchii (White truffle); identical to SEQ ID NO: 4058
  CDS (386)..(1837)

SEQ ID NO: 22267 - protein, 483 aa, Tuber borchii (White truffle); identical to SEQ ID NO: 4059

SEQ ID NO: 22268 - DNA, 1311 bp, Ralstonia solanacearum (Pseudomonas solanacearum); identical to SEQ ID NO: 4060
  CDS (1)..(1311)

SEQ ID NO: 22269 - protein, 436 aa, Ralstonia solanacearum (Pseudomonas solanacearum); identical to SEQ ID NO: 4061

SEQ ID NO: 22270 - DNA, 1356 bp, Rhizobium meliloti (Sinorhizobium meliloti); identical to SEQ ID NO: 4062
  CDS (1)..(1356)

SEQ ID NO: 22271 - protein, 451 aa, Rhizobium meliloti (Sinorhizobium meliloti); identical to SEQ ID NO: 4063

SEQ ID NO: 22272 - DNA, 1655 bp, Lotus japonicus; identical to SEQ ID NO: 4064
  CDS (37)..(1497)

SEQ ID NO: 22273 - protein, 486 aa, Lotus japonicus; identical to SEQ ID NO: 4065

SEQ ID NO: 22274 - DNA, 1497 bp, Oryza sativa (Rice); identical to SEQ ID NO: 4066
  CDS (1)..(1497)

SEQ ID NO: 22275 - protein, 498 aa, Oryza sativa (Rice); identical to SEQ ID NO: 4067

SEQ ID NO: 22276 - DNA, 1479 bp, Hebeloma cylindrosporum; identical to SEQ ID NO: 4068
  CDS (1)..(1479)

SEQ ID NO: 22277 - protein, 492 aa, Hebeloma cylindrosporum; identical to SEQ ID NO: 4069

SEQ ID NO: 22278 - DNA, 1416 bp, Hebeloma cylindrosporum; identical to SEQ ID NO: 4070
  CDS (1)..(1416)

SEQ ID NO: 22279 - protein, 471 aa, Hebeloma cylindrosporum; identical to SEQ ID NO: 4071

SEQ ID NO: 22280 - DNA, 1771 bp, Ustilago maydis (Smut fungus); identical to SEQ ID NO: 4072
  CDS (149)..(1735)

SEQ ID NO: 22281 - protein, 528 aa, Ustilago maydis (Smut fungus); identical to SEQ ID NO: 4073

SEQ ID NO: 22282 - DNA, 1557 bp, Sulfolobus tokodaii; identical to SEQ ID NO: 4074
  CDS (1)..(1557)

SEQ ID NO: 22283 - protein, 518 aa, Sulfolobus tokodaii; identical to SEQ ID NO: 4075

SEQ ID NO: 22284 - DNA, 1356 bp, Rhizobium loti (Mesorhizobium loti); identical to SEQ ID NO: 4076
  CDS (1)..(1356)

SEQ ID NO: 22285 - protein, 451 aa, Rhizobium loti (Mesorhizobium loti); identical to SEQ ID NO: 4077

SEQ ID NO: 22286 - DNA, 1296 bp, Rhodospirillum rubrum; identical to SEQ ID NO: 4078
  CDS (1)..(1296)

SEQ ID NO: 22287 - protein, 431 aa, Rhodospirillum rubrum; identical to SEQ ID NO: 4079

SEQ ID NO: 22288 - DNA, 1473 bp, Dictyostelium discoideum (Slime mold); identical to SEQ ID NO: 4080
  CDS (37)..(1428)

SEQ ID NO: 22289 - protein, 463 aa, Dictyostelium discoideum (Slime mold); identical to SEQ ID NO: 4081

SEQ ID NO: 22290 - DNA, 1494 bp, Schizosaccharomyces pombe (Fission yeast); identical to SEQ ID NO: 4082
  CDS (1)..(1494)

SEQ ID NO: 22291 - protein, 497 aa, Schizosaccharomyces pombe (Fission yeast); identical to SEQ ID NO: 4083

SEQ ID NO: 22292 - DNA, 1797 bp, Lotus japonicus; identical to SEQ ID NO: 4084
  CDS (76)..(1581)

SEQ ID NO: 22293 - protein, 501 aa, Lotus japonicus; identical to SEQ ID NO: 4085

SEQ ID NO: 22294 - DNA, 1491 bp, Arabidopsis thaliana (Mouse-ear cress); identical to SEQ ID NO: 4086
  CDS (1)..(1491)

SEQ ID NO: 22295 - protein, 496 aa, Arabidopsis thaliana (Mouse-ear cress); identical to SEQ ID NO: 4087

SEQ ID NO: 22296 - DNA, 1554 bp, Schizosaccharomyces pombe (Fission yeast); identical to SEQ ID NO: 4088
  CDS (1)..(1554)

SEQ ID NO: 22297 - protein, 517 aa, Schizosaccharomyces pombe (Fission yeast); identical to SEQ ID NO: 4089

SEQ ID NO: 22298 - DNA, 1476 bp, Xanthomonas axonopodis (pv. citri), and; identical to SEQ ID NO: 4090
  CDS (1)..(1476)

SEQ ID NO: 22299 - protein, 491 aa, Xanthomonas axonopodis (pv. citri), and; identical to SEQ ID NO: 4091

SEQ ID NO: 22300 - DNA, 1482 bp, Prochlorococcus sp. (strain PCC 9511); identical to SEQ ID NO: 4092
  CDS (1)..(1482)

SEQ ID NO: 22301 - protein, 493 aa, Prochlorococcus sp. (strain PCC 9511); identical to SEQ ID NO: 4093

SEQ ID NO: 22302 - DNA, 1317 bp, Corynebacterium glutamicum (Brevibacterium flavum); identical to SEQ ID NO: 4094
  CDS (1)..(1317)

SEQ ID NO: 22303 - protein, 438 aa, Corynebacterium glutamicum (Brevibacterium flavum); identical to SEQ ID NO: 4095

SEQ ID NO: 22304 - DNA, 1690 bp, Ustilago violacea (Smut fungus) (Microbotryum violaceum); identical to SEQ ID NO: 4096
  CDS (19)..(1500)

SEQ ID NO: 22305 - protein, 493 aa, Ustilago violacea (Smut fungus) (Microbotryum violaceum); identical to SEQ ID NO: 4097

SEQ ID NO: 22306 - DNA, 1658 bp, Arabidopsis thaliana (Mouse-ear cress); identical to SEQ ID NO: 4098
  CDS (63)..(1490): n means a or g or c or t/u

SEQ ID NO: 22307 - protein, 475 aa, Arabidopsis thaliana (Mouse-ear cress); identical to SEQ ID NO: 4099

SEQ ID NO: 22308 - DNA, 1359 bp, Corynebacterium glutamicum (Brevibacterium flavum); identical to SEQ ID NO: 4100
  CDS (1)..(1359)

SEQ ID NO: 22309 - protein, 452 aa, Corynebacterium glutamicum (Brevibacterium flavum); identical to SEQ ID NO: 4101

SEQ ID NO: 22310 - DNA, 1751 bp, Lycopersicon esculentum (Tomato); identical to SEQ ID NO: 4102
  CDS (56)..(1522)

SEQ ID NO: 22311 - protein, 488 aa, Lycopersicon esculentum (Tomato); identical to SEQ ID NO: 4103

SEQ ID NO: 22312 - DNA, 1671 bp, Arabidopsis thaliana (Mouse-ear cress); identical to SEQ ID NO: 4104
  CDS (10)..(1569)

SEQ ID NO: 22313 - protein, 519 aa, Arabidopsis thaliana (Mouse-ear cress); identical to SEQ ID NO: 4105

SEQ ID NO: 22314 - DNA, 1659 bp, Lycopersicon esculentum (Tomato); identical to SEQ ID NO: 4106
  CDS (179)..(1561)

SEQ ID NO: 22315 - protein, 460 aa, Lycopersicon esculentum (Tomato); identical to SEQ ID NO: 4107

SEQ ID NO: 22316 - DNA, 1603 bp, Ustilago maydis (Smut fungus); identical to SEQ ID NO: 4108
  CDS (91)..(1554)

SEQ ID NO: 22317 - protein, 487 aa, Ustilago maydis (Smut fungus); identical to SEQ ID NO: 4109

SEQ ID NO: 22318 - DNA, 1470 bp, Geobacter sulfurreducens; identical to SEQ ID NO: 4110
  CDS (1)..(1470)

SEQ ID NO: 22319 - protein, 489 aa, Geobacter sulfurreducens; identical to SEQ ID NO: 4111

SEQ ID NO: 22320 - DNA, 1221 bp, Geobacter sulfurreducens; identical to SEQ ID NO: 4112
  CDS (1)..(1221)

SEQ ID NO: 22321 - protein, 406 aa, Geobacter sulfurreducens; identical to SEQ ID NO: 4113

SEQ ID NO: 22322 - DNA, 1656 bp, Triticum aestivum (Wheat); identical to SEQ ID NO: 4114
  CDS (93)..(1505)

SEQ ID NO: 22323 - protein, 470 aa, Triticum aestivum (Wheat); identical to SEQ ID NO: 4115

SEQ ID NO: 22324 - DNA, 1278 bp, Mycobacterium paratuberculosis; identical to SEQ ID NO: 4116
  CDS (1)..(1278)

SEQ ID NO: 22325 - protein, 425 aa, Mycobacterium paratuberculosis; identical to SEQ ID NO: 4117

SEQ ID NO: 22326 - DNA, 1440 bp, Mycobacterium paratuberculosis; identical to SEQ ID NO: 4118
  CDS (1)..(1440)

SEQ ID NO: 22327 - protein, 479 aa, Mycobacterium paratuberculosis; identical to SEQ ID NO: 4119

SEQ ID NO: 22328 - DNA, 1236 bp, Bacillus cereus ATCC 10987; identical to SEQ ID NO: 4120
  CDS (1)..(1236)

SEQ ID NO: 22329 - protein, 411 aa, Bacillus cereus ATCC 10987; identical to SEQ ID NO: 4121

SEQ ID NO: 22330 - DNA, 1332 bp, Rhodopseudomonas palustris; identical to SEQ ID NO: 4122
  CDS (1)..(1332)

SEQ ID NO: 22331 - protein, 443 aa, Rhodopseudomonas palustris; identical to SEQ ID NO: 4123

SEQ ID NO: 22332 - DNA, 1443 bp, Rhodopseudomonas palustris; identical to SEQ ID NO: 4124
  CDS (1)..(1443)

SEQ ID NO: 22333 - protein, 480 aa, Rhodopseudomonas palustris; identical to SEQ ID NO: 4125

SEQ ID NO: 22334 - DNA, 21 bp, Primer
atggctcggggtgacggacat

SEQ ID NO: 22335 - DNA, 25 bp, Primer
tcatgcttcttttgcgtgatgcaat

SEQ ID NO: 22336 - DNA, 1164 bp, Saccharomyces cerevisiae
  CDS (1)..(1164)
atgactgaattcgaattgcctccaaaatatatcaccgctgctaacgacttgcggtcagacacattcaccactccaactgcagagatgatggaggccgctttagaggcctctatcggtgacgctgtctacggtgaagatgttgacaccgttaggctcgaacagaccgttgcccgcatggctggcaaagaagcaggtttgttctgtgtctctgggactttgtccaaccagattgccatcagaactcacttgatgcaacctccatactctattctatgtgattacagggctcacgtttacactcacgaagccgctggactggcgatcttgtctcaagcgatggtggttcctgtggttccttccaacggtgactacttgaccttggaagacatcaagtcacactacgtcccagacgacggtgatattcacggtgcccccaccagattgatttctctggaaaacactttacacggtattgtttatccattggaagaactggtccgcatcaaagcttggtgtatggaaaatggtctcaaactacattgtgacggtgccagaatctggaatgccgctgcacaatctggcgtgccattaaagcaatatggggaaatcttcgactccatctccatctgtctatccaagtctatgggtgctcctattgggtccgtcttggttgggaaccttaagtttgtcaagaaggccacccatttcagaaaacaacaaggtggtggtattagacaatctggtatgatggctagaatggctcttgtaaacatcaacaacgattggaagtcccaattgctgtactcgcactctttggctcatgaattagccgaatattgtgaggcaaagggcatcccgctagagtctccagcagacaccaactttgtctttattaacctgaaggccgctagaatggacccagatgtccttgttaagaagggtttgaagtacaacgttaagctaatgggtggtagagtctcgttccactatcaagtcaccagagatactttggaaaaagtcaaattggccatctccgaggccttcgactatgctaaagaacatcctttcgactgtaacggacctacccagatttaccgtagtgaatccaccgaggtcgacgttgatggcaacgctatccgcgaaataaaaacctacaaatactga

SEQ ID NO: 22337 - protein, 387 aa, Saccharomyces cerevisiae
MTEFELPPKYITAANDLRSDTFTTPTAEMMEAALEASIGDAVYGEDVDTVRLEQTVARMAGKEAGLFCVSGTLSNQIAIRTHLMQPPYSILCDYRAHVYTHEAAGLAILSQAMVVPVVPSNGDYLTLEDIKSHYVPDDGDIHGAPTRLISLENTLHGIVYPLEELVRIKAWCMENGLKLHCDGARIWNAAAQSGVPLKQYGEIFDSISICLSKSMGAPIGSVLVGNLKFVKKATHFRKQQGGGIRQSGMMARMALVNINNDWKSQLLYSHSLAHELAEYCEAKGIPLESPADTNFVFINLKAARMDPDVLVKKGLKYNVKLMGGRVSFHYQVTRDTLEKVKLAISEAFDYAKEHPFDCNGPTQIYRSESTEVDVDGNAIREIKTYKY

SEQ ID NO: 22338 - DNA, 1041 bp, Pseudomonas aeruginosa
  CDS (1)..(1041)
atgaccgatcacacccaacagttcgccagcgacaactattccggcatctgccccgaagcctgggcggcgatggccgaagccaaccgcggccacgaacgcgcctatggcgacgaccagtggaccgcgcgtgcttcggactacttccgccagttgttcgagaccgattgcgaagtgttcttcgccttcaacggcaccgccgccaactccctggccctggctgcgctgtgccagagctaccacagcgtgatctgctcggagaccgcccacgtcgagaccgacgagtgcggcgcgccggagttcttctccaatggctccaagctgctgctggcgcagaccgaggtcggcaagctgaccccggcgtcgatccgcgacatcgctctcaagcgccaggatatccactatccgaagccgcgcgtggtgactctcacccaggccaccgaggtcggcacggtgtaccgcccggacgagctgaaggcgatcagcgccacctgcaaggagctcggcctgcacctgcacatggacggcgcgcgcttctccaacgcctgcgccttcctcggctgctcgccggcggagctgagctggaaggccggggtcgacgtgctctgcttcggcggcaccaagaacggcatggcggtgggcgaggcgatcctgttcttcaaccgcgacctggccgaggacttcgactaccgctgcaagcaggccggccaactggcctcgaagatgcgcttcctcgccgcgccctgggtcggcgtactgcaggacgatgcttggctgcgctacgccgatcacgccaaccgctgcgcgcggctgttggccgaactggtggccgacgttcccggcgtcagcctgatgttcccggtagaagccaacggcgtgttcctgcagctttccgagccggcgatcgaagccttgcgcgcgcgcggctggcgcttctacaccttcatcggtgaaggtggcgcgcgtttcatgtgttcctgggataccgatatcgagcgggtccgcgaactggcgcgggacatccgcctggtgatgggcgcctga

SEQ ID NO: 22339 - protein, 346 aa, Pseudomonas aeruginosa
MTDHTQQFASDNYSGICPEAWAAMAEANRGHERAYGDDQWTARASDYFRQLFETDCEVFFAFNGTAANSLALAALCQSYHSVICSETAHVETDECGAPEFFSNGSKLLLAQTEVGKLTPASIRDIALKRQDIHYPKPRVVTLTQATEVGTVYRPDELKAISATCKELGLHLHMDGARFSNACAFLGCSPAELSWKAGVDVLCFGGTKNGMAVGEAILFFNRDLAEDFDYRCKQAGQLASKMRFLAAPWVGVLQDDAWLRYADHANRCARLLAELVADVPGVSLMFPVEANGVFLQLSEPAIEALRARGWRFYTFIGEGGARFMCSWDTDIERVRELARDIRLVMGA

SEQ ID NO: 22340 - DNA, 1077 bp, Listeria monocytogenes
  CDS (1)..(1077)
atgacaaacacactaaaaaccagttaccaaaaaacaccttataaactaggcgggaatggcccgcgcaatgtgggtgttttaacagaagcacttcaaaatatagatgataatttagaaagcgatatttacggaaacggtgcagttattgaagactttgaaacaaaaatcgcgaaaattctcgggaaacaatctgcggtatttttcccaagtgggacgatggcacaacaaatcgcgttaaggatttgggctgaccggaaagagaatcggcgcgtagcatatcatccgctctctcatttggagattcatgagcaagatgggctaaaagaattgcagcaaatcacgccactattacttggtacagcgaatcagcttttgacaattgacgatattaaaagtcttcgcgagccagtttctagtgtgcttatcgaacttcctcaacgagaaattggtgggcaactacctgcttttgaagagcttgagaagatttcagagtattgccatgaacagggtatttcgttgcatctggacggggcgcggttatgggaaattacgccgttttatcagaagtctgcggaagaaatttgtgcgctgtttgatagtgtgtatgtgtcgttttataaagggattggcgggattgctggggcgattttggctgggaatgatgattttgtgcaagaggcgaaaatctggaaacgacggtatggcggggatttgattagtctgtatccatatattttgtccgcggattattattttgaaaaacggattgggaaaatggcggagtattttgaagcggcgaaaggattggctgagcgatttaattcgtgttcgggcgtgaagactgtgccggaagtgccggtttctaatatgtttcatgtttattttgagaattcggctgatgagattggggcaattttgacgaagattcaggatgaaactggcgttgggatttcggggtatttgcaggagaaatcagcggatgtttgtgcgtttgaggtttcggttggggatgcgtttgcggaaataccagcaaaaaatttagaactagtttttagatgtttggaaaaggaactttga

SEQ ID NO: 22341 - protein, 358 aa, Listeria monocytogenes
MTNTLKTSYQKTPYKLGGNGPRNVGVLTEALQNIDDNLESDIYGNGAVIEDFETKIAKILGKQSAVFFPSGTMAQQIALRIWADRKENRRVAYHPLSHLEIHEQDGLKELQQITPLLLGTANQLLTIDDIKSLREPVSSVLIELPQREIGGQLPAFEELEKISEYCHEQGISLHLDGARLWEITPFYQKSAEEICALFDSVYVSFYKGIGGIAGAILAGNDDFVQEAKIWKRRYGGDLISLYPYILSADYYFEKRIGKMAEYFEAAKGLAERFNSCSGVKTVPEVPVSNMFHVYFENSADEIGAILTKIQDETGVGISGYLQEKSADVCAFEVSVGDAFAEIPAKNLELVFRCLEKEL

SEQ ID NO: 22342 - DNA, 1053 bp, Agrobacterium tumefaciens
  CDS (1)..(1053)
atgttttttgcttcagacaattgggctggcgcccatccggccgtcaatgaacggctgtcgcgggaatccacgcgttttgccgccgcttacggcaccagcgaactcgatctctccatcgaaaaacgcttcaacgaaatcttcgaacgcgaagtcgcggttttttttgtcgccaccggcacggcggccaattcgctttcgctggccagcatcgcccgtcccggcggcctgaccttctgtcattcggaagcgcatgtgatcgaggacgaatgtggcgcgccggatttcttttcaggcatgcgcatggtcgccgtcgaggggcctgatggcaagatgctgccggagaacctcatcgagcgcattgcgcgctatccgcaggatgccgtgcaccatgggcgcgccgcagccattaccatgacgcaggcgactgaagccggcaccgtctatacgcttgatgaaatcgacgctatatccaaaatcgccaaggaaaacggcctgccgttgcatatggatggcgcgcggtttgccaatgcacttgccgcactcggcacgacgccggctgaaatgacctggaaacgcggcgtcgatgtcctgtctttcggcggcacgaaaaacggctgctggtgcgcggaagcgatcgtgtttttcgatccttcgcttgcccgggacttctccttcctgcgcaagcgtaccgcccagcttttttcgaaatcgcgtttcatcgccgcgcaattcgaagcctacctgcaggacgacctgtggctcggtctcgccggccacgccaatgccatggccaaccggctgcgcgccggtttcggctcactgaacagcgcccgcctggcatggccgacacaggccaacgaggttttcgccattctgcccaaggcagccgctgaagcggcgacgcaaaaaggcgcgaagttctatgactggctggagccgcgcgacatgccggaaaatgtcggcaaggacgaagtactgatccgcatggtcacgagctttgcgacgaccgaagctgatgtggacgaattcctgtcgatctgcgctgccgtctga

SEQ ID NO: 22343 - protein, 350 aa, Agrobacterium tumefaciens
MFFASDNWAGAHPAVNERLSRESTRFAAAYGTSELDLSIEKRFNEIFEREVAVFFVATGTAANSLSLASIARPGGLTFCHSEAHVIEDECGAPDFFSGMRMVAVEGPDGKMLPENLIERIARYPQDAVHHGRAAAITMTQATEAGTVYTLDEIDAISKIAKENGLPLHMDGARFANALAALGTTPAEMTWKRGVDVLSFGGTKNGCWCAEAIVFFDPSLARDFSFLRKRTAQLFSKSRFIAAQFEAYLQDDLWLGLAGHANAMANRLRAGFGSLNSARLAWPTQANEVFAILPKAAAEAATQKGAKFYDWLEPRDMPENVGKDEVLIRMVTSFATTEADVDEFLSICAAV

SEQ ID NO: 22344 - DNA, 1002 bp, Salmonella enterica subsp. enterica serovar Typhi
  CDS (1)..(1002)
atgattgatttacgcagtgataccgttacccgaccgggccgcgccatgctcgaggcgatgatgaccgccccggtcggggacgacgtatacggcgatgcccctaccgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcacataattatctctatgaagctggcggcgctgcggtgctcggcagcattcagccgcagcctattgatgccgccgcggacggtacgctgccgctggagaacgtagcggcgaagattaaagcggatgacatccacttcgcgcgcacgcgcttgctcagtctggaaaatacgcataacgggaaagtgctgccgcgcgcgtatctgaaagacgcctggacgtttacccgcgaacgtgggctggcgctgcacgttgacggcgcccgaatttttaacgcggtggttgcctacggctgtgagttaaaagagattacgcagtattgcgactcttttaccatctgcctgtcaaaaggtctcgggacgccggtcggttcgctgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgacaacgccgcctggctggcgcagcagcttcgcgaagcgggcgcggatgtcatgcgccacgaaacgaatatgctgtttgttcgcgttggcgaagcacaggccgccgcgcttggcggctatttgcgggaacggaatatcctgattaacgccgcgccgattgtgcgtctggtgacgcatctggatgtctctcgcgaacagcttgccgacgtcgtcgcccactggcgcgcctttttagcccgctaa

SEQ ID NO: 22345 - protein, 333 aa, Salmonella enterica subsp. enterica serovar Typhi
MIDLRSDTVTRPGRAMLEAMMTAPVGDDVYGDAPTVNALQRYAADLSGKEAALFLPTGTQANLVALLSHCERGEEYIVGQGAHNYLYEAGGAAVLGSIQPQPIDAAADGTLPLENVAAKIKADDIHFARTRLLSLENTHNGKVLPRAYLKDAWTFTRERGLALHVDGARIFNAVVAYGCELKEITQYCDSFTICLSKGLGTPVGSLLVGNRDYIKRATRWRKMVGGGMRQAGILAAAGLYALKHNVARLQEDHDNAAWLAQQLREAGADVMRHETNMLFVRVGEAQAAALGGYLRERNILINAAPIVRLVTHLDVSREQLADVVAHWRAFLAR

SEQ ID NO: 22346 - DNA, 1038 bp, Nostoc sp. PCC 7120
  CDS (1)..(1038)
atgaatagcaacttagaacagtttgccagtgacaactacgctggtatttgtccagaagcaatgaactatatgattcaagctaatcaaggtagtgcgccagcttatggaaatgatgaatggacgcaaaaagcaacagactattttcgagaactttttgaaattgattgcgaagtattttttacttttaacggtacagcagcaaattcattatctttagctgcactttgtcagtcatatcacagcgttatttgtcatgaaacagcacatatagaaacagatgaatgtggcgcaccagagtttgcgtctaatggttctaagttgttacttgctaaaggagaaaatggtaagttaacaccacaagagatagagtctgtaatcacgaagcgagttgatattcattatcctaaaccaaaagtaattagtattactcaagctacagaattagggactttatattctatagaagaacttttagatattaaaaaagttgcccaaaagtatcaattaaaaattcacatggacggcgcacgctttgccaatgcagttgcagccatgaataaaagtccggcagagatgagttggaaaagtggcgtggatgtattgtgtttttgtgggacaaaaaatggtatggcattaggggaagccattatattttttaatcgagcattggcagaagattttgattatcgttgtaaacaagcaggacaattagcatcaaaaatgcggtttatttctgcgccgtggttaggtttgttagaaactggtgcgtggttgaaaaatgctcaacacgcgaatcaatgtgcggcttatttagagaatgaattgttaaaaatagaaggtgtggaaattatgtttccccgtgaagtaaatgcagtttttgtcaaactgccagagcaagttatcaatggcttaaaagcaaacaattggttgttttatacttttattggggtaggtggtgtacgctttatgtgttcttggaataccaccaaaagcagaattgatgaattagttggagatattaaaacaggattgggctaa

SEQ ID NO: 22347 - protein, 345 aa, Nostoc sp. PCC 7120
MNSNLEQFASDNYAGICPEAMNYMIQANQGSAPAYGNDEWTQKATDYFRELFEIDCEVFFTFNGTAANSLSLAALCQSYHSVICHETAHIETDECGAPEFASNGSKLLLAKGENGKLTPQEIESVITKRVDIHYPKPKVISITQATELGTLYSIEELLDIKKVAQKYQLKIHMDGARFANAVAAMNKSPAEMSWKSGVDVLCFCGTKNGMALGEAIIFFNRALAEDFDYRCKQAGQLASKMRFISAPWLGLLETGAWLKNAQHANQCAAYLENELLKIEGVEIMFPREVNAVFVKLPEQVINGLKANNWLFYTFIGVGGVRFMCSWNTTKSRIDELVGDIKTGLG

SEQ ID NO: 22348 - DNA, 1032 bp, Thermotoga maritima
  CDS (1)..(1032)
atgatcgatctcaggtccgacaccgttacaaaaccaacagaagagatgagaaaagccatggcacaggctgaggtgggagacgatgtgtacggagaagatccaaccatcaacgaactcgaaaggctcgccgcagagacctttggaaaggaagcggctctctttgtaccctccggcaccatgggaaatcaagtgagcataatggctcacacccagaggggcgatgaagtgatactggaggcagacagccacatcttctggtacgaggtcggagccatggcggttctctccggagtcatgccccatcctgtacctggaaaaaatggagccatggaccccgatgatgtgaggaaggccataagacccagaaacatacacttccccagaacttcgctcattgccatcgaaaacacacacaaccgttccggtggaagagtggtcccgcttgaaaacataaaagagatttgcacgatagccaaagaacacggcataaacgttcacatagatggtgcgaggatcttcaacgcctcaatcgcttcaggtgttcccgtgaaggagtacgccgggtacgccgattccgtgatgttctgtctttcaaaaggtctctgcgcacccgtcggttcggtggttgtaggagacagggacttcatagaaagagcgagaaaggcgagaaagatgctcggtggagggatgagacaggcaggtgttctcgctgccgctggaataatcgccttgacaaagatggtagatcgattgaaagaagatcatgaaaacgccagatttctcgccctgaagttgaaagaaatagggtactccgtgaatcccgaagatgtgaaaaccaacatggtgattctgaggaccgacaacctgaaggtgaacgcgcacgggttcatagaagcgctcagaaacagcggggtgctcgcgaacgccgtatccgacacggagatcagactggtaacccacaaagacgtttcaagaaacgacatagaagaggctctgaacatcttcgaaaaactcttcagaaaattctcctga

SEQ ID NO: 22349 - protein, 343 aa, Thermotoga maritima
MIDLRSDTVTKPTEEMRKAMAQAEVGDDVYGEDPTINELERLAAETFGKEAALFVPSGTMGNQVSIMAHTQRGDEVILEADSHIFWYEVGAMAVLSGVMPHPVPGKNGAMDPDDVRKAIRPRNIHFPRTSLIAIENTHNRSGGRVVPLENIKEICTIAKEHGINVHIDGARIFNASIASGVPVKEYAGYADSVMFCLSKGLCAPVGSVVVGDRDFIERARKARKMLGGGMRQAGVLAAAGIIALTKMVDRLKEDHENARFLALKLKEIGYSVNPEDVKTNMVILRTDNLKVNAHGFIEALRNSGVLANAVSDTEIRLVTHKDVSRNDIEEALNIFEKLFRKFS

SEQ ID NO: 22350 - DNA, 978 bp, Bacillus halodurans
  CDS (1)..(978)
atgagacaagcgatggcttcagcagaagtaggggatgatgtataccaagaggacccaagtgttcgcgcattagaagaacgagcagcggaattaacaggaaaagaagcagcgctgttcgtaacgagcggaacacaaggcaatcaggtggcagttgcgacacactgcgtccctggccaagaaatcattttagaagcggatgcccatctgttcctatatgaaggtggtgcagcttccgcttttgctggtgtacaaacatacgcgattaaagggacaaacggaatgttctctgccgagcaagtaaggagagctatacgtccagaagacgaccacgatcctgagacgggtttaatctgtttagaaaacacgcataatcgagcgggaggagccgttatttcaccagaacagatgaaggatgtctacgacgtggcaaaggcgtacaatgtacctgttcatctagatggagcgcgcctatttcacgcggctgttgccctaggtcagccactatcctccttcactcagtacacggacaccgttcaactgtgcctttcgaaagggcttggggcgccagtaggctccattcttgccggtgatgcttcatttattaaacgggcaagaaaatggcgaaaacgccttggtggcgggtggcgacaagccggtgtgttagctgcacctgcccttctcgccttaaatacaatggtcgagcgtttggcggaagaccacgagcatgctaaaatactcgcagacggtattcacgggttgcatggattaaccgtcattcacaaagttgaaacaaatatcattctcgttgacgtagaaaaaacaggccatacgagtgatacatttgtagaggcgttaaaagagcgcggcgtgcgagccgttgcctttgatccatacattgttcggtttgtcacccataaagacgtatctaaggacgatgtcatgcaaacattggctgttctttcctcgcttgtttcatga

SEQ ID NO: 22351 - protein, 325 aa, Bacillus halodurans
MRQAMASAEVGDDVYQEDPSVRALEERAAELTGKEAALFVTSGTQGNQVAVATHCVPGQEIILEADAHLFLYEGGAASAFAGVQTYAIKGTNGMFSAEQVRRAIRPEDDHDPETGLICLENTHNRAGGAVISPEQMKDVYDVAKAYNVPVHLDGARLFHAAVALGQPLSSFTQYTDTVQLCLSKGLGAPVGSILAGDASFIKRARKWRKRLGGGWRQAGVLAAPALLALNTMVERLAEDHEHAKILADGIHGLHGLTVIHKVETNIILVDVEKTGHTSDTFVEALKERGVRAVAFDPYIVRFVTHKDVSKDDVMQTLAVLSSLVS

SEQ ID NO: 22352 - DNA, 1032 bp, Caulobacter crescentus
  CDS (1)..(1032)
atgacccagaccgcgccccgctacgatttcgcctccgacaacgtcgccggcgccatgcccgaggtgatggaggcgttgatcgcggccaatgcggggacggcctcgggctacgggaccgaccatgtcagccgtgccgccgccgatcgcatccgcgcggcgctggacgccgacgcgcaggtgcggttcacagcctcgggcacggcggccaacgccttcgccctgaccctgctggcccagccgcacgaggcggtgctggcccacgagcacgcccacatctgcacggacgagaccggcgcgcccggcttctttggccagggcgtcggcctgatcggcttgccgggcgcatcgggcaagatggagttggcggccctggaggcggcgctggcccagccggacgtctcgtaccgccagccggcggcggccttgtcgctgaccaccgccaccgagtacggcacggtctattcggaagaccacctgcgggccctgatcgcgccggtgaaggccaagggctatggcgtccacctggacggcgcgcggctggccaatgcggtcgcggggggctttgacctgaaaagcatcgccaagatgggcgtcgacatcctggtgatgggcggcaccaaggccggctcgacgcccaccgaggccgtggtgttcctgaaccccgaccacgccaaacgcctggacgcgcgcctcaagcacgccggccagctgatctcgaagggacgcttcctggccgcgccgtggctgggcctgctgggcgagaacggtcagaccgccccctgggccgcccgcgccgcccacgccaacgccatggcgcagaagctggccgcgctgatgcccgtcccgatcaagcacccggtcgaggccaacggcatcttcgtcgagatggacgaacttgccctggaacgcctgcgcggcgaaggctggttcgtctatcgcttcctggacggcacggtgcgcttcatgtgctcgtgggccacgacgcccgagatggtcgaggatctgggcgcggcgctgaagcgagtggcttag

SEQ ID NO: 22353 - protein, 343 aa, Caulobacter crescentus
MTQTAPRYDFASDNVAGAMPEVMEALIAANAGTASGYGTDHVSRAAADRIRAALDADAQVRFTASGTAANAFALTLLAQPHEAVLAHEHAHICTDETGAPGFFGQGVGLIGLPGASGKMELAALEAALAQPDVSYRQPAAALSLTTATEYGTVYSEDHLRALIAPVKAKGYGVHLDGARLANAVAGGFDLKSIAKMGVDILVMGGTKAGSTPTEAVVFLNPDHAKRLDARLKHAGQLISKGRFLAAPWLGLLGENGQTAPWAARAAHANAMAQKLAALMPVPIKHPVEANGIFVEMDELALERLRGEGWFVYRFLDGTVRFMCSWATTPEMVEDLGAALKRVA

SEQ ID NO: 22354 - DNA, 1035 bp, Clostridium acetobutylicum
  CDS (1)..(1035)
atgttacgttttgattgtgattatactgagggggctcatcctaaaatattagaaaagcttactataacaaattatgagcaaacaataggctatggggaagatcaatattgtagggaagctgcaaatataataaaaaagaagtgccaacgtgaagacgtcgatgttcactttttagttggaggaactcaaacgaaccttacagtaatttcagctgccttgagacctcaccaaggagcaattactgtagtaactggccatgttaatactcatgaaactggtgctatagaagccactggtcacaaggtgcttactgtggaagataatgaaggtaagataactgctaaacaaatacaggatgtttatgatagtcattttaatgatgcatctcctgaacatactgtacaacctaagatggtttatatttcaaatccaactgaaataggaacaatatattcaaaagcagagcttacttctataagtgaaacctgcagaaaaaataatcttatactatacatagatggtgctagattaggttatgggctttgtgctgaaaataatgacttagatttaccaactatagctaagctttgtgatgctttctatattggaggtaccaaggtaggtgctttattcggagaagctttagttatatcaaatgaagctttaaaatctgattttcgttatttcattaaacaaaaaggtggtctattagcaaaaggaagacttcttggtatacaattcgcaactttatttgaagatgacttatattttgagatatcaagacatgcagacgaaatggcaacattaataaatgatgcctgcaataaaaagggatattcatttctatctccttcaactactaatcagcagttccctgtattacctgattctgtcattgaaaagttaaaacaagattatgccttttcttattgggaacgagttaataaaactcacagtgctgttcgcttctgtacaagttgggcaactaaaaaagaatccgtattaaaattagtagacgctatcgagaaggcttaa

SEQ ID NO: 22355 - protein, 344 aa, Clostridium acetobutylicum
MLRFDCDYTEGAHPKILEKLTITNYEQTIGYGEDQYCREAANIIKKKCQREDVDVHFLVGGTQTNLTVISAALRPHQGAITVVTGHVNTHETGAIEATGHKVLTVEDNEGKITAKQIQDVYDSHFNDASPEHTVQPKMVYISNPTEIGTIYSKAELTSISETCRKNNLILYIDGARLGYGLCAENNDLDLPTIAKLCDAFYIGGTKVGALFGEALVISNEALKSDFRYFIKQKGGLLAKGRLLGIQFATLFEDDLYFEISRHADEMATLINDACNKKGYSFLSPSTTNQQFPVLPDSVIEKLKQDYAFSYWERVNKTHSAVRFCTSWATKKESVLKLVDAIEKA

SEQ ID NO: 22356 - DNA, 1074 bp, Halobacterium sp. NRC-1
  CDS (1)..(1074)
atgtttcggaacgtaactggcaggatgacttttccccctgggggtggatgtcccgatatgatcgatcttcgcagcgacacggtcgccacgccgaccgaggcgatgcgggaggcggcggcccaggcgccggtcgagcacggcgagcacggcgacgacccggctgtggcagcggtggaggcgacggcggcggacgccgtgggcatggcggcggccgtgttcgtgccgagccggacgatggccaaccagatcggggcgcaggtacacaccgcccgcgggcagagcgtgctcgtcgagcgggccagccacagctacaggcgggggagtggcgggctggcacaacacgctggggtgcaggcgcgcgcgttcgacggcggcgaaaccggctgtccgaccgcggagcaggtggccgccgagatcacggcggggggtgggcaccggccggaggtcgggctggcgtgcgtggagatcgcacacggggcgaacggcggggtcgtggcgcccgtcgacgcgttcgcggctgccgtggagaccgcccacgagcacgacgtgccggtgcacgtcgacgggacgcgggtgttcagcgctgcgaccgcgctgggcgtcgatgcggcgacgctgctgtcgccggtggattcggtggcggtgtgtctgtcgacggggctgggcgcacccatgggggcagtgctggcgggaagcgagtcgttcgtggcgtcggcccgacgcgtgcaggagatgtacgggggtgggatgcagcaggcgggcatggtcgcggcggcgggcgtgtgcgccctggagaaccgccaccgagtccacgaggaccacgagaacgcgcgtcggttggccgaggacctcgacgcgctcccgggggtgacggcggccgaaccggacacgaacatcgtgctcgcggacacccgggacgcggacgtgaccgccgcggcgttcctggcgggctgtgaggaagagggcgtgctggggacggcggacggcgagtacacggtccggttctgcacgcaccgcgacatcgggggcgcggacatcgcggcggtggtgtcggcggcgggggaggtcgtctaa

SEQ ID NO: 22357 - protein, 357 aa, Halobacterium sp. NRC-1
MFRNVTGRMTFPPGGGCPDMIDLRSDTVATPTEAMREAAAQAPVEHGEHGDDPAVAAVEATAADAVGMAAAVFVPSRTMANQIGAQVHTARGQSVLVERASHSYRRGSGGLAQHAGVQARAFDGGETGCPTAEQVAAEITAGGGHRPEVGLACVEIAHGANGGVVAPVDAFAAAVETAHEHDVPVHVDGTRVFSAATALGVDAATLLSPVDSVAVCLSTGLGAPMGAVLAGSESFVASARRVQEMYGGGMQQAGMVAAAGVCALENRHRVHEDHENARRLAEDLDALPGVTAAEPDTNIVLADTRDADVTAAAFLAGCEEEGVLGTADGEYTVRFCTHRDIGGADIAAVVSAAGEVV

SEQ ID NO: 22358 - DNA, 1029 bp, Deinococcus radiodurans
  CDS (1)..(1029)
atggtgtgcgccatgacccgcccgccgctgatcgccgacctgcgctccgataccgtcaccaagcccactcccgccatgcgtgaggcgatggcgaccgccgaggtgggcgacgacgtgtacggcgaagaccccaacgtcaacgccctgcaaaacgaactcgcgcacctgaccggctttgaggcggggctgttcatgccgtcgggcagcatgacgaaccaggtggcgattgccgtgcacacccgccggggcgaggaagtcatctgcgccgagggcagccacatctacgagtgggaactggggatgatggcggccttttccggcgtggtcccgcgcttcgtgcccgcgccgctgggcgtgccgagtcccgaggacgtgcggctggcggtccgccgcagcgtccaccagtcacccaccggcctgatcagcctggaaaacacccacaacaaggccgggggcacggtgattccgctggcggtgctgcggcagatgcgggcagtggccgacgccgagggactgcctctgcacctcgacggagcgcgggtcttcaacgccgccgtgaagctgggcgtggacgtgcgcgaaatcacgcgctgcttcgacaccgtgagcgtgtgcctgagcaaggggctcggcgccccggtgggcagcgtgctgctcggctcggcgcaggcgattcggcaggcgcaccgctaccgcaagatgctcggcggcgggatgcggcaggccggaattctggcggcggcggcgcgggtggccctgcgcgaaggtccggcgcgactggccgacgaccacttgcggacccggcgattggcccgcgccctggtcgaagcgggctacgacgtggacctcgccgccgtgcagaccaacatcatctatgcccggctgcccgaggccgagcgccgcgccgctgcctgggccgaacagggcgtgctcgccagtgcgctggggcacgactcggtgcgcttcgtgctgcaccatcaggtggacgacgacgcgctcgaccaggccattcgcgtgctgaccgcctga

SEQ ID NO: 22359 - protein, 342 aa, Deinococcus radiodurans
MVCAMTRPPLIADLRSDTVTKPTPAMREAMATAEVGDDVYGEDPNVNALQNELAHLTGFEAGLFMPSGSMTNQVAIAVHTRRGEEVICAEGSHIYEWELGMMAAFSGVVPRFVPAPLGVPSPEDVRLAVRRSVHQSPTGLISLENTHNKAGGTVIPLAVLRQMRAVADAEGLPLHLDGARVFNAAVKLGVDVREITRCFDTVSVCLSKGLGAPVGSVLLGSAQAIRQAHRYRKMLGGGMRQAGILAAAARVALREGPARLADDHLRTRRLARALVEAGYDVDLAAVQTNIIYARLPEAERRAAAWAEQGVLASALGHDSVRFVLHHQVDDDALDQAIRVLTA

SEQ ID NO: 22360 - DNA, 1032 bp, Vibrio cholerae
  CDS (1)..(1032)
atgcggatatttgtaggagaaaatatggactttcgatcggataccgttacccaaccgaccgacgcgatgcgtcaagcgatggcacaagcccctgtgggtgacgatgtgtatggcgatgaccccaccgtcaacgagttagaacagtgggcggcagagcgccatggctttgaagccgcgctgtttaccacctcaggcactcaagccaatttgttaggtttactcgcccattgcgaacgcggcgacgaatatttgtgtggccagcaagcccataactatcgttatgaagctggcggtgctgccgtacttggctctatccagccacaaccgattgacaatgaaccggatggcacactcgatttcgccaaactcaaagccgcgatcaaaccggatgatgcacattttgcccgcaccaaactgctcagcttggaaaacaccatcaatggtaaagtgcttccactcagttatttggcgaaggcgcgcgagtttgttgatcaacatggtttgcaactgcaccttgatggggctcgggtctacaacgcggcggtcgcactggatgtggatgtcaaagagatcgcgcaatattttgattcgatcaccgtgtgtctatccaaaggcttagccgcgccagtcggttcgttactgctcggttccaaggactttattgccaaagcgagacgctggcgaaaaatggtcggtggcggtatgcgccaagcgggcattttagccgcagcggggaaattggcgctcaccgagcaagtcatgcagctcaagaccgatcatgataatgctcgtcatctggctttggggctgaatgctttaccggggttttcggttaataccgaatgggtacagaccaatattgtgtttgctaaattggactcgacagtcgatatccagtccatcgcccagcaacttcgccaagcaggcattatcatcaccgcgggtaatccagtgcgcttcgtgacacataaagacattacacgtcaggatattgataccctactcgccaaactgcgcaccttactggcttga

SEQ ID NO: 22361 - protein, 343 aa, Vibrio cholerae
MRIFVGENMDFRSDTVTQPTDAMRQAMAQAPVGDDVYGDDPTVNELEQWAAERHGFEAALFTTSGTQANLLGLLAHCERGDEYLCGQQAHNYRYEAGGAAVLGSIQPQPIDNEPDGTLDFAKLKAAIKPDDAHFARTKLLSLENTINGKVLPLSYLAKAREFVDQHGLQLHLDGARVYNAAVALDVDVKEIAQYFDSITVCLSKGLAAPVGSLLLGSKDFIAKARRWRKMVGGGMRQAGILAAAGKLALTEQVMQLKTDHDNARHLALGLNALPGFSVNTEWVQTNIVFAKLDSTVDIQSIAQQLRQAGIIITAGNPVRFVTHKDITRQDIDTLLAKLRTLLA

SEQ ID NO: 22362 - DNA, 1280 bp, Escherichia coli
  CDS (61)..(1062)
gcgaaaacaaactggctaaggtaaaaagggtggcatttcccgtcataataaggacatgccatgattgatttacgcagtgataccgttacccgaccaagccgcgccatgctcgaagcgatgatggccgccccggttggggacgacgtttacggagacgaccctaccgttaatgctctgcaggactacgcagcagagctttccggtaaagaagccgccatttttctgcctaccggcactcaggccaacctggtcgctctgctcagtcactgcgaacgcggcgaagagtatattgtcggtcaggccgcgcataactatctgtttgaagccggtggcgcggcggtgctgggcagtattcaaccgcaacccatagacgcggctgccgacggcacgctaccgctggataaagtggcgatgaaaatcaaacccgacgatatccatttcgcccgcaccaaattactcagtctggaaaacacccacaacggcaaagtgttgccgcgggaatacctgaaagaagcatgggaatttacccgcgagcgcaatctggcgctgcatgttgacggtgcgcgcatctttaatgccgtggtggcttacggctgcgaactgaaagagatcacgcaatattgtgattcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggatatatgccctgaaaaataacgttgcgcgcttgcaggaagaccacgacaacgctgcctggatggcggagcagctgcgtgaagcaggcgcggatgtgatgcgtcaggacaccaatatgctgtttgttcgcgtcggggaagaaaatgctgccgcgttaggcgaatacatgaaagcgagaaacgtgctgattaacgcctcgccgattgtccgcctggtgacgcatcttgacgtctcgcgcgaacaactggcggaagtcgccgcccactggcgtgcattcctggcgcgttaaggagagagacgtgccgcaacgcattttagttctcggtgccagtggctacattggtcagcatctggtgcgcacactcagccagcaagggcatcagatcctggcggcggcacgtcatgtcgacaggcttgcaaagctgcaactggcaaacgtcagttgccataaagtcgatctcagctggccggataacctaccggccctgttgcaggatatcgatacgg

SEQ ID NO: 22363 - protein, 333 aa, Escherichia coli
MIDLRSDTVTRPSRAMLEAMMAAPVGDDVYGDDPTVNALQDYAAELSGKEAAIFLPTGTQANLVALLSHCERGEEYIVGQAAHNYLFEAGGAAVLGSIQPQPIDAAADGTLPLDKVAMKIKPDDIHFARTKLLSLENTHNGKVLPREYLKEAWEFTRERNLALHVDGARIFNAVVAYGCELKEITQYCDSFTICLSKGLGTPVGSLLVGNRDYIKRAIRWRKMTGGGMRQSGILAAAGIYALKNNVARLQEDHDNAAWMAEQLREAGADVMRQDTNMLFVRVGEENAAALGEYMKARNVLINASPIVRLVTHLDVSREQLAEVAAHWRAFLAR

SEQ ID NO: 22364 - DNA, 1005 bp, Pseudomonas aeruginosa
  CDS (1)..(1005)
atgcctgtcatcgacctgcgcagcgacaccgtcacccagcccaccgccggcatgcgcgaagccatggccgcggccgaactgggcgacgacgtctatggcgaggaccccacggtcaaccgcctggaggccgaactggcggcgcgcctgggcttcgccgcggcgctcttcgtaccgaccgggaccatgagcaacctgctcggattgatggcccactgcgagcgcggcgacgaatacatcgtcggccagcaggcgcatacctacaaatacgagggcggcggtgccgcggtgctgggctcgatccagccgcagccgatcgacggcgaggccgacggatcgctccacctggacaaggtcgcggcggcgatcaaggccgacgatttccacttcgccaggacccgcctgctggccctggaaaacaccatgcagggcaaggtgctgccgctcgactacctggccgcggcgcgcgccttcactcgcgcgcgtggcctggccctgcacctggatggcgcgcgcctgtacaacgcggcggtgaagctgggcgtagacgccagcgagatcacccgacacttcgactcggtgtcggtgtgcctgtccaagggcctcggtgcgccggtgggctcggtgctttgcggcagcgtcgaactgatcggcaaggcccgccgctggcgcaaaatggtcggcggcgggatgcgccaggccggcctgttggcggctgccggactgtacgccctcgaccaccaggtggcacgcctggccgacgaccacgccaacgccgcgcgcctgggcgacgggctgcgcgaactgggctatgcggtggagccggtgcagaccaacatggtctacgtcgatgtcggcgagcgggcggtcgcgctgcgcgacttcctcgccgagcgcggggtgcggatcagcgcggcggcgcgtttgcgcctggtcacccacctggacgtttccgccgagtccataggacaagtactggatgccttcgcggcctttcgtcgctcataa

SEQ ID NO: 22365 - protein, 334 aa, Pseudomonas aeruginosa
MPVIDLRSDTVTQPTAGMREAMAAAELGDDVYGEDPTVNRLEAELAARLGFAAALFVPTGTMSNLLGLMAHCERGDEYIVGQQAHTYKYEGGGAAVLGSIQPQPIDGEADGSLHLDKVAAAIKADDFHFARTRLLALENTMQGKVLPLDYLAAARAFTRARGLALHLDGARLYNAAVKLGVDASEITRHFDSVSVCLSKGLGAPVGSVLCGSVELIGKARRWRKMVGGGMRQAGLLAAAGLYALDHQVARLADDHANAARLGDGLRELGYAVEPVQTNMVYVDVGERAVALRDFLAERGVRISAAARLRLVTHLDVSAESIGQVLDAFAAFRRS

SEQ ID NO: 22366 - DNA, 1080 bp, Leishmania major
  CDS (1)..(1080)
atgtcaacgccaaggacgacggcgacggcggccaagccgaagccgtacagctttgtgaatgactacagcgtgggtatgcatcccaagattttagatctgatggcgcgcgataacatgacgcagcacgcgggctacggacaggacagccactgcgcgaaggcggcacgcctgatcggcgagttgcttgagcggccggacgcggacgtccattttatttccggcggcacgcagacgaacctgatcgcctgcagtctggcgctacgcccgtgggaagctgtcatcgcaacgcagctgggccacatcagcacgcacgagacgggcgccattgaggcgacggggcacaaagtcgtcacggcgccgtgcccggacggtaagctgcgcgttgccgacatcgagagcgcactgcacgagaatcgctcggagcacatggtgatacccaaactcgtctacatctccaacacgacggaggtaggcacgcagtacacgaagcaggagttggaggacatctccgcctcatgcaaggagcacggcctgtacctcttcctcgacggcgcccgcctcgcctcggccctaagcagccctgtgaacgatctgacgttggcagatatcgctcgcctgacggacatgttctacattggcgccacgaaggccggtggcatgtttggcgaagcgctcatcatcttgaatgacgccctaaagccgaacgcgcgccacctcatcaagcagcgcggcgccctcatggcgaagggatggctgctcggcatccaattcgaggtgctcatgaaggacaacctcttcttcgagctcggcgcccactcgaacaagatggccgccatcctcaaggctggactggaggcgtgcggcatccgacttgcctggccatccgccagcaatcagctcttcccgatcctggaaaacaccatgatcgcagagctgaacaacgacttcgacatgtacaccgtcgagcccttgaaagatggcacgtgcatcatgcgactctgcacgtcgtgggcgacggaggagaaggagtgccatcgttttgtggaggtgctgaagcgcctcgtcgcgtcaacggcctaa

SEQ ID NO: 22367 - protein, 359 aa, Leishmania major
MSTPRTTATAAKPKPYSFVNDYSVGMHPKILDLMARDNMTQHAGYGQDSHCAKAARLIGELLERPDADVHFISGGTQTNLIACSLALRPWEAVIATQLGHISTHETGAIEATGHKVVTAPCPDGKLRVADIESALHENRSEHMVIPKLVYISNTTEVGTQYTKQELEDISASCKEHGLYLFLDGARLASALSSPVNDLTLADIARLTDMFYIGATKAGGMFGEALIILNDALKPNARHLIKQRGALMAKGWLLGIQFEVLMKDNLFFELGAHSNKMAAILKAGLEACGIRLAWPSASNQLFPILENTMIAELNNDFDMYTVEPLKDGTCIMRLCTSWATEEKECHRFVEVLKRLVASTA

SEQ ID NO: 22368 - DNA, 1302 bp, Caenorhabditis elegans
  CDS (1)..(1302)
atgatatctagacacttcactgtattaacagcactcaacttgcaaaccaagatcaaaatttgcattcgaaacttttcaattagaggagcaatgactaaagttaatggaaattcaaatggaaatggaatatctgcttccacagatcttcttgatacgccatctgcatatactcaaaagtccaataaaactcatacttcaatcgacttgagatcggatacggtcaccgttccatcggttgaaatgagaagagcaatggcagaagctattgttggtgatgatgtctatggagaagatacaacaactaatagacttgagcaaagatgtgccgagttatttggaaaagaagctggactgtttgttaccagtggaacaatgggaaatcttttggcaatcatggcacattgtcaacgtggcgaggagataatcgtcggacggtacaatcatattcatcgttgggaacagggaaattatgctcaatttgctgggatctctgccacgacattggaggtgaagcccgatggaacgatggatttgaatgacatcgaacaggcgatccgtgtcaagggaggttatgttcaaattaaagatgagagttgtgatgacttggaagtgacgagtatacccgattgtcacatgccagcttcaaagctgatttgcatcgagaacacccataattatactggaggaaaagcgcttccaattgagtggatgagatctgtaaagcagcttgctgaacgtcgtgatctcaaagttcatatggatggagctcggatctataatgcagcagttgcctccaactgttccgtcagcaaaatcgcctcgttcgccgacactgtccaaatgtgtttctccaaaggactcggtgctccagttggatcaattgttgtaggaccgaaagatttcattgatcgtgctagacacagtcgtaaggctttgggtggaggatggagacaaagtggaattctcgctgctgctgcacatattgctcttgatcatgccgatgcaacaattcgagctgatcatgaaagagctaaaacattggcaagaatgattaatgacgctactccagaagaatttagaacgaaggtctttgctgcggaaaaagacatcaccaacatggttcttgttcattgccaaaatggagttacagttcaacagctcactgatttcttccaaaaacacgatattctggcaatgacttttgacgcaagacgtattcgaatggttctcaactggaatgtgagcgatgagaatttggaaactatcgtcgaagtctacaagaagtttttgaaacaattgtga

SEQ ID NO: 22369 - protein, 433 aa, Caenorhabditis elegans
MISRHFTVLTALNLQTKIKICIRNFSIRGAMTKVNGNSNGNGISASTDLLDTPSAYTQKSNKTHTSIDLRSDTVTVPSVEMRRAMAEAIVGDDVYGEDTTTNRLEQRCAELFGKEAGLFVTSGTMGNLLAIMAHCQRGEEIIVGRYNHIHRWEQGNYAQFAGISATTLEVKPDGTMDLNDIEQAIRVKGGYVQIKDESCDDLEVTSIPDCHMPASKLICIENTHNYTGGKALPIEWMRSVKQLAERRDLKVHMDGARIYNAAVASNCSVSKIASFADTVQMCFSKGLGAPVGSIVVGPKDFIDRARHSRKALGGGWRQSGILAAAAHIALDHADATIRADHERAKTLARMINDATPEEFRTKVFAAEKDITNMVLVHCQNGVTVQQLTDFFQKHDILAMTFDARRIRMVLNWNVSDENLETIVEVYKKFLKQL

SEQ ID NO: 22370 - DNA, 1212 bp, Streptomyces coelicolor
  CDS (1)..(1212)
atgagcgacacggcagaacaggaagagcgggcggcaccggccagaccggaagcgccgccggcccaggacgagccggcggagcagcgcgacaggcgcagccgggagcggcgcgtggccgccctccgcggcgcgcggcgcgtactcgcccgccccggcttcgtcacgaccctgcgcgagcgcatcgccctgctcgacggggccgaggagctgtacgacctcgacgagccctccgacatgtacggcaacggcgtcgtcgaggccctggaggagaggaccgccgccctgctcggcacggaggccgccgccttcttcccgaccgggaccatggcccagcaggtggccctgcgctgctgggcgggccgcaccggcaacccggtcgtcgccctgcacggtctcggccatcccgagcagcacgagcgcaacgccttcagccgggtcggcggcctgcacccggtacggctgaccgacgcgcccaggccgccgaccgccgacgaggtgcgcggcttcgaggagccgttcggggcgctgatgctggaactgccgctcagggaggccggatacctgctgcccacctgggaggagctcaccgaggtcgtcgaggccgcccgggagcgcgacgcggtggtccatttcgacggggcccggctgtgggagtgcaccgtccacttcggccgccccctggccgagatcgcgggcctggcggacagcgtgtacgtctcgttctacaagtccctcaagggctacggcggcggcgccctggccggtccccggacgctggtcgaggaggcgaaggcctggcggcaccggtacggcggccaggtgttccagcagttccccacggcgctgtccgccctggcaggcctggagcgcgagctgccccgactgccctcgtacgtggcccacgcgcgcgtggtggcggccgcgctgcgcgcgtcactcgcggcggcgggactgccgtgggcgcgggtgcaccccgcggtgccgcacacgcacgagttccaggtctggctgccctgcgaccccgacgcggcgagtgaggccgcgctccggcaggccgaggagaccgggacgatgctgttctcccagccctgggacgcgggcggccccgggatcgccctcaccgaggtctcggtgggcgagtcgggactggagtggacggccgacgacgtgcgggcggcggtcgccgacttcgccgcccggctgacggcgtga

SEQ ID NO: 22371 - protein, 403 aa, Streptomyces coelicolor
MSDTAEQEERAAPARPEAPPAQDEPAEQRDRRSRERRVAALRGARRVLARPGFVTTLRERIALLDGAEELYDLDEPSDMYGNGVVEALEERTAALLGTEAAAFFPTGTMAQQVALRCWAGRTGNPVVALHGLGHPEQHERNAFSRVGGLHPVRLTDAPRPPTADEVRGFEEPFGALMLELPLREAGYLLPTWEELTEVVEAARERDAVVHFDGARLWECTVHFGRPLAEIAGLADSVYVSFYKSLKGYGGGALAGPRTLVEEAKAWRHRYGGQVFQQFPTALSALAGLERELPRLPSYVAHARVVAAALRASLAAAGLPWARVHPAVPHTHEFQVWLPCDPDAASEAALRQAEETGTMLFSQPWDAGGPGIALTEVSVGESGLEWTADDVRAAVADFAARLTA

SEQ ID NO: 22372 - DNA, 1131 bp, Schizosaccharomyces pombe
  CDS (1)..(1131)
atgagcggatccgttacttctacgactaccgaaacaagattatgcccttccaaccaagggagcgctaaaaagtatcgtccttggaatgatttccgtagtgacactttgactgttcctaccgatgaaatgcgtcgcatcatgtatgaggcctctgatggtgattgcgtttatgaggaagatgaggatactagaaagttggaagtttatgttgcaaagttgactggtaaggaagctgctttgttcgtaacatctggtactcaaggtaatcagttgtgtattcgtagtcatttgcatcaacctcctcatagtatcatttgtgatgatcgcgcccatatttataactgggaagcgggtgcaattggtttgtttacgcaagctattgttcgtcctatttctccaaaaaataatgtatatattactgccgaggaaattgagaacaagcttatcctgggaaatgatattcacttttcacccactgggttgatttgtttagaaaatactattaaaggtgctgtcgttccattggatgaagtggctcgtatatctggtttagctaaggctcacaagatccccctgcattgcgacggtgctcgcttatgggatgctgctgttgcttccaacgtttcaattaaggagtactgctcttactttgattccgttagtctttgcctaagcaaaggtcttgcggctcctgttggtagcattattgtgggaccacgagactttattgctaaagccaaatggttccgtaaggcttatggtggtggattgagacaatctggtatgcttgctgctgcaggattatactcaattcagcataactttcctttgttgaagcaggtccataaatatgctattgaagtcgccgaatacgcagaatctcttggaattgagcttgaagttcccactcaaagtaacatggtgacattggccaatatcaacgttgctattctttgcgatgaagccaaaaagtctggaatcattttaatgggacctcgtatcgtgtttcatattcagatcactcctgatgctgtcgagattttgaagaacgttttacgtcgcacagttgagcgtcaagcagttgaaacccatattgttgccaaacctggtgagttttgtgtcggctattaa

SEQ ID NO: 22373 - protein, 376 aa, Schizosaccharomyces pombe
MSGSVTSTTTETRLCPSNQGSAKKYRPWNDFRSDTLTVPTDEMRRIMYEASDGDCVYEEDEDTRKLEVYVAKLTGKEAALFVTSGTQGNQLCIRSHLHQPPHSIICDDRAHIYNWEAGAIGLFTQAIVRPISPKNNVYITAEEIENKLILGNDIHFSPTGLICLENTIKGAVVPLDEVARISGLAKAHKIPLHCDGARLWDAAVASNVSIKEYCSYFDSVSLCLSKGLAAPVGSIIVGPRDFIAKAKWFRKAYGGGLRQSGMLAAAGLYSIQHNFPLLKQVHKYAIEVAEYAESLGIELEVPTQSNMVTLANINVAILCDEAKKSGIILMGPRIVFHIQITPDAVEILKNVLRRTVERQAVETHIVAKPGEFCVGY

SEQ ID NO: 22374 - DNA, 1017 bp, Aeromonas jandaei
  CDS (1)..(1017)
atgcgctatatcgatttacgaagtgatacggtcacccagcccacggatgccatgcgtcagtgcatgctccatgccgaggtcggggatgatgtttatggggaggatccgggcgtcaacgcgttggaagcctatggcgccgacctgctgggaaaagaggctgcgctgttcgtgccatccggcaccatgtccaacttgctggcggtgatgagccattgccagcgtggggaaggggctgtgctgggctcggcagcccacatctatcgctatgaggcgcagggttctgctgtgctggggtctgtggccctgcaacctgtgcccatgcaggctgatggctcgctggcgctggcggatgtgcgggcggccatcgcccctgacgatgtccattttaccccgactcgcctcgtctgcctcgaaaacacccataacggcaaggtgctgcccttgccttatctgcgcgagatgcgcgaactggtcgatgagcatggtttgcagttgcatctggacggtgctcgtctgttcaatgccgtggtggcgagtggccatacggtgcgcgaactggtcgcgccgtttgacagtgtctccatctgcctctccaaggggctgggcgcgccggtgggatcgctgctggtgggttctcatgcctttattgcccgtgccagaaggctgcgcaagatggtggggggcggtatgcgtcaggcggggatcctggctcaggctggcctgtttgcgttgcagcagcatgtggtacgcctcgcggacgatcatcgccgtgccagacagttggccgaggggctggctgcgctgcctggcatcaggctggatctggcgcaggttcagaccaacatggtgttcctgcaactgacgagtggcgagagtgcacccttgctggccttcatgaaggcgcgggggatcctcttctccggttatggtgagctgcggttggtgacccatctgcagatccacgatgatgacattgaagaggtgattgacgcctttaccgagtatctcggggcgtga

SEQ ID NO: 22375 - protein, 338 aa, Aeromonas jandaei
MRYIDLRSDTVTQPTDAMRQCMLHAEVGDDVYGEDPGVNALEAYGADLLGKEAALFVPSGTMSNLLAVMSHCQRGEGAVLGSAAHIYRYEAQGSAVLGSVALQPVPMQADGSLALADVRAAIAPDDVHFTPTRLVCLENTHNGKVLPLPYLREMRELVDEHGLQLHLDGARLFNAVVASGHTVRELVAPFDSVSICLSKGLGAPVGSLLVGSHAFIARARRLRKMVGGGMRQAGILAQAGLFALQQHVVRLADDHRRARQLAEGLAALPGIRLDLAQVQTNMVFLQLTSGESAPLLAFMKARGILFSGYGELRLVTHLQIHDDDIEEVIDAFTEYLGA

SEQ ID NO: 22376 - DNA, 1152 bp, Tolypocladium inflatum
  CDS (1)..(1152)
atgaagatttgcccgatactgaattccaaggcaggtcattggggagatcccactctcactggctcagcctttgatttcaggagcgacgctattactacaccatcccatggaatgctggaagcaatcgccggggccacgctcaatgatgatgtctatggcgaggaccagctaacacggtccttcgaggagcacatggcgagcatctgtggcaaagaagcagctctgtttgttgtgtccgggaccatggccaaccagattgccttaggagcgctgtcacgacgatgcacaggtgtactagcagatgctacctctcatatcgtacattttgaggccggtggccttgccggtctctccggggcatccatccagcccgtgcggccggcgaatgggcattatctcacccttgatgatgtggaacgacacgcagtgaccaccaacatgatagaacggttgcccaccagcatcatcagcctcgagaacacagctcacggcagcgtaatcccactacaagagctccgcaagatgaaggcttgggctgacgagcaggagatcgccattcacatcgacggtgcgcggatatggcacgccgtggcaggcgggggcggtagtctaaaggagatcgcgggctgctgcgacgcgatgaccctctccttcggtaaagggctcgcagcaccgataggatcggccatcgtgggctcgagggaccttatagcaagggcgagaagactgcgccaaagcatcggcggcggcgtccgcaaggctggggccattgtggctgcagcttggcaggccatgatagagaactttggtcccggcgatgtcgacacacggggcatcatccagagaacacatgtgttggcgagagcggtggccaacatgtggacctcgaggggcggtctgcttcttcgcccggtgatgacgaaccttgtctggctcgacttgaagagcgctggtctcgacaagtccacactggacacggctgctcagcaccgtgacatacgcatcagggcaccacgcatcgttctgcatcaccagatatcaaccgatgctatgcgacgactggaggcggtgttcgaggaggtgttagagaaaaaggcaagtcaaagtcctttgcggtcaagagcggagcgagcaggtctagaacgcctttag

SEQ ID NO: 22377 - protein, 383 aa, Tolypocladium inflatum
MKICPILNSKAGHWGDPTLTGSAFDFRSDAITTPSHGMLEAIAGATLNDDVYGEDQLTRSFEEHMASICGKEAALFVVSGTMANQIALGALSRRCTGVLADATSHIVHFEAGGLAGLSGASIQPVRPANGHYLTLDDVERHAVTTNMIERLPTSIISLENTAHGSVIPLQELRKMKAWADEQEIAIHIDGARIWHAVAGGGGSLKEIAGCCDAMTLSFGKGLAAPIGSAIVGSRDLIARARRLRQSIGGGVRKAGAIVAAAWQAMIENFGPGDVDTRGIIQRTHVLARAVANMWTSRGGLLLRPVMTNLVWLDLKSAGLDKSTLDTAAQHRDIRIRAPRIVLHHQISTDAMRRLEAVFEEVLEKKASQSPLRSRAERAGLERL

SEQ ID NO: 22378 - DNA, 1104 bp, Debaryomyces hansenii
  CDS (1)..(1104)
atggatttctctaattattcagacctcagtccagcacacaatgagttcagaagtgatacatttacgaccccaacattatctatggttgcatcgctaacgaaggctactttaggagattctgtttataatgaagatgattctacaattcaattggaaaaaaaggttgctgacatgactgggaaggaagctggcctattctgtgtaagtgggacgttatctaatcagatctgtttacgtgttaatttaaaacagccaccatatagtatactatgcgattatagggcccatgtatacgtgaatgaagcaggggggatggcaacattatgtcaagcaatggcacaaccaattaaacctaagaatggtatttatttgactttagaagacgatatattgccaaacttcattccggacgatggagaaattcatggggctccaactaagcttatctccttagagaatactttacatggtatgcttttccccattgaagagattgctaaaatatccaaattttgcaaaaataacgatgtcaagcttcacttagatggtgccagattatggaatgcatcaattgccacagggatttctttaaaagagtattgttcgtattttgattctgtttccttatgtctttcaaagagtttgggggcacctatcggtacagtattaattgccgataaaaattttgttaagaaggccaatcacttcaagaagcaaagtggtggaggaattagacaatcgggtctcttggctactatggctatgaccgctattgacgaaaactttggaaagatacaaaggtcccatgatatggctaaagaattaggcaaactatgtgaagaaaatggaattgtcttagaacacccagttgacactaattttgtctttatcgactttgctaaaaacaaaatgagttctgacgttctaactaaattactgaaagaaaacggtatcaagctatatgctggcagagttgctttccactaccaggtatctctggaaagctttgagaaatgcaaaaaagtagtactcgaatgttataaagattcactacaaaacccttacattggtaagtcatcttcctcgtattaccaagccaagtaa

SEQ ID NO: 22379 - protein, 367 aa, Debaryomyces hansenii
MDFSNYSDLSPAHNEFRSDTFTTPTLSMVASLTKATLGDSVYNEDDSTIQLEKKVADMTGKEAGLFCVSGTLSNQICLRVNLKQPPYSILCDYRAHVYVNEAGGMATLCQAMAQPIKPKNGIYLTLEDDILPNFIPDDGEIHGAPTKLISLENTLHGMLFPIEEIAKISKFCKNNDVKLHLDGARLWNASIATGISLKEYCSYFDSVSLCLSKSLGAPIGTVLIADKNFVKKANHFKKQSGGGIRQSGLLATMAMTAIDENFGKIQRSHDMAKELGKLCEENGIVLEHPVDTNFVFIDFAKNKMSSDVLTKLLKENGIKLYAGRVAFHYQVSLESFEKCKKVVLECYKDSLQNPYIGKSSSSYYQAK

SEQ ID NO: 22380 - DNA, 1128 bp, Debaryomyces hansenii
  CDS (1)..(1128)
atgacagtagaaattgcaccagaatattctactcataatgaattcagaagtgatactttcaccgtgccaaccaagaccatgttggagtccatccgaaacagcacatttggagactccgtgtataacgaggataaaactacgttgatgttagagaagaagatgtgcgagttgacaggaaagccagccgctttattctgtgttagtggaacgttatccaaccaaattggattgagagccaacttgttccagccaccatattcgattttatgtgactatagagcacatgtattcattcacgaagccggtggattggctaccttgtcacaagccatggtacacccggtacatccttctaacggagtatacttgacgttggaagacattgctgaaaatatcactccagacgatggagacatccatgcggcacctactaagctcatctcattagaaaacaccttacacggaactatcatgcctatagaagagattgccaggatcagtgcttttgctaaggagaataatattaaattgcatttagatggggccagattgtggaattctgccgcggaaacgggtatttcgatcgagaaatattgctcatacttcgattcggtttcgttatgtctttcgaagtcgatcggagctccagtcggttctatcttggttggagagcctaccctcattgccaaggcaaaccatttcaagaaacaaaacggtggtggtatcagacaagccggtattttggcgtcgatggctatggtggctattgatgagaatttcgcaaaattgccttactcgcattccctcgctaaagatgtcgcgagcttctgcgaaggtcacggaatcgccttggaaagtccggctcataccaattttgttttcattgatctcgtcaaaaacaagatggacgactcattactcattgaattaggtaaaaagtacaatgttaagttgatgggtggtagaatcgcattccactaccagttatcggaagaaagtgtcgaaaatgtcaaaagggctatattggaatgttaccaagatgcattcaaaaacccatacaccaaaaccaagtgtaacaagaagatgtataattttgatgccatcaagaattcattagtttctaattaa

SEQ ID NO: 22381 - protein, 375 aa, Debaryomyces hansenii
MTVEIAPEYSTHNEFRSDTFTVPTKTMLESIRNSTFGDSVYNEDKTTLMLEKKMCELTGKPAALFCVSGTLSNQIGLRANLFQPPYSILCDYRAHVFIHEAGGLATLSQAMVHPVHPSNGVYLTLEDIAENITPDDGDIHAAPTKLISLENTLHGTIMPIEEIARISAFAKENNIKLHLDGARLWNSAAETGISIEKYCSYFDSVSLCLSKSIGAPVGSILVGEPTLIAKANHFKKQNGGGIRQAGILASMAMVAIDENFAKLPYSHSLAKDVASFCEGHGIALESPAHTNFVFIDLVKNKMDDSLLIELGKKYNVKLMGGRIAFHYQLSEESVENVKRAILECYQDAFKNPYTKTKCNKKMYNFDAIKNSLVSN

SEQ ID NO: 22382 - DNA, 1071 bp, Yarrowia lipolytica
  CDS (1)..(1071)
atgactgcctgctctcacgatttcagatcggatacgatcacaaatcccaccaaagagatgatggaagccatcaccaactcgtactctgctcttggcgacgcagtgtacgaggaggacaccatcaccaccaactttgagagccgaatcaaggagctcaccggccacgaggctgctgtcttcgccgtctccggtacgatgactaaccagctggccatcagatcccacctgttccagcctccacactcgatcctgtgtgatcatcgagcacatgtgtacacctgcgaagctggtggcatagccacactgtctcaggccatggtgacccccgtcatcccctccaatggcatttacatgactctggaggacatcaaggccaagatcattgtcggagaagatgttcatgtcgcacctaccaagctcatctgtctggaaaacacaatgggtggcgccatttaccccattgaggagattcgtcgcatttcaaagtttgcacgggacaatgacatccctatccatctggatggcgccagactgtggaatgcaagcattgctacaggcgtgtcaatgcgggagtatggttcactctttgactcgatctctttatgtctatcaaaaggcttatgtgcccctgtaggcagtgtgcttgtggggtcaaagaagctgatcaagaccgctacctggtttaagaagcaggccggaggaggaattcggcagtccggtatcctgacatctgcagctaacgttgcattggaccaagtctggccctcaatggcaaaaactcatgctactgcgaaggagttcgccaactttgttacttctgacctgggcctcaagctcctttttcccgctgataccaactttgtttacattgatgaaacggacaaatttgattctgatgtctttgtcaagcttggagcggagcggggcatcaagttgctcggaggcagaatcgtcttccactaccatacttcacccgaggccattgagaccttgaaggaggtgcttcaagaggctatcaaacagtattctggggtaaaggaagacaagcttaagactagtggctacatctaa

SEQ ID NO: 22383 - protein, 356 aa, Yarrowia lipolytica
MTACSHDFRSDTITNPTKEMMEAITNSYSALGDAVYEEDTITTNFESRIKELTGHEAAVFAVSGTMTNQLAIRSHLFQPPHSILCDHRAHVYTCEAGGIATLSQAMVTPVIPSNGIYMTLEDIKAKIIVGEDVHVAPTKLICLENTMGGAIYPIEEIRRISKFARDNDIPIHLDGARLWNASIATGVSMREYGSLFDSISLCLSKGLCAPVGSVLVGSKKLIKTATWFKKQAGGGIRQSGILTSAANVALDQVWPSMAKTHATAKEFANFVTSDLGLKLLFPADTNFVYIDETDKFDSDVFVKLGAERGIKLLGGRIVFHYHTSPEAIETLKEVLQEAIKQYSGVKEDKLKTSGYI

SEQ ID NO: 22384 - DNA, 1188 bp, Kluyveromyces lactis
  CDS (1)..(1188)
atgactgcttctgataagaaatctactgctgctgctccttcagagccagcttacacctcagctgccaatgaccttcggtctgatactttcaccactccaactaaggaaatgttggaagctgctttcaatgcttccatcggtgatgcagtctataacgaagacgtcgacaccattgagctagaaaccgtcgtagctcgtttagctggtaaagaagccgggttattctgtgtctctggtactttatcgaaccaaattggtttgagaacgcatctattccaacctccatactctatcttgtgtgattacagagctcatgtttatactcatgaagcagctgggttggcaatcttgtctcaagcgatggtcactccggtgatcccatctaacggtgattatatgactttggaagatatcaaggctcattacatcccggacgacggggatattcacggtgcgccaacaagagtgttatcgttggaaaacactttgcacggtatcgtttacccattggaagaattgatccgtatcaaagggtggtgtttggaaaacgatatcaaattacactgtgacggtgctagaatttggaacgcagttgtcgaatccggtgtctctttgaaacagtacggtgaaattttcgactctatctccatttgtctatctaagtccatgggtgctccaatggggtctgttcttgttggtagcaacaagtttgtcaagaaatgtaaccatttcagaaaacaacaaggtggtggtgttagacaatcaggtattatgtgcagaatggcactttgcgctgtgaacggtgactggaagactaagatgggatactctcaccagttggcccacgaattggctaaattctgtaaagataacggtattccattggagtctccagctgacaccaacttcgtcttcttggacttgcaaaaggcaaagatgaacccagacgttcttgtcaagaaaggtttgaaatatggggtcaaattgatgggtggtagagtttctttccactaccaagtcaccagagaaactttggaaaatgttaagtctgctgtcttggaaactttccaatacgcaaaggaaaacccattcgacactaacggtccaacaaaaatctaccgtagtgaatctactgattttgatatccatggtaaccctatcagtgatatcaagacttacaagtactga

SEQ ID NO: 22385 - protein, 395 aa, Kluyveromyces lactis
MTASDKKSTAAAPSEPAYTSAANDLRSDTFTTPTKEMLEAAFNASIGDAVYNEDVDTIELETVVARLAGKEAGLFCVSGTLSNQIGLRTHLFQPPYSILCDYRAHVYTHEAAGLAILSQAMVTPVIPSNGDYMTLEDIKAHYIPDDGDIHGAPTRVLSLENTLHGIVYPLEELIRIKGWCLENDIKLHCDGARIWNAVVESGVSLKQYGEIFDSISICLSKSMGAPMGSVLVGSNKFVKKCNHFRKQQGGGVRQSGIMCRMALCAVNGDWKTKMGYSHQLAHELAKFCKDNGIPLESPADTNFVFLDLQKAKMNPDVLVKKGLKYGVKLMGGRVSFHYQVTRETLENVKSAVLETFQYAKENPFDTNGPTKIYRSESTDFDIHGNPISDIKTYKY

SEQ ID NO: 22386 - DNA, 1182 bp, Kluyveromyces lactis
  CDS (1)..(1182)
atgcctattccacctttgtatacttcttctgcaggggatttcagatccgacacattcacgataccgacaaaagatttctggagccaagtgaccgatgcttcattgggagatactatcaatttagaagatacagatacgtgttcattggaagctagattatctgacgagattcttggtggcagggttcacagtggcgagaaatcagagggtttgttttgcatgtcaacaacattggcaaaccaaatagctgtccgctcccacttgaatttcgcaccaccttactctgtactttgtgataaacgagctcatatttttgttgatgaatgtgccgggattgcagtactttcccaagctttggtaatgcctaccatggcaagtaacggctgttacttaacattggaagatataaaggagaattatgtccctgacataggcgatatacacctagctccaacaagattaatatgcttggagaacaccttgcatggtatgttgtttcctctgactgaacttcaaagaatcagcgactgggctcattcccaagacattaaaattcatctcgatggagcaagattgtggaatgctgccgccgccaccgccgccgctaataattcctcttcggagtttgagactgaaatagaatacatgcaaaaagtgtcaaaattagtggactcagtctcgatctgtctttctaagtccatcggagcaccaattggttcagtgttagtggggtcgtctcaattcatcaagaaagctaggcacatacagaaacaacaaggtggcggtataagacaagccgggtttatcactaagattgctaattactgtattgatctcaacttcccgaacaggattgttgaagttaacaaggctaccagcaggttttggacagatttattccatacactaaaggaccagtatcagtttgaattggtcttacaacatcctgttgagacaaattttatatttgtggatttagctaagtcaaaaatatcattgaagctcttgttggaatttgcggaaaagaataatgttagattatgggatggcagactagcattccattaccagaatatcgaccaagaaggtttggatcgtttaaaacaaacctttattgacatcgcgaagtattacaaagagcatccatatgttgcagaagagagaagtgccagaatttattga

SEQ ID NO: 22387 - protein, 393 aa, Kluyveromyces lactis
MPIPPLYTSSAGDFRSDTFTIPTKDFWSQVTDASLGDTINLEDTDTCSLEARLSDEILGGRVHSGEKSEGLFCMSTTLANQIAVRSHLNFAPPYSVLCDKRAHIFVDECAGIAVLSQALVMPTMASNGCYLTLEDIKENYVPDIGDIHLAPTRLICLENTLHGMLFPLTELQRISDWAHSQDIKIHLDGARLWNAAAATAAANNSSSEFETEIEYMQKVSKLVDSVSICLSKSIGAPIGSVLVGSSQFIKKARHIQKQQGGGIRQAGFITKIANYCIDLNFPNRIVEVNKATSRFWTDLFHTLKDQYQFELVLQHPVETNFIFVDLAKSKISLKLLLEFAEKNNVRLWDGRLAFHYQNIDQEGLDRLKQTFIDIAKYYKEHPYVAEERSARIY

SEQ ID NO: 22388 - DNA, 1161 bp, Candida glabrata
  CDS (1)..(1161)
atgactactgaactaccaccacaatataccagtgcttccaatgacctgcgttccgacactttcaccactcctaccaggaagatgaaggaggctgctctggaggcttctattggtgacgctgtctacaacgaggacgtcgacaccatccgtctcgagcagcacgtcgcaaagctggccggtatggaggccggtctgttctgtgtctccggtacgctgtccaaccaaatcgctctgagagcgcacttgtaccagccaccttactccatcctgtgcgactacagagcgcacgtctacacacacgaggcagctggtctggccatcctgtcccaagccatggtcgtcccagtgatcccatccaatggcaactacatgaccctcgaggacatcaagagccactatgtcccagacgatggtgacatccacggtgccccaaccaaggtcatctccctggagaacaccttgcatggtatcatctacccgctagaagaactggtccgcatcaaggcctggtgtatggagaacggcctcaagctgcactgtgacggtgcccgtatctggaacgcagccgctgagtccggtgtcccactgaaacagttcggtgaactcttcgactccatctccatctgcctgtcaaagtccatgggtgccccaatgggctccatcctggtcggtaacaccaagttcatcaagaagtgtaaccacttcagaaagcagcaaggtggtggtgtaagacaatcaggtatgctatccagaatggccctctgcaacatcgacgccgactggaagtcaaacctactgtactcccacagactagcccacaacttggcagacttctgtaaagaaaagggtatccctctcgagtccccagccgacactaacttcgtcttcgtcgacttgagagcagcaaagatgaaccctgacgtcctggttaagaaaggtctgaaatacggtgtaaagctgatgggtggtagaatctccttccactaccaagtctcagaagaatccttggaaaaggtaaaactggctttgctcgaagccttcgaatactctaaggaacacccattcgatgaaaacggagctactaagatctaccgtagtgcctccaccgaagtcgacatcgaaggtaacgctatccaagagatcaagacttacaagtactaa

SEQ ID NO: 22389 - protein, 386 aa, Candida glabrata
MTTELPPQYTSASNDLRSDTFTTPTRKMKEAALEASIGDAVYNEDVDTIRLEQHVAKLAGMEAGLFCVSGTLSNQIALRAHLYQPPYSILCDYRAHVYTHEAAGLAILSQAMVVPVIPSNGNYMTLEDIKSHYVPDDGDIHGAPTKVISLENTLHGIIYPLEELVRIKAWCMENGLKLHCDGARIWNAAAESGVPLKQFGELFDSISICLSKSMGAPMGSILVGNTKFIKKCNHFRKQQGGGVRQSGMLSRMALCNIDADWKSNLLYSHRLAHNLADFCKEKGIPLESPADTNFVFVDLRAAKMNPDVLVKKGLKYGVKLMGGRISFHYQVSEESLEKVKLALLEAFEYSKEHPFDENGATKIYRSASTEVDIEGNAIQEIKTYKY

SEQ ID NO: 22390 - DNA, 1026 bp, Staphylococcus aureus subsp
  CDS (1)..(1026)
atgatttcattcgaaaatgattatttagaaggtgctcatgaaaaagtattaaaacgattagtagatacaaatcttgtacaagcttcgggatatggctttgatcaattcacagctcaggcaattgaaaagattaaagatacaattgactgtccaaatgctacaattcgttttttagtaggtggaacacaaaccaatcaggttgttattaattcaatgttagaaagttacgaaggggtcatttcagcagacactggtcatgttgctgtgcatgagggcggtgcaattgaatatagtggacataaagtaattactataccctctaaggaaggaaaagttagtgcttcagatgttgaaacttacatggagacatttaaaagtgattttaaaaaggaccatatggtattcccaggaatggtatatatttctcatcctactgaatatggcacattatactctaaatcagaattggaagagttatgcaaagtatgtaagcaatatcagcttccattatttatggatggtgcacgattagggtatggattgatgagtgatcaatcagatatgactattaaagacatcgctaaatattgtgatgtattttatataggtggtacgaagataggtgcattatgcggagaagcaattgtttttacgaagaataatgaaccgaaacaatttaccactcgaatcaaacatcacggtgcacttttagcaaaaggacggttaacaggcatacaatttttagaattatttacggataatttatattttaatataagcagacatgctatcgaaatggcaaataagatgaaagacgggtttataaataaaggctatcgtctttactttgattctccaaccaatcaacaattttttattttaagtaacgagaaaatagcagagttagaacaaaaagttaaatttgctgtttgggaaaaatacgatgatcaacatcgtgttgttagattcgcaaccagttgggcgacaaccgaagaaaatttaaataaactattagaattaatctaa

SEQ ID NO: 22391 - protein, 341 aa, Staphylococcus aureus subsp
MISFENDYLEGAHEKVLKRLVDTNLVQASGYGFDQFTAQAIEKIKDTIDCPNATIRFLVGGTQTNQVVINSMLESYEGVISADTGHVAVHEGGAIEYSGHKVITIPSKEGKVSASDVETYMETFKSDFKKDHMVFPGMVYISHPTEYGTLYSKSELEELCKVCKQYQLPLFMDGARLGYGLMSDQSDMTIKDIAKYCDVFYIGGTKIGALCGEAIVFTKNNEPKQFTTRIKHHGALLAKGRLTGIQFLELFTDNLYFNISRHAIEMANKMKDGFINKGYRLYFDSPTNQQFFILSNEKIAELEQKVKFAVWEKYDDQHRVVRFATSWATTEENLNKLLELI

SEQ ID NO: 22392 - DNA, 1008 bp, Photobacterium profundum
  CDS (1)..(1008)
atgattgattttcgctcagacacagtaacacgtccatccgattcaatgttggaaacaatgatgaaagcccctgtcggcgacgatgtatatggtgatgaccctacggtaaatgatttagaacagtggacagcagaacgccacggctttgaagcggctattttttgtagctcaggtacgcaagcaaacttgttaggtttaatggcacattgtgaacgtggtgatgagtacctttgcggccagcaagcacacaattataagtttgaaggcggtggtgcagcggtattaggttctattcaaccacaacctatcgaaaatgaaaaagacggttcaatttctattgataaactaaaagctgcaattaaaccaatagatcctcactttgcgcgcaccaccctactcagccttgaaaataccattaatggtaaagtactgccgttatcatatttgaaagaagcgcgtgaatttgtcaatcagcacggcttaaaattgcatttagatggcgctcgcgtatataacgcatcggtagcattagatgtagacatcaaagagatctcgcaacacttcgattcaatgacaatctgtttatcaaaagggttaggtgctcctattgggtcattgctactaggcaaccatgagctaatagccaaagcacgtcgttggagaaaagtattaggtggcggtatgcgtcaagctggtattttagcggcagcaggaaaaatagcccttactgaaaatgtaactcgtctggcagacgatcatgccaacgctcgttatcttgcacaagaattagcaaaagttgacggcttttcagttaatcttgaacatgttcaaacgaatatgctttttgccaaggttgactcaactatcaatcaacagcagttagttgataacttaaaagagcaaggtatcttatttagcgcaggtaaccctatgcgtttagtcactcatttagatataagccgagtagacatcgatacctttataacggcgttaaaatgcgctttataa

SEQ ID NO: 22393 - protein, 335 aa, Photobacterium profundum
MIDFRSDTVTRPSDSMLETMMKAPVGDDVYGDDPTVNDLEQWTAERHGFEAAIFCSSGTQANLLGLMAHCERGDEYLCGQQAHNYKFEGGGAAVLGSIQPQPIENEKDGSISIDKLKAAIKPIDPHFARTTLLSLENTINGKVLPLSYLKEAREFVNQHGLKLHLDGARVYNASVALDVDIKEISQHFDSMTICLSKGLGAPIGSLLLGNHELIAKARRWRKVLGGGMRQAGILAAAGKIALTENVTRLADDHANARYLAQELAKVDGFSVNLEHVQTNMLFAKVDSTINQQQLVDNLKEQGILFSAGNPMRLVTHLDISRVDIDTFITALKCAL

SEQ ID NO: 22394 - DNA, 1026 bp, Bdellovibrio bacteriovorus
  CDS (1)..(1026)
atgaaacgcggttttggcagcgacaatcatgccggtgtccacccacggattctgcaatctatcctggacgccaacaccgaacacgcccccgcctacggaaccgatgaatggaccgaacgcgcggtgggggaattcaaaaaccaattcggcaaagacgcccacgtgttcttcgtcttcaatggcacggccgccaacgtcacggccttaagagccatggcccgcccctggcaatcggtgttctgttcagacgtggcgcacatcaatgtggatgaatgcggctcgccggaatttttaagtggttgcaaactgctgccactgccctcccacaacggaaaactgtctgtggaagaacttgaaaaggccttcatccgccggggggaccagcatttttcccagactcaggtgctcagcctgactcagcctacagaactgggaaccacctattctttggatgagctcaaagccctgatcgcttgggccaaaagcaaaaaactgctggtgcacattgacggagccagactgagcaacgcggccttgtacttgaaaaagaccttgaaagaaatcaccaccgacctgggggtggatgtggtttctttcggtggcaccaaaaatggtttgatgatgggtgaagccgttgtgatcctgaataaggatctggcgcaggattttaaatacatccgcaaacaaagcgcgcagctgccttccaagacccgctttatcgcctgtcagtttgaagcttacttcaaagacggtctatggcagcagattgctgaacattcccaccagatggccctgtatctgtatgaacagtgcaaaggacttgccggggtgaccgtgcgcgaagtcccgcaaagcaatgcggtctttgcgacaattcccagccactgggtgaaacccttgcgggaacattattttttctatgtctgggacgaaaacacatttgaatgtcgctggatgacctcctgggacacgcaaaaatcggatatcgatggtttcgtcgcacttctaaaggagcaacgtctatga

SEQ ID NO: 22395 - protein, 341 aa, Bdellovibrio bacteriovorus
MKRGFGSDNHAGVHPRILQSILDANTEHAPAYGTDEWTERAVGEFKNQFGKDAHVFFVFNGTAANVTALRAMARPWQSVFCSDVAHINVDECGSPEFLSGCKLLPLPSHNGKLSVEELEKAFIRRGDQHFSQTQVLSLTQPTELGTTYSLDELKALIAWAKSKKLLVHIDGARLSNAALYLKKTLKEITTDLGVDVVSFGGTKNGLMMGEAVVILNKDLAQDFKYIRKQSAQLPSKTRFIACQFEAYFKDGLWQQIAEHSHQMALYLYEQCKGLAGVTVREVPQSNAVFATIPSHWVKPLREHYFFYVWDENTFECRWMTSWDTQKSDIDGFVALLKEQRL

SEQ ID NO: 22396 - DNA, 1101 bp, Rhodopseudomonas palustris
  CDS (1)..(1101)
atgatctacgcccccgcccctgacgatccgcgactgccgccggtgcggatcaatttgctgtcggacacccagactcagcccagtgcggcgatgcgggaggcgatggcgcgggcgccggtgggagacgaacagatcggtgccgatccgaccgtgaacgcgctgtgcgcccgtgtcgccgatctgctcggcaaggaggcggcggtgttcatggcgtccggcacgatctgcaacattgcggcgacgttggcgcattgccgagccggcgacgaaattctcgcgcacgagacgtcccatgtcgtctcgctggagggctgcacacacgcggctctcggcggctttcagatccacccgctgccgggcgcaggcggtcagttctccgctgaaacgctgcgatcggcgctgcatcggccagaccggcatcaggcgaggcagagcctggtgtgcgtcgagcagaccaccaatctcggcggcggcacggtgtggaacgctttgacgctccggcagatcgcggaattggctcgcgccaatggattagccacccatatggacggtgctcgcctgatgaacgccagcgtcgccagcggcatctcgccccggcagatcgccgccggctgggactcggtgtggatcgacttcagcaagggcctcggcgcgccactcggtgccgtgcttgcgggatcgcgcgatttcatcgacgaggtctggctgtggaagcagcggctcggcgggtcgctgcgtcaggccggcatttgcgccgccgcctgcctgtatgcgctcgaccacaatgtcgggcgcctcgctgaggatcacgccaatgcccgattgctcgcggcaggcttgtcgcagatcgacggcgtgagcgctgcaccgccggagaccaacctggtctatttcgacgtctccggcgccgcgtggtcaaagcaggcaattgtcgacgcgctgcgggcccgtggtgtgctgatctcgatcctcagcgaccggctacgcgcctgcacgcatctcgacgtcacgcccgcgatgatccaagaggcgctcgcagtgatccgcaacgtggtcgaaggcgatacgacggcccggatcggccgcagcgcacagatctga

SEQ ID NO: 22397 - protein, 366 aa, Rhodopseudomonas palustris
MIYAPAPDDPRLPPVRINLLSDTQTQPSAAMREAMARAPVGDEQIGADPTVNALCARVADLLGKEAAVFMASGTICNIAATLAHCRAGDEILAHETSHVVSLEGCTHAALGGFQIHPLPGAGGQFSAETLRSALHRPDRHQARQSLVCVEQTTNLGGGTVWNALTLRQIAELARANGLATHMDGARLMNASVASGISPRQIAAGWDSVWIDFSKGLGAPLGAVLAGSRDFIDEVWLWKQRLGGSLRQAGICAAACLYALDHNVGRLAEDHANARLLAAGLSQIDGVSAAPPETNLVYFDVSGAAWSKQAIVDALRARGVLISILSDRLRACTHLDVTPAMIQEALAVIRNVVEGDTTARIGRSAQI

SEQ ID NO: 22398 - DNA, 1083 bp, Rhodopseudomonas palustris
  CDS (1)..(1083)
atgttagcctcgggtatggcctacatcccttccctacccgatccgaacgcgccgccggtgcggatcaatctgctctccgacacccagacgcggccgacgccggcgatgcgcgaggcgatggcgctggccgaggtcggcgacgagcagaccggcgacgatccgaccaccaacctgttgcaggagcgcgtcgcggcgctgctcggcaaacaggccgcagtgttcctcccttcagggacgatgtgcaacgtcacgactacgctcgcgacctgccggcccggggacgagatcatcgcccatcgcaccgcgcatatcctgtcacgcgaaggcggtgcgcacgccgcgctcggcggcttccagatcaccggcctggacggcgacgacggccagttctcactcgagacgttccgcgccgcgctgcatccgaagacgcgctacgaaccgccacaagtgatggtcagcgccgaacagaccgccaatatcggcggcggcacaatctggccgcaggccacgctcgacgcggtcgccgcggccggcaaggacgccgggctgtggacgcatatcgacggcgcacggctgatgaacgcggtggtcgccacgggtatcagtgccaaggcgatgacggcgggttgggactcggcgtggatcgatttcagcaagggcctcggtgcaccggtcggcgccgtgctggccggcccgcgtgccttcatcgacgaggtgtggcgctggaagcagcggctcggaggcgcgatgcggcagtccggcgtgattgccgcggcgtgtctgtacgcgctcgatcatcacgtcgatcgccttgccgacgatcatgccaacgcgcgccgtcttgcctccgggctagcgcagatcgacggcatcgaggtgcagacgccgcagaccaatctggtgttcttcaaaccggaccgcaccggcgtctccggcgccgacatggtcgcacagctccgccggcgcggcgtggtgttggcgatgatggagggacggatccgcgcctgcacgcatctcgacgtcagcgcggacatgatcgagcaaacgctcgaccacgtccgcgagatcgtgcgggcagcctga

SEQ ID NO: 22399 - protein, 360 aa, Rhodopseudomonas palustris
MLASGMAYIPSLPDPNAPPVRINLLSDTQTRPTPAMREAMALAEVGDEQTGDDPTTNLLQERVAALLGKQAAVFLPSGTMCNVTTTLATCRPGDEIIAHRTAHILSREGGAHAALGGFQITGLDGDDGQFSLETFRAALHPKTRYEPPQVMVSAEQTANIGGGTIWPQATLDAVAAAGKDAGLWTHIDGARLMNAVVATGISAKAMTAGWDSAWIDFSKGLGAPVGAVLAGPRAFIDEVWRWKQRLGGAMRQSGVIAAACLYALDHHVDRLADDHANARRLASGLAQIDGIEVQTPQTNLVFFKPDRTGVSGADMVAQLRRRGVVLAMMEGRIRACTHLDVSADMIEQTLDHVREIVRAA

SEQ ID NO: 22400 - DNA, 1855 bp, Mus musculus
  CDS (128)..(1330)
atagtgccccgggcttgcccagttcaggtccgcgcggggtcagaagagtccagttacacgggttccccgctggcacggaagagactgtcctccgctcctgcggccgagaaagacgagtgccacagccatgctatgcagcctgttccgggccgccatgctacgcagcctgttccgggccacggtcccggggctcagggtgccctgggctcagtggtctaggaattgggcgggggtcccagcccacgtggtggacctacgcagcgacacggtgacccggccagggccggccatgaggcgcgctatggccgaagcggttgtaggagacgatgattacggcgaagaccctacggtccacgaactgcaggaaaaggctgcagagttgcttggggtagagaggacgctgtttgtgcccaccaacactatggccaacctcatctctgtgatgggtcactgccggcgccggggttcccaggtcctccttgggcaggaatgccacctccacgtctatgagcagggcggggtggcacagatcgctggggtgcattcccaccccctccccgacctgccctatggcaccttggacctgaatgagctagagagggcactcacgcggggctctgggagtccctaccatccagtctgtgagctcgtgtacctggagaacactcacagcagcgcgggaggccgggtcctccctgtcgactacctccgccaggtgtgcctcctggcccacgcccacggagcaagggtccacatggatggagctcggttgatgaatgcagcagtggctctgcgcataccccctgcccgccttgtagagcactgtgactctgtatccttctgtttctctaagggcctaggtgcaccagtgggagctctggttggcggatccaaagacttcattggagaagcatggcgcctccgcaaggccctgggtggaggcatgcgccaggctggagtgctggctgcggctgccctggtgggactagctgaggcagaggaggtgctaccaagggaccacgagaatgcccagagattcgctaaaggactccaagacctggcgtcacccatttgctctgtggatcctgccaccgtggagaccaacatggtgctggtgcaggtagctgggctgcctccctcggagctatgccagcgcctgcaggctgtgagtgcagaggaggtggctcagactggccgtgccgtgcgcgtgctgctgtttccctggacagaacagtctgtgcgggctgtgtggcaccgagatgtgtctgctcaggacacggaactggcactgaagaagtgggagtttgtgctgagacagttgcggccctgaggccaggggatccgggaccccgtgctacgattggagtgggcagtgagatgcctgaagctgttagcctggtgaaggctcatcctctctggaggatggtgacatcattccgtctctggtttgctccagtgacactcctgggatggccttacgcagtcaggaataaccaggcataaggtggggaaagctgtgactgcatatccagagaaggaagcgcatagaggaggcaggccctggggttggggttggccctggggtgtagcaggattgcctagtgtgcataagccctgggctccatccccagcactgtgggttcgaaccccagcagctcacagctcacaactgtaaccctaccatgctaggggattagaagctcaaggccactctcagctactcagagaatttgatgcaagcctgggctacacgagaccctgtcttcaagaaaatagatccttagtgactgacacagtggagttgtcagaggtggactgtgaaataaaatactgaaggcacaaaaaaaaaaaaaaa

SEQ ID NO: 22401 - protein, 400 aa, Mus musculus
MLCSLFRAAMLRSLFRATVPGLRVPWAQWSRNWAGVPAHVVDLRSDTVTRPGPAMRRAMAEAVVGDDDYGEDPTVHELQEKAAELLGVERTLFVPTNTMANLISVMGHCRRRGSQVLLGQECHLHVYEQGGVAQIAGVHSHPLPDLPYGTLDLNELERALTRGSGSPYHPVCELVYLENTHSSAGGRVLPVDYLRQVCLLAHAHGARVHMDGARLMNAAVALRIPPARLVEHCDSVSFCFSKGLGAPVGALVGGSKDFIGEAWRLRKALGGGMRQAGVLAAAALVGLAEAEEVLPRDHENAQRFAKGLQDLASPICSVDPATVETNMVLVQVAGLPPSELCQRLQAVSAEEVAQTGRAVRVLLFPWTEQSVRAVWHRDVSAQDTELALKKWEFVLRQLRP

SEQ ID NO: 22402 - DNA, 1080 bp, Listeria monocytogenes
  CDS (1)..(1080)
atgataaacacactaaaaaccagctaccaaaaaacaccatataaactaggcgggaacggtccgcgcaatgtaggtgttctgacagaagcacttcaaaatatagatgataacctagaaagcgatatttacggaaatggcgcagttattgaaaactttgaaacaaaaatcgcgaaaattctcgggaaacaatctgcggtattttttccaagtgggacgatggctcagcaaattgcgttaaggatttgggctgaccggaaagagaatcggtgcgtggcatatcatccactctctcatttggagattcacgagcaagatgggttaaaagaattgcaacaaatcacgcccatattacttggaacagctaatcgacttttgacaattgacgatattaaaagccttcgcgagccagtttctagtgtgcttatcgaacttccacaacgagaaattggtgggcagctgcctgcttttgaagagcttgaggagatttcggagtattgccatgaacagggtatttcgttgcatcttgacggggcacggttatgggaaatcacgccgttttatcagaagtctgcggaagaaatttgtgcgctgtttgatagtgtgtatgtgtcgttttacaaaggaattggcgggattgctggggcgattctggctgggaatgatgattttgtgcaagaggcgaaaatctggaaacgacggtatggcggagatttgattagtctgtatccgtatattttgtccgcggattactattttgaaaaacggattgggaaaatggcggaatattttgaagcggcgaaaggattggctgagcgatttaattcgtgttcgggcgtgaagactgtgccggaagtgccggtttctaatatgtttcatgtttattttgagaagtcggccgatgaggttggggcgattttgacgaagattcaggatgaaactggagttggaatttcggggtatttgcaggagaaatcggcggatgtttgcgcgtttgaggtttcggttggggatgcatttgcggagataccggtggagattttggatgatttatttaagaaacttgtaaattcagtaaaatag

SEQ ID NO: 22403 - protein, 359 aa, Listeria monocytogenes
MINTLKTSYQKTPYKLGGNGPRNVGVLTEALQNIDDNLESDIYGNGAVIENFETKIAKILGKQSAVFFPSGTMAQQIALRIWADRKENRCVAYHPLSHLEIHEQDGLKELQQITPILLGTANRLLTIDDIKSLREPVSSVLIELPQREIGGQLPAFEELEEISEYCHEQGISLHLDGARLWEITPFYQKSAEEICALFDSVYVSFYKGIGGIAGAILAGNDDFVQEAKIWKRRYGGDLISLYPYILSADYYFEKRIGKMAEYFEAAKGLAERFNSCSGVKTVPEVPVSNMFHVYFEKSADEVGAILTKIQDETGVGISGYLQEKSADVCAFEVSVGDAFAEIPVEILDDLFKKLVNSVK

SEQ ID NO: 22404 - DNA, 1023 bp, Desulfovibrio vulgaris
  CDS (1)..(1023)
atgctcaagagtttcgccagcgacaacacagcaggggtgcatccgcgcatcctcgccgccatggcctccgccaacgaaggccacgccaaggcctacggcatggacccgtggacaagtgaggctgcggatgtcttccgcggacacttcggtgatgacatcgacctgtatttcgtctttctgggcaccgctgcgaacgtgctgggactcaaatccgtcacgcgcccctggcattcggtggtctgcgccgatgtggcccatatcaatgtcgatgaatgcggcgcgccggagtcggtgaccgggtcgaagttgcaggtcatcccgtcgcacgacggtcgcatccgggtcatggacatcgtgcccctcatgcactcgctgggtaatttccaccacagccagccccgtgtcatctccatcacccagacgactgaactcggcacggtgtactcgccggcgcagatacgcgcgctggccgatttcgcccacgccaacggcatgctgctgcacatggatggtgcacggctgtgcaacgcggcggcggcactcgataccgggctggcggccctcacccgtgacacgggggtcgatgtgctctcgttcggcggcaccaagaacggcatgatgttcggtgaagccgtcatcttcttcaatcgtgaactggcaagcgaattcaagttcatccgcaagcaggggatgcaactggtctcgaagatgcgcttcatcgcggcgcagttcatcgaacttctgcgtgatggtctgtggcttgagaacgcccgtaacgccaacagcatggcacggctcatggctgaaagcctgcgcggtctgccccatgtgaccatcacccggcccgttgaggcaaacgccgtgttcgcccggctttcgccggaacatatcgcggcactgcagaaggacttctatttctatgagtgggacccggtgctgcacgaggtgcgctggatgaccagcttcgactccaccgaggaacaggtcatggagttcgtgcacgccatcaaacggctggcatag

SEQ ID NO: 22405 - protein, 340 aa, Desulfovibrio vulgaris
MLKSFASDNTAGVHPRILAAMASANEGHAKAYGMDPWTSEAADVFRGHFGDDIDLYFVFLGTAANVLGLKSVTRPWHSVVCADVAHINVDECGAPESVTGSKLQVIPSHDGRIRVMDIVPLMHSLGNFHHSQPRVISITQTTELGTVYSPAQIRALADFAHANGMLLHMDGARLCNAAAALDTGLAALTRDTGVDVLSFGGTKNGMMFGEAVIFFNRELASEFKFIRKQGMQLVSKMRFIAAQFIELLRDGLWLENARNANSMARLMAESLRGLPHVTITRPVEANAVFARLSPEHIAALQKDFYFYEWDPVLHEVRWMTSFDSTEEQVMEFVHAIKRLA

SEQ ID NO: 22406 - DNA, 1023 bp, Thermus thermophilus
  CDS (1)..(1023)
atgcgcctcgtggacctgaggagcgacaccctcacccgccccaccccggccatgcgcaaggccatggcggaggcggaggtgggggacgacgtctacggcgaagaccccacggtgaaccgcctcgaggccctggcggcggaaaggctcgggtttgaacgggccctcttcctgccctcgggcaccatggccaaccaggtggccctcctcctccacctgccccggggcggcgaggtcctggcccccgagggggcccacctctacgagtacgagctcggcgccccggccctcctcgccggggccctggtccgccccgtgcccgccccaggggggaggccggacctgaaggccctggaggaggccctaaggcggggccccttccaggcccccatcgggctactcgccctggagaacacccacaacctggccggggggcgggtggtgcccctggaggtccaaaggcgggtccaagacctggcccgcgcccggggcctccccacccacctggacggggcccgcctccacaacgccgccgtcttcttgggggtggaggcccgggaggtggcccggggcttcaccaccgccatggtctccctctccaaggggctcggggccccggtgggaagcctcctcctcctgcccaaggagctggaggccgaggcccggcgttaccgcaagctcctcgggggcgggtggcggcaggcgggggtcttggccgcggcggggatcctggccctagaggaaggccccaagcacctccggcgcgaccacgagatggcccgcgccctggcggaggggctttttcgcctggggctcgccgtggacctgggggcggtggagaccaacatggtctacctggaggtggaggaccccgagggctttctccagggtctaagggcccggggggtgctcgcggggcgcgtggggggaagggtgcggttcgtgacccaccgggacctcatggacgaggacatcccccttaccctggagagggtccaagacctccttcactccaggcccaggtag

SEQ ID NO: 22407 - protein, 340 aa, Thermus thermophilus
MRLVDLRSDTLTRPTPAMRKAMAEAEVGDDVYGEDPTVNRLEALAAERLGFERALFLPSGTMANQVALLLHLPRGGEVLAPEGAHLYEYELGAPALLAGALVRPVPAPGGRPDLKALEEALRRGPFQAPIGLLALENTHNLAGGRVVPLEVQRRVQDLARARGLPTHLDGARLHNAAVFLGVEAREVARGFTTAMVSLSKGLGAPVGSLLLLPKELEAEARRYRKLLGGGWRQAGVLAAAGILALEEGPKHLRRDHEMARALAEGLFRLGLAVDLGAVETNMVYLEVEDPEGFLQGLRARGVLAGRVGGRVRFVTHRDLMDEDIPLTLERVQDLLHSRPR

SEQ ID NO: 22408 - DNA, 1053 bp, Wolbachia pipientis wMel
  CDS (1)..(1053)
atgagagtaaaaatagatttctttagcgattcaaacactgacccttcagctaaaatgagggaagcgatggctaaagcaaaagttggaaacgaagctgcatgtgaagatccaactgtgaacgaattagtggcaaccgcatgtaaaatattaggtaaacctgcaggaatctttttgatttcaggaacgatgtccaatgtaattgcttataaagtacacattcaaagacctggtgattacttgctgcttgatgaaacttcacatccactcatagtacaatctggcttgatcgcagcccaggcacatgctactcctttgcccatcaaaggtacaagaggaatatttactggagaacaaattgttgagtttattactcgtcctagtttaagaaatattccgagagttgggcttgtttctatcgaacaaacgacaaattttggtggtggagctgtgtggcctttagaatatattcaagagatctcaagtctctgcaaagagaatgacgtattcactcatttagatggagcaagactgttcaacgcttgtgctcatactaaaatatctccaaaggagtatgcaagttattttgattcggtattcattgattttagtaaaggattaggtgctccaatgggtgcaatattgcttggaagtgaagattttattgaaaaagcttggtactataagtttcaaattggcggaggtatgcaccaagctggcattatttcagctgcatgtttatatgctctacgtaataatgtaaattctttagaagaagatcataaaaaaatgcagcaccttatagaaggcctagactccatagatcaagttataattgatatcgacctgtataaaactaatatagcgtatttttcattacgtactaattgtatatctactcaagaattaataaacgtactaatgacaaattatggaattagaatggctaacatcaaaggtaaaatcagagctataacacatagagatataagctatgaagatattaatactactgtatctgctataagaaagatactaagtaattttctgcactaa

SEQ ID NO: 22409 - protein, 350 aa, Wolbachia pipientis wMel
MRVKIDFFSDSNTDPSAKMREAMAKAKVGNEAACEDPTVNELVATACKILGKPAGIFLISGTMSNVIAYKVHIQRPGDYLLLDETSHPLIVQSGLIAAQAHATPLPIKGTRGIFTGEQIVEFITRPSLRNIPRVGLVSIEQTTNFGGGAVWPLEYIQEISSLCKENDVFTHLDGARLFNACAHTKISPKEYASYFDSVFIDFSKGLGAPMGAILLGSEDFIEKAWYYKFQIGGGMHQAGIISAACLYALRNNVNSLEEDHKKMQHLIEGLDSIDQVIIDIDLYKTNIAYFSLRTNCISTQELINVLMTNYGIRMANIKGKIRAITHRDISYEDINTTVSAIRKILSNFLH

SEQ ID NO: 22410 - DNA, 1050 bp, Wolbachia pipientis wMel
  CDS (1)..(1050)
atggaaaaaattattgatctgagaagtgacactacaactctgcagagctccaacgttatacatgcaataagtaatgcaactgttggagattttgcttatggtgaagacaaaagctgtaatgacttatcagaatattgcaaacaattattcaaagtagaagaagcattatttgcaaccagcggtatgcttgcaaatagattagccattgccagtcaaacaagtcctggtgatgaactaataactcattataattatcacgttaattttttcgatagcgcaggcaatgcaaaagtaaataatatcgtatttaattgtattagaaataatagcggaatcttagatgttgctgaagtagaatatgctattaattctaagccaaggtacaaaatttttgctcaggtgagtcttgtttctatagaaaatagtataaacgggtttaatggtaaaatttatccttttgaaaaacaagtcgagttatatcactttttaaaagctcacaatgtaaatcttcatttagacggtgcaagaatatttaatgctcatgtcgaaacaaatattgctttagcagattatgctaaatatgtggatacaatgagcttttcttttaccaaaggactgggagctccttttggttcaatgcttatgggtaaaagagagataattgaaagggctaaaaagctacaggtttggctaggtagtggttatcatcagatagggtattgtgctaatgcagcaaagtatgtactacagaacaatatttctaggcttaaagaagacaataaactcgccaaactgtttgcagacaagattaaggaaattccacacataaaactggtactaccttatccagaaactaatatagtaagctttagtataaaagcactaaatgtaactaatgaggttttcttgagtaagtgccaagcttatggtttattgctttttccttggctcgagtctcatataagagcagttacccatcttggcacaaaggaaacagacatcatgaaagctgctgaaattataaaggaggttgtgttaaatttaatatga

SEQ ID NO: 22411 - protein, 349 aa, Wolbachia pipientis wMel
MEKIIDLRSDTTTLQSSNVIHAISNATVGDFAYGEDKSCNDLSEYCKQLFKVEEALFATSGMLANRLAIASQTSPGDELITHYNYHVNFFDSAGNAKVNNIVFNCIRNNSGILDVAEVEYAINSKPRYKIFAQVSLVSIENSINGFNGKIYPFEKQVELYHFLKAHNVNLHLDGARIFNAHVETNIALADYAKYVDTMSFSFTKGLGAPFGSMLMGKREIIERAKKLQVWLGSGYHQIGYCANAAKYVLQNNISRLKEDNKLAKLFADKIKEIPHIKLVLPYPETNIVSFSIKALNVTNEVFLSKCQAYGLLLFPWLESHIRAVTHLGTKETDIMKAAEIIKEVVLNLI

SEQ ID NO: 22412 - DNA, 1056 bp, Treponema denticola
  CDS (1)..(1056)
atgtatttttttataaatgattacagtgaaggttgtcatccaaaaattcttaaagcattgacggaaacaaatgaagagcaaaccgtcggttacggctgtgacgaatattgtgcagaagctgcagaccttatcttaaaagaactggatgcacctcaaagtaaggtttatttcttttctggcggaacacaaaccaacctgaccatgatagcctcagtactaagaccccatcagggagttatcgccgccgatacagggcatataaacgtacatgagtcgggagccatcgaagcttgcggacacaaggttctaaccatcgaatcggcaaacggaaaaataacggcggagcaggctgaagctcttataagggcacattacgatgatcccacagccgagcacatggttcagcccggaatgatttatatttcaaatcctacggaactcggcaccatttattcaaaaaaagaattacaggctttaaagctgaccgctcaaaaatattccgtacccctctatgttgacggcgcccgcctagggacagccctcaccgctgacaataacgacttaagccttgcagacatggcaagatatacggatgccttttatataggcggaacaaagatgggcgctcttttcggtgaagcccttatcatcaacaaccaagatcttcaaaaagactttagatatatacaaaaacaaaaaggcggtctttttgcaaagggcagacttttaggccttcagtttaaaactctttttaaggataagctttacttcgaaataggaagaacaatgaacgaaacggcaaagatgatccgtaaaggtttttccgataggggcttttctttttttatgaaaagcgaaacaaaccagagctttccgataatagaaaatagtcttttagctaaaatagaaaaagaatttaaatgcgaattttgggcaaaaatttcagaaaaccaaacagcagttcgcttttgtacctcatgggcaacaacaaaagaggcggtaaaaaaactttttgaatacgtggacgagataaacagcaatgcgattaaaagataa

SEQ ID NO: 22413 - protein, 351 aa, Treponema denticola
MYFFINDYSEGCHPKILKALTETNEEQTVGYGCDEYCAEAADLILKELDAPQSKVYFFSGGTQTNLTMIASVLRPHQGVIAADTGHINVHESGAIEACGHKVLTIESANGKITAEQAEALIRAHYDDPTAEHMVQPGMIYISNPTELGTIYSKKELQALKLTAQKYSVPLYVDGARLGTALTADNNDLSLADMARYTDAFYIGGTKMGALFGEALIINNQDLQKDFRYIQKQKGGLFAKGRLLGLQFKTLFKDKLYFEIGRTMNETAKMIRKGFSDRGFSFFMKSETNQSFPIIENSLLAKIEKEFKCEFWAKISENQTAVRFCTSWATTKEAVKKLFEYVDEINSNAIKR

SEQ ID NO: 22414 - DNA, 1056 bp, Geobacter sulfurreducens
  CDS (1)..(1056)
atgaacaactgcacgaccaccgagcgccgcaaccagtttgccagtgacaactacgccggaatctgccccgaggcatggcaggccatggaagaggccaaccgtgggtatgcctgttcctacggcgacgacacctggacggagagggcgtgccgcctgctgcgcgacacctttgaaaccgactgcgaggtgttcttcgtcttcaacggcacggcggccaactcactggccctggcatccctctgccagtcgtaccacagcatcatctgccacgagacatcccatatcgaaaccgacgaatgcggggccgccgaatttttttccaacggcacaaaaatacttctggttcccggcccccacggcaaggtcgacccggacgcagttgagcacacggtcaaacggcgcctcgacattcattaccccaagcccaaggtcctcagcatcacccaggcaacggaattggggaccctctattcggtggatgaactgcgcgagctgggccatcttgctcgacgcctggatctacgcgtccacatggacggggcccgttttgcaaatgccgttgccgccctcggtgtccacccgagcgagatcacctggaaggccggggtcgacgtgctctgtttcggcgggaccaagaacggcatggccgtaggtgaagcagtcgtgtttttcaaccgggagcttgcccgcgagttcgactaccgctgcaagcaggcaggacagcttgcctcgaagatgcgctttctggccgctccctggatcggcatgctggaaagcggtgcctggttgacccgctcagcccatgcgaatgcctgcgcagccagacttgaagcccggcttcgcgatattcccggcgtcggcatccgctttccccgccaggcaaactcggtctttgccgatctcccgccgggggtcgtcgacgccctccatgggcttggttggcatttctacaccttcatcggctccggcggagcgcgcttcatgtgctcctgggagacgagcgatcaggacatcgacctactggcgactgacatagcaggttgctgtaataggtaa

SEQ ID NO: 22415 - protein, 351 aa, Geobacter sulfurreducens
MNNCTTTERRNQFASDNYAGICPEAWQAMEEANRGYACSYGDDTWTERACRLLRDTFETDCEVFFVFNGTAANSLALASLCQSYHSIICHETSHIETDECGAAEFFSNGTKILLVPGPHGKVDPDAVEHTVKRRLDIHYPKPKVLSITQATELGTLYSVDELRELGHLARRLDLRVHMDGARFANAVAALGVHPSEITWKAGVDVLCFGGTKNGMAVGEAVVFFNRELAREFDYRCKQAGQLASKMRFLAAPWIGMLESGAWLTRSAHANACAARLEARLRDIPGVGIRFPRQANSVFADLPPGVVDALHGLGWHFYTFIGSGGARFMCSWETSDQDIDLLATDIAGCCNR

SEQ ID NO: 22416 - DNA, 1047 bp, Geobacter sulfurreducens
  CDS (1)..(1047)
atgaacatcattgacctgcgcagcgacaccgttacccggccgagccctgccatgcgcgccgccatggcgggagccgaggtaggggacgacgtctatggcgaagacccgaccgtgaaccggctggaggaactgggcgccgccacgctcggcacggaagcggccctgttcaccgccagcggtacccaggccaatcttctggctctcctggcccactgccggcgtggtgacgaatacattgccggccagaccgcccactgctatcgctacgaagggggcggtgccgccgctttggggggcatccagccccagcccctggaggtggaacccgacgggaccctcgatctctcagccgtggccgccgccatcaagccggacgacctccacttcgcccgcacccggctcctctgcctggaaaacacccatgccgggcgggttcttcccctggactacctggcacgcgccagacggctctgcaacgagcagagccttggcctgcacatggacggtgcccgcatcttcaatgccgccgtaaagctcggcgtaccggtccgcgagatcgccggtcacgtggattcggtgtcggtctgcctctccaaggggctcggcgccccggtggggtcgctgctctgcgggggaagggagttcgtcgccacggcccgccggtggcgcaaggcggtcggaggaggcatgcgccaggccggcatcctggcggccgccggcatcctggcgctgaccgaaaacgttgaccggctcgccgaggaccatgccaacgcccgccgcttggccgaggggttggccgccatcccggggctgggccttgacccgtcccaggtccagaccaacatggtattcctgtgcctccctctccggacggcggaccggctcgcctcatttctcaacgaacagggaattctcatctccggccgggaaagtatccgtctcgtcacccaccttgacgtaacctcttcggacgtggaacgggttatcgcggcattcggcgcattcttcgccggccacggcgagatgcaaccgggagcatcgtcatga

SEQ ID NO: 22417 - protein, 348 aa, Geobacter sulfurreducens
MNIIDLRSDTVTRPSPAMRAAMAGAEVGDDVYGEDPTVNRLEELGAATLGTEAALFTASGTQANLLALLAHCRRGDEYIAGQTAHCYRYEGGGAAALGGIQPQPLEVEPDGTLDLSAVAAAIKPDDLHFARTRLLCLENTHAGRVLPLDYLARARRLCNEQSLGLHMDGARIFNAAVKLGVPVREIAGHVDSVSVCLSKGLGAPVGSLLCGGREFVATARRWRKAVGGGMRQAGILAAAGILALTENVDRLAEDHANARRLAEGLAAIPGLGLDPSQVQTNMVFLCLPLRTADRLASFLNEQGILISGRESIRLVTHLDVTSSDVERVIAAFGAFFAGHGEMQPGASS

SEQ ID NO: 22418 - DNA, 1056 bp, Yersinia pestis
  CDS (1)..(1056)
atgatgaaatctatttttctagccaatgagaagacgatgctgatcgatttacgcagtgacacagtaacgcaaccctgtgccgccatgcgcgccgcgatggcgaatgccgaggtcggtgatgatgtgtatggcgatgacccaaccgtcaatgcgcttgaagccaaagccgccagtttatccggtaaagaagccgcgctgtttctgccaacaggcactcaggcaaatttggtggcgctattgacccattgtcagcgtggtgaagagtatattgtcggccaaaaagcccataactatttgtatgaagccgggggtgccgccgttttgggcagtatccaaccacaacctattgatgccaacgatgacggcacactaccactggataacgttctggccgccatcaaacccgatgacattcactttgcccccacccggctgttaagtttggaaaatactcacaatggcaaagtcttgcctttgcgttatttacagcaagcctgggcgttgacccgcgaaaaaaaactggcgttacatattgatggcgcacgtgtttttaatgctgcggtggcgctgaatgtgccactgaacgatattagccagtattgcgataccctgacaatttgtctgtcaaaaggattagggacgcctgttggttccctgctctgtggcagcgcagaattcattcatcgcgcccggcgctggcgaaaaatgaccggtggtggtatgcgtcaggccggtattttagcggcagccgggttgtatgcgctgcaacataatgtggcgagactcaaagatgatcacgataacgcccagtggttggaacagcaattacgtgacttaggcattgagatagccgcccccggcgcgcaaacaaacgtgctgtacattacgcaatctgccgaatcagcgttgaaacttggcccctggatgcgtgaacgtggtgtgctgatcagtgccgggccgctcacccgcctgattactcaccttaacgtgagccgaaaagatctggaaaaagtcgtcgcgctgtggcgtgaatttattgccgagcaacattcatga

SEQ ID NO: 22419 - protein, 351 aa, Yersinia pestis
MMKSIFLANEKTMLIDLRSDTVTQPCAAMRAAMANAEVGDDVYGDDPTVNALEAKAASLSGKEAALFLPTGTQANLVALLTHCQRGEEYIVGQKAHNYLYEAGGAAVLGSIQPQPIDANDDGTLPLDNVLAAIKPDDIHFAPTRLLSLENTHNGKVLPLRYLQQAWALTREKKLALHIDGARVFNAAVALNVPLNDISQYCDTLTICLSKGLGTPVGSLLCGSAEFIHRARRWRKMTGGGMRQAGILAAAGLYALQHNVARLKDDHDNAQWLEQQLRDLGIEIAAPGAQTNVLYITQSAESALKLGPWMRERGVLISAGPLTRLITHLNVSRKDLEKVVALWREFIAEQHS

SEQ ID NO: 22420 - DNA, 1140 bp, Ashbya gossypii
  CDS (1)..(1140)
atgttgccggcgcggtatctgacatcgaggaacgacttccggtcggacacgttcacgctgccgacggcggaggtgtgggcggcgggcgcgggcgcgtcgctgggggacacggtctaccaggaggacacggacacgtgcgcgctggaggcgcgggtggcgcaggagttcgggggcgcgcgcggcggggacgcggcggggctgatgtgcgtgtcgacgacgatggcgaaccagctggcggtgcgtgcgctgctggaccgggcgccaccgtactcggtgctgtgcgaccggcgcgcgcatgtgtacgtggacgagtgcgcggggctggcggtgctgtcgcaggcgctggtgattcctgcggaagccgcgaacgggcggcacctgacgctggaggacgtgcagcgcgcgtacgtgccggacgacggcgacacgcacggcgcgccgacgcgcgtcgtggcgctggagaacacgctgcacgggatgtgctttccgctggaggagatgcggcgcatctgcgactgggcgcacgcgcaggggatgctagtgcacctcgacggcgcgcggctgtggaacgcggccgcggcgcagccgggcgacgcggcggcgtacatgcggcgcgtgtgcgcgctgttcgactccgtgtcgctgtgcctgtcgaagtccgtgggcgcgccggtgggctccgtgctggtgggcggccgcgacctgatccggcgcgcgcgccacctgcagaagcagcagggcggcggcatccgccaggccgggtttctggcgcgcatggcggactactgcatcacgaaaaacgtgcctgggctgggcgacgtcgctgcgcgcgcggcggcgttctggcgggatctgcacgacgacctgcgtgaccaccacggtatgcagctgcatctagcgcacccggtggagaccaacttttttttcatagacctggagcgctcgggcatcgagccctcgagtctgctggagttcggcgccaagaacgacgtgcggcttttcgacgggcggctggcgttccacttccagaatgtggaggacagctcgctggcgcagctcaagcaagtctttgtcgacctggccgcctattaccgagagcatccgtacgtggcccccgctggcccccaacgccgctactag

SEQ ID NO: 22421 - protein, 379 aa, Ashbya gossypii
MLPARYLTSRNDFRSDTFTLPTAEVWAAGAGASLGDTVYQEDTDTCALEARVAQEFGGARGGDAAGLMCVSTTMANQLAVRALLDRAPPYSVLCDRRAHVYVDECAGLAVLSQALVIPAEAANGRHLTLEDVQRAYVPDDGDTHGAPTRVVALENTLHGMCFPLEEMRRICDWAHAQGMLVHLDGARLWNAAAAQPGDAAAYMRRVCALFDSVSLCLSKSVGAPVGSVLVGGRDLIRRARHLQKQQGGGIRQAGFLARMADYCITKNVPGLGDVAARAAAFWRDLHDDLRDHHGMQLHLAHPVETNFFFIDLERSGIEPSSLLEFGAKNDVRLFDGRLAFHFQNVEDSSLAQLKQVFVDLAAYYREHPYVAPAGPQRRY

SEQ ID NO: 22422 - DNA, 1008 bp, Vibrio vulnificus
  CDS (1)..(1008)
atggattttcgttctgacaccgtaactcgccctactcccgccatgcgcgaagccatggctaacgccatcgtcggcgatgatgtttacggtgatgacccaaccgtaaatgaactggaagcctttgccgccaaagaagccggctttgaagcggcgctctttactacttcaggtacgcaagcaaacctgctaggtttgatggcgcattgtgaacgcggtgatgagtatctttgtggccaacaagcgcacaactatcgttacgaggctggcggcgcggcagtattaggttcaatccaacctcaaccggttgagaacaatcccgatggcactttaccgtttgacaagctagccgccgccatcaaacccgatgacagccactttgcgcgcactaagctgcttagccttgaaaataccatcaacggtaaagtgctgcctttgagctatttgcaggaggcgcgtgctttcgtcgataaacacaatctaaaactccatcttgatggtgctcgtgtttataacgcagcaacggcgttggatgttccagtaagagacatcgctcagtattttgattcaatgaccatttgtctttccaaaggattgggcgctccggtgggttctctgctgctgggttctaaagaatacatcgcaaaagcacgacgtttacgcaaaatggtcggtggcggtatgcgccaagcgggtattttagccgcggcaggtaagcttgctttgaccgaacaagtggctcagttgaaagtcgatcatgccaatgccaaagcattggcgcagggtttgtctgagttgccaggtgtgcatgtcaatcctgatttcgtgcaaacaaacattgtgtttgccaaactggatgacaatgtcgacatcaacgcgattgcgcaaaaattggcggaagaatcgatcatcattaccccgggaaatccgattcgttttgtgactcacaaagatatttctcgccaagatattgatctatttctagaaaagttgcgattcttcctcggctaa

SEQ ID NO: 22423 - protein, 335 aa, Vibrio vulnificus
MDFRSDTVTRPTPAMREAMANAIVGDDVYGDDPTVNELEAFAAKEAGFEAALFTTSGTQANLLGLMAHCERGDEYLCGQQAHNYRYEAGGAAVLGSIQPQPVENNPDGTLPFDKLAAAIKPDDSHFARTKLLSLENTINGKVLPLSYLQEARAFVDKHNLKLHLDGARVYNAATALDVPVRDIAQYFDSMTICLSKGLGAPVGSLLLGSKEYIAKARRLRKMVGGGMRQAGILAAAGKLALTEQVAQLKVDHANAKALAQGLSELPGVHVNPDFVQTNIVFAKLDDNVDINAIAQKLAEESIIITPGNPIRFVTHKDISRQDIDLFLEKLRFFLG

SEQ ID NO: 22424 - DNA, 1038 bp, Porphyromonas gingivalis
  CDS (1)..(1038)
atgagcaagatcagcttcaaaaacgactattctgaaggtgcgcatcctgacatactgcatgcgctgacagataccaacttcgttccacaagagggatacggctatgactcctattgcgaggaagcgcgtgcgatgatccgccgtgaatgcaataagcccgatgccgaggtccatttcgtatcgggtgggacacagaccaatctcttggcaatcagtcacctgctccgtccgcacgaagctgtcatagcagcacagtcagggcatatcaacgtacacgaaaccggtgccatcgaatccaccggacataaggtttgcacagtacctactccactcggcaaactcagtgtggagcatatccgcgaagtccttgcttttcatacggacgaacacatggtaaggccgtccatggtctatatctcccaatccacagagttgggcacactctattctcgtcatgagctgtcggatctgtccaccttttgccgtgcaaacggtctcctactctacctcgacggtgcccgtatcggttcggcgatcatggcagagacagaggacaatccgaccctgaccgatatagccaccctgaccgatgcgttctacatcggcggcaccaagaacggagcactccttggagaagccattgtcttccctcgtccacgtccggacgatgctttcctctatcaaatcaaacagcgtggagccatgttggccaaagggcgcgtgctgggtatccagtttgccacgcttttccgcgatgggctttactaccggcttgcagctcatgccaacagaatggcagcagatctggcgacagctatctccttctgcggttattccttcctctaccctccgcaaaccaaccagatcttcccgatcctccccaacgatctgatcgaaagactgaaaaccgtattcgacttctacgtgtggcaagccgtatcacccgacagctcagccattcgtctggtcacttcatgggctactccatcggagaatgtagccgcctttgccgaatacctttccacctctcacatctaa

SEQ ID NO: 22425 - protein, 345 aa, Porphyromonas gingivalis
MSKISFKNDYSEGAHPDILHALTDTNFVPQEGYGYDSYCEEARAMIRRECNKPDAEVHFVSGGTQTNLLAISHLLRPHEAVIAAQSGHINVHETGAIESTGHKVCTVPTPLGKLSVEHIREVLAFHTDEHMVRPSMVYISQSTELGTLYSRHELSDLSTFCRANGLLLYLDGARIGSAIMAETEDNPTLTDIATLTDAFYIGGTKNGALLGEAIVFPRPRPDDAFLYQIKQRGAMLAKGRVLGIQFATLFRDGLYYRLAAHANRMAADLATAISFCGYSFLYPPQTNQIFPILPNDLIERLKTVFDFYVWQAVSPDSSAIRLVTSWATPSENVAAFAEYLSTSHI

SEQ ID NO: 22426 - DNA, 1035 bp, Gloeobacter violaceus
  CDS (1)..(1035)
atgcccgacccggttgtcgatctgcgcagcgacacggtgacccgaccgacccgggcgatgcgcgccgccatgttcgaagccgaagtcggggacgatgtctacggcgaagatccgaccgtcaaccgcctccaggagcgtgtcgcccacctgctcggcaaagaaaaggggctattttttccgagcggcacgatgtgcaaccaggtggccatcgccacccatacccgccccggccaagaaatcatctgtgatcgcgactgccatgtgttcaattacgagcgggccggggcaagccacctgggcggcgtgcaactccatcccctcgacggccgccacggggtcctgagtgcccagcaggtgcgctccgccgtccgccccatcgagttgcacgaaccgcccacgggcttgattctgctcgagaatacccacaaccgcggcggcggcacggtctatccccaggacgtcatcgaacaaatcgccgccgtcgccggcgccgcgggcatccccatgcacctcgacggtgcccggctattgaacgccagcgtcgccggttcccacagtccggcgacgctggcggcaccctttgattcggtctacttttgtctttccaagggcctcgggtgtccggcgggctcggtgctcgccggcaaagccgatttcatcgcccaggcgacacgcctgcgtaaggcctttggcggaggcatgcgccaggtgggttttctggcggctgccggtctgtacgccctcgatcaccacatcgagcgcctcgcggacgatcatcgccgggcacggcagttggccgtccacctaaaagatctcaacgccttcgatgtcgagctcgacgctgtgcacaccaacatcgtgatggtggatgtgcacgcggattgcacggcggcggcggtggcggcggatctgaccgcccacggcgtgcgggtgagtgtctttggtccccggcgtctgcggttggtcacccaccttgatatcgatgacgcgggagtggagcggaccgtcgccgtcttcaagcggctctacggctag

SEQ ID NO: 22427 - protein, 344 aa, Gloeobacter violaceus
MPDPVVDLRSDTVTRPTRAMRAAMFEAEVGDDVYGEDPTVNRLQERVAHLLGKEKGLFFPSGTMCNQVAIATHTRPGQEIICDRDCHVFNYERAGASHLGGVQLHPLDGRHGVLSAQQVRSAVRPIELHEPPTGLILLENTHNRGGGTVYPQDVIEQIAAVAGAAGIPMHLDGARLLNASVAGSHSPATLAAPFDSVYFCLSKGLGCPAGSVLAGKADFIAQATRLRKAFGGGMRQVGFLAAAGLYALDHHIERLADDHRRARQLAVHLKDLNAFDVELDAVHTNIVMVDVHADCTAAAVAADLTAHGVRVSVFGPRRLRLVTHLDIDDAGVERTVAVFKRLYG

SEQ ID NO: 22428 - DNA, 1029 bp, Chromobacterium violaceum
  CDS (1)..(1029)
atgcagtggatagaccttcgcagcgataccgtcacccatccgaccccggcgatgcgccgcgcgatggccgaggccgaagtcggcgacgatgtctacggcgacgaccccaccgtgctgaagctggaggcgctggccgccgacaggctgggcaaggaggcggcgctgctcgtccccagcggcaccttcggcaaccagctggcgctgttcacccactgccgccgcggcgacgaggtgattgtcgaggacaacagccacatcgtctggcacgaggccggcgcggcggcggtgatcgccggcgcccacctgcggacgatagagggcgataacggcctgatggcggtggacgcgatcgagcggcgcatccgcgtcggcgacgacatccacgagcctcgcaccggtctgatctgcctggaaaacgcccatggcaacggccgcgtgctgccgttgtcggcgatggccgacaccgcggcgctggcgcgcgagcacggcgtgccggtgcacctggacggcgcgcgggtgttcaacgccgccgcccatctgggctgcgacgtgcgcgaggtcacccgccacgtcgacagcgtgatggcctgcctgtccaagggcctggccgcgccgatcggctccatcctggccggttccgccgatttcatcgatcaggcgcgccgcaagcgcaagctgctgggcggcggcctgcgccaggccggcgtgatcgccgcgcccggcatcctggcgctgaccgagatggccgcgcgtctggacgaggaccaccgcaatgcccgctacctggccgagggcctggccaagctgccgtgcgtggacttgaatccggccgatgtccacatcaacctggtgtggttccgcttcaacgccgacatcgacgccgctgaactgatggccgcgctgaagcaggccggcttcctcgccaatccgccgcatcagggcgcgatgcgcctggtgacccactggcaggtaggccgcgccgacatcgaccgcctgttggaggtgatgcagcgcgtgctctgcgactga

SEQ ID NO: 22429 - protein, 342 aa, Chromobacterium violaceum
MQWIDLRSDTVTHPTPAMRRAMAEAEVGDDVYGDDPTVLKLEALAADRLGKEAALLVPSGTFGNQLALFTHCRRGDEVIVEDNSHIVWHEAGAAAVIAGAHLRTIEGDNGLMAVDAIERRIRVGDDIHEPRTGLICLENAHGNGRVLPLSAMADTAALAREHGVPVHLDGARVFNAAAHLGCDVREVTRHVDSVMACLSKGLAAPIGSILAGSADFIDQARRKRKLLGGGLRQAGVIAAPGILALTEMAARLDEDHRNARYLAEGLAKLPCVDLNPADVHINLVWFRFNADIDAAELMAALKQAGFLANPPHQGAMRLVTHWQVGRADIDRLLEVMQRVLCD

SEQ ID NO: 22430 - DNA, 1047 bp, Fusobacterium nucleatum subsp
  CDS (1)..(1047)
atgagtataaggaggaaaattattatgttaaattttaaaaatgattatagtgaaggagcttgttcagaagtattagaagcacttgttaaaacaaattatgaacaaactgttggttatggagaagatgaatattgtgaagaagctagaaatttaattaaagaaaatattaattattctaatgcagatatttattttttagttggagggacacaggcaaatacaacagttatttctcactctttaaaaccttatgaagctgttattgcttgtaaaacaggtcatatatctatacatgaaacaggagctattgaagcaacaggacataaaataattgaagtagatggaattgatggaaaattaactcctgatttaattttaaatgaattaagaaaacatgaagatcatcatatggtaaaaccaaaaatggtttatatttcaaataccactgaaataggaactgtctacactaaaagtgaattagaaaatattagtaaagtttgtaaggataataatttatacttatatttagatggtgcaagacttgcatctgcacttacctctgaaaaatgtgatataaatttagaagattatccaaaatattgtgatgttttctatattggaggaacaaaatgtggcttattgtttggtgaagcagttgtaattataaatgatgaaataaaaaaagaatttcaattctctgttaaacaaaaaggtggattatttgcaaaaggaagattattaggagtacagtttgcaactttatttaaagatgatttatactatagaataggtgttcattcaaataaaatggcattaaagataaaaaatgcttttgcagaaaagggtattaagttagctactgattcttatactaatcaagtttttgtagatttaagtcaagaacaaataaaaaaattagaaaaagatgttgttttttcagtagaattttttggaataggagaaaatcaatcatcaagatttgtaacttcttgggcaactaaggaagaagatgttaataaacttgtggaactgataaaaaatctttaa

SEQ ID NO: 22431 - protein, 348 aa, Fusobacterium nucleatum subsp
MSIRRKIIMLNFKNDYSEGACSEVLEALVKTNYEQTVGYGEDEYCEEARNLIKENINYSNADIYFLVGGTQANTTVISHSLKPYEAVIACKTGHISIHETGAIEATGHKIIEVDGIDGKLTPDLILNELRKHEDHHMVKPKMVYISNTTEIGTVYTKSELENISKVCKDNNLYLYLDGARLASALTSEKCDINLEDYPKYCDVFYIGGTKCGLLFGEAVVIINDEIKKEFQFSVKQKGGLFAKGRLLGVQFATLFKDDLYYRIGVHSNKMALKIKNAFAEKGIKLATDSYTNQVFVDLSQEQIKKLEKDVVFSVEFFGIGENQSSRFVTSWATKEEDVNKLVELIKNL

SEQ ID NO: 22432 - DNA, 1083 bp, Neurospora crassa
  CDS (1)..(1083)
atgacaactcccacggcgtccatgcttgccgctatccagtcctgctctctgctcgacgatgtcatgcaagaagatcccaccaccagcgaccttgaggcccactgcgctgctttgtgcggcaaggaggccggcctcctcgttttgtcaggcaccatgggcaatcagctagctatgaggtccttgctcacccaaccgcctcacggtgtgctctgcgatgcccgctgccacattgtaaaatatgaggctggaggtgtctcatctctaacgggcgccatgctcaagcctgtcatgcctagcaacggcgtctaccttaccctcgaagacgtcaaggccaacattcatctcgatgacgacgtgcacacttgcccgactcgcgttctcgagctcgagaacacactcaatggcatgatcatgccgctctccgaggtgcgccgcatctccgcctttgctcgcgagcatgggatcaagatgcactgcgacggcgcgcgcttgtgggaggcggtggcctctggtgctggaagccttgccgaatttgcaaagtgctttgacacaatcagcctatgcttctccaagggccttggagcacccattggcagcatgctggtaggccccaaggacgtgatcaagcatgcccggtgggtaagaaagtcgattggcggtggactaagacagtcgggcgtcgtggcggctgctgcgagggttgccgttgacgaaacgtttggcaaggggcccagtggcgaaggcggcaagttgaagggagcgcatattttggccaaggagatcgagaggatatggacgggcttgggcggcaagcttcttcatcctgttgacaccaacatggtgtggctcgatttgaacgatgcgaagtgttcggcggagaggatgaatgagctcggcaaagaatcgggactcaagttatgggcacctcgcttggtcatcagctaccaggtttttgaaaaccgtgaccatgtaatacccaagctggagagcatcttcgagacgatcatgcaggagaagacaacaaagacgggagaaggttttcagaaggctgatggagagatatcgcaatatcggagcaaatag

SEQ ID NO: 22433 - protein, 360 aa, Neurospora crassa
MTTPTASMLAAIQSCSLLDDVMQEDPTTSDLEAHCAALCGKEAGLLVLSGTMGNQLAMRSLLTQPPHGVLCDARCHIVKYEAGGVSSLTGAMLKPVMPSNGVYLTLEDVKANIHLDDDVHTCPTRVLELENTLNGMIMPLSEVRRISAFAREHGIKMHCDGARLWEAVASGAGSLAEFAKCFDTISLCFSKGLGAPIGSMLVGPKDVIKHARWVRKSIGGGLRQSGVVAAAARVAVDETFGKGPSGEGGKLKGAHILAKEIERIWTGLGGKLLHPVDTNMVWLDLNDAKCSAERMNELGKESGLKLWAPRLVISYQVFENRDHVIPKLESIFETIMQEKTTKTGEGFQKADGEISQYRSK

SEQ ID NO: 22434 - DNA, 1020 bp, Bordetella pertussis
  CDS (1)..(1020)
atgatcgatctgcgcagcgataccgtgacccgtcccagcgccgccatgcggcaggccatggcggccgcgccggtgggtgacgatgtgatgggcgatgaccccagcgtacggcgcctgcaggacgaggttgccgcgcgggcgggcaaggaggccgggctgttcttcccgtcgggcacgcagagcaacctggccgcgctgatggcgcattgcgcccgcggcgacgagtatctggtggggcagcaggcccatacgtacaaattcgagggaggcggcgctgcggtgctgggcagcatccagccgcagcccgtcgaccatgccgccgacggcagcctgccgctggacaggctggcggccgcgctcaagccgggcggcgatccgcatttcgcccgtacccggctgttggcgctggaaaacaccttccagggccgggtcatgcccgccggctatgtcgcgcaggccacgggctgggcccgcgagcatggcctgtccacccatctggacggcgcgcgcgtcttcaatgcggccgtggccagcggcgtgccggtgcaacagctgtgcgagccgttcgatacggtttcgatctgtttttccaaggggctgggcgcgccggtcggatcggtgctggtcggcagccgcgccctgatcgagcaggcgcatcgctggcgcaagatgctgggcggcggcatgcggcaggccggcatactggctgccgcctgcctgcacgcgctgcaccaccacgtcgagcgcctggcgctagaccacgacaacgcggcgcggctggccgcgggcctggacggcatcgacggcgtgcgcgtgctggggcagcacaccaacatggtgttcgccgagttcgatccggcccggtgcgaatcgctgaccacggcgctgcgcgggcagggcattctgatgcgggcggtctatggcgggccgacccgcctggtgacgcacctggacgtggacgccgacggcatcgatcgcgtcgtcgacgcggtacgcgggcattgcgcggccgcgcgctga

SEQ ID NO: 22435 - protein, 339 aa, Bordetella pertussis
MIDLRSDTVTRPSAAMRQAMAAAPVGDDVMGDDPSVRRLQDEVAARAGKEAGLFFPSGTQSNLAALMAHCARGDEYLVGQQAHTYKFEGGGAAVLGSIQPQPVDHAADGSLPLDRLAAALKPGGDPHFARTRLLALENTFQGRVMPAGYVAQATGWAREHGLSTHLDGARVFNAAVASGVPVQQLCEPFDTVSICFSKGLGAPVGSVLVGSRALIEQAHRWRKMLGGGMRQAGILAAACLHALHHHVERLALDHDNAARLAAGLDGIDGVRVLGQHTNMVFAEFDPARCESLTTALRGQGILMRAVYGGPTRLVTHLDVDADGIDRVVDAVRGHCAAAR

SEQ ID NO: 22436 - DNA, 1376 bp, Oryza sativa
  CDS (115)..(1233)
ctgctgcggaccgcgcctcatcgcgtcccgtctccacccgcgcctctcctctcgtcccgcgcctcggccgccgtctgattccgtgcagttggaggctaggaggagctcctcaaaatggtgaccaacgtggtggacctacggtcggacacggtgacgaagccctccgacgcgatgcgcgccgccatggccgccgcggacgtggacgacgacgtccttggcgccgacccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaactgtggtggaaagtgtctgtctgctgaatatactgacgaggttggtgaagttgccaagagtcatggtctgaagcttcacatagatggagctcgcatttttaatgcttctgtggcccttggagttcctgttcatcgacttgtgaaagctgcggattcagtctcggtgtgcatatctaaagggttaggcgctcctgttggatcagttattgttggttcgacggccttcatagaaaaggctaaaattcttaggaagacactaggtggtggaatgaggcaagtgggaattctttgtgcggctgcctatgttgccgttcgcgacactgtaggaaaacttgctgatgaccatagaagggctaaagttttagcagatggtctgaagaaaatcaagcattttagagttgatacaacttcagtggagaccaatatggtattctttgatattgtggattcacgcatatcacctgacaaactgtgtcaagtccttgaacaacgcaatgtgcttgccatgccagcaggctcgaagagcatgaggcttgtcatccactaccaaatttctgatagtgatgttcagtatgcactgacatgcgtggagaaagctgctgaagaaatactgacaggcagtaagaagtttgaacatctgacaaacggtactaccaggaattcatacgggcactagtagatcactcctttcgtgcccactgatgcatcagtccagcgtccagcttgcttgtcatctcatgactgatgtactcacaacttggcttaataataactgatgttcactctgttggaaaaaaaaaaaaaaaaaaaaaaaaaaaa

SEQ ID NO: 22437 - protein, 372 aa, Oryza sativa
MVTNVVDLRSDTVTKPSDAMRAAMAAADVDDDVLGADPTAHRFEMEMARITGKEAALFVPSGTMANLISVLVHCDTRGSEVILGDNSHIHIYENGGISTIGGVHPKTVRNNPDGTMDIDKIVVAIRHPDGALYYPTTRLICLENTHANCGGKCLSAEYTDEVGEVAKSHGLKLHIDGARIFNASVALGVPVHRLVKAADSVSVCISKGLGAPVGSVIVGSTAFIEKAKILRKTLGGGMRQVGILCAAAYVAVRDTVGKLADDHRRAKVLADGLKKIKHFRVDTTSVETNMVFFDIVDSRISPDKLCQVLEQRNVLAMPAGSKSMRLVIHYQISDSDVQYALTCVEKAAEEILTGSKKFEHLTNGTTRNSYGH

SEQ ID NO: 22438 - DNA, 1242 bp, Streptomyces avermitilis
  CDS (1)..(1242)
atgagcgatacggcggagcagggcgaggaacgggcggcggagcgggccggggaggcgtcggcggaggggaccggggagacatctgcggaggggaccggggaggcgtcggctcagctgcggcgcgcgcggcggacggcggcctaccggggggcccggcgcgtcctgtcgcgccccgggttccgggccaccatcagggagcggctggcgctcctggaggacgcgtcgcggctgtacgacctggacgagtccgtggacatgtacggggacgggatcgtcgcggccctggaggagcgggtcgccgggctgctgggcatggaggccgcggcgttcttccccaccgggacgatggcccagcaggtggccctgcgctgctgggcgggtcgtaccggcaacccgaccgtggcgctgcacgcgctgagccaccccgaagtgcacgaacggaacgcgctcggcacggtcggcggactgcgcccggtccgcgtgacggacgagccccggctgccgaccgccgacgaggtgcgcgacttcgaggagcccttcggggccctcatgctcgaactgcccctgcgggacgtcggctacgtcctgccctcctgggaggagctgtccgaggtcgtggcggccgcccgggaacgtgacgcggtggtccacttcgacggcgcacgcctgtgggagtgcacaccccacttcagccgccccctggacgagatcgcgggcctcgcggacagcgtctacgtgtcgttctacaaatcgctcggcgggttcagcggcgcggcactggccggcccgaaaaccctggtcgacgaggcgaagacctggcggcaccggtacggcggcatggtcgtccaacagttcccggcggtgctgtccgcgctggccgggctggaggaggagctgccccggctgccggagtacgtggcgcacgcgcgcgtggtcgccgcggcgctgcgcgaggggttcgcggcggcgggggtgccctggctgcgcgtgcaccccgaggagccgcacacccatgagttccagctctggctgccgtacgaccccgaggtggtgacggaagccgccacgcggcaggccgaggagaccgggaccttcctgttcgccaacgcctggacccgcggcgggccgggcctggcggtcaccgaggtctccgtacgggcgcacggccttcagtggacggccgaagacgtcaaggcggccgtccaggagttcgtgacgcgcctgcccggcgctgccgggtag

SEQ ID NO: 22439 - protein, 413 aa, Streptomyces avermitilis
MSDTAEQGEERAAERAGEASAEGTGETSAEGTGEASAQLRRARRTAAYRGARRVLSRPGFRATIRERLALLEDASRLYDLDESVDMYGDGIVAALEERVAGLLGMEAAAFFPTGTMAQQVALRCWAGRTGNPTVALHALSHPEVHERNALGTVGGLRPVRVTDEPRLPTADEVRDFEEPFGALMLELPLRDVGYVLPSWEELSEVVAAARERDAVVHFDGARLWECTPHFSRPLDEIAGLADSVYVSFYKSLGGFSGAALAGPKTLVDEAKTWRHRYGGMVVQQFPAVLSALAGLEEELPRLPEYVAHARVVAAALREGFAAAGVPWLRVHPEEPHTHEFQLWLPYDPEVVTEAATRQAEETGTFLFANAWTRGGPGLAVTEVSVRAHGLQWTAEDVKAAVQEFVTRLPGAAG

SEQ ID NO: 22440 - DNA, 1071 bp, Streptomyces avermitilis
  CDS (1)..(1071)
atgaaccctcctaagaccgacgcccggcggcatcacgacccggaggtacgtggcttcgccagcgacaactacgcgggggcccaccccgaggtgctcgccgccctggccctggccaacggcgggcaccagatcgcgtacggcgaggacgagtacacggacaacctccagcgcatcgtccgcagccacttcggcgccggcgccgaggcgttccccgtcttcaacggcaccggcgcaaacgtcgtcgccctccaggcggtcaccgaccgctggggcgcggtgatctgcgcggagagcgcgcacatcaacgtggacgagggcggcgcccccgagcgcatgggcggcctcaaactcctcaccgtgcccacgcccgacggcaagctcacgcccgagctgatcgaccggcaggcgtacggctgggacgacgagcaccgtgcgatgccgcaggtcgtctcgatcgcccagaacaccgaactgggcaccgtctacacgcccgacgagatccgcgcgatctgcgaccacgcccacgggcacggcatgaaggtgcacctcgacggcgcccggatagccaacgcggccgcctcgctgaacgtccccatgcggacgttcaccaacgcggtcggcgtcgacatcctctccctgggcgggacgaagaacggcgcgctgttcggcgaggccgtcgtggtcatcaaccaggacgccgtcagccacatgaagcacctgcgcaagctgtccatgcagctggcctcgaagatgcgtttcgtctcggtgcagctggaggcgctgctcgccaaggatctgtggctgcgcaacgcccggcacgccaacgagatggcccagcggctcgcggagggcgtgcgcgcggtccacggcgtggagatcctctacccggtgcaggccaacgcggtcttcgcgcgtctcccgcacgacgtgagtgagcgcctgcagaagcactaccgcttctacttctggaacgaggccgcgggcgacgtccgctggatgtgcgccttcgacacgaccgaggacgacgtcgacggattcgtggcggcgctcaaggaggagatggcccggtag

SEQ ID NO: 22441 - protein, 356 aa, Streptomyces avermitilis
MNPPKTDARRHHDPEVRGFASDNYAGAHPEVLAALALANGGHQIAYGEDEYTDNLQRIVRSHFGAGAEAFPVFNGTGANVVALQAVTDRWGAVICAESAHINVDEGGAPERMGGLKLLTVPTPDGKLTPELIDRQAYGWDDEHRAMPQVVSIAQNTELGTVYTPDEIRAICDHAHGHGMKVHLDGARIANAAASLNVPMRTFTNAVGVDILSLGGTKNGALFGEAVVVINQDAVSHMKHLRKLSMQLASKMRFVSVQLEALLAKDLWLRNARHANEMAQRLAEGVRAVHGVEILYPVQANAVFARLPHDVSERLQKHYRFYFWNEAAGDVRWMCAFDTTEDDVDGFVAALKEEMAR

SEQ ID NO: 22442 - DNA, 1005 bp, Vibrio parahaemolyticus
  CDS (1)..(1005)
atggattttcgttcagacacagtgactcaacccacccaagctatgcgcgaagtaatgttcagcgcccctgttggcgatgatgtttatggtgacgatcctaccgtaaacgagctagagcaattcgcggctgaattagcagggtttgaggcagcgttgtttaccacttctggcacacaagcaaaccttttaggattaatggcgcactgtgagcgtggcgatgaatatttatgcggccagcaagcgcacaattacaaatatgaagcaggtggcgcagcggtactgggttctatccagcctcaaccaatagaaaacaatccagatggcacgttgccatttgacaaattagaggcggcaattaaacctgatgacgcgcactttgctcgtactcgtctgctaagtttagaaaacaccatcaacggtaaagtgatcccactgtcttacttagcggaagctcgtgaattcgttaataaacacaatctgaaactgcatctcgacggtgcccgtgtgtttaacgcagctgttgcgctcgatgttcccgtcaaagatattggtcagtactttgattccatgacgatttgtttatcgaaaggtcttgcggcacccgttggttcactgctgcttggcagcaaggaatacatcgcgaaagctcgccgtttaagaaagatggtcggtggcggaatgcgtcaggcaggtattctagcggcagcaggtaaactggcgatcactgaacaagtcgcgcagttaaagcaagatcacatcaatgcaaaagcattggcggaaggtttagctgaactaccgggtttctcggtaaatcctgacttcgttcaaaccaacattgtgtttgctaagttggatgctaaagtcgatatccaaagcatcgcggaacaactcaagcaacaaaacatcatcatcagcccaggaaacccaattcgctttgtcacacacaaagacatctctgctgaagatattcaaaccttcctatcgagccttaaatctctgctttag

SEQ ID NO: 22443 - protein, 334 aa, Vibrio parahaemolyticus
MDFRSDTVTQPTQAMREVMFSAPVGDDVYGDDPTVNELEQFAAELAGFEAALFTTSGTQANLLGLMAHCERGDEYLCGQQAHNYKYEAGGAAVLGSIQPQPIENNPDGTLPFDKLEAAIKPDDAHFARTRLLSLENTINGKVIPLSYLAEAREFVNKHNLKLHLDGARVFNAAVALDVPVKDIGQYFDSMTICLSKGLAAPVGSLLLGSKEYIAKARRLRKMVGGGMRQAGILAAAGKLAITEQVAQLKQDHINAKALAEGLAELPGFSVNPDFVQTNIVFAKLDAKVDIQSIAEQLKQQNIIISPGNPIRFVTHKDISAEDIQTFLSSLKSLL

SEQ ID NO: 22444 - DNA, 1077 bp, Vibrio parahaemolyticus
  CDS (1)..(1077)
atgagtacccacctaaaacagctttgtcatacccacctcccaggtaataaagaagactctccagccgagcactttgcaaaaatggcaaagtggtgtgaagagaacaaagtgaatcacgatgtctatggcgagggagaaacgattcacgcattcgagcaaaaggttgccgatctgctgggttacgaggcgggcctttttgttgtcactgggacgatgacacagccaacggtgctagaaatcgtcacaagacaaaagcgtaatcctattgttgcgatgcatgcatctagccatatacctgaacatgaaaagcaaggctatcagcttcaacatcgctttagtgttttgccagtagggaacgtttaccaaacgtggaagcttgaggatctcactgcgtggccggatgaaatcgcagccgttttgtatgaactcccgatgcgagaaattggcggtcagttaccttcatggcaagaactggaagaaatcaaagcttactgcgccgaaaaagacattcatctccacatggagggtgcaaggctttgggaaaccgcagcgtattatcagaaagaataccgcgagatcgccgctggttttgatacgacgtatgtatcactctataaaggcattaacggcatgggcggatctatgctgcttggttcaaaggcgttcattgaactggcctcaatgtggatgaagcgacaaggtggcaacctgtaccacagaacaccttatgtagtgtctgcggcaatgcagttcgatgaaaggttggcgcagctaccggatctgtttgagcgaacaaaacaaatctacaagatcattgatgagttcccatctttggcggtaagaccaacccaaccgcaagcaaacatgttgcaccttatcctgcctttcagctgtgaaaagttgaaagaactccaacatattttcgctacagaaaagggcatttggtttggtaatccgcaagtcacggcacatccacatcaatccatcgttgagtggtatgtcggtgactacctgctcaaccttggtgacgaagaattaaggtcatttttcaaccagttactcggtggtaaggcataa

SEQ ID NO: 22445 - protein, 358 aa, Vibrio parahaemolyticus
MSTHLKQLCHTHLPGNKEDSPAEHFAKMAKWCEENKVNHDVYGEGETIHAFEQKVADLLGYEAGLFVVTGTMTQPTVLEIVTRQKRNPIVAMHASSHIPEHEKQGYQLQHRFSVLPVGNVYQTWKLEDLTAWPDEIAAVLYELPMREIGGQLPSWQELEEIKAYCAEKDIHLHMEGARLWETAAYYQKEYREIAAGFDTTYVSLYKGINGMGGSMLLGSKAFIELASMWMKRQGGNLYHRTPYVVSAAMQFDERLAQLPDLFERTKQIYKIIDEFPSLAVRPTQPQANMLHLILPFSCEKLKELQHIFATEKGIWFGNPQVTAHPHQSIVEWYVGDYLLNLGDEELRSFFNQLLGGKA

SEQ ID NO: 22446 - DNA, 1005 bp, Pseudomonas syringae
  CDS (1)..(1005)
atgacggtcatcgatctgcgcagcgacacagtgactctgcccaccgcaggcatgcttgacgccatggcacatgcgccggtgggcgatgatgtctacggtgaagaccctacggtcaatctgctcgaggccacgctcgccgagcgcctcgggttcgacgccgccttgttcgtgccctccggcaccatgagcaatctgctggcgttgatggcgcactgtgagcggggcgatgaatacatcgtcggtcagcaggcccacacctataaatacgaagggggtggcgcggcggtactgggctcgattcagcctcagccgctggacgtgcaggcggacggttcgctgagcctgcaacaggtgctcgacaccatcaagccggacgacttccactttgcccgcacacgcctgctggccctggaaaacaccatgcagggcaaggtgctgccgcttgagtacctggccgccgcgcgcaagctgaccctggaaaaaggcctcgcgctgcacctcgacggcgcgcggctgtacaacgcggcggtcaagctgggcgttgatgcccgggagatcacccggcacttcgattcagtctccatctgcctatccaaaggcctgggcgcccccattggctcggtgctgtgcggctcgcagccgctgatggtcaaggcgcggcgtctgcgcaagatgctcggcgggggcatgcgtcaggcaggcgggctggccgctgccgggctctatgcgctggatcatcaggtccagcggctggccgacgatcatgccaatgcggcgtttctggccgagagcttgagcgggctgggttacagtgtcgagcctgtgcagaccaacatggtctatgtgcagatcggtgatcgcgccgcagcgctcaaggcattctgcgccgagcgtggcatcgtgctcactgccgcgtcgcggctgcgcatggtcactcacctgaatgtttcgcgtgctcaggcagagcaagtgatcgcggcattcgcagcctttgaacacccatga

SEQ ID NO: 22447 - protein, 334 aa, Pseudomonas syringae
MTVIDLRSDTVTLPTAGMLDAMAHAPVGDDVYGEDPTVNLLEATLAERLGFDAALFVPSGTMSNLLALMAHCERGDEYIVGQQAHTYKYEGGGAAVLGSIQPQPLDVQADGSLSLQQVLDTIKPDDFHFARTRLLALENTMQGKVLPLEYLAAARKLTLEKGLALHLDGARLYNAAVKLGVDAREITRHFDSVSICLSKGLGAPIGSVLCGSQPLMVKARRLRKMLGGGMRQAGGLAAAGLYALDHQVQRLADDHANAAFLAESLSGLGYSVEPVQTNMVYVQIGDRAAALKAFCAERGIVLTAASRLRMVTHLNVSRAQAEQVIAAFAAFEHP

SEQ ID NO: 22448 - DNA, 1041 bp, Pseudomonas syringae
  CDS (1)..(1041)
atgacagaccaaagccaacagttcgccagtgacaactactccggtatctgccctgaagcgtgggccgcgatggagcaggcgaacaaaggccatcaacgtgcctatggggacgatcaatggactgcgcgcgcctcggatgatttccgccgtttgtttgaaaccgactgcgaagtgttttttgctttcaacggcacagcggccaactcgctggcgctgtcctcgctgtgccagagttaccacagtgtcatctgttcggaaacggctcacgtcgaaaccgatgaatgcggcgcgccggaatttttctccaacggctccaagctgctgaccgcccgcagcccgggcggcaagctgaccccggaatcgattcgtgaagtggcgctcaagcgtcaggacattcactaccccaagccgcgcgttgtaaccctgacccaggccacggaagtgggcggcgtctatcagccagaagagctcaaggccatcagcgccacctgcaaggaactgggcctgcacctgcacatggacggtgcgcgcttctccaatgcctgcgcgtttctggatgcatcgccggccgagctgacctggaagtccggcgttgatgtgctgtgctttggcggcaccaaaaacggcatggcggtgggcgaggcgatcctgtttttcgaccacgatctggccgtcgatttcgattatcgctgcaagcaagccgggcaactggcgtcgaaaatgcgcttcctgtccgcgccctgggttggcctgctggaaaacgacgcgtggctcaaacatgctcgccacgccaaccggtgcgcacagttgctggctgatctggtcaaggacattgccggcgtcgaactgatgttcccggtgcaggccaatggcgtgtttctgcaactgtcggagcctgccatcgcagccttgaccgccaggggctggcgcttctacaccttcatcggcaatggcggcgcgcgcttcatgtgctcgtgggataccgaagaagaccgcgtgcgtgaactcgccgcggacatccgcctggtgatgcagggctga

SEQ ID NO: 22449 - protein, 346 aa, Pseudomonas syringae
MTDQSQQFASDNYSGICPEAWAAMEQANKGHQRAYGDDQWTARASDDFRRLFETDCEVFFAFNGTAANSLALSSLCQSYHSVICSETAHVETDECGAPEFFSNGSKLLTARSPGGKLTPESIREVALKRQDIHYPKPRVVTLTQATEVGGVYQPEELKAISATCKELGLHLHMDGARFSNACAFLDASPAELTWKSGVDVLCFGGTKNGMAVGEAILFFDHDLAVDFDYRCKQAGQLASKMRFLSAPWVGLLENDAWLKHARHANRCAQLLADLVKDIAGVELMFPVQANGVFLQLSEPAIAALTARGWRFYTFIGNGGARFMCSWDTEEDRVRELAADIRLVMQG

SEQ ID NO: 22450 - DNA, 1041 bp, Pseudomonas putida
  CDS (1)..(1041)
atgacagacaagagccaacaattcgccagcgacaactattccggtatctgccccgaagcctgggtggcgatggagaaagccaaccgcggccacgaccgcgcctacggcgacgaccagtggaccgagcgtgcatcggagtacttccgcaatctgttcgaaaccgactgcgaggtgttctttgccttcaacggcaccgcggccaactccctggccctggcatccctgtgccagagctatcacagcgtgatctgctccgagaccgcccacgtcgaaaccgacgaatgcggtgcaccggagtttttctccaacggctccaagctgctgacggcggccagcgtcaacggcaagctgacgccacagtcgatccgcgaagtggcgctcaaacgccaggatatccactaccccaagccgcgcgtggtgaccattacccaggccaccgaagtgggcacggtgtaccgccccgacgagctgaaggcgatcagcgccacctgcaaggagctgggcctgaacctgcacatggacggcgcacgctttaccaatgcctgtgcgttcctgggctgcagcccggccgaactgacctggaaggccggtgtggatgtgctgtgctttggcggcaccaagaacggcatggcggtgggcgaagcgattctgttcttcaaccgccagctggccgaagacttcgattatcgctgcaagcaggccgggcaactggcgtcgaagatgcgcttcttgtcggcgccctgggtcgggctgctggaagatggcgcatggttacgccatggcaaccacgccaatcattgcgcgcaactgctggcatcgctggtcagtgacctgccgggggtagagctgatgttcccggtggaggccaacggggtgttcctgcagatgccagagcacgccatcgaggcgctgcggggcaagggctggcgcttctatacctttatcggcagcggtggcgcgcgcttcatgtgctcgtgggataccgaagaagcgcgggtgcgtgagctggcggcggatatccgcacgatcattggtggctga

SEQ ID NO: 22451 - protein, 346 aa, Pseudomonas putida
MTDKSQQFASDNYSGICPEAWVAMEKANRGHDRAYGDDQWTERASEYFRNLFETDCEVFFAFNGTAANSLALASLCQSYHSVICSETAHVETDECGAPEFFSNGSKLLTAASVNGKLTPQSIREVALKRQDIHYPKPRVVTITQATEVGTVYRPDELKAISATCKELGLNLHMDGARFTNACAFLGCSPAELTWKAGVDVLCFGGTKNGMAVGEAILFFNRQLAEDFDYRCKQAGQLASKMRFLSAPWVGLLEDGAWLRHGNHANHCAQLLASLVSDLPGVELMFPVEANGVFLQMPEHAIEALRGKGWRFYTFIGSGGARFMCSWDTEEARVRELAADIRTIIGG

SEQ ID NO: 22452 - DNA, 1026 bp, Clostridium tetani
  CDS (1)..(1026)
atggattttttagatttgagaagtgataccgtaacaaaaccaacagaaaatatgagaaaagctatgtttaaagctaatgttggtgatgatgtatatggtgatgaccctacagtaaatgaactagaagagtatgctgctaatttggtggggaaagaaacagccttatttgttccaagtggagtttttggtaatcaactgtccctttttactcattgcaaaagaggtgatgaagttattttaggagaggattgtcatataataatgcatgaaacgggagcacctgctgttatagctggtgtacaattaagacctataaaaagcgaaaatggattcatgtcattagatgatatacaaagtaaaattagaggtgaaaatattcatttccctgatacttctcttatatgcgtggaaaatgctcattcctgtggaagagttatctctttgaaacatatggagaaaatatataatatatcaaggcaacataatataccaatacatttagatggagctaggctatttaatgcagctgcatatttagatgtaggtgttaaagacataaccaaatactgtgattctgtaatgttttccatttctaaaggactttgtgctcctgttggatcaatacttgcaggtagcaaggattttattaaaaaagctagaaagaaaagaaaactcatgggtggcggcttaagacaagcaggggtgttagcagcacctggactagtagctttaaaggaaatgattcctcaattaaaaaaagactatgaaaatgcattattattaggaaaagaattaagtaaaataccaaatataaaagtaaatttagatgatataaatattaacatggtatttttttctatagaaaatatagattatgatgaagtagatataataaataaattttatagtaagggtataaaaattaatggtaccgaagacggtaaatttagatttgccacacattattggattaaagaagaggatatttcatatataatagaaaccatgaaaatttctctgcaataa

SEQ ID NO: 22453 - protein, 341 aa, Clostridium tetani
MDFLDLRSDTVTKPTENMRKAMFKANVGDDVYGDDPTVNELEEYAANLVGKETALFVPSGVFGNQLSLFTHCKRGDEVILGEDCHIIMHETGAPAVIAGVQLRPIKSENGFMSLDDIQSKIRGENIHFPDTSLICVENAHSCGRVISLKHMEKIYNISRQHNIPIHLDGARLFNAAAYLDVGVKDITKYCDSVMFSISKGLCAPVGSILAGSKDFIKKARKKRKLMGGGLRQAGVLAAPGLVALKEMIPQLKKDYENALLLGKELSKIPNIKVNLDDININMVFFSIENIDYDEVDIINKFYSKGIKINGTEDGKFRFATHYWIKEEDISYIIETMKISLQ

SEQ ID NO: 22454 - DNA, 1083 bp, Bradyrhizobium japonicum
  CDS (1)..(1083)
atgacgagaccagccatgctctacaccccgcccccgatcgatcccaaggcgccgccggtgcgcatcaatctgctgtcggacacccagaccaagccgacggctgcgatgcgcgaggcgatggcgcgcgccgaggtcggcgacgagcaggtcggcgacgatccgaccgtgaacgcgctgtgcgagcgcgttgcggatctgctcggcaaggaggccgccgtgtacatgccctcgggcacgatgtgcaacgtcaccgcgacgctggtgcattgccggcccggcgacgagattctcgcgcacgagaccgcgcacatcatcgcccgtgagggcggcgcgcatgccgcgatcggcggcttccaggttacgcagctcaagggccccgacggccagttcacgccggagacgttccggaaagctctgcacccgcgcacgcgctaccagccgccgcagaccgtcgtcagcgtcgagcagaccgccaatatcggcggcggcacgatctggaagaaggccgcactcgacgagatcgtcgagatcgccaggcagcacggcctcgtcacccacatggacggcgcgcggctgctcaacgccacggtggcgagcggcatctctccgcgcgacatgaccgctggctgggattcggcctggatcgacttctccaagggcctgggcgcgccgatcggcggcgtgctcgccggctcgcgcgccttcatcgacgcggtctggcagtggaagcagcgcctcggcggctcgatgcggcaggccggaatctgcgccgccgcctgcatctacgccctcgaccatcacgtcgatcgccttgccgacgatcatgcccatgcgcgcgcactcgcccgcggactgtcgcagatcgcaggcatcgaggtgcaggagcccgagaccaacctcgtgttcttcaagcccgatggcgccggcgtccccggcgacaagatggtcgccgcactgcgccagcgcggcgtgacgctcgcgatgatggacggccgcatccgcgcctgcacgcatctcgacgtcaatgcgagccagatcgaggaaacgatcggatacgtgcgcgagatcgtgcgcggggcgtaa

SEQ ID NO: 22455 - protein, 360 aa, Bradyrhizobium japonicum
MTRPAMLYTPPPIDPKAPPVRINLLSDTQTKPTAAMREAMARAEVGDEQVGDDPTVNALCERVADLLGKEAAVYMPSGTMCNVTATLVHCRPGDEILAHETAHIIAREGGAHAAIGGFQVTQLKGPDGQFTPETFRKALHPRTRYQPPQTVVSVEQTANIGGGTIWKKAALDEIVEIARQHGLVTHMDGARLLNATVASGISPRDMTAGWDSAWIDFSKGLGAPIGGVLAGSRAFIDAVWQWKQRLGGSMRQAGICAAACIYALDHHVDRLADDHAHARALARGLSQIAGIEVQEPETNLVFFKPDGAGVPGDKMVAALRQRGVTLAMMDGRIRACTHLDVNASQIEETIGYVREIVRGA

SEQ ID NO: 22456 - DNA, 1044 bp, Bradyrhizobium japonicum
  CDS (1)..(1044)
atggtcgcgcaagagagaggccgcgacggcgtcgtcgatctgcgcagcgacaccgtcacgctgccgacggccgcgatgctggagcgcatgcagcgggccccgctcggcgacgacggccgcgagggcgacccgaccgtccgcgcgctcgaagcgcggggcgccgcgttgaccggcaaggaagctgccctgttcgtgccgagcggcacgatgggcaatctcctggcgatgctcgcccatgccgagcgcggcggagaggtcttcgccgacgctggtgcgcacctgctcaactccgagctcggcagcgtcgtgacgatcgcggggctggtgcccaagcccatgccgagccgtcgcggtgcaatggacgaagcggcgcttgcagacgcgatccgcggctcggaacgtcccggcctgatcgcaatggagactgcgcataacggcgccggcggcgccgtgctgcccccgccgcacatgatgcgaattcacgcgctcggacagagcaacgggatccccgtgcatctggacggcgcccgcctgttcaatgcctcggtcgcgctcggcgtgccggcggcacggatcgccgagcatgccgacagcgtgatggtctgcctgtccaagggcctgagcgcgccggtcggcagcctgctgtgcggcggcgcggcgttcgtcgcacgggcgcgcacgttgcggaaactcgtcggcggcaccatgcgccagtccggtgtcgtcgcagccgcgggcctcgtcgcgctggagacgatgatcgagcgcctctccaaggatcacgcggcagcaaggcggctcgccgcggccttgagctggctcgacccggcactcgccgatcccgaccaggtgcaaaccaacatcctgcgcgtcgacgtctccgcaagcggacgcgaggccgccgcatgggccgagggcgtgaagcagcgcggcatcctggtgcaggccagcggcccctcgcagctccggctcgtcacccatcgccacatcgacggagcggcggtggaccgcaccattgccgccttcgcggcgctcggccgctag

SEQ ID NO: 22457 - protein, 347 aa, Bradyrhizobium japonicum
MVAQERGRDGVVDLRSDTVTLPTAAMLERMQRAPLGDDGREGDPTVRALEARGAALTGKEAALFVPSGTMGNLLAMLAHAERGGEVFADAGAHLLNSELGSVVTIAGLVPKPMPSRRGAMDEAALADAIRGSERPGLIAMETAHNGAGGAVLPPPHMMRIHALGQSNGIPVHLDGARLFNASVALGVPAARIAEHADSVMVCLSKGLSAPVGSLLCGGAAFVARARTLRKLVGGTMRQSGVVAAAGLVALETMIERLSKDHAAARRLAAALSWLDPALADPDQVQTNILRVDVSASGREAAAWAEGVKQRGILVQASGPSQLRLVTHRHIDGAAVDRTIAAFAALGR

SEQ ID NO: 22458 - DNA, 1014 bp, Bacteroides thetaiotaomicron
  CDS (1)..(1014)
atgagaagttttgcctctgataataattccggtgtgcatccgttggtgatggaagcattgagccgggcaaacgcagatcatgcgttgggttatggtgatgatcgatggacggaagaagccgtagccaagataaaagaaacctttacacaggactgtgtccctttgtttgtattcaatggcacgggcagcaatgtggtggctttgcaagtaatgacgcgtccgtatcattcaatcttctgtgcagaaactgcccatatttatgtagacgagtgcggctctcccgtgaaaatgacaggttgtcagattcggccgattgccacaaccgatggtaagttgactcccgaactgatgcagccttatctgcacggtttcggcgaccagcatcattcgcaaccccgtgcgctttacatctctcaatgcaccgaactcggaacgatttatacacccgaagaactgaaacgtctgactgactttgcccatctgaacggtatgtatgtccacatggacggagcaaggattgccaatgcctgtgccgctcttcatctttcgctcaaagaactgactgtagactgtggaattgacatccttagtttcggcggaacaaaaaacggactgatgatgggggaatgtgtgattatatttaataaggacctgcaacgggaagcccgttttgtccggaaacaatctgcccaactggcttccaagatgcgttacctttcctgtcagtttactacctacttgacggatgacctgtggctgaagaatgccgctcatgccaatgcgatggcaggcaagctctatcgggcacttaaggaactgcccgaagtcacctttacccaaaagccggagagcaaccagttatttctgaccatgccccgtccgactatcgaccggatgctggaatcttatttcttttatttctggaatgaggcgaatcacgaaatccgcctggtgacttcttttgacacaacggaagaggatgtaaatcaatttattcgacttttgagacgttaa

SEQ ID NO: 22459 - protein, 337 aa, Bacteroides thetaiotaomicron
MRSFASDNNSGVHPLVMEALSRANADHALGYGDDRWTEEAVAKIKETFTQDCVPLFVFNGTGSNVVALQVMTRPYHSIFCAETAHIYVDECGSPVKMTGCQIRPIATTDGKLTPELMQPYLHGFGDQHHSQPRALYISQCTELGTIYTPEELKRLTDFAHLNGMYVHMDGARIANACAALHLSLKELTVDCGIDILSFGGTKNGLMMGECVIIFNKDLQREARFVRKQSAQLASKMRYLSCQFTTYLTDDLWLKNAAHANAMAGKLYRALKELPEVTFTQKPESNQLFLTMPRPTIDRMLESYFFYFWNEANHEIRLVTSFDTTEEDVNQFIRLLRR

SEQ ID NO: 22460 - DNA, 1077 bp, Vibrio vulnificus
  CDS (1)..(1077)
atgaaaaaggatttacgtgcgcattgccacaccattattgcgggcaatcacgagcaaagcccggcagaacatttctacgcgatggcgaaatggtgtgaagaacaccaagtgaagcacgatgtgtatggtgatggggaattcatcaactcattccaacaaaaagtagccgaccttttaggctttgaagcgggtttgtttgttatcacgggcaccatgacgcaggccacggcccttgagttggtgtgccgtaaaaaacgcaatcctgtggtcgcgatgcatgaatccagtcatatttatcgttttgaacgtcagggttatcaactgcagaatcgtttttccatcttgcctctgggcgatatgttccgaccttggacagcaaaagatctcaacgcctggccagatgaaatttcagcggtcctgtatgagctgccaatgcgtgagttaggcgggcaattgccaagttgggacgaactcaatgacatcaaagccgagtgtgaacaccgcgacattcacctccatatggatggtgctcgtttatgggagtgcgccgcctattatcaaaagtcgtacaaagagattgccacgggttttcagtcggcttatgtctctctctataagggcatcaatggcttagggggatcattgctactcggggacaagcaattcatcgagcaggcgtcgatttggatgaagcgccaaggtggcaatgtgtatcatcgcacgccttacgtggtgtcggctgcaatgcagtttgatcagcaattggcgaaaatgccagcgctgtttgcgcgcactcagcagatctaccaaatcctccgcgagttcccacagctggctgtgagcccgtatgagccgcacgccaacatgctgcacttgattgtgccgctgagcgttgagaacgccatcgagttgcgtgatcgagtggcagagcaaaaaggcatttggttagggcatccacaaaccacgcaacaccccgatcaatcgatcttcgagtggtatgtgggcgataggttgctcaacatcgctgatgatcagttgcgtgaagtgttggcttacttagcaaatgcagagtgttga

SEQ ID NO: 22461 - protein, 358 aa, Vibrio vulnificus
MKKDLRAHCHTIIAGNHEQSPAEHFYAMAKWCEEHQVKHDVYGDGEFINSFQQKVADLLGFEAGLFVITGTMTQATALELVCRKKRNPVVAMHESSHIYRFERQGYQLQNRFSILPLGDMFRPWTAKDLNAWPDEISAVLYELPMRELGGQLPSWDELNDIKAECEHRDIHLHMDGARLWECAAYYQKSYKEIATGFQSAYVSLYKGINGLGGSLLLGDKQFIEQASIWMKRQGGNVYHRTPYVVSAAMQFDQQLAKMPALFARTQQIYQILREFPQLAVSPYEPHANMLHLIVPLSVENAIELRDRVAEQKGIWLGHPQTTQHPDQSIFEWYVGDRLLNIADDQLREVLAYLANAEC

SEQ ID NO: 22462 - DNA, 1026 bp, Streptococcus agalactiae
  CDS (1)..(1026)
atgttacattttgaaaatgattataataaaggagctcatccagagcttttgaatgcccttattgaaactaatgatcaaggtctatcgggatatgggacagatagttactgtcaacaagcggcagataaaattcgagaagtctgttcctgtccacaagctgaagttgagtttttagtgggtggtactcaaacaaatcaagtagttatcagtagtatgcttgcttcttatgaaggagttattgctgcagaaacaggtcatgtgagtagtcatgaagcaggagccatagaattttcaggtcataaggtattgactttaccttctcataatgggaaattactcgcaagcgaagttgcaacttatattgagactttttatgctgatggtaattaccaacacatggtttttccaggaatggtttatatatcacatccaacagaatatggaacactttatagtaaagcagaactagaagagttatcgaagatttgtaaacattatcaaatccccttatttattgacggtgctcgtctggggtatggtttggctgcgaaagatacagatgttgatttcccaacgattgcagccttatcagatgttttttacattggtggaaccaaaatgggggctcttgctggggaagcagttgttttcacaaagaaaaatcgtccaaaacagtttactacaattgtaaagcagcatggtgcgttattagccaagggaagattgctggggcttgcttttgatcgtttctttacggatgacctttacttaaagattggaaagcatgcgattgacttagcagaggaattaaaaatcattttagaagaaaaaggttactcgttctatttaaaatcaccaactaatcaacaatttgttattgtagaaaatacaaaactaacagatttagcaaagaatgtagcttatagtttttgggaaaaatatgatgaccatcatactgtaatacgtctagcaactagttggtcaactagtcgcgaagatgtaactgctttaagaaatgtcttgtga

SEQ ID NO: 22463 - protein, 341 aa, Streptococcus agalactiae
MLHFENDYNKGAHPELLNALIETNDQGLSGYGTDSYCQQAADKIREVCSCPQAEVEFLVGGTQTNQVVISSMLASYEGVIAAETGHVSSHEAGAIEFSGHKVLTLPSHNGKLLASEVATYIETFYADGNYQHMVFPGMVYISHPTEYGTLYSKAELEELSKICKHYQIPLFIDGARLGYGLAAKDTDVDFPTIAALSDVFYIGGTKMGALAGEAVVFTKKNRPKQFTTIVKQHGALLAKGRLLGLAFDRFFTDDLYLKIGKHAIDLAEELKIILEEKGYSFYLKSPTNQQFVIVENTKLTDLAKNVAYSFWEKYDDHHTVIRLATSWSTSREDVTALRNVL

SEQ ID NO: 22464 - DNA, 1014 bp, Shewanella oneidensis
  CDS (1)..(1014)
atgatcgatttgcgcagtgataccgtgacccagccaactgaggcgatgcgtttagccatgtctagggcagaagtgggcgacgatgtttatggtgatgatccgaccgtgaacagtttgcaggacatggccgccgagatgtttggttttgagagcgctctttttacggcatcgggcactcaagccaatttgctcgcactgatggcgcattgcgagcgtggggatgaatatttatgtggtcagcaggcccataactacaaatttgaaggtggtggcgcggcggtattgggtagcattcaaccacaaccgttgacgaatcaactggatggcactattgcccttactgatgttgaagcagccatcaagcccgatgatattcattttgcccgcacacgcttactgagtttagaaaatactattggggggaaagtgttgtcgcaggcctatcttgccaatgcgcaggcgttggcttttcaacgtggtttaaaaattcatttagatggtgcaagggtggccaatgctgcagtagcacaaggtattgctattgctgatatagcagcgcattttgattcagtttccatttgtttatcaaaaggattatgtgcgccagtagggtcgttactcttaggggatgaacgcctgattaaaaaagcgacacgttggcgaaaaatgcttggtggcggtatgcgtcaagcgggtattttagcggcggctggcaagttagccttaactgaacaagttgaaagacttgcagaagatcatgaaaatgcggcttatctggctcagcagttaagccagttggatgagtttgacattgacttagcctcagttcaaaccaatatggtgtttgcaacattggcatcccatgtcgatgaacaggccttagtgaaacgctgtcgtggcgagggcattctgattagtcctggacgtaccttacgttttgttacccataaagatgtctcgcgtcaggatattgataaggtattgcaggtatttaaattacatctgcaggcgtaa

SEQ ID NO: 22465 - protein, 337 aa, Shewanella oneidensis
MIDLRSDTVTQPTEAMRLAMSRAEVGDDVYGDDPTVNSLQDMAAEMFGFESALFTASGTQANLLALMAHCERGDEYLCGQQAHNYKFEGGGAAVLGSIQPQPLTNQLDGTIALTDVEAAIKPDDIHFARTRLLSLENTIGGKVLSQAYLANAQALAFQRGLKIHLDGARVANAAVAQGIAIADIAAHFDSVSICLSKGLCAPVGSLLLGDERLIKKATRWRKMLGGGMRQAGILAAAGKLALTEQVERLAEDHENAAYLAQQLSQLDEFDIDLASVQTNMVFATLASHVDEQALVKRCRGEGILISPGRTLRFVTHKDVSRQDIDKVLQVFKLHLQA

SEQ ID NO: 22466 - DNA, 1002 bp, Escherichia coli O6
  CDS (1)..(1002)
atgattgatttacgcagtgataccgttacccgaccgagccgcgccatgctcgaagcgatgatggccgccccggttggggacgacgtttacggagacgaccctaccgttaatgctctgcaggactatgcagccgagctttccggtaaagaagccgccatttttctgcctaccggcactcaggccaacctggtcgctctgctcagtcactgcgaacgcggcgaagagtatatcgtcggtcaggccgcgcataactatctgtttgaagccggtggcgcagcagtgctgggcagtattcagccgcaacccatcgacgcagctgccgacggcacgctaccgctggataaagtggcgatgaaaatcaaacccgacgatatccatttcgcccgcaccaaattactcagtctggaaaacacccacaacggcaaagtgctgccgcgtgaatacttaaaagaggtatgggaatttacccgcaagcgcaatctggcgctgcatgttgacggtgcgcgcatctttaatgccgtggtggcttacggctgcgaactgaaagagatcacacaatattgtgactcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggctgtatgcgctgaaaaataacgtcgcacgtttgcaggaagaccacgacaacgccgcctggatggcgaagcaactgcgtgaagcaggcgcggatgtgatgcgtcaggacaccaatatgctgtttgttcgcgtcggggaagaaaatgctgccgcgttaggcgaatacatgaaagcgagaaacgtactgattaacgcctcgccgattgtccgcctggtgacgcatcttgacgtctcgcgcgctcagctggcggaagtcgccgcccactggcgcgcattcctggcgcgttaa

SEQ ID NO: 22467 - protein, 333 aa, Escherichia coli O6
MIDLRSDTVTRPSRAMLEAMMAAPVGDDVYGDDPTVNALQDYAAELSGKEAAIFLPTGTQANLVALLSHCERGEEYIVGQAAHNYLFEAGGAAVLGSIQPQPIDAAADGTLPLDKVAMKIKPDDIHFARTKLLSLENTHNGKVLPREYLKEVWEFTRKRNLALHVDGARIFNAVVAYGCELKEITQYCDSFTICLSKGLGTPVGSLLVGNRDYIKRAIRWRKMTGGGMRQSGILAAAGLYALKNNVARLQEDHDNAAWMAKQLREAGADVMRQDTNMLFVRVGEENAAALGEYMKARNVLINASPIVRLVTHLDVSRAQLAEVAAHWRAFLAR

SEQ ID NO: 22468 - DNA, 1026 bp, Bifidobacterium longum
  CDS (1)..(1026)
atgctgtcttttgagaacgattactcccgcgccgcccatcccgcggtgcttgaagccgtggctgaagccaacaaccatctgtattcgggctacgggtccgacgaactgagcgatcaggccaaggccaagatccgcgaggcctgcggccagccggacgcggatgtgtggttcctcgtcggcggcacgcagaccaaccaggtcgtcatcgacaccatcaccccggcgtatgcaggcgtggtcgcggtcgcctccggccatccgaacgtgcacgaggccggcgccatcgagttctccgggcacaaggtgctcacgattccccagcacaacggcaaaatggacccgaccgaactggacgagttctgcaagaccttctatgcggacggcaactacgagcacatggtgttcccgggctccgtgtacgtctcgcaaagcaccgaatatggcaccatctactccaaggccgagttgcaggccatcgccgatgtggcgcacaagtacgacatgccgctgttcgtggatggcgcgcgactcggctacgcgctgaccgccaccggttcagacatgacgctcgcggatctggcgaccatcgccgacgtgttctacatcggcggtaccaaggtgggtgccctgttcggcgaggccgtggtgtttaccaagcacaacacgccgaagcacttcttgaccctcatcaagcagcacggtgccttgctggccaagggctttgtgctgggcgcgcagtttgacgctttgttcaccgacaacctgtatttcaagatcgcccgcaacgccaatgaggcggccgatcgtattcgcgaggccctgcgcgccaagggctacacgctcactttcgaagcgcccaccaaccagattttcgtgacgatggatcagccgaccatcgaccgtctggagcgcgagatcaagctcggctttaccgaaaaggccgacgacacgcacaccgtgatgcgcatctgcaccagctgggccaccacgcctgaagaggtcgatcaacttattgagttgttgtaa

SEQ ID NO: 22469 - protein, 341 aa, Bifidobacterium longum
MLSFENDYSRAAHPAVLEAVAEANNHLYSGYGSDELSDQAKAKIREACGQPDADVWFLVGGTQTNQVVIDTITPAYAGVVAVASGHPNVHEAGAIEFSGHKVLTIPQHNGKMDPTELDEFCKTFYADGNYEHMVFPGSVYVSQSTEYGTIYSKAELQAIADVAHKYDMPLFVDGARLGYALTATGSDMTLADLATIADVFYIGGTKVGALFGEAVVFTKHNTPKHFLTLIKQHGALLAKGFVLGAQFDALFTDNLYFKIARNANEAADRIREALRAKGYTLTFEAPTNQIFVTMDQPTIDRLEREIKLGFTEKADDTHTVMRICTSWATTPEEVDQLIELL

SEQ ID NO: 22470 - DNA, 1116 bp, Rhizobium loti
  CDS (1)..(1116)
atggatgaaacgagcgtcaagaccatgagcgacagcaagcagacccgcccccgcggcttcaccagcgacaacatcgccggcgtctcccccgaggtgatcgcagccatcaccgcgtgcgcgtcgggtcaggcgcttccctacggcaacgatgagctgacgcataccgtcgagcgccagctcgccgaggtgttcgagcatgcggtcgacgtgttcctcgtttcgacggggtcggcggcgaacgcgctggcgctcgcggcgattacgccgccatggggcagcatcctctcgcacgccgacgcacacatcaaccgcgacgagtgcggcgcgccggagttctacaccgccggtgcgaagttggtgcagcttccaggcgaggctggcaaaatcgccatcgacgccttggcggccaatgcaacgcgcatggtgggcgatatccactcggtccagccctccagcgtcagcatcacgcaggcgaccgagatgggatcggtctacgcgctcgacgaaatcagggcgatcggacatatctgccggtcagcgaacctgccgctccacatggacggtgctcgcttcgccaacgccctcgtcactctgcgctgctcgccggccgagatgacgtggaaggccggcgtcgacctagtgtcgtttggcgccaccaagaacggaacgtttggggtcgatgcggtcgtctcgtttcgcagagatctcgcgagcacgatcgcctttcgccgcaagcgggccggccagttgagttccaagatgcgcttcatggcggcgcaaatggacggttatctgagggacggtgtctggcttcgcaacgcggtccatgccaatgcgatggcatcggcgctcgcgcgggggttggccctggtgccaggcgtgaaaatccagcagcggcccgaggccaatatactgttctgccgacttcccacgtccctgatccgggggctgctcgacatgggattccgcttctaccatgatcgctgggagcccgggatcgtgaggttcgtcacctctttcgcgacgaccgaggccgacgtgtccgacttgatcggcgcggcgaccagcctctgcgcaccggtcggctcggctcgtgttccggctggcgccgaatga

SEQ ID NO: 22471 - protein, 371 aa, Rhizobium loti
MDETSVKTMSDSKQTRPRGFTSDNIAGVSPEVIAAITACASGQALPYGNDELTHTVERQLAEVFEHAVDVFLVSTGSAANALALAAITPPWGSILSHADAHINRDECGAPEFYTAGAKLVQLPGEAGKIAIDALAANATRMVGDIHSVQPSSVSITQATEMGSVYALDEIRAIGHICRSANLPLHMDGARFANALVTLRCSPAEMTWKAGVDLVSFGATKNGTFGVDAVVSFRRDLASTIAFRRKRAGQLSSKMRFMAAQMDGYLRDGVWLRNAVHANAMASALARGLALVPGVKIQQRPEANILFCRLPTSLIRGLLDMGFRFYHDRWEPGIVRFVTSFATTEADVSDLIGAATSLCAPVGSARVPAGAE

SEQ ID NO: 22472 - DNA, 1074 bp, Xanthomonas campestris
  CDS (1)..(1074)
atgatggacgggcagggcagcgctgcacgcatcagctttcgcaacgattacagcgagggcgcacatccgcgcgtcttgcaggcattggcgcaggccagtgacgagcaaaatggcggctacggcaccgatcggcatagcgaacgtgctgcggcattgatccgcaatgccatcgcgcaaccgcaggccgccgtgcatctgctggtcggtggcacgcagaccaacctgattgcgatcagcgcgtttttgcgcccgcatcaggcggtgattgcggtggaagcgggccacatcgccacgcacgaaaccggcgcgatcgaggccaccgggcacaaggtgctcaccgtccccgcgctgcacgacaagctgacgcctgcattgatcgcgccactgcttgcggtgcacagcaacgagcacatggtgcagccgcgcctggtttatctttccaacagcaccgagagcggcaccatctacacgcgtgccgaacttgaggcgctcgcgcagttctgccgcgcgcacgacttgctgctgtatctggatggcgcgcgcctgggcgcggcattgactgcccatggcaacgatctggatctaccgacgattgccgcgctcaccgatgcgttctacatcggcggcaccaagaatggcgccttgctcggcgaagcgctgatcatcgtgacgccggcgttgcaggccgatttccgctacctgatcaagcaacgcggcgcgctgctggccaagggcatggtgctgggtgcgcagttcgctgcgcttttcgaagaggggctgttctttgagttagccgcgcatgccaatgcaatggcgcagcggctgcgtgccggcttgctggccgccggcgccgaattcaccagcaactcgccgaccaaccagcaattcattgccgtgagcgcgcagcaggccgagcagatcgcgcagcgctacgacttcgaacgctgggaaacgcgcagcgacggccgcctggtgattcgcttcgtgacctcgtgggccaccacgcctgccgcagttgatcgtctgtgcgcgtatgttgcggcccttttgcagcatcctgcggtgcagtcatga

SEQ ID NO: 22473 - protein, 357 aa, Xanthomonas campestris
MMDGQGSAARISFRNDYSEGAHPRVLQALAQASDEQNGGYGTDRHSERAAALIRNAIAQPQAAVHLLVGGTQTNLIAISAFLRPHQAVIAVEAGHIATHETGAIEATGHKVLTVPALHDKLTPALIAPLLAVHSNEHMVQPRLVYLSNSTESGTIYTRAELEALAQFCRAHDLLLYLDGARLGAALTAHGNDLDLPTIAALTDAFYIGGTKNGALLGEALIIVTPALQADFRYLIKQRGALLAKGMVLGAQFAALFEEGLFFELAAHANAMAQRLRAGLLAAGAEFTSNSPTNQQFIAVSAQQAEQIAQRYDFERWETRSDGRLVIRFVTSWATTPAAVDRLCAYVAALLQHPAVQS

SEQ ID NO: 22474 - DNA, 1065 bp, Xanthomonas axonopodis
  CDS (1)..(1065)
atgatggacgggcagggtagcgctacgcgcatcagctttcgcaacgactacagcgaaggcgcgcatccgcggctgttgcaggcgttggcgcaggccagcgccgagcagcatgccggctatggcaccgatcggcacacagcgcgtgcggttgcgttgatccgcaccgcagtcgcgcagccgcaggccgacgtgcatctgctggtcggcggcacgcagaccaatctgattgcgatcagcgcgttcttgcgcccgcatcaggcagtcatcgcggtggacgcggcgcatatcgccacgcacgagaccggcgccatcgaagcgaccggccacaaggtgctcaccgtgccggcgctgcacgacaagctgacgcctgcgctgattcagccggtgctggctgtgcacagcaacgaacacatggtgcagccgcgtctggtctacatttccaacagcaccgaaagcggcaccatctatacgcgcgccgaactcgatgcgttgtcgcggttttgtcgcgcgaacgatttgctgctgtacctggatggcgcgcgtctgggtgcggcgctgaccgccgacggcaacgatctggatctgccggccattgccacgctgaccgacgcgttctatatcggtggcaccaagaatggtgcgctgctcggcgaagcgctggtcatcgtcaatcccgccctgcaggcggatttgcgttatctgatcaagcagcgcggcgcgctactggccaagggcatggtggttggtgcgcaatttgcggcgttgttcgaagacagtctgttcttcgaactggccgcgcatgccaatgccatggcgcaacgcttgcgcgccggcctgcttgcggccggcgcgcacttcaccagcgactcgccgaccaaccagcagttcatcgccgtcagcgcgcaacacgctgcgcagctcgtgcaacgctacgacttcgagcgctgggaagtgcgcaccgatggcagtcaggtaatccgcttcgtgacctcgtgggcgaccacagccgcgtcggtcgatcggctgtgtgcggatgttgccgcacttcatcgcggcgtgtcgtaa

SEQ ID NO: 22475 - protein, 354 aa, Xanthomonas axonopodis
MMDGQGSATRISFRNDYSEGAHPRLLQALAQASAEQHAGYGTDRHTARAVALIRTAVAQPQADVHLLVGGTQTNLIAISAFLRPHQAVIAVDAAHIATHETGAIEATGHKVLTVPALHDKLTPALIQPVLAVHSNEHMVQPRLVYISNSTESGTIYTRAELDALSRFCRANDLLLYLDGARLGAALTADGNDLDLPAIATLTDAFYIGGTKNGALLGEALVIVNPALQADLRYLIKQRGALLAKGMVVGAQFAALFEDSLFFELAAHANAMAQRLRAGLLAAGAHFTSDSPTNQQFIAVSAQHAAQLVQRYDFERWEVRTDGSQVIRFVTSWATTAASVDRLCADVAALHRGVS

SEQ ID NO: 22476 - DNA, 1041 bp, Thermoanaerobacter tengcongensis
  CDS (1)..(1041)
atgaaatatattgacctaagaagcgacacagtaacccagcccactcctgagatgagagaagccatgtacaaagctgaagtgggcgatgacgtatacggagaagaccctactgtgagaaaacttgaagaaatggcagcagaaatgctaggaaaagaagcagcaatgcttgtgaccagcggaactcaagggaaccaagtctcaataatgactcacactcatccaggagaagaaatcatactagaggaaaattcccacataataacctatgaagttggagggataggctatctcgctggagtacaggcaaaaactttgaagggcaataaaggagttttaaatccggaagatgtggaaaaagctataaggcctaaaaacatacactttcctgagacaagcctaatctgccttgaaaacacacacaatagagcaggtggcactgtgactccaattgaagtcatgaaaaagatatatgaaatcgcacaaaagcatggaatacctgtacatctggacggcgccagaatatttaacgccgcgacatatctcaaagtagatgtaaaagaaattgcgaaatatgctgacagcgtgatgttctgcctttcaaaagggttatgtgcccctatcgggtctatcgtcgtcggaacaaaagaatttattgaaagggcgaggaaataccgcaagatgctgggaggaggaatgaggcaggcaggtttcatcgctgctgctggcatcgtagcccttgaaaaaatgacaaaaaggcttcaagaagaccatgacaatgcaaggcttctggccgaaggtctgaaaaacatccccgggatagaccttgatatggaaacagtgcaaactaacatagtaatgactgatatttctggcactggaatgacaggaagggaattttctctaaagttaaaagaacacggcgttttagtaaatgggggagatgacttttcagtaagatttgtgactcactattacataactaaagaagacgtaaagaaggccttgagtgcaattgaaaaagtggtaagagaaaagcattaa

SEQ ID NO: 22477 - protein, 346 aa, Thermoanaerobacter tengcongensis
MKYIDLRSDTVTQPTPEMREAMYKAEVGDDVYGEDPTVRKLEEMAAEMLGKEAAMLVTSGTQGNQVSIMTHTHPGEEIILEENSHIITYEVGGIGYLAGVQAKTLKGNKGVLNPEDVEKAIRPKNIHFPETSLICLENTHNRAGGTVTPIEVMKKIYEIAQKHGIPVHLDGARIFNAATYLKVDVKEIAKYADSVMFCLSKGLCAPIGSIVVGTKEFIERARKYRKMLGGGMRQAGFIAAAGIVALEKMTKRLQEDHDNARLLAEGLKNIPGIDLDMETVQTNIVMTDISGTGMTGREFSLKLKEHGVLVNGGDDFSVRFVTHYYITKEDVKKALSAIEKVVREKH

SEQ ID NO: 22478 - DNA, 1023 bp, Fusobacterium nucleatum
  CDS (1)..(1023)
atgataaattttaaaaatgattatagtgaaggagcttgttcagaagtactggaagcattgataaaaactaattatgagcaaacagtaggttatggagaagatgaatactgtgaaaaggctaaaaatttaattaaagaaaatattaattatcctaatgcaaatatttattttttagttggtgggacacaagcaaatacaactgttatttctcactctctaagaccttatgaagctgttattgcttgtaagacaggacatatctctatacatgaaacaggagctattgaagctactggacataaaataattgaagtagatggaattgatgggaaattaactcctgatttaattttaaatgaattaagaaaacatgaagatcatcacatggtaaaacctaaaatggtttatatttcaaatactactgaaataggaactgtttatactaaaaaagaattagaaaatattagtaaagtttgtaaagataataatttatatttatatttagatggtgcaagacttgcatctgcacttacctctgaaaaatgtgatataaatttagaagattatccaagatattgtgatgttttctatattggtggaacaaaatgtggcttattatttggtgaagcagttgtgattataaatgatgagataaagaaagaatttaacttttctgttaaacaaaaaggtggattatttgcaaaaggaagattattaggaatacagtttgcaactttatttaaagatgatttatattatagaataggtgttcattcaaataaaatggcattaaaaataaaaaatgcttttatagaaaaaggtattaagttagctactgattcttatactaaccaagtttttgtagatttaagtcaagaacaaataaaaaaattagaaaaagatgttatattttcagtagaattttttggaataggagaaagtcaatcatcaagatttgtaacttcttgggcaacaaaagaagaagatattgataaacttgtagaactgattaaatctctttaa

SEQ ID NO: 22479 - protein, 340 aa, Fusobacterium nucleatum
MINFKNDYSEGACSEVLEALIKTNYEQTVGYGEDEYCEKAKNLIKENINYPNANIYFLVGGTQANTTVISHSLRPYEAVIACKTGHISIHETGAIEATGHKIIEVDGIDGKLTPDLILNELRKHEDHHMVKPKMVYISNTTEIGTVYTKKELENISKVCKDNNLYLYLDGARLASALTSEKCDINLEDYPRYCDVFYIGGTKCGLLFGEAVVIINDEIKKEFNFSVKQKGGLFAKGRLLGIQFATLFKDDLYYRIGVHSNKMALKIKNAFIEKGIKLATDSYTNQVFVDLSQEQIKKLEKDVIFSVEFFGIGESQSSRFVTSWATKEEDIDKLVELIKSL

SEQ ID NO: 22480 - DNA, 1533 bp, Arabidopsis thaliana
  CDS (303)..(1379)
gataatatttcattttcgtcgtttctttctttctaagtttcgatgtcagttcctaatctctatggcgttcatgatagccaaatggtaactttggtggcctaatgtatgtcacgtaaattatccacgtggcactcacttttttgcatctttctcaaaatatatcaaaggagacttcataaagaaagaatctttagtgtggagagactaaaaggacaccacaagcttatttcataagaaacttcaaattagaatcagaaacaagagcatccttcttcatttacacaggtaaattaggtgtaaaaatggtgatgagaagtgtggatctacgatcagataccgttactagaccgacagatgcgatgcgagaagcaatgtgtaacgcagaggtggatgatgacgtcctcggatatgacccaacggctagacgtcttgaagaggagatggctaagatgatggggaaagaggctgctctgttcgtgccatccgggacaatggggaatctgatcagcgtgatggttcactgcgacgtgagaggcagcgaggtgattcttggcgacaattgtcacatccatgtttacgagaatggagggatatcgactatcgggggagtgcatcctaagacagtcaagaatgaagaagacgggaccatggacttggaggccattgaagcagctattagagatcctaaaggaagcacgttttatccatcaacaaggttgatttgcttggagaacacacatgccaactctggtgggagatgtttgagcgtggaatacactgagaaagttggagagattgcgaagagacatggcgtgaagctccatatcgacggagcccgtcttttcaatgcttccattgcacttggagttccagtccataagcttgttaaggctgcggactccgttcaggtgtgtctctctaaaggtcttggagctccggtaggatctgtaatcgttggttcgcaaagcttcatagagaaggcgaaaacggttaggaaaacattaggtggaggaatgagacaaataggtgttctgtgcgcagccgctttggtcgcactccaagaaaacctcccaaagctacaacatgaccacaagaaggctaagttgttagctgaagggttgaatcaaatgaaagggattagagtaaatgttgcagccgtggagaccaacatgattttcatggatatggaggatggttcaagacttacggctgagaaactgcggaagaatctagaggagaatggcattctccttatccggggaaactcatcccggatcagaatagttatacaccaccagataacaacaagtgatgtgcattacacattgtcttgctttcagcaagcaatgctaacgatgcaggaaccaagccgaacctaatttggcgaaaccgaaatgcttcttcttttcttttcaacttattaaatattgttgtctaaagtacattttaattaaaactataagcatttcaatgaaattgtcaccctcattcctggatgtttgagtttttaatttataagttgttttacctttg

SEQ ID NO: 22481 - protein, 358 aa, Arabidopsis thaliana
MVMRSVDLRSDTVTRPTDAMREAMCNAEVDDDVLGYDPTARRLEEEMAKMMGKEAALFVPSGTMGNLISVMVHCDVRGSEVILGDNCHIHVYENGGISTIGGVHPKTVKNEEDGTMDLEAIEAAIRDPKGSTFYPSTRLICLENTHANSGGRCLSVEYTEKVGEIAKRHGVKLHIDGARLFNASIALGVPVHKLVKAADSVQVCLSKGLGAPVGSVIVGSQSFIEKAKTVRKTLGGGMRQIGVLCAAALVALQENLPKLQHDHKKAKLLAEGLNQMKGIRVNVAAVETNMIFMDMEDGSRLTAEKLRKNLEENGILLIRGNSSRIRIVIHHQITTSDVHYTLSCFQQAMLTMQEPSRT

SEQ ID NO: 22482 - DNA, 1098 bp, Ralstonia solanacearum
  CDS (1)..(1098)
atgaaccgcgatccgatgccgaccaccagaacacccgccctgggctttaccagcgacaacatcgaaggcgcgtcgcccgaggtgctcgatgccatccttgccgccaatgccggtcaggcggccccatacggcgcggatgactgcaccgcccgggtcgagcaaacgctgagcgagctgttcgagcgcgaagtcaaagtcttcctggtcccgaccggcaccgcggccaatgcgctctgcctgggcgcgatgacgccgccctggggcaacgtgtactgccacccgtcaagccacatcaacaacgacgagtgcggtgcccccgagttctatacgaacggcgcgaaactggtcgcagtggatgggccatccgccaagatcgatgtggagaagcttcgcgccgccacccgcgtgaaggtgggcgacgtgcattccacccagcccgcttgcgtcagcctgacgcaagcgacggaagtcgggagcctctacacgctgaatgagatcgaagcgatcggacagctctgcaaggacgcccgcatcaagctgcagatggatggctcgcgctttgccaacgcgctggtctccctgggctgctcgcccgcggcaatgacatggaaagcgggcgtcgatgcgctgtcgttcggcgcgaccaagaatggcgtcgtcgcggcggaagccattgtgctgtttgacctgtcgctcgcggccgagatgggctaccgccgcaagcgggccggccatctgttctcgaagatgcgttttctgtcggcccagatcgaagcctacctggccaacgatctctggttgcgcaacgcacgccaggcaaacgacatggccctgcgcctggcccgtggccttgaagggatgcatggggccagcgtgctgggcgccacggaagccaacatcgtcttctgccgcctcccctcgaccctcattgaaaacctgctccaggcgggattccgcttttatcacaatcgctgggagccgaacgtggtgcgctttgtgacgtccttcgccaccacggccgatgatgtcgacaacctgctgcggcatatgaaggccgcagccgccgggccatcggcagacacccatgccaccgcatga

SEQ ID NO: 22483 - protein, 365 aa, Ralstonia solanacearum
MNRDPMPTTRTPALGFTSDNIEGASPEVLDAILAANAGQAAPYGADDCTARVEQTLSELFEREVKVFLVPTGTAANALCLGAMTPPWGNVYCHPSSHINNDECGAPEFYTNGAKLVAVDGPSAKIDVEKLRAATRVKVGDVHSTQPACVSLTQATEVGSLYTLNEIEAIGQLCKDARIKLQMDGSRFANALVSLGCSPAAMTWKAGVDALSFGATKNGVVAAEAIVLFDLSLAAEMGYRRKRAGHLFSKMRFLSAQIEAYLANDLWLRNARQANDMALRLARGLEGMHGASVLGATEANIVFCRLPSTLIENLLQAGFRFYHNRWEPNVVRFVTSFATTADDVDNLLRHMKAAAAGPSADTHATA

SEQ ID NO: 22484 - DNA, 1038 bp, Ralstonia solanacearum
  CDS (1)..(1038)
atgcaacacttcgcctccgacaactacgccggcttctgcccggaatccctgaagtacttcctggaagcgaacggcagcggccacgagcccgcctacggcgacgactcctggacgcagcgcgtatgcgaccgcatccgcgatctgttcgagaccgattgcgaagtctttttcgtcttcaacggcaccgccgccaattcgctggcgctgtccgcgctgtgccagtcgtaccactccgtcatctgccatgagctggcgcacatcgagacggacgagtgcggcggccccgagttcttctccaacggctccaagctgctgaccgccgagggcgccgacggcaagctgacgcccgacgcggtggaggcgctggtcacgcgccgctccgacatccactaccccaagcccaaggtggtctcgctcacgcagtcgaccgaggtgggcacggtctacacggtggacgaggtgcgggcgattgccgctgtcgcccgccgccggcagctgcgcgtgcacatggacggcgcgcgcttcgccaacgcggtggcctcgctcggcgtgcatccgtccgagatcacctggcgcgcgggggtggacgtgctgtgcttcggcggcaccaagaatggcctgccggtgggcgaggcggtggtgttcttcaaccgccgcctggccgaggacttcgcctaccgcgtcaagcaggccgggcaactggcctccaagatgcgcttcatctccgcgccgtggctgggcctgctggagaacgacgtgtggctgcgcaacgcgcgccatgccaacgcgatggcgcaactgctgcaccagcgcatccgcgaggtgccgggcgtgcgcatcatgttcccgccgcaggccaatgccgtgttcgccgagctgccgctgcccgccatcgagacgctgcgcgcgcgcggctggcgcttctacaccttcatcggcgcaggcggctgccgcttcatgtgtgcgtgggacttgcagcccgagacggtggaggcgctcgccggcgacatccgcctggcctgcggacaggccgcatag

SEQ ID NO: 22485 - protein, 345 aa, Ralstonia solanacearum
MQHFASDNYAGFCPESLKYFLEANGSGHEPAYGDDSWTQRVCDRIRDLFETDCEVFFVFNGTAANSLALSALCQSYHSVICHELAHIETDECGGPEFFSNGSKLLTAEGADGKLTPDAVEALVTRRSDIHYPKPKVVSLTQSTEVGTVYTVDEVRAIAAVARRRQLRVHMDGARFANAVASLGVHPSEITWRAGVDVLCFGGTKNGLPVGEAVVFFNRRLAEDFAYRVKQAGQLASKMRFISAPWLGLLENDVWLRNARHANAMAQLLHQRIREVPGVRIMFPPQANAVFAELPLPAIETLRARGWRFYTFIGAGGCRFMCAWDLQPETVEALAGDIRLACGQAA

SEQ ID NO: 22486 - DNA, 1002 bp, Salmonella typhimurium
  CDS (1)..(1002)
atgattgatttacgcagtgataccgttacccgaccgggccgcgccatgctcgaggcgatgatgaccgccccggtcggggacgacgtatacggcgatgaccctactgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcgcataattatctctatgaagctggcggcgcggcggtgctcggcagcattcagccgcagcccatcgacgccgccgcggacggtacgctgccgctggagaacgtggcggcgaagattaaagcggatgacatccacttcgcgcgcacgcgcttgctcagtctggaaaatacgcataacgggaaagtgctgccgcgcgcgtatctgaaagacgcctggacatttacccgcgaacgtggactggcgctgcacgttgacggcgcccgaatttttaacgcggtggttgcctacggctgtgagttaaaagagattacgcagtattgcgactcttttaccatctgcctgtcaaaaggtctcggaacgccggtcggttcactgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgataacgccgcctggctggcgcagcagcttcgggaagcgggcgcggaggtcatacgccacgaaacgaatatgctgtttgttcgcgttggcgaagcacaggccgccgcgcttggcgactatttgcgggaacggaatatcctgattaacgccgcgccgattgtgcgtctggtgacgcatctggatgtctctcgcgaacagcttaccgacgtcgtcgcccactggcgcgcctttttagcccgctaa

SEQ ID NO: 22487 - protein, 333 aa, Salmonella typhimurium
MIDLRSDTVTRPGRAMLEAMMTAPVGDDVYGDDPTVNALQRYAADLSGKEAALFLPTGTQANLVALLSHCERGEEYIVGQGAHNYLYEAGGAAVLGSIQPQPIDAAADGTLPLENVAAKIKADDIHFARTRLLSLENTHNGKVLPRAYLKDAWTFTRERGLALHVDGARIFNAVVAYGCELKEITQYCDSFTICLSKGLGTPVGSLLVGNRDYIKRATRWRKMVGGGMRQAGILAAAGLYALKHNVARLQEDHDNAAWLAQQLREAGAEVIRHETNMLFVRVGEAQAAALGDYLRERNILINAAPIVRLVTHLDVSREQLTDVVAHWRAFLAR

SEQ ID NO: 22488 - DNA, 1047 bp, Rhizobium meliloti
  CDS (1)..(1047)
atgatcttctcctccgacaactgggccggcgcccatccggcgattgccgaaagtctggtcgcgaatgcgcagggctatgcttccgcctacggcacgagcgaactcgaccggagggtggaacagagattttcggagattttcgagagggacgtcgcggtattcttcgtgggcaccggaaccgccgcaaattcccttgcgctttcgagcgccaatcgggcgggcggaatcgctttctgccatcgcgaagcgcatgtgaacgtcgacgagtgcggcgcgccggagttcttctcgcacggcgcgaggctgtgcccggtcgagggcgcccgcggcaggatggagccggcgaagctcgaggccgaaattcggcggctcccgagggagaacgtccatggcggtcagccgatggcggtgacgctgacgcaggcgaccgagagcggcaccgtctattcgctcgaccagatcgaaacgatcggttcgatcgcccgctcccataaactgccgctgcacatggatggcgcccgtttcgccaatgccctggtcagccttggtacgacaccggccgagatgacctggaagcgtggcgtcgatctgctttcgttcggcggaaccaagaacggctgctggtgcgccgaggcgctggtgctcttcgacctttcgaaggcgcaggagatgcacttcctgcgcaagcgctcggctcaactcttctccaagtcgcgcttcgtcgccgcccagttcgacgcctatcttgccggcgatctctggctcgatcttgcgcgccacgccaacgcgatggcacagcgcctcgccgacggcatcaccgcttcggccgggagccggcttgcctgggcgcccgatgccaacgaggtcttcgtcgtgctgaaacgggaggccgcgggtcggctgcagcggcagggcgcgcttttctacgattgggaagtgccgcacgatctcgaaggcagcctcgcggaagacgaagggctctatcgcctggttaccagcttcgccacccgcgccgaggacgtcgaccgtttcgtcgccgcctgctga

SEQ ID NO: 22489 - protein, 348 aa, Rhizobium meliloti
MIFSSDNWAGAHPAIAESLVANAQGYASAYGTSELDRRVEQRFSEIFERDVAVFFVGTGTAANSLALSSANRAGGIAFCHREAHVNVDECGAPEFFSHGARLCPVEGARGRMEPAKLEAEIRRLPRENVHGGQPMAVTLTQATESGTVYSLDQIETIGSIARSHKLPLHMDGARFANALVSLGTTPAEMTWKRGVDLLSFGGTKNGCWCAEALVLFDLSKAQEMHFLRKRSAQLFSKSRFVAAQFDAYLAGDLWLDLARHANAMAQRLADGITASAGSRLAWAPDANEVFVVLKREAAGRLQRQGALFYDWEVPHDLEGSLAEDEGLYRLVTSFATRAEDVDRFVAAC

SEQ ID NO: 22490 - DNA, 1092 bp, Rhizobium loti
  CDS (1)..(1092)
atgaacgaaagcaagcagacccgcccccgcggctttaccagcgacaacatcgccggcgtctcccccgaggtgatcgcagccatcaccgcgtgcgcgtcaggtcaggcgcttccctacggcaacgatgagctgacgcataccgtcgagcaccagctcgccgaggtgttcgagcatgcggtcgacgtgttcctcgtttcgacggggtcggcggcgaacgcgctggcgctcgcggcgattacgccgccatggggcagcatcctctcgcacgccgacgcacacatcaaccgcgacgagtgcggcgcgccggagttctacaccgccggtgcgaagttggtgcagcttccaggcgaggctggcaaaatcgacatcgacgccttggcggccaatgccatgcgcatggtgggcgatatccactcggtccagccctccagcgtcagcatcacgcaggcgaccgagatgggatcggtctacgcgctcgacgagatcaaggccatcagccatatctgccggtcagcgaacctgccgctccacatggacggtgctcgcttcgccaacgccctcgtcactctgcgctgctcgccggccgagatgacgtggaaggccggcgtcgaccttgtgtcatttggcgccacgaagaatggaacgtttggggtcgatgcggtcgtctcgttccgcggagatctcgcgagcacgatcgcctttcgccaaaagcgggccggccagttgagttccaagatgcgcttcatggcggcgcaaatggacggttatctgagggacggtgtctggcttcgcaacgcggtccatgccaatgcgatggcatcggcgctcgcgcgggggttggccctggtgccaggcgtgaagatccagcagcgtcccgaggccaacatcctgttctgccgacttcccacgtccctgatccgggggctgctcgacatgggattccgcttctaccatgatcgctgggagcccgggatcgtgaggttcgtcacctctttcgcgacgaccgaggccgacgtgtccgacttgatcggcgcggcaaccagcctctgcgcaccggtcggctcggctcgtgttccggctggcgccgaatga

SEQ ID NO: 22491 - protein, 363 aa, Rhizobium loti
MNESKQTRPRGFTSDNIAGVSPEVIAAITACASGQALPYGNDELTHTVEHQLAEVFEHAVDVFLVSTGSAANALALAAITPPWGSILSHADAHINRDECGAPEFYTAGAKLVQLPGEAGKIDIDALAANAMRMVGDIHSVQPSSVSITQATEMGSVYALDEIKAISHICRSANLPLHMDGARFANALVTLRCSPAEMTWKAGVDLVSFGATKNGTFGVDAVVSFRGDLASTIAFRQKRAGQLSSKMRFMAAQMDGYLRDGVWLRNAVHANAMASALARGLALVPGVKIQQRPEANILFCRLPTSLIRGLLDMGFRFYHDRWEPGIVRFVTSFATTEADVSDLIGAATSLCAPVGSARVPAGAE

SEQ ID NO: 22492 - DNA, 1313 bp, Arabidopsis thaliana
  CDS (91)..(1158)
gagtcacccgaagcacatctctttttatctcttcgccaagaaaacaaaaagcatagcctaacagaacagaatctagtgagccaaatcaagatggtgacgccaactacaattagaaccgtcgatctccgctccgacacggtgactaaaccaacagagtcaatgcgttcagcaatggcaaacgcggaagtagacgacgacgttttgggaaacgatccaacggctctgcgtttggagaaagaggtggctgagatcgctggaaaagaggcggcgatgtttgttccgtcagggacaatggggaatctgataagcgtgttggtccattgtgatgagagagggagtgaagtgattcttggagacgactctcacattcatatatatgaaaacggcggcgtttcaagcctcggtggtgtgcatccgaggacggtgaagaatgaggaagacggtacgatggagattggtgctattgaagctgccgtgaggagtcccaaaggagatctccatcatccggttactaagcttatatgtcttgagaatactcaagcaaattgtggaggtagatgccttcctatagaatatatagacaaagtcggagaattagccaagaaacatggtttgaagcttcacattgacggagctaggattttcaacgcttctgtggcacttggagttcccgtgaagaggattgttcaagcagctgattctgtctcgatctgtttgtcgaaaggtattggtgcaccggtcggttcggtaatcgtgggaagcaagaagttcattactaaagcaaggtggttaaggaaaacattaggcggaggaatgagacagatcggcgtgctctgcgccgccgcattggtggctctccatgaaaacgtcgccaagctcgaagatgaccataagaaagccagggttttggcagaaggactgaaccggattgaacggttaagagtgaacgttgcagctgtggaaaccaacatcatatacgtagacataccagaagatccaaaatttggagcagaagaggcatgtaagagcttggaagatgtcggtgtgcttgtcataccccaagctacattcagaatcaggattgttctacaccaccaaatctcagacgtcgacgtggaatatgtactctcttgctttgagaaaatatttcactcgtgaagagaagagaaggcgttattattttaagtaatttcactcgttggacatgtgtaaggttgtatttgaatcttcattcagaataaggttgtatttgaatcgattttcttggtttacaaatgaaaacctttaaccaagaagtagaaaactctttcatc

SEQ ID NO: 22493 - protein, 355 aa, Arabidopsis thaliana
MVTPTTIRTVDLRSDTVTKPTESMRSAMANAEVDDDVLGNDPTALRLEKEVAEIAGKEAAMFVPSGTMGNLISVLVHCDERGSEVILGDDSHIHIYENGGVSSLGGVHPRTVKNEEDGTMEIGAIEAAVRSPKGDLHHPVTKLICLENTQANCGGRCLPIEYIDKVGELAKKHGLKLHIDGARIFNASVALGVPVKRIVQAADSVSICLSKGIGAPVGSVIVGSKKFITKARWLRKTLGGGMRQIGVLCAAALVALHENVAKLEDDHKKARVLAEGLNRIERLRVNVAAVETNIIYVDIPEDPKFGAEEACKSLEDVGVLVIPQATFRIRIVLHHQISDVDVEYVLSCFEKIFHS

SEQ ID NO: 22494 - DNA, 1059 bp, Arabidopsis thaliana
  CDS (1)..(1059)
atggtgatgagaagtgtggatctacgatcagataccgttactagaccgacagatgcgatgcgagaagcaatgtgtaacgcagaggtggatgatgacgtcctcggatatgacccaacggctagacgtcttgaagaggagatggctaagatgatggggaaagaggctgctctgttcgtgccatccgggacaatggggaatctgatcagcgtgatggttcactgcgacgtgagaggcagcgaggtgattcttggcgacaattgtcacatccatgtttacgagaatggagggatatcgactatcgggggagtgcatcctaagacagtcaagaatgaagaagacgggaccatggacttggaggccattgaagcagctattagagatcctaaaggaagcacgttttatccatcaacaaggttgatttgcttggagaacacacatgccaactctggtgggagatgtttgagcgtggaatacactgagaaagttggagagattgcgaagagacatggcgtgaagctccatatcgacggagcccgtcttttcaatgcttccattgcacttggagttccagtccataagcttgttaaggctgcggactccgttcaggtgtgtctctctaaaggtcttggagctccggtaggatctgtaatcgttggttcgcaaagcttcatagagaaggcgaaaacggttaggaaaacattaggtggaggaatgagacaaataggtgttctgtgcgcagccgctttggtcgcactccaagaaaacctcccaaagctacaacatgaccacaagaaggctaagttgttagctgaagggttgaatcaaatgaaagggattagagtaaatgttgcagccgtggagaccaacatggatggttcaagacttacggctgagaaactgcggaagaatctagaggagaatggcattctccttatccggggaaactcatcccggatcagaatagttatacaccaccagataacaacaagtgatgtgcattacacattgtcttgctttcagcaagcaatgctaacgatgcaggaaccaagccgaacctaa

SEQ ID NO: 22495 - protein, 352 aa, Arabidopsis thaliana
MVMRSVDLRSDTVTRPTDAMREAMCNAEVDDDVLGYDPTARRLEEEMAKMMGKEAALFVPSGTMGNLISVMVHCDVRGSEVILGDNCHIHVYENGGISTIGGVHPKTVKNEEDGTMDLEAIEAAIRDPKGSTFYPSTRLICLENTHANSGGRCLSVEYTEKVGEIAKRHGVKLHIDGARLFNASIALGVPVHKLVKAADSVQVCLSKGLGAPVGSVIVGSQSFIEKAKTVRKTLGGGMRQIGVLCAAALVALQENLPKLQHDHKKAKLLAEGLNQMKGIRVNVAAVETNMDGSRLTAEKLRKNLEENGILLIRGNSSRIRIVIHHQITTSDVHYTLSCFQQAMLTMQEPSRT

SEQ ID NO: 22496 - DNA, 1071 bp, Streptomyces coelicolor
  CDS (1)..(1071)
atgaacccaccgaagaccgacgcgcgtcgccatcacgaccccgaggtccgcggtttcgccagtgacaactacgccggggctcacccggaagtactcgccgcgctggcgctggccaacggcgggcaccaggtcgcgtacggcgaggacgactacaccgagaacctccagcgcgtgatccgcagccacttcggctccggcgccgaggcgttcccggtcttcaacggcaccggcgccaacgtcgtcgcgctccaggcggtcaccgaccgctggggcgcggtgatctgcgccgagagcgcgcacatcaacgtcgacgagggcggcgcccccgagcgcatgggcggcctcaagctgctcaccgtccccacccccgacggcaagctcacgcccgagctgatcgaccgccaggcctacggctgggacgacgagcaccgggcgatgccgcaggtcgtctcgatcacccagagcaccgagctgggcaccctctacacgcccgacgagatccgcgccgtctgcgagcacgcccacgcgcacggcatgaaggtgcacctggacggctcccggatagccaacgccgccgcctcgctggacgtgcccatgcgcacgttcaccaacgcggtcggcgtcgacctcctctccctcggcggcaccaagaacggcgcgctgttcggcgaggcggtcgtcgtcctgaaccaggacgccgtgcgccacatgaagcacctgcgcaagctgtccatgcagctggcctccaagatgcgcttcgtgtccgtgcagctggaggcgctgctggccaaggacctgtggctgcgcaacgcccggcactccaacgagatggcccagcgcctggccgagggcgtgcgcgccgtgcacggcgtggagatcctctacccggtgcaggccaacgcggtcttcgcccggctgccgcacgaggtgagcgagcgcctgcagaagcggttccgcttctacttctgggacgaggccgccggcgacgtgcgctggatgtgcgccttcgacaccaccgagaacgacgtcgacgctttcgtgtccgccctcaaggaagagatggcgcgctga

SEQ ID NO: 22497 - protein, 356 aa, Streptomyces coelicolor
MNPPKTDARRHHDPEVRGFASDNYAGAHPEVLAALALANGGHQVAYGEDDYTENLQRVIRSHFGSGAEAFPVFNGTGANVVALQAVTDRWGAVICAESAHINVDEGGAPERMGGLKLLTVPTPDGKLTPELIDRQAYGWDDEHRAMPQVVSITQSTELGTLYTPDEIRAVCEHAHAHGMKVHLDGSRIANAAASLDVPMRTFTNAVGVDLLSLGGTKNGALFGEAVVVLNQDAVRHMKHLRKLSMQLASKMRFVSVQLEALLAKDLWLRNARHSNEMAQRLAEGVRAVHGVEILYPVQANAVFARLPHEVSERLQKRFRFYFWDEAAGDVRWMCAFDTTENDVDAFVSALKEEMAR

SEQ ID NO: 22498 - DNA, 1113 bp, Arabidopsis thaliana
  CDS (1)..(1113)
atggtgacgccaactacaattagaaccgtcgatctccgctccgacacggtgactaaaccaacagagtcaatgcgttcagcaatggcaaacgcggaagtagacgacgacgttttgggaaacgatccaacggctctgcgtttggagaaagaggtggctgagatcgctggaaaagaggcggcgatgtttgttccgtcagggacaatggggaatctgataagcgtgttggtccattgtgatgagagagggagtgaagtgattcttggagacgactctcacattcatatatatgaaaacggcggcgtttcaagcctcggtggtgtgcatccgaggacggtgaagaatgaggaagacggtacgatggagattggtgctattgaagctgccgtgaggagtcccaaaggagatctccatcatccggttactaagcttatatgtcttgagaatactcaagcaaattgtggaggtagatgccttcctatagaatatatagacaaagtcggagaattagccaagaaacatggtttgaagcttcacattgacggagctaggattttcaacgcttctgtggcacttggagttcccgtgaagaggattgttcaagcagctgattctgtctcgatctgtttgtcgaaaggtattggtgcaccggtcggttcggtaatcgtgggaagcaagaagttcattactaaagcaaggtggttaaggaaaacattaggcggaggaatgagacagatcggcgtgctctgcgccgccgcattggtggctctccatgaaaacgtcgccaagctcgaagatgaccataagaaagccagggttttggcagaaggactgaaccggattgaacggttaagagtgaacgttgcagctgtggaaaccaacatcgtaaatccaaaatttggagcagaagaggcatgtaagagcttggaagatgtcggtgtgcttgtcataccccaagctacattcagaatcaggattgttctacaccaccaaatctcagacgtcgacgtggaatatgtactctcttgctttgaggtatgtagtttgctttcatctactgatatgtgctttgatatttttaatttctttgctacgctttattcattcattgattaa

SEQ ID NO: 22499 - protein, 370 aa, Arabidopsis thaliana
MVTPTTIRTVDLRSDTVTKPTESMRSAMANAEVDDDVLGNDPTALRLEKEVAEIAGKEAAMFVPSGTMGNLISVLVHCDERGSEVILGDDSHIHIYENGGVSSLGGVHPRTVKNEEDGTMEIGAIEAAVRSPKGDLHHPVTKLICLENTQANCGGRCLPIEYIDKVGELAKKHGLKLHIDGARIFNASVALGVPVKRIVQAADSVSICLSKGIGAPVGSVIVGSKKFITKARWLRKTLGGGMRQIGVLCAAALVALHENVAKLEDDHKKARVLAEGLNRIERLRVNVAAVETNIVNPKFGAEEACKSLEDVGVLVIPQATFRIRIVLHHQISDVDVEYVLSCFEVCSLLSSTDMCFDIFNFFATLYSFID

SEQ ID NO: 22500 - DNA, 1327 bp, Drosophila melanogaster
  CDS (79)..(1230)
agtttttcgctagctctgaacggagcacgttgtgtgatttttttcgcttagtttttttatcaattaggtttccaaaaaatgaccacccattccgttgttgacctgcgctcggacaccgtcagccagccgacggacaagatgcgggcccggatggccaccgccgtggtcggggatgacgtttatggcgaggatcccaccgtcaacgaactggaggcgcgaacagcggccattttcggcaaggaggcgggcctctttgtgcccagcggcaccatgggaaatctactggcaattatggttcactgccatcgtcgtggcacggaggccctggtcggcgatttatcgcacatctttctgtacgaacaaggtggcgcctcgcatttggccggagtccaattagccactctgaagaacgagcaggatggcacctttagtctgcaggatctgcgccgcaggatacgccacgaagactgccacgagcccatcacctcgctggtggtggtggagcagacccacaatatctgcggtggcaaagtggtgcctctggccttcttggatgagctagctgctctggtccgacagccgggcgtgggcactgggaacgcccgtatcgctctacacatggacggagcgagggtctttaatgcggccaccgccttgggcgtgggagtggagcgcatctgccgcgatttcgattcggtatctatctgcctcagcaagggcttatcggctcccgtgggatccgtgttagtcggctccaaggccttcatttcggaagcccatcgactgcgcaaagctttgggaggcggaatgcggcaggtgggagtgttagcagcagctggactggtagctttggatgaagtggtaccacttctgagcaaagatcacgagcggaccaataaaattgccaacgctatatatgaactgaaaagtcccaacattaccgtacacgtgtcgtctgtccagagcaatatccttctggtagagataacccaacccaaactgacggccagtgagttctccacccggttgagcatcgttgatgctggtgaagtggaagccggagtgaaggacaaaaacggagccggaatcgtggtgaaggctagtgcccgggattgggcatttgcgagacttgtgctctaccatcaggtggacgatgagcaagtggacctggccatcaggaagctgaagtacgtcatcggccagtacgacaagcaatttcccaggacctagacatttgtaattcttttgaatattactggaaagacaaacacaattagattttgcattttgtcgtttaattaaagacatagagggagcaaaagaagat

SEQ ID NO: 22501 - protein, 383 aa, Drosophila melanogaster
MTTHSVVDLRSDTVSQPTDKMRARMATAVVGDDVYGEDPTVNELEARTAAIFGKEAGLFVPSGTMGNLLAIMVHCHRRGTEALVGDLSHIFLYEQGGASHLAGVQLATLKNEQDGTFSLQDLRRRIRHEDCHEPITSLVVVEQTHNICGGKVVPLAFLDELAALVRQPGVGTGNARIALHMDGARVFNAATALGVGVERICRDFDSVSICLSKGLSAPVGSVLVGSKAFISEAHRLRKALGGGMRQVGVLAAAGLVALDEVVPLLSKDHERTNKIANAIYELKSPNITVHVSSVQSNILLVEITQPKLTASEFSTRLSIVDAGEVEAGVKDKNGAGIVVKASARDWAFARLVLYHQVDDEQVDLAIRKLKYVIGQYDKQFPRT

SEQ ID NO: 22502 - DNA, 1014 bp, Zymomonas mobilis
  CDS (1)..(1014)
atgcaaagtattcgtttcttttccgataacgctgccactgtcgcagcccccgtcatggatgctattatcgccgccaatcaaagcgacatggcttatgattccgataaatggagtcagaaacttgacgctattttctcggaattattcggaacagacgtaacggctcattgggcagtcaccggaacggcggccaatgccctgtctttatccgctatctgcccgccttttgggggtgttttatgcagtcaggatgcccatgtccaaacggatgaggggggcgctcctgaattttacaccggcggttccaaattgctgttggttccgggcgaaggcgctaaaattacgcccgaagccttaaagacaagagccgaagcgattgctgacagcgtccatatggtgcaacctcatgcggtgaccattaccaattcaactgaattaggtcaggtttacacgccagaagaaacagcggctattggtgccgttgcccgtgaaaaaggcttgcgtttccatctggatggcgcccgttttgctaatgcggttgctgctctcggctgcaatccggctgatctgacatggaaagccggtgttgatttgatgagcttcggctttaccaaaaatggtgccatggccgcagaagcgatcgttttcttcgatcgtgagcttgctgcccacaataaacgtcgccggaaacgggccggtcatttgctgtccaaaggtcgcttcattgccgcccaaatcgaagccatgttgaaaaatgatttatggcttgatctggcgcgttcttccaataccgttgccaaacggattgcagaagccgttgatcccaaaagacatgcctatccggtcaaagccaatgaagtcttcttattcatctcgatggaagaacgggcagaattgcggaaacagggctttgttttctatgactggggtcatgacaaaatccgtctggttgcctcatgggatcagccagaacatgaagtcgttgcattagaaaaagccttaaaggctttataa

SEQ ID NO: 22503 - protein, 337 aa, Zymomonas mobilis
MQSIRFFSDNAATVAAPVMDAIIAANQSDMAYDSDKWSQKLDAIFSELFGTDVTAHWAVTGTAANALSLSAICPPFGGVLCSQDAHVQTDEGGAPEFYTGGSKLLLVPGEGAKITPEALKTRAEAIADSVHMVQPHAVTITNSTELGQVYTPEETAAIGAVAREKGLRFHLDGARFANAVAALGCNPADLTWKAGVDLMSFGFTKNGAMAAEAIVFFDRELAAHNKRRRKRAGHLLSKGRFIAAQIEAMLKNDLWLDLARSSNTVAKRIAEAVDPKRHAYPVKANEVFLFISMEERAELRKQGFVFYDWGHDKIRLVASWDQPEHEVVALEKALKAL

SEQ ID NO: 22504 - DNA, 1149 bp, Ashbya gossypii
  CDS (1)..(1149)
atgaatcaggatatggaactaccagaggcgtacacgtcggtttcgaacgacttccgttcggacacgttcaccactccaacgcgcgaaatgatcgaggctgcgctaacggcgaccatcggtgacgccgtctaccaagaggacatcgacacgttgaagctagaacagcacgtcgccaagctggccggcatggaggccggtatgttctgcgtatctggtactttgtccaaccagattgctttgcggacccacctaactcagccaccatattcgattctttgcgactaccgtgcgcatgtgtacacgcacgaggctgcggggttggcaattttgtcccaggccatggtgacacctgtcattccttccaacggcaactacttgactttggaagacatcaagaagcactacattcctgatgatggcgacatccacggtgctccaacaaaggttatctcgttggaaaacaccttgcacggtatcattcacccactagaggagcttgttcggatcaaggcttggtgtatggagaacgacctcagactacactgcgatggtgcgagaatctggaacgcgtccgcagaatccggtgtgcctctaaaacagtacggagagctattcgactccatttccatctgcttgtccaagtccatgggtgccccaatgggctccattctcgtcgggtcgcacaagttcataaagaaggcgaaccacttcagaaagcagcaaggtggtggtgtcagacagtctggtatgatgtgcaagatggcgatggtggctatccagggtgactggaagggcaagatgaggcgttcgcacagaatggctcacgagctggccagattttgcgcagagcacggcatcccattggagtcgcctgctgacaccaactttgtctttttggacttgcagaagagcaagatgaaccctgacgtgctcgtcaagaagagtttgaagtacggctgcaagctaatgggcgggcgtgtctccttccactaccagatatctgaggagtcccttgagaagatcaagcaggccatcctagaggcgttcgagtactcgaagaagaacccttacgatgaaaacggccccacgaagatctacagaagtgagtccgctgacgctgtgggtgagatcaagacctacaagtattaa

SEQ ID NO: 22505 - protein, 382 aa, Ashbya gossypii
MNQDMELPEAYTSVSNDFRSDTFTTPTREMIEAALTATIGDAVYQEDIDTLKLEQHVAKLAGMEAGMFCVSGTLSNQIALRTHLTQPPYSILCDYRAHVYTHEAAGLAILSQAMVTPVIPSNGNYLTLEDIKKHYIPDDGDIHGAPTKVISLENTLHGIIHPLEELVRIKAWCMENDLRLHCDGARIWNASAESGVPLKQYGELFDSISICLSKSMGAPMGSILVGSHKFIKKANHFRKQQGGGVRQSGMMCKMAMVAIQGDWKGKMRRSHRMAHELARFCAEHGIPLESPADTNFVFLDLQKSKMNPDVLVKKSLKYGCKLMGGRVSFHYQISEESLEKIKQAILEAFEYSKKNPYDENGPTKIYRSESADAVGEIKTYKY

SEQ ID NO: 22506 - DNA, 1530 bp, Candida albicans
  CDS (117)..(1241)
aagcttttggtttgctattttggtttaatagattaataaccttttttcctttttcctttccttttcccttttttttgcatctatacgacacatattactcagcacaccacattaatatgacagcagacgaagaagaaacttttaccacctttaatgagttcagaagcgatacattcactgttccaactagggccatggttgaagatggatttatgaatgccacatttggtgattccgtataccaagaagacgaaaccacattacgtttggaaagtaaaatgtgtgagataactgggaaaccagcagctttattttgtgttagtggaaccatgtcaaatcaaattggattaagagctaatcttgttcaacctccatatagtatattatgtgactaccgtgctcatgtgtttttacatgaagctggtggattggctacattgagtcaagctatggtacatccagttcgaccatcaaatggaaattacttgacctttgaagatgttttgggcaatgtaacttatgatgatgatggagatattcatgctgctccaaccaaagtaatctcattggaaaataccttacacggaatcataattccaatagaagaaatacgtaaaatcagtgaattttgtcgtgaaaatgatatcaggttgcatttagacggggccagattatggaatgctagtgtggcaaccggaattagtattaaagaatactgttcatattttgacagtgtttcattgtgtttatccaagtcattgggagcaccaattggttcagtattggttggagatgaaaaattcattcgtaaagctaaccatttcaaaaaacaaagtggtggaggaataaggcaggccggtataatgtctgctatggccatacatgctattgattataatctttcaaaacttgaattatcacacaattatgctaaacaaattggcgacttttgccaagaacacggaatcaaattggaatcaccagtggataccagtcttgtgtttctcgatttgaaggccaataaaatggatccgaatagattagttgaattgggaagaacaaagtataacgtcaagcttatgggacaaagaatagcatgtcatttccaattgagtcaagaaagtgttgataatgtgaagaaatgtattttagagtgtttggaatatcatcaaaaacatcctcataaagatgatggtaggaataataagaagatgtatagtttggacgccattaaaaaataaatgaattgtaatgagtctattcttgtcgtagtattgtaaaactgtctcttgttgtttggttgcaattgcacgtggcaaatttaagttgtatgcttttttctttggggcaattgtcgtttttttttttgggtgacgcttcttggtgtaatttggtgtgtgtatctattgttgtttgttttttgggcaaatatatatttatcacttattattcatccatccatcgattaattagcaatcgtttattttactttatttcgagtttactttttcctttttttacttttctttt

SEQ ID NO: 22507 - protein, 374 aa, Candida albicans
MTADEEETFTTFNEFRSDTFTVPTRAMVEDGFMNATFGDSVYQEDETTLRLESKMCEITGKPAALFCVSGTMSNQIGLRANLVQPPYSILCDYRAHVFLHEAGGLATLSQAMVHPVRPSNGNYLTFEDVLGNVTYDDDGDIHAAPTKVISLENTLHGIIIPIEEIRKISEFCRENDIRLHLDGARLWNASVATGISIKEYCSYFDSVSLCLSKSLGAPIGSVLVGDEKFIRKANHFKKQSGGGIRQAGIMSAMAIHAIDYNLSKLELSHNYAKQIGDFCQEHGIKLESPVDTSLVFLDLKANKMDPNRLVELGRTKYNVKLMGQRIACHFQLSQESVDNVKKCILECLEYHQKHPHKDDGRNNKKMYSLDAIKK

SEQ ID NO: 22508 - DNA, 1041 bp, Pseudomonas sp
  CDS (1)..(1041)
atgaccgatcaaagccaacaattcgccagcgacaactattccggtatctgccccgaagcctgggccgccatggaaaaggccaaccacggccacgaacgtgcctatggcgacgaccaatggaccgcacgggcagccgatcactttcgcaagctgtttgaaaccgactgcgaagtgttctttgccttcaacggcaccgccgccaactcgctggcgctatcgtcgttgtgccagagctaccacagcgtgatctgctcggagaccgcccacgtcgaaaccgacgaatgcggcgcgccggagtttttctccaacggttccaagctgctgaccgcccgcagcgaaggcggcaagctgaccccggcttcgatccgcgaagtagcgctcaagcgccaggacatccactaccccaaaccccgggtagtgaccatcacccaggctaccgaggtgggcagcgtctaccgcccggatgaactcaaggcgatcagcgccacctgcaaggaactgggcctgaacctgcacatggacggtgctcgtttcagcaacgcctgcgccttcctcggctgcaccccggccgagctgacctggaaggccggtatcgacgtgctgtgctttggcggcaccaaaaacggcatggcggtgggtgaggcgatcctgttcttcaaccgcaaactggccgaggacttcgactaccgttgcaagcaggccgggcaactggcgtcgaaaatgcgcttcctctcggcgccctgggtaggcctgctggaggacggcgcctggctgcgccacgccgcccatgccaaccactgcgcacaattgctcagctcgctggtcgcggacatccccggcgttgaactgatgttcccggtggaggccaacggtgtattcctgcaaatgtcggaacccgccctggaagcattgcgcaacaagggctggcgtttttacaccttcatcggcagcggcggcgcccggttcatgtgctcctgggacaccgaggaagcccgggtacgcgaactggcggcagatatccgcgccgtgatgagcgcctga

SEQ ID NO: 22509 - protein, 346 aa, Pseudomonas sp
MTDQSQQFASDNYSGICPEAWAAMEKANHGHERAYGDDQWTARAADHFRKLFETDCEVFFAFNGTAANSLALSSLCQSYHSVICSETAHVETDECGAPEFFSNGSKLLTARSEGGKLTPASIREVALKRQDIHYPKPRVVTITQATEVGSVYRPDELKAISATCKELGLNLHMDGARFSNACAFLGCTPAELTWKAGIDVLCFGGTKNGMAVGEAILFFNRKLAEDFDYRCKQAGQLASKMRFLSAPWVGLLEDGAWLRHAAHANHCAQLLSSLVADIPGVELMFPVEANGVFLQMSEPALEALRNKGWRFYTFIGSGGARFMCSWDTEEARVRELAADIRAVMSA

SEQ ID NO: 22510 - DNA, 1170 bp, Cochliobolus carbonum
  CDS (1)..(1170)
atgtcgaacatggttttgaatggaaacattgacaaatccgataggaattccatactagacatacttcaatcgcttgagaatattgcatggggacaaccaggctctgcaaggtgcgattttaggagtgatgttattacacgccctagccttaggatgttgtccgcggtcctcaagactacactcggcgatgacgtatttcgagaagacctaacgactgcccacttcgaagcgcatgtggctgaaatcagcggccgagaagaaggcatgttcgtgatcacagggacgatggccaatcagctttgtttgcatgctctagtctcaactagaccgtgtgggattttacttagctcagagtcccatgccatacactatgaggcaggtggctcttcgatgcttagcggcgccatgcttcagcctgtgcagccgtcgaatggtaaatatctgagagtggaagatttggaggagcacgcaattctaaccgacgatgtccacaaatgccccacaagcattgtttctatggaaaatacagctggtggagcagtcgttcctgtccatgagctccgccgcatccgggattgggcaaagcaaaataacgtgaggactcacctggacggtgctagacttttcgaggctgttgctaccggtgctgggactctcaaagaatattgcagccttattgacctagtctccgtggattttagtaagaatcttggagccccaatgggcgcaatgattcttggtgacaaaaaattgattcagcagatgcgaagaactcgaaaagggattggaggaggaatgagacaaggaggggtaatcactgcagctgcacgggaggcactgtttgaaaactttggactgggagcggaaatcgaaagtcaaaccctattgcaagtgcacaaagtcgcaaagcgtctaggggaagaatggactagaaaaggtgggaagttgagcaaagagatcgagacaaatatcatatggctcgatcttgatgcggttggaattaagaaaagtcaatttattgataagggaagggaatatggggtgattctagacggctgtcgcattgtttgccatcaccagattgatatatatgcagtagaggctcttatcgacgtcttccatgatatactaaaagcagatcctatcaaaaacaagaatagcgatagatag

SEQ ID NO: 22511 - protein, 389 aa, Cochliobolus carbonum
MSNMVLNGNIDKSDRNSILDILQSLENIAWGQPGSARCDFRSDVITRPSLRMLSAVLKTTLGDDVFREDLTTAHFEAHVAEISGREEGMFVITGTMANQLCLHALVSTRPCGILLSSESHAIHYEAGGSSMLSGAMLQPVQPSNGKYLRVEDLEEHAILTDDVHKCPTSIVSMENTAGGAVVPVHELRRIRDWAKQNNVRTHLDGARLFEAVATGAGTLKEYCSLIDLVSVDFSKNLGAPMGAMILGDKKLIQQMRRTRKGIGGGMRQGGVITAAAREALFENFGLGAEIESQTLLQVHKVAKRLGEEWTRKGGKLSKEIETNIIWLDLDAVGIKKSQFIDKGREYGVILDGCRIVCHHQIDIYAVEALIDVFHDILKADPIKNKNSDR

SEQ ID NO: 22512 - DNA, 25 bp, Primer
atgactgaattcgaattgcctccaa

SEQ ID NO: 22513 - DNA, 26 bp, Primer
tcagtatttgtaggtttttatttcgc

SEQ ID NO: 22514 - protein, 97 aa, consensus
  MISC_FEATURE (1)..(97): consensus for the disclosure of xaa see table XV
NPXXXXXXXXXXXXXXXXXXXXXXXXXXDXXXXXXXXXXXXXXXXXXXXXXXXXXXXXXXXXXXXXXXXXXXXXXXXXXXXXXXXXKXXXXXXRXXX

SEQ ID NO: 22515 - protein, 116 aa, consensus
  MISC_FEATURE (1)..(116): consensus for the disclosure of xaa see table XV
XXXXGXPXXXXLXXXXXXXXXXXXXXXXXXXXXXXXXXXXXXXYGXXXGXXXXRXXXXXXXXXXXXXXXXXXXXXXXXXXXXXXXGXXXXXXXXXXXXXXXXXXXXXXXXXXXXXY

SEQ ID NO: 22516 - protein, 44 aa, consensus
  MISC_FEATURE (1)..(44): consensus for the disclosure of xaa see table XV
YXXPXXXNPXXXXXXXXXXXXXXXXAXXXXXXXXXDXXYXXLXX

SEQ ID NO: 22517 - protein, 162 aa, consensus
  MISC_FEATURE (1)..(162): consensus for the disclosure of xaa see table XV
GXXXXXXXFSKXXXPGXRXGXXXXXXXXXXXXXXXXGXXXSGGXXXXXXXXXXXXXXXXXXXXXXXXXXXXXXXXXRXXXXXXXXXXXXXXXXXXXXXXXXXXGGYFXWXXXPXXXXXXXXXXXXXXXXXXXXXXGXXFXXXXXXXXXXXXXXXXXRLXXXX

SEQ ID NO: 22518 - protein, 487 aa, consensus
  MISC_FEATURE (1)..(487): Xaa in all Positions is any amino acid
XXXXXXXXXXXXXXXXXXXXXXXXXXXXXXXXNXXXGXPXXXXLXXXXXXXXXXXXXXXXXXXXXXXXXXXXXXXYGXXXGXXXXRXXXXXXXXXXXXXXXXXXXXXXXXXXXXXXXGXSXXXXXXXXXXXXXXXXXXXXXXXXXXTYXXXXXXXXXXXXXXXXXXXXXXXXXXXXXXXXLXXXXXXXXXXXXXXXXXXXXXXXXXXXXXXXXXXXXYXXPTXXNPXGXXXSXXXXXXLXXXARXXDXLXXXDDVYXXLXXXXXXXXXXXXXXXXXXXXXXXXXXXXXXXXXXXXGXXXSNXXFSKXXXPGXRXGXXEXXXXXXXXXLXXXGXXXSGGXXXXXXXXXXXXXXXXGXXXXXXXXXXXXXYXXRXXXXXXXXXXXXPXXXXXXXXXXXXXGGYFXWXXXPXXXXXXXXXXXXXXXXXXXXXXGXXFXXXXXXXXXXXXXXXXXRLXXXFXEXXXXXXGXXXXXXXXXXXXXXXXXXXXX

SEQ ID NO: 22519 - protein, 73 aa, consensus
  MISC_FEATURE (1)..(73): consensus for the disclosure of xaa see table XV
CCXXGXXXXGXXXGXXXXXXXXXXXXXXXXXXXXXXXXXXXXXXXXXXXXXXNXXLXADXXAXXXYXXXXXDX

SEQ ID NO: 22520 - protein, 39 aa, consensus
  MISC_FEATURE (1)..(39): consensus for the disclosure of xaa see table XV
HXXXXXXXXVXXXXXXXXXXXXXXXXXXXGYXXGAKXXX

SEQ ID NO: 22521 - protein, 88 aa, consensus
  MISC_FEATURE (1)..(88): consensus for the disclosure of xaa see table XV
XAHPSXXXXEXXXXXXXXXPXXIXAAEXDXXFPXXXRXXXEXXLXXXXXXYXXXLXSXVXHGFAXRXXXXXXXXXXXXXXXXXXXXXW

SEQ ID NO: 22522 - protein, 264 aa, consensus
  MISC_FEATURE (1)..(264): Xaa in all Positions is any amino acid
MASXXXXXCCXXGXXHXGXXXGXXXXXXXXXXXXXXXXXXXXXXXXVXXXXXXXXXXXXXNXXLXADQXAXXGYXXXXXDILXXDXXXXXXXXXXXXXXXXXXXXXXXXXXHXXXXXXXXVXXXXXXLXXXXXXXXXGXXGYCXGAKXXXXXXXXXXXXXXXXXXXXAHPSXVXXEEXXAIXXXXPXXISAAEXDXIFPXEXRHXXEXXLKXXXXXYQXXLFSGVXHGFAXRXDXXXXXXXXAXXXXXXXXXXWFXXXXXXXXX

SEQ ID NO: 22523 - protein, 77 aa, consensus
  MISC_FEATURE (1)..(77): consensus for the disclosure of xaa see table XV
XXXXXXXXXXXDXXXXXXXXXXXXXXXXXXXXXXXDXXXXXXXXXXXXXXXXXXXXXXXXXXXXXKXXXGXXXXXXG

SEQ ID NO: 22524 - protein, 51 aa, consensus
  MISC_FEATURE (1)..(51): consensus for the disclosure of xaa see table XV
XXXXXXXXXXXXXXXXXXXXXRXXXXXXXXXXXXXXLXXXXXXXXXXXXXX

SEQ ID NO: 22525 - protein, 1090 aa, consensus
  MISC_FEATURE (1)..(1090): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXYXRXXXPTXXXXXXXXXXLEXXXXXXXXXXXSGXXAXXXXXXXXXXXGXXXXXXXXXYXXXXXXXXXXXXXXXXXXXXXXXXXXXXXXXXXXXXXXXXXXXXXXXXXXXXXXEXPXXXXXXXXDXXXXXXXXXXXXXXXXXXXXXXXDNTXXXXXXXXPXXXXPLXXGXDXXXXSXTKYXXGHXDXXXGXXXXXXXXXXXXXXXXXXXXXXXXXXXXXXXXXXXXXXXXXXXXXXXXXXXXXGXXXXPXXXXXXXRGXXTLXXRXXXXXXXAXXXAXXLXXXXXXXVXXVXXPXXXXXXXXXXXXXXXXXXXXXXXXXXXXXXXXXXXXXXXXXXXXXXXXXXXXXXXXXXXXSXGXXESLXXXXXXXXXXXXXXXXXXXXXXXXXXXXXXXXXRXXXGXEXXXDXXXDXXXXXXXXXXXXXXXXXXXXXXXXXXXXXXXXX

SEQ ID NO: 22526 - protein, 114 aa, consensus
  MISC_FEATURE (1)..(114): consensus for the disclosure of xaa see table XV
XXPXXXXXXXXXXXRXXXXXXXXXXXXXXXXXXXXXXXXXXXXXXXXGXXXGXXXXXXXXXXXXXXXXXXXXXXXXXXXXXXXXXXXXXXXXXXXXXXXXXXXXXXXXGWXXXX

SEQ ID NO: 22527 - protein, 98 aa, consensus
  MISC_FEATURE (1)..(98): consensus for the disclosure of xaa see table XV
XXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 22528 - protein, 47 aa, consensus
  MISC_FEATURE (1)..(47): consensus for the disclosure of xaa see table XV
YXXXXXXXXXXXXXXXXXXXXXXXXXXXXXXXXXXYXPXXXXKXXXX

SEQ ID NO: 22529 - protein, 70 aa, consensus
  MISC_FEATURE (1)..(70): consensus for the disclosure of xaa see table XV
YXXXXXPHGXXXXXXXXXXXXXXXXXXXXXXXXXXXXXXXXXXFXXPXXRXXXXXXGXXXXXXXXXXXXL

SEQ ID NO: 22530 - protein, 60 aa, consensus
  MISC_FEATURE (1)..(60): consensus for the disclosure of xaa see table XV
XXXGGAXEXXXXXXXXXXXXXXXRXGFXXXAXXXGXXXXVPXXXFGEXXXXXXXXXXXXX

SEQ ID NO: 22531 - protein, 79 aa, consensus
  MISC_FEATURE (1)..(79): consensus for the disclosure of xaa see table XV
QXXXXXXXGXXXXXXXXXXXXXXXXXGXXPXXXXXXXXXGXPXXXXXXXXXXXXXXXXXXXXXHXXXXXXXXXXXXXXX

SEQ ID NO: 22532 - protein, 678 aa, consensus
  MISC_FEATURE (1)..(678): Xaa in all Positions is any amino acid,
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQXXXXXXXXXXXXXXXXXXXXXXXXXXXXXXXXXWXXXXXYXXXXXXDXXXXXXXXXXXXXXXXRXXXXWXXXXXYFPXXLXKTXXLXXXXNXXXXXXXXXXXXXXXXXXXXXXXXXXXXXXXXXXXXXXXXXXXXXXXYXXGXHPHGXXXXGXXXXXXTXXXXXXXXFPGXXXXLXXLXXXFXXPXXRXXXXXXGXXXXXXXXXXXXLXXXXXXXXXXXXXXXXXXXXXIXXGGAXEXLXXXPGXXXLXLXXRKGFXXXAXXXGXXXLVPXXXFGENXXXXQXXXXXXSXXXXXXXXXQXXXXXXXGXXXXXXXXRGXFXXXXXGXXPXXXPIXXVVGXPIXVXXXXXXXXXPXXXXXXXXHXXYXXXLXXXXXXXKXXXXXXXXXXXXXXX

SEQ ID NO: 22533 - protein, 73 aa, consensus
  MISC_FEATURE (1)..(73): consensus for the disclosure of xaa see table XV
XXXXXXXXXXXXXXXXXXXXXXGXXXXXXXXXXXXXXXXXXXXXXXXXXXXXXXXXXXXXXXXXXXXXXXXXX

SEQ ID NO: 22534 - protein, 104 aa, consensus
  MISC_FEATURE (1)..(104): consensus for the disclosure of xaa see table XV
XXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXX

SEQ ID NO: 22535 - protein, 47 aa, consensus
  MISC_FEATURE (1)..(47): consensus for the disclosure of xaa see table XV
XXCCXCXXXXXXRDXCXXXXXXXXXXXXCXXXXXXXXXCXXXXGXXX

SEQ ID NO: 22536 - protein, 96 aa, consensus
  MISC_FEATURE (1)..(96): Xaa in all Positions is any amino acid
XXXXXXXXXXXXXXXXXXXXXXXXXXXXXXXXXXXXXXXXXXXKXKXCCXCXXXKXXRDXCXXXXGXXXXXXXCXXXIXXXXXCXXXXGFXXXXXX

SEQ ID NO: 22537 - protein, 194 aa, consensus; identical to SEQ ID NO: 4334
  MISC_FEATURE (1)..(194): consensus for the disclosure of xaa see table XV

SEQ ID NO: 22538 - protein, 61 aa, consensus; identical to SEQ ID NO: 4335
  MISC_FEATURE (1)..(61): consensus for the disclosure of xaa see table XV

SEQ ID NO: 22539 - protein, 15 aa, consensus
  MISC_FEATURE (1)..(15): consensus for the disclosure of xaa see table XV
LXXXXXXNXXXNAXX

SEQ ID NO: 22540 - protein, 922 aa, consensus; identical to SEQ ID NO: 18673
  MISC_FEATURE (1)..(922): Xaa in all positions is any amino acid.

SEQ ID NO: 22541 - protein, 23 aa, consensus
  MISC_FEATURE (1)..(23): consensus for the disclosure of xaa see table XV
SXXTXXXXXXXLXXXXXXXXXXG

SEQ ID NO: 22542 - protein, 222 aa, consensus; identical to SEQ ID NO: 5291
  MISC_FEATURE (1)..(222): Xaa in all positions is any amino acid.

SEQ ID NO: 22543 - protein, 55 aa, consensus
  MISC_FEATURE (1)..(55): consensus for the disclosure of xaa see table XV
XXXXXXXXEXXXXXXXXXXXXXXXXXXXXXXXXXXXXXXXXXXXXXXXXXXXGXX

SEQ ID NO: 22544 - protein, 101 aa, consensus
  MISC_FEATURE (1)..(101): consensus for the disclosure of xaa see table XV
XXXXGXXXXDXXXXXXXXXXXXXXXXXXXXXXXXXXXXXXXXXXXXXXXXXXXXXXXXXXXXXXXXXXXXXXXXXXXPXXXXXXXXXXXXRXXXXXXXXXX

SEQ ID NO: 22545 - protein, 113 aa, consensus
  MISC_FEATURE (1)..(113): consensus for the disclosure of xaa see table XV
XXXYXXXXXXXXXXXDCSXXXXXXXXXXXXXXXXXXXXXXXXXXXXXXXXXXXXXGDLXXFXXXXXXXXXHXXXXXXXXXXXXXXXXXXXXXXXXXXXXXXXYXXXXXXXXXR

SEQ ID NO: 22546 - protein, 200 aa, consensus
  MISC_FEATURE (1)..(200): Xaa in all positions is any amino acid.
  for the disclosure of the amendment in position 190 see table XVI
LXXCXXXXXXXXXXXXXXXXXXXXXXXXXXXXXXXXXXXXXXXXXXXXXXXXXXXXXXXXXXXXXXXXXXXXXXXXXXXXXXXXXXXGXXYXXGGXXXXXGXDCSGXVXXXXXXXXXXXLPRXXXXXXXXXXXXXXXXXXXXGDLXFFXXXXXXXXXXHVGIYXXXXXFXHXXXXXXXXXVXXXXXXXXYWXXXXXXXXR

SEQ ID NO: 22547 - protein, 189 aa, consensus; identical to SEQ ID NO: 10198
  MISC_FEATURE (1)..(189): Xaa in all positions is any amino acid.

SEQ ID NO: 22548 - protein, 136 aa, consensus; identical to SEQ ID NO: 10195
  MISC_FEATURE (1)..(136): Xaa in all positions is any amino acid.

SEQ ID NO: 22549 - protein, 46 aa, consensus; identical to SEQ ID NO: 546
  MISC_FEATURE (1)..(46): xaa in  all positions is any amino acid.

SEQ ID NO: 22550 - protein, 289 aa, consensus; identical to SEQ ID NO: 10197
  MISC_FEATURE (1)..(289): Xaa in all positions is any amino acid.

SEQ ID NO: 22551 - protein, 71 aa, consensus
  MISC_FEATURE (1)..(71): consensus for the disclosure of xaa see table XV
XXXXXXXXXXXXXXXXXXXXXXXXTNXLXLNAXXEXXRXGXXGXXFXVVAXXVXXLXXXXXXXXXXXXXXX

SEQ ID NO: 22552 - protein, 1274 aa, consensus
  MISC_FEATURE (1)..(1274): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXLXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXLXXXXXXQAXXXXXTXXXXXXXXXXVXXXXXXAXXAXXXXXXXXXXAXXXXXXXXXXXXXXXXXXXXXXXXXXXMXXIXXXSXXIXXIXXVIXXIAFQTNXLALNAXVEAARAGEXGXGFAVVAXEVRXLAXRSXXAAXEIXXLIXXXXXXXXXXXXXXXXSXXXXXXGXXXXXXXGXXXXXXXXXXXXXXXXXXXIXXXXXEQXXGXXXXXXXXXXXDXXTQXNAXXXEXXXXXXXXXXXXXXXLXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 22553 - protein, 98 aa, consensus; identical to SEQ ID NO: 18676
  MISC_FEATURE (1)..(98): consensus for the disclosure of xaa see table XV

SEQ ID NO: 22554 - protein, 47 aa, consensus; identical to SEQ ID NO: 18677
  MISC_FEATURE (1)..(47): consensus for the disclosure of xaa see table XV

SEQ ID NO: 22555 - protein, 117 aa, consensus; identical to SEQ ID NO: 18678
  MISC_FEATURE (1)..(117): consensus for the disclosure of xaa see table XV

SEQ ID NO: 22556 - protein, 75 aa, consensus; identical to SEQ ID NO: 18679
  MISC_FEATURE (1)..(75): consensus for the disclosure of xaa see table XV

SEQ ID NO: 22557 - protein, 45 aa, consensus; identical to SEQ ID NO: 4350
  MISC_FEATURE (1)..(45): consensus for the disclosure of xaa see table XV

SEQ ID NO: 22558 - protein, 95 aa, consensus; identical to SEQ ID NO: 7414
  MISC_FEATURE (1)..(95): consensus for the disclosure of xaa see table XV

SEQ ID NO: 22559 - protein, 90 aa, consensus; identical to SEQ ID NO: 7415
  MISC_FEATURE (1)..(90): consensus for the disclosure of xaa see table XV

SEQ ID NO: 22560 - protein, 11 aa, consensus
  MISC_FEATURE (1)..(11): consensus for the disclosure of xaa see table XV
XSXSDRXRYYW

SEQ ID NO: 22561 - protein, 414 aa, consensus; identical to SEQ ID NO: 7417
  MISC_FEATURE (1)..(414): Xaa in all positions is any amino acid
  for the disclosure of the amendment in position 285 see table XVI

SEQ ID NO: 22562 - protein, 369 aa, consensus; identical to SEQ ID NO: 7418
  MISC_FEATURE (1)..(369): Xaa in all positions is any amino acid
  for the disclosure of the amendment in position 285 see table XVI

SEQ ID NO: 22563 - protein, 53 aa, consensus; identical to SEQ ID NO: 5292
  MISC_FEATURE (1)..(53): consensus for the disclosure of xaa see table XV

SEQ ID NO: 22564 - protein, 75 aa, consensus; identical to SEQ ID NO: 5293
  MISC_FEATURE (1)..(75): consensus for the disclosure of xaa see table XV

SEQ ID NO: 22565 - protein, 100 aa, consensus; identical to SEQ ID NO: 5294
  MISC_FEATURE (1)..(100): consensus for the disclosure of xaa see table XV

SEQ ID NO: 22566 - protein, 46 aa, consensus; identical to SEQ ID NO: 5295
  MISC_FEATURE (1)..(46): consensus for the disclosure of xaa see table XV

SEQ ID NO: 22567 - protein, 688 aa, consensus; identical to SEQ ID NO: 5296
  MISC_FEATURE (1)..(688): Xaa in all positions is any amino acid

SEQ ID NO: 22568 - protein, 45 aa, consensus
  MISC_FEATURE (1)..(45): consensus for the disclosure of xaa see table XV
XXXXXXXXXXXXXXXXXXXGXXXXXXXXPXXXXXXXXXXXXXXXX

SEQ ID NO: 22569 - protein, 37 aa, consensus; identical to SEQ ID NO: 4448
  MISC_FEATURE (1)..(37): consensus for the disclosure of xaa see table XV

SEQ ID NO: 22570 - protein, 46 aa, consensus; identical to SEQ ID NO: 4449
  MISC_FEATURE (1)..(46): consensus for the disclosure of xaa see table XV

SEQ ID NO: 22571 - protein, 50 aa, consensus; identical to SEQ ID NO: 4450
  MISC_FEATURE (1)..(50): consensus for the disclosure of xaa see table XV

SEQ ID NO: 22572 - protein, 38 aa, consensus; identical to SEQ ID NO: 4451
  MISC_FEATURE (1)..(38): consensus for the disclosure of xaa see table XV

SEQ ID NO: 22573 - protein, 470 aa, consensus; identical to SEQ ID NO: 18690
  MISC_FEATURE (1)..(470): Xaa in all positions is any amino acid.

SEQ ID NO: 22574 - protein, 16 aa, consensus
  MISC_FEATURE (1)..(16): consensus for the disclosure of xaa see table XV
XXXXXXXXXXXXXXXX

SEQ ID NO: 22575 - protein, 60 aa, consensus; identical to SEQ ID NO: 18692
  MISC_FEATURE (1)..(60): consensus for the disclosure of xaa see table XV

SEQ ID NO: 22576 - protein, 50 aa, consensus; identical to SEQ ID NO: 4455
  MISC_FEATURE (1)..(50): consensus for the disclosure of xaa see table XV

SEQ ID NO: 22577 - protein, 35 aa, consensus; identical to SEQ ID NO: 4456
  MISC_FEATURE (1)..(35): consensus for the disclosure of xaa see table XV

SEQ ID NO: 22578 - protein, 62 aa, consensus; identical to SEQ ID NO: 4457
  MISC_FEATURE (1)..(62): consensus for the disclosure of xaa see table XV

SEQ ID NO: 22579 - protein, 54 aa, consensus; identical to SEQ ID NO: 4458
  MISC_FEATURE (1)..(54): consensus for the disclosure of xaa see table XV

SEQ ID NO: 22580 - protein, 521 aa, consensus; identical to SEQ ID NO: 18697
  MISC_FEATURE (1)..(521): Xaa in all positions is any amino acid.

SEQ ID NO: 22581 - protein, 396 aa, consensus; identical to SEQ ID NO: 18698
  MISC_FEATURE (1)..(396): Xaa in all positions is any amino acid.

SEQ ID NO: 22582 - protein, 125 aa, consensus; identical to SEQ ID NO: 1943
  MISC_FEATURE (1)..(125): consensus for the disclosure of xaa see table XV

SEQ ID NO: 22583 - protein, 308 aa, consensus
  MISC_FEATURE (1)..(308): Xaa in all positions is any amino acid.
ALXXFXXXXVXXXMXXXLAXXXXXXIXXXXXXXXXXXXXXXXXXXXXXXXXXXXXXXXXXXXXPXLXXFIXXLXXXSNVQXPTLMXXXVYLXXLXXXXPXXXXGXXXTXHRIFLXXLILAAKXLNDSSPXNKHWAXYTXXXXXXXXXXXXXXEXNXXERXLLXXXXWDXXXXXXDLXXXLXXFLXPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRXSXXXXXXXXXXXXXXXXXXXTXXSRXS

SEQ ID NO: 22584 - protein, 94 aa, consensus
  MISC_FEATURE (1)..(94): consensus for the disclosure of xaa see table XV
XXXXXXXXXXXXXXXXXXXXXXXXXXXXXXXXXXXXXXXXXXXXXXXXXXXXXXXXXXGXXXXXXXXXXXXXXXXXXXXXXXXXXHXXXXEXXX

SEQ ID NO: 22585 - protein, 89 aa, consensus
  MISC_FEATURE (1)..(89): consensus for the disclosure of xaa see table XV
GXXXXXXXXXXXXXXXXXXXXXXXXDGXRXXXXXXXXXXXXXXXXXXXXXXXDXXXXXXXKXXXXXXXXXXXXXXXXXXXXXXXXXXXX

SEQ ID NO: 22586 - protein, 464 aa, consensus
  MISC_FEATURE (1)..(464): Xaa in all Positions is any amino acid
XXXXXXXXXXXXXXXXXXXXXXXXXXXXXXXXXXXXXXXXXXXXSDXXXXXXXXXXXXXXXXXXXXXXXXYGXDXXXXXXXXXXXXXXXXXXXXXXXXXFXXXGTXXNXXXXXXXXXXXXXXXXXXXXXXHXXXXEXGXXXXXXXXXXXXXXXXXXXXXXXXXXXXXXXXXXXXXXXXHXXXXXXXXXXXXXXXXXGXXXXXXXXXXXXXXXXXXXXXXXHXDGARXXXAXXXXXXXXXXXXXXXXXXXDXXXXXXXKXXXXXXXXXXXXXXXXXXXXXXXXKXXGXXXXXXXXXXXXXXXXXXXXXXXXXXXXXXXXXXXXXXAXXXXXXXXXXXXXXXXXXXXXXXXXXNXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXX

SEQ ID NO: 22587 - protein, 122 aa, consensus
  MISC_FEATURE (1)..(122): consensus for the disclosure of xaa see table XV
XXRSDXXTXPXXXXXXXXXXXXXXXXDXVXXEDXXTXXXEXXXXXXXGXXXXXXXXXXXXXXXTXXNQXXXXXXXXXXXXXXXXXXXXXHXXXXEXXXXXXXXXAXXXPXXXXNXXXXXXXX

SEQ ID NO: 22588 - protein, 50 aa, consensus
  MISC_FEATURE (1)..(50): consensus for the disclosure of xaa see table XV
XXXXXPTXXXXXENTXXGXXXPXXEXXXXXXXXXXXXXXXHXDGARXXXX

SEQ ID NO: 22589 - protein, 62 aa, consensus
  MISC_FEATURE (1)..(62): consensus for the disclosure of xaa see table XV
XXXXXXXXDXXXXXXXKXXXAPXGXXXXXXXXXXXXXXXXXXXXGGGXRXXGXXXXXXXXXX

SEQ ID NO: 22590 - protein, 65 aa, consensus
  MISC_FEATURE (1)..(65): consensus for the disclosure of xaa see table XV
XXXLXXXXXXXXXXXXXXXXXXXXXXXXXXXXXXXXXXXXXXRXXXHXXXXXXXXXXXXXXXXXX

SEQ ID NO: 22591 - protein, 432 aa, consensus
  MISC_FEATURE (1)..(432): Xaa on all Positions is any amino acid
XXXXXXXXXXXXXXXXXXXXXXXXXXXXXXXXXXXXXXXXRSDTXTXPTXXMXXXXXXXXXXXGDXVYXEDXXTXXXEXXXXXXXGXXXXXXXAXXFXVSGTXXNQXXXRXXLXXXPPXSILCDXRAHXXXXEAXGXAXLSQAXXXPXXPXNGXYXTXEDXXXXXXXXXXXDXHXXPTXXXXLENTXXGXXXPXXEXXXIXXXXXXXXXXXHXDGARXWXAXXXXXXXXXXXXXXXXXXFDSXSXCLSKXXXAPXGSXXVGXXXXXXXXXXXXKXXGGGXRQXGXXXXXAXXXXXXXXXXXXXXXXXXXXXXHXXAXXXXXXXXXXGXXLXXPXXTNXVXXDXXXXXXXXXXXXXXXXXXXXXXLXXXRXXXHXQXXXXXXXXXXKXXXXXXXXXXXXXXXXXXXXXXXXXXXXXXXXXXXXXXXXXXXXXX

SEQ ID NO: 22592 - protein, 432 aa, consensus
  MISC_FEATURE (1)..(432): Xaa in all Positions is any amino acid
XXXXXXXXXXXXXXXXXXXXXXXXXXXXXXXXXXXXXXXXRSDXXTXPXXXXXXXXXXXXXXXXDXVXXEDXXTXXXEXXXXXXXGXXXXXXXXXXXXXXXTXXNQXXXXXXXXXXXXXXXXXXXXXHXXXXEXXXXXXXXXAXXXPXXXXNXXXXXXXXXXXXXXXXXXXXXXXXPTXXXXXENTXXGXXXPXXEXXXXXXXXXXXXXXXHXDGARXXXXXXXXXXXXXXXXXXXXXXXDXXXXXXXKXXXAPXGXXXXXXXXXXXXXXXXXXXXGGGXRXXGXXXXXXXXXXXXXXXXXXXXXXXXXXXXXXXXXXXXXXXXXXXXXLXXXXXXXXXXXXXXXXXXXXXXXXXXXXXXXXXXXXXXRXXXHXXXXXXXXXXXXXXXXXXXXXXXXXXXXXXXXXXXXXXXXXXXXXXXXXXXXXXXXXXX

SEQ ID NO: 22593 - protein, 101 aa, consensus; identical to SEQ ID NO: 18650
  MISC_FEATURE (1)..(101): consensus for the disclosure of xaa see table XV

SEQ ID NO: 22594 - protein, 580 aa, consensus
  MISC_FEATURE (1)..(580): Xaa in all positions is any amino acid.
WXXXXXXXXXXXXXXXXXXFXXHPLXXEDXXXXXXRXKXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXDXXDHXXXXXXXXXXXXXXXXXXXXXXXXXXXXXXXXXXXXXXXXXXXXXXXXXXXXXXXXXIXXXXXXXXGXGMNFXXXXXXXXXXXXXXXXXXXXXXXXXXXXXXXXXXXXXXXXW

SEQ ID NO: 22595 - protein, 222 aa, consensus
  MISC_FEATURE (1)..(222): Xaa in all positions is any amino acid.
NXXXFXXXXXXXXXXXXXXXXXXXXXXXXXXXXXXXXXXXXXXXXXXXXXXXXXXXXXXXXXXXXXXXXFXHXXXXHXXXNMXXLXXFXXXXXXXXGXXXXXXXYXXXXXXXXXXXXXXXXXXXXXXXXXXXXXXXXXXXXXXXGASGAXXXXXXXXXXXXPXXXXXXXXXXXXXXXXXXXXXXXXXXXXXXXXXXXXXXXXXXXXXXXXXXXXXXXXXXXG

SEQ ID NO: 22596 - protein, 60 aa, consensus; identical to SEQ ID NO: 1957
  MISC_FEATURE (1)..(60): consensus for the disclosure of xaa see table XV
  for the disclosure of the amendment in position 16 see table XVI

SEQ ID NO: 22597 - protein, 569 aa, consensus; identical to SEQ ID NO: 5817
  MISC_FEATURE (1)..(569): Xaa in all position is any amino acid

SEQ ID NO: 22598 - protein, 212 aa, consensus; identical to SEQ ID NO: 1948
  MISC_FEATURE (1)..(212): consensus for the disclosure of xaa see table XV

SEQ ID NO: 22599 - protein, 223 aa, consensus; identical to SEQ ID NO: 18705
  MISC_FEATURE (1)..(223): Xaa in all positions is any amino acid.

SEQ ID NO: 22600 - protein, 33 aa, consensus; identical to SEQ ID NO: 228
  MISC_FEATURE (1)..(33): Xaa in all positions is any amino acid.

SEQ ID NO: 22601 - protein, 76 aa, consensus; identical to SEQ ID NO: 13766
  MISC_FEATURE (1)..(76): Xaa in all positions is any amino acid.

SEQ ID NO: 22602 - protein, 113 aa, consensus
  MISC_FEATURE (1)..(113): consensus for the disclosure of xaa see table XV
XXXXXXXXXXXXXXXXXXXXXXXXXLXXDXXGNXXXQKXXEXXXXXXXXXXXXXXXXXXXXXXXXXXXXXXXQXXXXXXXXXXXXXXXXXXXXXXXXXXXXDXXXNXVXQXXX

SEQ ID NO: 22603 - protein, 179 aa, consensus
  MISC_FEATURE (1)..(179): consensus for the disclosure of xaa see table XV
XXXXXXXXXXXXXXXXXXXXXXXXXXXXXXLXXXXXGXXXXXXXXXXXXXXXXXXXXXXXXXXXXXXXXXXXXXXXXXXKXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 22604 - protein, 1016 aa, consensus
  MISC_FEATURE (1)..(1016): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDQXGXRXXQXXXXXXXXXXXXXXXXXXXXXXXXLXXDXFGNYXXQKXXEXXXXXXXXXXXXXXXXXXXXXXXXXXXXRXXQXXXXXXXXXXXXXXXXXXXXXXXXXXXXDXXGNHVIQKXXXXXXXXXXXFXXXXXXXXXXXXXXXXXXHXXGCXVXQRXXXXXXXXXXXXXXXXXXXXXXXLXXDXXGNYVXQXXXXXXXXXXXXXXXXXXXXXXXXXXXXXXXXXXXXXXKFXSNVXEKXXXXXXXXXXXXXXXXXXXXXXXXXXXXXXXXXXXXXXXXDXXXNYVXQXXXXXXXXXXXXXXXXXXXXXXXXXXXXXXXXXXXXXXXXXXXXXXXXXXXXXX

SEQ ID NO: 22605 - protein, 26 aa, consensus
  MISC_FEATURE (1)..(26): consensus for the disclosure of xaa see table XV
XXXGXXXXXXXXXXXXXXXXXXXXXX

SEQ ID NO: 22606 - protein, 16 aa, consensus
  MISC_FEATURE (1)..(16): consensus for the disclosure of xaa see table XV
XXXXXXXXXXXXXXXX

SEQ ID NO: 22607 - protein, 22 aa, consensus
  MISC_FEATURE (1)..(22): consensus for the disclosure of xaa see table XV
XXXXXXXXXHXXXGXXXXXXXX

SEQ ID NO: 22608 - protein, 547 aa, consensus; identical to SEQ ID NO: 18717
  MISC_FEATURE (1)..(547): Xaa in all positions is any amino acid.

SEQ ID NO: 22609 - DNA, 723 bp, Escherichia coli; identical to SEQ ID NO: 417
  CDS (1)..(723)

SEQ ID NO: 22610 - protein, 240 aa, Escherichia coli; identical to SEQ ID NO: 418

SEQ ID NO: 22611 - DNA, 723 bp, Listeria innocua; identical to SEQ ID NO: 453
  CDS (1)..(723)

SEQ ID NO: 22612 - protein, 240 aa, Listeria innocua; identical to SEQ ID NO: 454

SEQ ID NO: 22613 - DNA, 798 bp, Yersinia pestis; identical to SEQ ID NO: 2052
  CDS (1)..(798)

SEQ ID NO: 22614 - protein, 265 aa, Yersinia pestis; identical to SEQ ID NO: 452

SEQ ID NO: 22615 - DNA, 744 bp, Salmonella enterica subsp. enterica serovar Typhi; identical to SEQ ID NO: 2054
  CDS (1)..(744)

SEQ ID NO: 22616 - protein, 247 aa, Salmonella enterica subsp. enterica serovar Typhi; identical to SEQ ID NO: 460

SEQ ID NO: 22617 - DNA, 714 bp, Listeria innocua; identical to SEQ ID NO: 455
  CDS (1)..(714)

SEQ ID NO: 22618 - protein, 237 aa, Listeria innocua; identical to SEQ ID NO: 456

SEQ ID NO: 22619 - DNA, 723 bp, Listeria monocytogenes; identical to SEQ ID NO: 457
  CDS (1)..(723)

SEQ ID NO: 22620 - protein, 240 aa, Listeria monocytogenes; identical to SEQ ID NO: 458

SEQ ID NO: 22621 - DNA, 729 bp, Listeria monocytogenes; identical to SEQ ID NO: 429
  CDS (1)..(729)

SEQ ID NO: 22622 - protein, 242 aa, Listeria monocytogenes; identical to SEQ ID NO: 430

SEQ ID NO: 22623 - DNA, 729 bp, Listeria innocua; identical to SEQ ID NO: 2062
  CDS (1)..(729)

SEQ ID NO: 22624 - protein, 242 aa, Listeria innocua; identical to SEQ ID NO: 432

SEQ ID NO: 22625 - DNA, 729 bp, Bacillus subtilis; identical to SEQ ID NO: 421
  CDS (1)..(729)

SEQ ID NO: 22626 - protein, 242 aa, Bacillus subtilis; identical to SEQ ID NO: 422

SEQ ID NO: 22627 - DNA, 747 bp, Bacillus halodurans; identical to SEQ ID NO: 445
  CDS (1)..(747)

SEQ ID NO: 22628 - protein, 248 aa, Bacillus halodurans; identical to SEQ ID NO: 446

SEQ ID NO: 22629 - DNA, 723 bp, Bacillus halodurans; identical to SEQ ID NO: 433
  CDS (1)..(723)

SEQ ID NO: 22630 - protein, 240 aa, Bacillus halodurans; identical to SEQ ID NO: 434

SEQ ID NO: 22631 - DNA, 714 bp, Bacillus halodurans; identical to SEQ ID NO: 427
  CDS (1)..(714)

SEQ ID NO: 22632 - protein, 237 aa, Bacillus halodurans; identical to SEQ ID NO: 428

SEQ ID NO: 22633 - DNA, 811 bp, Corynebacterium glutamicum; identical to SEQ ID NO: 2072

SEQ ID NO: 22634 - protein, 269 aa, Corynebacterium glutamicum; identical to SEQ ID NO: 462

SEQ ID NO: 22635 - DNA, 732 bp, Bacillus subtilis; identical to SEQ ID NO: 425
  CDS (1)..(732)

SEQ ID NO: 22636 - protein, 243 aa, Bacillus subtilis; identical to SEQ ID NO: 426

SEQ ID NO: 22637 - DNA, 744 bp, Caulobacter crescentus; identical to SEQ ID NO: 2076
  CDS (1)..(744)

SEQ ID NO: 22638 - protein, 247 aa, Caulobacter crescentus; identical to SEQ ID NO: 442

SEQ ID NO: 22639 - DNA, 711 bp, Streptococcus pneumoniae; identical to SEQ ID NO: 2078
  CDS (1)..(711)

SEQ ID NO: 22640 - protein, 236 aa, Streptococcus pneumoniae; identical to SEQ ID NO: 436

SEQ ID NO: 22641 - DNA, 729 bp, Streptococcus pneumoniae; identical to SEQ ID NO: 2080
  CDS (1)..(729)

SEQ ID NO: 22642 - protein, 242 aa, Streptococcus pneumoniae; identical to SEQ ID NO: 438

SEQ ID NO: 22643 - DNA, 708 bp, Streptococcus pneumoniae; identical to SEQ ID NO: 2082
  CDS (1)..(708)

SEQ ID NO: 22644 - protein, 235 aa, Streptococcus pneumoniae; identical to SEQ ID NO: 450

SEQ ID NO: 22645 - DNA, 717 bp, Escherichia coli; identical to SEQ ID NO: 423
  CDS (1)..(717)

SEQ ID NO: 22646 - protein, 238 aa, Escherichia coli [sequence omitted]

SEQ ID NO: 22647 - DNA, 708 bp, Lactococcus lactis subsp. lactis; identical to SEQ ID NO: 443
  CDS (1)..(708)

SEQ ID NO: 22648 - protein, 235 aa, Lactococcus lactis subsp. lactis; identical to SEQ ID NO: 444

SEQ ID NO: 22649 - DNA, 756 bp, Escherichia coli; identical to SEQ ID NO: 439
  CDS (1)..(756)

SEQ ID NO: 22650 - protein, 251 aa, Escherichia coli; identical to SEQ ID NO: 440

SEQ ID NO: 22651 - DNA, 732 bp, Clostridium acetobutylicum; identical to SEQ ID NO: 2090
  CDS (1)..(732)

SEQ ID NO: 22652 - protein, 243 aa, Clostridium acetobutylicum; identical to SEQ ID NO: 448

SEQ ID NO: 22653 - DNA, 747 bp, Bordetella parapertussis; identical to SEQ ID NO: 2092
  CDS (1)..(747)

SEQ ID NO: 22654 - protein, 248 aa, Bordetella parapertussis; identical to SEQ ID NO: 510

SEQ ID NO: 22655 - DNA, 747 bp, Bordetella bronchiseptica; identical to SEQ ID NO: 2094
  CDS (1)..(747)

SEQ ID NO: 22656 - protein, 248 aa, Bordetella bronchiseptica; identical to SEQ ID NO: 508

SEQ ID NO: 22657 - DNA, 738 bp, Bacillus cereus; identical to SEQ ID NO: 503
  CDS (1)..(738)

SEQ ID NO: 22658 - protein, 245 aa, Bacillus cereus; identical to SEQ ID NO: 504

SEQ ID NO: 22659 - DNA, 732 bp, Bacillus anthracis; identical to SEQ ID NO: 2098
  CDS (1)..(732)

SEQ ID NO: 22660 - protein, 243 aa, Bacillus anthracis; identical to SEQ ID NO: 502

SEQ ID NO: 22661 - DNA, 738 bp, Bacillus anthracis; identical to SEQ ID NO: 499
  CDS (1)..(738)

SEQ ID NO: 22662 - protein, 245 aa, Bacillus anthracis; identical to SEQ ID NO: 500

SEQ ID NO: 22663 - DNA, 765 bp, Streptomyces avermitilis; identical to SEQ ID NO: 2102
  CDS (1)..(765)

SEQ ID NO: 22664 - protein, 254 aa, Streptomyces avermitilis; identical to SEQ ID NO: 498

SEQ ID NO: 22665 - DNA, 756 bp, Enterococcus faecalis; identical to SEQ ID NO: 2104
  CDS (25)..(756)

SEQ ID NO: 22666 - protein, 243 aa, Enterococcus faecalis; identical to SEQ ID NO: 496

SEQ ID NO: 22667 - DNA, 708 bp, Enterococcus faecalis; identical to SEQ ID NO: 2106
  CDS (1)..(708)

SEQ ID NO: 22668 - protein, 235 aa, Enterococcus faecalis; identical to SEQ ID NO: 494

SEQ ID NO: 22669 - DNA, 675 bp, Shigella flexneri; identical to SEQ ID NO: 2108
  CDS (1)..(675)

SEQ ID NO: 22670 - protein, 224 aa, Shigella flexneri; identical to SEQ ID NO: 506

SEQ ID NO: 22671 - DNA, 723 bp, Shigella flexneri; identical to SEQ ID NO: 491
  CDS (1)..(723)

SEQ ID NO: 22672 - protein, 240 aa, Shigella flexneri; identical to SEQ ID NO: 492

SEQ ID NO: 22673 - DNA, 927 bp, Pseudomonas putida; identical to SEQ ID NO: 2112
  CDS (1)..(927)

SEQ ID NO: 22674 - protein, 308 aa, Pseudomonas putida; identical to SEQ ID NO: 490

SEQ ID NO: 22675 - DNA, 711 bp, Lactobacillus plantarum; identical to SEQ ID NO: 487
  CDS (1)..(711)

SEQ ID NO: 22676 - protein, 236 aa, Lactobacillus plantarum; identical to SEQ ID NO: 488

SEQ ID NO: 22677 - DNA, 699 bp, Streptococcus mutans; identical to SEQ ID NO: 485
  CDS (1)..(699)

SEQ ID NO: 22678 - protein, 232 aa, Streptococcus mutans; identical to SEQ ID NO: 486

SEQ ID NO: 22679 - DNA, 699 bp, Streptococcus agalactiae; identical to SEQ ID NO: 2118
  CDS (1)..(699)

SEQ ID NO: 22680 - protein, 232 aa, Streptococcus agalactiae; identical to SEQ ID NO: 484

SEQ ID NO: 22681 - DNA, 747 bp, Oceanobacillus iheyensis; identical to SEQ ID NO: 481
  CDS (1)..(747)

SEQ ID NO: 22682 - protein, 248 aa, Oceanobacillus iheyensis; identical to SEQ ID NO: 482

SEQ ID NO: 22683 - DNA, 756 bp, Escherichia coli O6; identical to SEQ ID NO: 479
  CDS (1)..(756)

SEQ ID NO: 22684 - protein, 251 aa, Escherichia coli O6; identical to SEQ ID NO: 480

SEQ ID NO: 22685 - DNA, 699 bp, Escherichia coli O6; identical to SEQ ID NO: 477
  CDS (1)..(699)

SEQ ID NO: 22686 - protein, 232 aa, Escherichia coli O6; identical to SEQ ID NO: 478

SEQ ID NO: 22687 - DNA, 765 bp, Streptomyces sp; identical to SEQ ID NO: 2126
  CDS (1)..(765)

SEQ ID NO: 22688 - protein, 254 aa, Streptomyces sp; identical to SEQ ID NO: 468

SEQ ID NO: 22689 - DNA, 714 bp, Streptococcus mutans; identical to SEQ ID NO: 2128
  CDS (1)..(714)

SEQ ID NO: 22690 - protein, 237 aa, Streptococcus mutans; identical to SEQ ID NO: 476

SEQ ID NO: 22691 - DNA, 762 bp, Streptomyces griseus; identical to SEQ ID NO: 2130
  CDS (1)..(762)

SEQ ID NO: 22692 - protein, 253 aa, Streptomyces griseus; identical to SEQ ID NO: 466

SEQ ID NO: 22693 - DNA, 726 bp, Clostridium perfringens; identical to SEQ ID NO: 471
  CDS (1)..(726)

SEQ ID NO: 22694 - protein, 241 aa, Clostridium perfringens; identical to SEQ ID NO: 472

SEQ ID NO: 22695 - DNA, 726 bp, Streptococcus pyogenes; identical to SEQ ID NO: 469
  CDS (1)..(726)

SEQ ID NO: 22696 - protein, 241 aa, Streptococcus pyogenes; identical to SEQ ID NO: 470

SEQ ID NO: 22697 - DNA, 705 bp, Pseudomonas fluorescens; identical to SEQ ID NO: 463
  CDS (1)..(705)

SEQ ID NO: 22698 - protein, 234 aa, Pseudomonas fluorescens; identical to SEQ ID NO: 464

SEQ ID NO: 22699 - DNA, 765 bp, Streptomyces coelicolor; identical to SEQ ID NO: 2138
  CDS (1)..(765)

SEQ ID NO: 22700 - protein, 254 aa, Streptomyces coelicolor; identical to SEQ ID NO: 474

SEQ ID NO: 22701 - DNA, 23 bp, Primer
atgggacacaagcccttataccg

SEQ ID NO: 22702 - DNA, 23 bp, Primer
ttatcgcgatgattttcgctgcg

SEQ ID NO: 22703 - DNA, 1259 bp, Escherichia coli K12; identical to SEQ ID NO: 9931
  CDS (170)..(916)

SEQ ID NO: 22704 - protein, 249 aa, Escherichia coli K12; identical to SEQ ID NO: 9932

SEQ ID NO: 22705 - DNA, 798 bp, Neisseria meningitidis; identical to SEQ ID NO: 9933
  CDS (1)..(798)

SEQ ID NO: 22706 - protein, 265 aa, Neisseria meningitidis; identical to SEQ ID NO: 9934

SEQ ID NO: 22707 - DNA, 855 bp, Xylella fastidiosa; identical to SEQ ID NO: 9935
  CDS (1)..(855)

SEQ ID NO: 22708 - protein, 284 aa, Xylella fastidiosa; identical to SEQ ID NO: 9936

SEQ ID NO: 22709 - DNA, 936 bp, Pseudomonas aeruginosa; identical to SEQ ID NO: 9937
  CDS (1)..(936)

SEQ ID NO: 22710 - protein, 311 aa, Pseudomonas aeruginosa; identical to SEQ ID NO: 9938

SEQ ID NO: 22711 - DNA, 1293 bp, Arabidopsis thaliana (mouse-ear cress); identical to SEQ ID NO: 9939
  CDS (1)..(1293)

SEQ ID NO: 22712 - protein, 430 aa, Arabidopsis thaliana (mouse-ear cress); identical to SEQ ID NO: 9940

SEQ ID NO: 22713 - DNA, 828 bp, Caulobacter crescentus; identical to SEQ ID NO: 9941
  CDS (1)..(828)

SEQ ID NO: 22714 - protein, 275 aa, Caulobacter crescentus; identical to SEQ ID NO: 9942

SEQ ID NO: 22715 - DNA, 930 bp, Yersinia pestis; identical to SEQ ID NO: 9943
  CDS (1)..(930)

SEQ ID NO: 22716 - protein, 309 aa, Yersinia pestis; identical to SEQ ID NO: 9944

SEQ ID NO: 22717 - DNA, 834 bp, Agrobacterium tumefaciens; identical to SEQ ID NO: 9945
  CDS (1)..(834)

SEQ ID NO: 22718 - protein, 277 aa, Agrobacterium tumefaciens; identical to SEQ ID NO: 9946

SEQ ID NO: 22719 - DNA, 885 bp, Nostoc sp. PCC 7120; identical to SEQ ID NO: 9947
  CDS (1)..(885)

SEQ ID NO: 22720 - protein, 294 aa, Nostoc sp. PCC 7120; identical to SEQ ID NO: 9948

SEQ ID NO: 22721 - DNA, 858 bp, Salmonella enterica subsp. enterica serovar Typhi; identical to SEQ ID NO: 9949
  CDS (1)..(858)

SEQ ID NO: 22722 - protein, 285 aa, Salmonella enterica subsp. enterica serovar Typhi; identical to SEQ ID NO: 9950

SEQ ID NO: 22723 - DNA, 849 bp, Yersinia pestis; identical to SEQ ID NO: 9951
  CDS (1)..(849)

SEQ ID NO: 22724 - protein, 282 aa, Yersinia pestis; identical to SEQ ID NO: 9952

SEQ ID NO: 22725 - DNA, 855 bp, Deinococcus radiodurans; identical to SEQ ID NO: 9953
  CDS (1)..(855)

SEQ ID NO: 22726 - protein, 284 aa, Deinococcus radiodurans; identical to SEQ ID NO: 9954

SEQ ID NO: 22727 - DNA, 738 bp, Clostridium acetobutylicum; identical to SEQ ID NO: 9955
  CDS (1)..(738)

SEQ ID NO: 22728 - protein, 245 aa, Clostridium acetobutylicum; identical to SEQ ID NO: 9956

SEQ ID NO: 22729 - DNA, 927 bp, Chlamydophila pneumoniae, Chlamydia pneumoniae; identical to SEQ ID NO: 9957
  CDS (1)..(927)

SEQ ID NO: 22730 - protein, 308 aa, Chlamydophila pneumoniae, Chlamydia pneumoniae; identical to SEQ ID NO: 9958

SEQ ID NO: 22731 - DNA, 921 bp, Mycobacterium tuberculosis; identical to SEQ ID NO: 9959
  CDS (1)..(921)

SEQ ID NO: 22732 - protein, 306 aa, Mycobacterium tuberculosis; identical to SEQ ID NO: 9960

SEQ ID NO: 22733 - DNA, 864 bp, Treponema pallidum subsp. pallidum (syphilis spirochete); identical to SEQ ID NO: 9961
  CDS (1)..(864)

SEQ ID NO: 22734 - protein, 287 aa, Treponema pallidum subsp. pallidum (syphilis spirochete); identical to SEQ ID NO: 9962

SEQ ID NO: 22735 - DNA, 918 bp, Chlamydia muridarum, Chlamydia trachomatis MoPn; identical to SEQ ID NO: 9963
  CDS (1)..(918)

SEQ ID NO: 22736 - protein, 305 aa, Chlamydia muridarum, Chlamydia trachomatis MoPn; identical to SEQ ID NO: 9964

SEQ ID NO: 22737 - DNA, 843 bp, Vibrio cholerae; identical to SEQ ID NO: 9965
  CDS (1)..(843)

SEQ ID NO: 22738 - protein, 280 aa, Vibrio cholerae; identical to SEQ ID NO: 9966

SEQ ID NO: 22739 - DNA, 1137 bp, Ureaplasma urealyticum; identical to SEQ ID NO: 9967
  CDS (1)..(1137)

SEQ ID NO: 22740 - protein, 378 aa, Ureaplasma urealyticum; identical to SEQ ID NO: 9968

SEQ ID NO: 22741 - DNA, 693 bp, Rickettsia conorii; identical to SEQ ID NO: 9969
  CDS (1)..(693)

SEQ ID NO: 22742 - protein, 230 aa, Rickettsia conorii; identical to SEQ ID NO: 9970

SEQ ID NO: 22743 - DNA, 918 bp, Chlamydia trachomatis; identical to SEQ ID NO: 9971
  CDS (1)..(918)

SEQ ID NO: 22744 - protein, 305 aa, Chlamydia trachomatis; identical to SEQ ID NO: 9972

SEQ ID NO: 22745 - DNA, 816 bp, Pseudomonas aeruginosa; identical to SEQ ID NO: 9973
  CDS (1)..(816)

SEQ ID NO: 22746 - protein, 271 aa, Pseudomonas aeruginosa; identical to SEQ ID NO: 9974

SEQ ID NO: 22747 - DNA, 795 bp, Bacillus halodurans; identical to SEQ ID NO: 9975
  CDS (1)..(795)

SEQ ID NO: 22748 - protein, 264 aa, Bacillus halodurans; identical to SEQ ID NO: 9976

SEQ ID NO: 22749 - DNA, 867 bp, Haemophilus influenzae; identical to SEQ ID NO: 9977
  CDS (1)..(867)

SEQ ID NO: 22750 - protein, 288 aa, Haemophilus influenzae; identical to SEQ ID NO: 9978

SEQ ID NO: 22751 - DNA, 801 bp, Helicobacter pylori; identical to SEQ ID NO: 9979
  CDS (1)..(801)

SEQ ID NO: 22752 - protein, 266 aa, Helicobacter pylori; identical to SEQ ID NO: 9980

SEQ ID NO: 22753 - DNA, 810 bp, Bacillus subtilis; identical to SEQ ID NO: 9981
  CDS (1)..(810)

SEQ ID NO: 22754 - protein, 269 aa, Bacillus subtilis; identical to SEQ ID NO: 9982

SEQ ID NO: 22755 - DNA, 687 bp, Rickettsia prowazekii; identical to SEQ ID NO: 9983
  CDS (1)..(687)

SEQ ID NO: 22756 - protein, 228 aa, Rickettsia prowazekii; identical to SEQ ID NO: 9984

SEQ ID NO: 22757 - DNA, 939 bp, Mycobacterium leprae; identical to SEQ ID NO: 9985
  CDS (1)..(939)

SEQ ID NO: 22758 - protein, 312 aa, Mycobacterium leprae; identical to SEQ ID NO: 9986

SEQ ID NO: 22759 - DNA, 803 bp, Streptococcus pneumoniae; identical to SEQ ID NO: 9987

SEQ ID NO: 22760 - protein, 267 aa, Streptococcus pneumoniae; identical to SEQ ID NO: 9988

SEQ ID NO: 22761 - DNA, 726 bp, Campylobacter jejuni; identical to SEQ ID NO: 9989
  CDS (1)..(726)

SEQ ID NO: 22762 - protein, 241 aa, Campylobacter jejuni; identical to SEQ ID NO: 9990

SEQ ID NO: 22763 - DNA, 933 bp, Vibrio cholerae; identical to SEQ ID NO: 9991
  CDS (1)..(933)

SEQ ID NO: 22764 - protein, 310 aa, Vibrio cholerae; identical to SEQ ID NO: 9992

SEQ ID NO: 22765 - DNA, 783 bp, Staphylococcus aureus; identical to SEQ ID NO: 9993
  CDS (1)..(783)

SEQ ID NO: 22766 - protein, 260 aa, Staphylococcus aureus; identical to SEQ ID NO: 9994

SEQ ID NO: 22767 - DNA, 882 bp, Synechocystis sp; identical to SEQ ID NO: 9995
  CDS (1)..(882)

SEQ ID NO: 22768 - protein, 293 aa, Synechocystis sp; identical to SEQ ID NO: 9996

SEQ ID NO: 22769 - DNA, 1317 bp, Arabidopsis thaliana (mouse-ear cress); identical to SEQ ID NO: 9997
  CDS (1)..(1317)

SEQ ID NO: 22770 - protein, 438 aa, Arabidopsis thaliana (mouse-ear cress); identical to SEQ ID NO: 9998

SEQ ID NO: 22771 - DNA, 2014 bp, Solanum tuberosum (potato); identical to SEQ ID NO: 9999
  CDS (104)..(1378)

SEQ ID NO: 22772 - protein, 424 aa, Solanum tuberosum (potato); identical to SEQ ID NO: 10000

SEQ ID NO: 22773 - DNA, 1231 bp, Arabidopsis thaliana (mouse-ear cress); identical to SEQ ID NO: 10001
  CDS (1)..(1200)

SEQ ID NO: 22774 - protein, 399 aa, Arabidopsis thaliana (mouse-ear cress); identical to SEQ ID NO: 10002

SEQ ID NO: 22775 - DNA, 978 bp, Corynebacterium glutamicum; identical to SEQ ID NO: 10003
  CDS (65)..(958)

SEQ ID NO: 22776 - protein, 297 aa, Corynebacterium glutamicum; identical to SEQ ID NO: 10004

SEQ ID NO: 22777 - DNA, 765 bp, Wolinella succinogenes; identical to SEQ ID NO: 10005
  CDS (1)..(765)

SEQ ID NO: 22778 - protein, 254 aa, Wolinella succinogenes; identical to SEQ ID NO: 10006

SEQ ID NO: 22779 - DNA, 855 bp, Porphyromonas gingivalis; identical to SEQ ID NO: 10007
  CDS (1)..(855)

SEQ ID NO: 22780 - protein, 284 aa, Porphyromonas gingivalis; identical to SEQ ID NO: 10008

SEQ ID NO: 22781 - DNA, 945 bp, Photorhabdus luminescens; identical to SEQ ID NO: 10009
  CDS (1)..(945)

SEQ ID NO: 22782 - protein, 314 aa, Photorhabdus luminescens; identical to SEQ ID NO: 10010

SEQ ID NO: 22783 - DNA, 849 bp, Photorhabdus luminescens; identical to SEQ ID NO: 10011
  CDS (1)..(849)

SEQ ID NO: 22784 - protein, 282 aa, Photorhabdus luminescens; identical to SEQ ID NO: 10012

SEQ ID NO: 22785 - DNA, 1131 bp, Mycoplasma gallisepticum; identical to SEQ ID NO: 10013
  CDS (433)..(1131)

SEQ ID NO: 22786 - protein, 232 aa, Mycoplasma gallisepticum; identical to SEQ ID NO: 10014

SEQ ID NO: 22787 - DNA, 804 bp, Gloeobacter violaceus; identical to SEQ ID NO: 10015
  CDS (1)..(804)

SEQ ID NO: 22788 - protein, 267 aa, Gloeobacter violaceus; identical to SEQ ID NO: 10016

SEQ ID NO: 22789 - DNA, 807 bp, Chromobacterium violaceum; identical to SEQ ID NO: 10017
  CDS (1)..(807)

SEQ ID NO: 22790 - protein, 268 aa, Chromobacterium violaceum; identical to SEQ ID NO: 10018

SEQ ID NO: 22791 - DNA, 858 bp, Prochlorococcus marinus subsp; identical to SEQ ID NO: 10019
  CDS (1)..(858)

SEQ ID NO: 22792 - protein, 285 aa, Prochlorococcus marinus subsp; identical to SEQ ID NO: 10020

SEQ ID NO: 22793 - DNA, 915 bp, Prochlorococcus marinus; identical to SEQ ID NO: 10021
  CDS (1)..(915)

SEQ ID NO: 22794 - protein, 304 aa, Prochlorococcus marinus; identical to SEQ ID NO: 10022

SEQ ID NO: 22795 - DNA, 897 bp, Synechococcus sp; identical to SEQ ID NO: 10023
  CDS (1)..(897)

SEQ ID NO: 22796 - protein, 298 aa, Synechococcus sp; identical to SEQ ID NO: 10024

SEQ ID NO: 22797 - DNA, 963 bp, Rhodopirellula baltica; identical to SEQ ID NO: 10025
  CDS (1)..(963)

SEQ ID NO: 22798 - protein, 320 aa, Rhodopirellula baltica; identical to SEQ ID NO: 10026

SEQ ID NO: 22799 - DNA, 1047 bp, Rhodopirellula baltica; identical to SEQ ID NO: 10027
  CDS (1)..(1047)

SEQ ID NO: 22800 - protein, 348 aa, Rhodopirellula baltica; identical to SEQ ID NO: 10028

SEQ ID NO: 22801 - DNA, 891 bp, Prochlorococcus marinus; identical to SEQ ID NO: 10029
  CDS (1)..(891)

SEQ ID NO: 22802 - protein, 296 aa, Prochlorococcus marinus; identical to SEQ ID NO: 10030

SEQ ID NO: 22803 - DNA, 855 bp, Helicobacter hepaticus; identical to SEQ ID NO: 10031
  CDS (1)..(855)

SEQ ID NO: 22804 - protein, 284 aa, Helicobacter hepaticus; identical to SEQ ID NO: 10032

SEQ ID NO: 22805 - DNA, 870 bp, Haemophilus ducreyi; identical to SEQ ID NO: 10033
  CDS (1)..(870)

SEQ ID NO: 22806 - protein, 289 aa, Haemophilus ducreyi; identical to SEQ ID NO: 10034

SEQ ID NO: 22807 - DNA, 867 bp, Candidatus Blochmannia floridanus; identical to SEQ ID NO: 10035
  CDS (1)..(867)

SEQ ID NO: 22808 - protein, 288 aa, Candidatus Blochmannia floridanus; identical to SEQ ID NO: 10036

SEQ ID NO: 22809 - DNA, 858 bp, Bordetella pertussis; identical to SEQ ID NO: 10037
  CDS (1)..(858)

SEQ ID NO: 22810 - protein, 285 aa, Bordetella pertussis; identical to SEQ ID NO: 10038

SEQ ID NO: 22811 - DNA, 921 bp, Chlamydophila caviae; identical to SEQ ID NO: 10039
  CDS (1)..(921)

SEQ ID NO: 22812 - protein, 306 aa, Chlamydophila caviae; identical to SEQ ID NO: 10040

SEQ ID NO: 22813 - DNA, 1179 bp, Streptomyces avermitilis; identical to SEQ ID NO: 10041
  CDS (1)..(1179)

SEQ ID NO: 22814 - protein, 392 aa, Streptomyces avermitilis; identical to SEQ ID NO: 10042

SEQ ID NO: 22815 - DNA, 828 bp, Nitrosomonas europaea; identical to SEQ ID NO: 10043
  CDS (1)..(828)

SEQ ID NO: 22816 - protein, 275 aa, Nitrosomonas europaea; identical to SEQ ID NO: 10044

SEQ ID NO: 22817 - DNA, 801 bp, Enterococcus faecalis; identical to SEQ ID NO: 10045
  CDS (1)..(801)

SEQ ID NO: 22818 - protein, 266 aa, Enterococcus faecalis; identical to SEQ ID NO: 10046

SEQ ID NO: 22819 - DNA, 819 bp, Coxiella burnetii; identical to SEQ ID NO: 10047
  CDS (1)..(819)

SEQ ID NO: 22820 - protein, 272 aa, Coxiella burnetii; identical to SEQ ID NO: 10048

SEQ ID NO: 22821 - DNA, 744 bp, Shigella flexneri; identical to SEQ ID NO: 10049
  CDS (1)..(744)

SEQ ID NO: 22822 - protein, 247 aa, Shigella flexneri; identical to SEQ ID NO: 10050

SEQ ID NO: 22823 - DNA, 810 bp, Tropheryma whipplei; identical to SEQ ID NO: 10051
  CDS (1)..(810)

SEQ ID NO: 22824 - protein, 269 aa, Tropheryma whipplei; identical to SEQ ID NO: 10052

SEQ ID NO: 22825 - DNA, 843 bp, Vibrio parahaemolyticus; identical to SEQ ID NO: 10053
  CDS (1)..(843)

SEQ ID NO: 22826 - protein, 280 aa, Vibrio parahaemolyticus; identical to SEQ ID NO: 10054

SEQ ID NO: 22827 - DNA, 816 bp, Pseudomonas syringae; identical to SEQ ID NO: 10055
  CDS (1)..(816)

SEQ ID NO: 22828 - protein, 271 aa, Pseudomonas syringae; identical to SEQ ID NO: 10056

SEQ ID NO: 22829 - DNA, 816 bp, Pseudomonas putida; identical to SEQ ID NO: 10057
  CDS (1)..(816)

SEQ ID NO: 22830 - protein, 271 aa, Pseudomonas putida; identical to SEQ ID NO: 10058

SEQ ID NO: 22831 - DNA, 786 bp, Lactobacillus plantarum; identical to SEQ ID NO: 10059
  CDS (1)..(786)

SEQ ID NO: 22832 - protein, 261 aa, Lactobacillus plantarum; identical to SEQ ID NO: 10060

SEQ ID NO: 22833 - DNA, 798 bp, Clostridium tetani; identical to SEQ ID NO: 10061
  CDS (1)..(798)

SEQ ID NO: 22834 - protein, 265 aa, Clostridium tetani; identical to SEQ ID NO: 10062

SEQ ID NO: 22835 - DNA, 843 bp, Bradyrhizobium japonicum; identical to SEQ ID NO: 10063
  CDS (1)..(843)

SEQ ID NO: 22836 - protein, 280 aa, Bradyrhizobium japonicum; identical to SEQ ID NO: 10064

SEQ ID NO: 22837 - DNA, 957 bp, Bacteroides thetaiotaomicron; identical to SEQ ID NO: 10065
  CDS (1)..(957)

SEQ ID NO: 22838 - protein, 318 aa, Bacteroides thetaiotaomicron; identical to SEQ ID NO: 10066

SEQ ID NO: 22839 - DNA, 843 bp, Bacteroides thetaiotaomicron; identical to SEQ ID NO: 10067
  CDS (1)..(843)

SEQ ID NO: 22840 - protein, 280 aa, Bacteroides thetaiotaomicron; identical to SEQ ID NO: 10068

SEQ ID NO: 22841 - DNA, 1386 bp, Mus musculus; identical to SEQ ID NO: 10069
  CDS (1)..(1386)

SEQ ID NO: 22842 - protein, 461 aa, Mus musculus; identical to SEQ ID NO: 10070

SEQ ID NO: 22843 - DNA, 795 bp, Streptococcus mutans; identical to SEQ ID NO: 10071
  CDS (1)..(795)

SEQ ID NO: 22844 - protein, 264 aa, Streptococcus mutans; identical to SEQ ID NO: 10072

SEQ ID NO: 22845 - DNA, 870 bp, Wigglesworthia glossinidia brevipalpis; identical to SEQ ID NO: 10073
  CDS (1)..(870)

SEQ ID NO: 22846 - protein, 289 aa, Wigglesworthia glossinidia brevipalpis; identical to SEQ ID NO: 10074

SEQ ID NO: 22847 - DNA, 849 bp, Vibrio vulnificus; identical to SEQ ID NO: 10075
  CDS (1)..(849)

SEQ ID NO: 22848 - protein, 282 aa, Vibrio vulnificus; identical to SEQ ID NO: 10076

SEQ ID NO: 22849 - DNA, 876 bp, Synechococcus elongatus; identical to SEQ ID NO: 10077
  CDS (1)..(876)

SEQ ID NO: 22850 - protein, 291 aa, Synechococcus elongatus; identical to SEQ ID NO: 10078

SEQ ID NO: 22851 - DNA, 765 bp, Shewanella oneidensis; identical to SEQ ID NO: 10079
  CDS (1)..(765)

SEQ ID NO: 22852 - protein, 254 aa, Shewanella oneidensis; identical to SEQ ID NO: 10080

SEQ ID NO: 22853 - DNA, 789 bp, Oceanobacillus iheyensis; identical to SEQ ID NO: 10081
  CDS (1)..(789)

SEQ ID NO: 22854 - protein, 262 aa, Oceanobacillus iheyensis; identical to SEQ ID NO: 10082

SEQ ID NO: 22855 - DNA, 1164 bp, Mycoplasma penetrans; identical to SEQ ID NO: 10083
  CDS (1)..(1164)

SEQ ID NO: 22856 - protein, 387 aa, Mycoplasma penetrans; identical to SEQ ID NO: 10084

SEQ ID NO: 22857 - DNA, 897 bp, Escherichia coli O6; identical to SEQ ID NO: 10085
  CDS (1)..(897)

SEQ ID NO: 22858 - protein, 298 aa, Escherichia coli O6; identical to SEQ ID NO: 10086

SEQ ID NO: 22859 - DNA, 894 bp, Corynebacterium efficiens; identical to SEQ ID NO: 10087
  CDS (1)..(894)

SEQ ID NO: 22860 - protein, 297 aa, Corynebacterium efficiens; identical to SEQ ID NO: 10088

SEQ ID NO: 22861 - DNA, 708 bp, Aquifex pyrophilus; identical to SEQ ID NO: 10089
  CDS (1)..(708): n means a or g or c or t/u

SEQ ID NO: 22862 - protein, 235 aa, Aquifex pyrophilus; identical to SEQ ID NO: 10090

SEQ ID NO: 22863 - DNA, 822 bp, Chlorobium tepidum; identical to SEQ ID NO: 10091
  CDS (1)..(822)

SEQ ID NO: 22864 - protein, 273 aa, Chlorobium tepidum; identical to SEQ ID NO: 10092

SEQ ID NO: 22865 - DNA, 828 bp, Xanthomonas campestris; identical to SEQ ID NO: 10093
  CDS (1)..(828)

SEQ ID NO: 22866 - protein, 275 aa, Xanthomonas campestris; identical to SEQ ID NO: 10094

SEQ ID NO: 22867 - DNA, 933 bp, Xanthomonas axonopodis; identical to SEQ ID NO: 10095
  CDS (1)..(933)

SEQ ID NO: 22868 - protein, 310 aa, Xanthomonas axonopodis; identical to SEQ ID NO: 10096

SEQ ID NO: 22869 - DNA, 786 bp, Thermoanaerobacter tengcongensis; identical to SEQ ID NO: 10097
  CDS (1)..(786)

SEQ ID NO: 22870 - protein, 261 aa, Thermoanaerobacter tengcongensis; identical to SEQ ID NO: 10098

SEQ ID NO: 22871 - DNA, 885 bp, Fusobacterium nucleatum; identical to SEQ ID NO: 10099
  CDS (1)..(885)

SEQ ID NO: 22872 - protein, 294 aa, Fusobacterium nucleatum; identical to SEQ ID NO: 10100

SEQ ID NO: 22873 - DNA, 795 bp, Clostridium perfringens; identical to SEQ ID NO: 10101
  CDS (1)..(795)

SEQ ID NO: 22874 - protein, 264 aa, Clostridium perfringens; identical to SEQ ID NO: 10102

SEQ ID NO: 22875 - DNA, 816 bp, Ralstonia solanacearum; identical to SEQ ID NO: 10103
  CDS (1)..(816)

SEQ ID NO: 22876 - protein, 271 aa, Ralstonia solanacearum; identical to SEQ ID NO: 10104

SEQ ID NO: 22877 - DNA, 834 bp, Rhizobium meliloti; identical to SEQ ID NO: 10105
  CDS (1)..(834)

SEQ ID NO: 22878 - protein, 277 aa, Rhizobium meliloti; identical to SEQ ID NO: 10106

SEQ ID NO: 22879 - DNA, 942 bp, Rhizobium meliloti; identical to SEQ ID NO: 10107
  CDS (1)..(942)

SEQ ID NO: 22880 - protein, 313 aa, Rhizobium meliloti; identical to SEQ ID NO: 10108

SEQ ID NO: 22881 - DNA, 816 bp, Rhizobium loti; identical to SEQ ID NO: 10109
  CDS (1)..(816)

SEQ ID NO: 22882 - protein, 271 aa, Rhizobium loti; identical to SEQ ID NO: 10110

SEQ ID NO: 22883 - DNA, 795 bp, Streptococcus pyogenes; identical to SEQ ID NO: 10111
  CDS (1)..(795)

SEQ ID NO: 22884 - protein, 264 aa, Streptococcus pyogenes; identical to SEQ ID NO: 10112

SEQ ID NO: 22885 - DNA, 870 bp, Pasteurella multocida; identical to SEQ ID NO: 10113
  CDS (1)..(870)

SEQ ID NO: 22886 - protein, 289 aa, Pasteurella multocida; identical to SEQ ID NO: 10114

SEQ ID NO: 22887 - DNA, 1839 bp, Arabidopsis thaliana; identical to SEQ ID NO: 10115
  CDS (241)..(1506)

SEQ ID NO: 22888 - protein, 421 aa, Arabidopsis thaliana; identical to SEQ ID NO: 10116

SEQ ID NO: 22889 - DNA, 813 bp, Brucella suis; identical to SEQ ID NO: 10117
  CDS (1)..(813)

SEQ ID NO: 22890 - protein, 270 aa, Brucella suis; identical to SEQ ID NO: 10118

SEQ ID NO: 22891 - DNA, 702 bp, Geobacter sulfurreducens; identical to SEQ ID NO: 10119
  CDS (1)..(702)

SEQ ID NO: 22892 - protein, 233 aa, Geobacter sulfurreducens; identical to SEQ ID NO: 10120

SEQ ID NO: 22893 - DNA, 936 bp, Mycobacterium paratuberculosis; identical to SEQ ID NO: 10121
  CDS (1)..(936)

SEQ ID NO: 22894 - protein, 311 aa, Mycobacterium paratuberculosis; identical to SEQ ID NO: 10122

SEQ ID NO: 22895 - DNA, 792 bp, Lactobacillus johnsonii; identical to SEQ ID NO: 10123
  CDS (1)..(792)

SEQ ID NO: 22896 - protein, 263 aa, Lactobacillus johnsonii; identical to SEQ ID NO: 10124

SEQ ID NO: 22897 - DNA, 858 bp, Treponema denticola; identical to SEQ ID NO: 10125
  CDS (1)..(858)

SEQ ID NO: 22898 - protein, 285 aa, Treponema denticola; identical to SEQ ID NO: 10126

SEQ ID NO: 22899 - DNA, 627 bp, Wolbachia pipientis wMel; identical to SEQ ID NO: 10127
  CDS (1)..(627)

SEQ ID NO: 22900 - protein, 208 aa, Wolbachia pipientis wMel; identical to SEQ ID NO: 10128

SEQ ID NO: 22901 - DNA, 792 bp, Bacillus cereus; identical to SEQ ID NO: 10129
  CDS (1)..(792)

SEQ ID NO: 22902 - protein, 263 aa, Bacillus cereus; identical to SEQ ID NO: 10130

SEQ ID NO: 22903 - DNA, 909 bp, Leptospira interrogans; identical to SEQ ID NO: 10131
  CDS (1)..(909)

SEQ ID NO: 22904 - protein, 302 aa, Leptospira interrogans; identical to SEQ ID NO: 10132

SEQ ID NO: 22905 - DNA, 657 bp, uncultured marine gamma proteobacterium EBAC20E09; identical to SEQ ID NO: 10133
  CDS (1)..(657)

SEQ ID NO: 22906 - protein, 218 aa, uncultured marine gamma proteobacterium EBAC20E09; identical to SEQ ID NO: 10134

SEQ ID NO: 22907 - DNA, 825 bp, Thermus thermophilus; identical to SEQ ID NO: 10135
  CDS (1)..(825)

SEQ ID NO: 22908 - protein, 274 aa, Thermus thermophilus; identical to SEQ ID NO: 10136

SEQ ID NO: 22909 - DNA, 807 bp, Desulfovibrio vulgaris; identical to SEQ ID NO: 10137
  CDS (1)..(807)

SEQ ID NO: 22910 - protein, 268 aa, Desulfovibrio vulgaris; identical to SEQ ID NO: 10138

SEQ ID NO: 22911 - DNA, 789 bp, Listeria monocytogenes str; identical to SEQ ID NO: 10139
  CDS (1)..(789)

SEQ ID NO: 22912 - protein, 262 aa, Listeria monocytogenes str; identical to SEQ ID NO: 10140

SEQ ID NO: 22913 - DNA, 1014 bp, Mycoplasma mobile 163K; identical to SEQ ID NO: 10141
  CDS (1)..(1014)

SEQ ID NO: 22914 - protein, 337 aa, Mycoplasma mobile 163K; identical to SEQ ID NO: 10142

SEQ ID NO: 22915 - DNA, 918 bp, Onion yellows phytoplasma; identical to SEQ ID NO: 10143
  CDS (1)..(918)

SEQ ID NO: 22916 - protein, 305 aa, Onion yellows phytoplasma; identical to SEQ ID NO: 10144

SEQ ID NO: 22917 - DNA, 1089 bp, Oryza sativa; identical to SEQ ID NO: 10145
  CDS (1)..(1089)

SEQ ID NO: 22918 - protein, 362 aa, Oryza sativa; identical to SEQ ID NO: 10146

SEQ ID NO: 22919 - DNA, 849 bp, Rhodopseudomonas palustris; identical to SEQ ID NO: 10147
  CDS (1)..(849)

SEQ ID NO: 22920 - protein, 282 aa, Rhodopseudomonas palustris; identical to SEQ ID NO: 10148

SEQ ID NO: 22921 - DNA, 879 bp, Corynebacterium diphtheriae; identical to SEQ ID NO: 10149
  CDS (1)..(879)

SEQ ID NO: 22922 - protein, 292 aa, Corynebacterium diphtheriae; identical to SEQ ID NO: 10150

SEQ ID NO: 22923 - DNA, 1026 bp, Mycoplasma mycoides; identical to SEQ ID NO: 10151
  CDS (1)..(1026)

SEQ ID NO: 22924 - protein, 341 aa, Mycoplasma mycoides; identical to SEQ ID NO: 10152

SEQ ID NO: 22925 - DNA, 837 bp, Bdellovibrio bacteriovorus; identical to SEQ ID NO: 10153
  CDS (1)..(837)

SEQ ID NO: 22926 - protein, 278 aa, Bdellovibrio bacteriovorus; identical to SEQ ID NO: 10154

SEQ ID NO: 22927 - DNA, 939 bp, Parachlamydia sp; identical to SEQ ID NO: 10155
  CDS (1)..(939)

SEQ ID NO: 22928 - protein, 312 aa, Parachlamydia sp; identical to SEQ ID NO: 10156

SEQ ID NO: 22929 - DNA, 849 bp, Photobacterium profundum; identical to SEQ ID NO: 10157
  CDS (1)..(849)

SEQ ID NO: 22930 - protein, 282 aa, Photobacterium profundum; identical to SEQ ID NO: 10158

SEQ ID NO: 22931 - DNA, 20 bp, Primer
atgctggcagcgtgggaatg

SEQ ID NO: 22932 - DNA, 25 bp, Primer
ttaaagcgtcctgaataccagtaac

SEQ ID NO: 22933 - DNA, 1224 bp, Escherichia coli; identical to SEQ ID NO: 1403
  CDS (285)..(1166)

SEQ ID NO: 22934 - protein, 293 aa, Escherichia coli; identical to SEQ ID NO: 514

SEQ ID NO: 22935 - DNA, 882 bp, Yersinia pestis; identical to SEQ ID NO: 525
  CDS (1)..(882)

SEQ ID NO: 22936 - protein, 293 aa, Yersinia pestis; identical to SEQ ID NO: 526

SEQ ID NO: 22937 - DNA, 882 bp, Salmonella typhimurium; identical to SEQ ID NO: 1407
  CDS (1)..(882)

SEQ ID NO: 22938 - protein, 293 aa, Salmonella typhimurium; identical to SEQ ID NO: 524

SEQ ID NO: 22939 - DNA, 882 bp, Escherichia coli; identical to SEQ ID NO: 519
  CDS (1)..(882)

SEQ ID NO: 22940 - protein, 293 aa, Escherichia coli; identical to SEQ ID NO: 520

SEQ ID NO: 22941 - DNA, 864 bp, Vibrio cholerae; identical to SEQ ID NO: 531
  CDS (1)..(864)

SEQ ID NO: 22942 - protein, 287 aa, Vibrio cholerae; identical to SEQ ID NO: 532

SEQ ID NO: 22943 - DNA, 879 bp, Buchnera aphidicola str. APS (Acyrthosiphon pisum); identical to SEQ ID NO: 1413
  CDS (1)..(879)

SEQ ID NO: 22944 - protein, 292 aa, Buchnera aphidicola str. APS (Acyrthosiphon pisum); identical to SEQ ID NO: 528

SEQ ID NO: 22945 - DNA, 852 bp, Haemophilus influenzae; identical to SEQ ID NO: 533
  CDS (1)..(852)

SEQ ID NO: 22946 - protein, 283 aa, Haemophilus influenzae; identical to SEQ ID NO: 534

SEQ ID NO: 22947 - DNA, 879 bp, Buchnera aphidicola str. Sg (Schizaphis graminum); identical to SEQ ID NO: 537
  CDS (1)..(879)

SEQ ID NO: 22948 - protein, 292 aa, Buchnera aphidicola str. Sg (Schizaphis graminum); identical to SEQ ID NO: 538

SEQ ID NO: 22949 - DNA, 861 bp, Pasteurella multocida; identical to SEQ ID NO: 535
  CDS (1)..(861)

SEQ ID NO: 22950 - protein, 286 aa, Pasteurella multocida; identical to SEQ ID NO: 536

SEQ ID NO: 22951 - DNA, 882 bp, Escherichia coli; identical to SEQ ID NO: 1421
  CDS (1)..(882): r means g or a

SEQ ID NO: 22952 - protein, 293 aa, Escherichia coli; identical to SEQ ID NO: 1422
  misc_feature (288)..(288): Xaa can be Ala or Thr

SEQ ID NO: 22953 - DNA, 870 bp, Haemophilus ducreyi; identical to SEQ ID NO: 539
  CDS (1)..(870)

SEQ ID NO: 22954 - protein, 289 aa, Haemophilus ducreyi; identical to SEQ ID NO: 540

SEQ ID NO: 22955 - DNA, 777 bp, Vibrio vulnificus; identical to SEQ ID NO: 1425
  CDS (1)..(777)

SEQ ID NO: 22956 - protein, 258 aa, Vibrio vulnificus; identical to SEQ ID NO: 530

SEQ ID NO: 22957 - DNA, 879 bp, Xanthomonas axonopodis (pv. citri); identical to SEQ ID NO: 543
  CDS (1)..(879)

SEQ ID NO: 22958 - protein, 292 aa, Xanthomonas axonopodis (pv. citri); identical to SEQ ID NO: 544

SEQ ID NO: 22959 - DNA, 879 bp, Xanthomonas campestris (pv. campestris); identical to SEQ ID NO: 541
  CDS (1)..(879)

SEQ ID NO: 22960 - protein, 292 aa, Xanthomonas campestris (pv. campestris); identical to SEQ ID NO: 542

SEQ ID NO: 22961 - DNA, 22 bp, Primer
atgatgcgaatcgcgctcttcc

SEQ ID NO: 22962 - DNA, 24 bp, Primer
ttacttcaggtattcacccgtacg

SEQ ID NO: 22963 - DNA, 1062 bp, Escherichia coli K12; identical to SEQ ID NO: 2732
  CDS (1)..(1062)

SEQ ID NO: 22964 - protein, 353 aa, Escherichia coli K12; identical to SEQ ID NO: 2733

SEQ ID NO: 22965 - DNA, 1444 bp, Pseudomonas fluorescens; identical to SEQ ID NO: 2734
  CDS (156)..(1214)

SEQ ID NO: 22966 - protein, 352 aa, Pseudomonas fluorescens; identical to SEQ ID NO: 2735

SEQ ID NO: 22967 - DNA, 1484 bp, Haemophilus influenzae; identical to SEQ ID NO: 2736
  CDS (278)..(1342)

SEQ ID NO: 22968 - protein, 354 aa, Haemophilus influenzae; identical to SEQ ID NO: 2737

SEQ ID NO: 22969 - DNA, 1131 bp, Thermus aquaticus; identical to SEQ ID NO: 2738
  CDS (62)..(1084)

SEQ ID NO: 22970 - protein, 340 aa, Thermus aquaticus; identical to SEQ ID NO: 2739

SEQ ID NO: 22971 - DNA, 1196 bp, Aquifex pyrophilus; identical to SEQ ID NO: 2740
  CDS (51)..(1097)

SEQ ID NO: 22972 - protein, 348 aa, Aquifex pyrophilus; identical to SEQ ID NO: 2741

SEQ ID NO: 22973 - DNA, 1023 bp, Rickettsia prowazekii; identical to SEQ ID NO: 2742
  CDS (1)..(1023)

SEQ ID NO: 22974 - protein, 340 aa, Rickettsia prowazekii; identical to SEQ ID NO: 2743

SEQ ID NO: 22975 - DNA, 1329 bp, Myxococcus xanthus; identical to SEQ ID NO: 2744
  CDS (201)..(1229)

SEQ ID NO: 22976 - protein, 342 aa, Myxococcus xanthus; identical to SEQ ID NO: 2745

SEQ ID NO: 22977 - DNA, 1394 bp, Legionella pneumophila; identical to SEQ ID NO: 2746
  CDS (166)..(1212)

SEQ ID NO: 22978 - protein, 348 aa, Legionella pneumophila; identical to SEQ ID NO: 2747

SEQ ID NO: 22979 - DNA, 1224 bp, Treponema pallidum subsp. pallidum (syphilis spirochete); identical to SEQ ID NO: 2748
  CDS (1)..(1224): k means g or t/u

SEQ ID NO: 22980 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 22981 - DNA, 1050 bp, Clostridium acetobutylicum; identical to SEQ ID NO: 2750
  CDS (1)..(1050)

SEQ ID NO: 22982 - protein, 349 aa, Clostridium acetobutylicum; identical to SEQ ID NO: 2751

SEQ ID NO: 22983 - DNA, 1047 bp, Listeria innocua; identical to SEQ ID NO: 2752
  CDS (1)..(1047)

SEQ ID NO: 22984 - protein, 348 aa, Listeria innocua; identical to SEQ ID NO: 2753

SEQ ID NO: 22985 - DNA, 1137 bp, Brucella melitensis; identical to SEQ ID NO: 2754
  CDS (1)..(1137)

SEQ ID NO: 22986 - protein, 378 aa, Brucella melitensis; identical to SEQ ID NO: 2755

SEQ ID NO: 22987 - DNA, 1062 bp, Salmonella enterica subsp. enterica serovar Typhi; identical to SEQ ID NO: 2756
  CDS (1)..(1062)

SEQ ID NO: 22988 - protein, 353 aa, Salmonella enterica subsp. enterica serovar Typhi; identical to SEQ ID NO: 2757

SEQ ID NO: 22989 - DNA, 1074 bp, Nostoc sp. PCC 7120; identical to SEQ ID NO: 2758
  CDS (1)..(1074)

SEQ ID NO: 22990 - protein, 357 aa, Nostoc sp. PCC 7120; identical to SEQ ID NO: 2759

SEQ ID NO: 22991 - DNA, 1044 bp, Xylella fastidiosa; identical to SEQ ID NO: 2760
  CDS (1)..(1044)

SEQ ID NO: 22992 - protein, 347 aa, Xylella fastidiosa; identical to SEQ ID NO: 2761

SEQ ID NO: 22993 - DNA, 1164 bp, Lactococcus lactis subsp. lactis; identical to SEQ ID NO: 2762
  CDS (1)..(1164)

SEQ ID NO: 22994 - protein, 387 aa, Lactococcus lactis subsp. lactis; identical to SEQ ID NO: 2763

SEQ ID NO: 22995 - DNA, 2025 bp, Borrelia burgdorferi (Lyme disease spirochete); identical to SEQ ID NO: 2764
  CDS (25)..(1122)

SEQ ID NO: 22996 - protein, 365 aa, Borrelia burgdorferi (Lyme disease spirochete); identical to SEQ ID NO: 2765

SEQ ID NO: 22997 - DNA, 1728 bp, Deinococcus radiodurans; identical to SEQ ID NO: 2766
  CDS (399)..(1490)

SEQ ID NO: 22998 - protein, 363 aa, Deinococcus radiodurans; identical to SEQ ID NO: 2767

SEQ ID NO: 22999 - DNA, 1071 bp, Caulobacter crescentus; identical to SEQ ID NO: 2768
  CDS (1)..(1071)

SEQ ID NO: 23000 - protein, 356 aa, Caulobacter crescentus; identical to SEQ ID NO: 2769

SEQ ID NO: 23001 - DNA, 1199 bp, Thermotoga maritima; identical to SEQ ID NO: 2770
  CDS (67)..(1137)

SEQ ID NO: 23002 - protein, 356 aa, Thermotoga maritima; identical to SEQ ID NO: 2771

SEQ ID NO: 23003 - DNA, 1662 bp, Arabidopsis thaliana (mouse-ear cress); identical to SEQ ID NO: 2772
  CDS (368)..(1498)

SEQ ID NO: 23004 - protein, 376 aa, Arabidopsis thaliana (mouse-ear cress); identical to SEQ ID NO: 2773

SEQ ID NO: 23005 - DNA, 1038 bp, Aquifex aeolicus; identical to SEQ ID NO: 2774
  CDS (1)..(1038)

SEQ ID NO: 23006 - protein, 345 aa, Aquifex aeolicus; identical to SEQ ID NO: 2775

SEQ ID NO: 23007 - DNA, 1062 bp, Chlamydophila pneumoniae, Chlamydia pneumoniae; identical to SEQ ID NO: 2776
  CDS (1)..(1062)

SEQ ID NO: 23008 - protein, 353 aa, Chlamydophila pneumoniae, Chlamydia pneumoniae; identical to SEQ ID NO: 2777

SEQ ID NO: 23009 - DNA, 1047 bp, Neisseria meningitidis; identical to SEQ ID NO: 2778
  CDS (1)..(1047)

SEQ ID NO: 23010 - protein, 348 aa, Neisseria meningitidis; identical to SEQ ID NO: 2779

SEQ ID NO: 23011 - DNA, 1032 bp, Campylobacter jejuni; identical to SEQ ID NO: 2780
  CDS (1)..(1032)

SEQ ID NO: 23012 - protein, 343 aa, Campylobacter jejuni; identical to SEQ ID NO: 2781

SEQ ID NO: 23013 - DNA, 1065 bp, Chlamydia muridarum, Chlamydia trachomatis MoPn; identical to SEQ ID NO: 2782
  CDS (1)..(1065)

SEQ ID NO: 23014 - protein, 354 aa, Chlamydia muridarum, Chlamydia trachomatis MoPn; identical to SEQ ID NO: 2783

SEQ ID NO: 23015 - DNA, 1050 bp, Bacillus halodurans; identical to SEQ ID NO: 2784
  CDS (1)..(1050)

SEQ ID NO: 23016 - protein, 349 aa, Bacillus halodurans; identical to SEQ ID NO: 2785

SEQ ID NO: 23017 - DNA, 1229 bp, Streptococcus pneumoniae; identical to SEQ ID NO: 2786
  CDS (26)..(1192)

SEQ ID NO: 23018 - protein, 388 aa, Streptococcus pneumoniae; identical to SEQ ID NO: 2787

SEQ ID NO: 23019 - DNA, 1251 bp, Agrobacterium tumefaciens; identical to SEQ ID NO: 2788
  CDS (1)..(1251)

SEQ ID NO: 23020 - protein, 416 aa, Agrobacterium tumefaciens; identical to SEQ ID NO: 2789

SEQ ID NO: 23021 - DNA, 1044 bp, Staphylococcus aureus; identical to SEQ ID NO: 2790
  CDS (1)..(1044)

SEQ ID NO: 23022 - protein, 347 aa, Staphylococcus aureus; identical to SEQ ID NO: 2791

SEQ ID NO: 23023 - DNA, 1506 bp, Acinetobacter calcoaceticus; identical to SEQ ID NO: 2792
  CDS (403)..(1452)

SEQ ID NO: 23024 - protein, 349 aa, Acinetobacter calcoaceticus; identical to SEQ ID NO: 2793

SEQ ID NO: 23025 - DNA, 1479 bp, Brucella abortus; identical to SEQ ID NO: 2794
  CDS (316)..(1398)

SEQ ID NO: 23026 - protein, 360 aa, Brucella abortus; identical to SEQ ID NO: 2795

SEQ ID NO: 23027 - DNA, 981 bp, Streptococcus pyogenes; identical to SEQ ID NO: 2796
  CDS (1)..(981)

SEQ ID NO: 23028 - protein, 326 aa, Streptococcus pyogenes; identical to SEQ ID NO: 2797

SEQ ID NO: 23029 - DNA, 1349 bp, Leptospira biflexa; identical to SEQ ID NO: 2798
  CDS (107)..(1270)

SEQ ID NO: 23030 - protein, 387 aa, Leptospira biflexa; identical to SEQ ID NO: 2799

SEQ ID NO: 23031 - DNA, 1762 bp, Xanthomonas campestris pv. campestris; identical to SEQ ID NO: 2800
  CDS (159)..(1190)

SEQ ID NO: 23032 - protein, 343 aa, Xanthomonas campestris pv. campestris; identical to SEQ ID NO: 2801

SEQ ID NO: 23033 - DNA, 1212 bp, Aeromonas salmonicida; identical to SEQ ID NO: 2802
  CDS (151)..(1212)

SEQ ID NO: 23034 - protein, 353 aa, Aeromonas salmonicida; identical to SEQ ID NO: 2803

SEQ ID NO: 23035 - DNA, 1433 bp, Azotobacter vinelandii; identical to SEQ ID NO: 2804
  CDS (311)..(1360)

SEQ ID NO: 23036 - protein, 349 aa, Azotobacter vinelandii; identical to SEQ ID NO: 2805

SEQ ID NO: 23037 - DNA, 1108 bp, Acetobacter polyoxogenes; identical to SEQ ID NO: 2806
  CDS (35)..(1081)

SEQ ID NO: 23038 - protein, 348 aa, Acetobacter polyoxogenes; identical to SEQ ID NO: 2807

SEQ ID NO: 23039 - DNA, 1230 bp, Neisseria gonorrhoeae; identical to SEQ ID NO: 2808
  CDS (133)..(1179)

SEQ ID NO: 23040 - protein, 348 aa, Neisseria gonorrhoeae; identical to SEQ ID NO: 2809

SEQ ID NO: 23041 - DNA, 1649 bp, Bacteroides fragilis; identical to SEQ ID NO: 2810
  CDS (351)..(1307)

SEQ ID NO: 23042 - protein, 318 aa, Bacteroides fragilis; identical to SEQ ID NO: 2811

SEQ ID NO: 23043 - DNA, 1349 bp, Methylobacillus sp; identical to SEQ ID NO: 2812
  CDS (293)..(1327)

SEQ ID NO: 23044 - protein, 344 aa, Methylobacillus sp; identical to SEQ ID NO: 2813

SEQ ID NO: 23045 - DNA, 1320 bp, Vibrio anguillarum; identical to SEQ ID NO: 2814
  CDS (166)..(1212)

SEQ ID NO: 23046 - protein, 348 aa, Vibrio anguillarum; identical to SEQ ID NO: 2815

SEQ ID NO: 23047 - DNA, 1394 bp, Anabaena variabilis; identical to SEQ ID NO: 2816
  CDS (125)..(1201)

SEQ ID NO: 23048 - protein, 358 aa, Anabaena variabilis; identical to SEQ ID NO: 2817

SEQ ID NO: 23049 - DNA, 1334 bp, Bacillus subtilis; identical to SEQ ID NO: 2818
  CDS (215)..(1258)

SEQ ID NO: 23050 - protein, 347 aa, Bacillus subtilis; identical to SEQ ID NO: 2819

SEQ ID NO: 23051 - DNA, 1348 bp, Proteus mirabilis; identical to SEQ ID NO: 2820
  CDS (151)..(1218)

SEQ ID NO: 23052 - protein, 355 aa, Proteus mirabilis; identical to SEQ ID NO: 2821

SEQ ID NO: 23053 - DNA, 1384 bp, Pseudomonas aeruginosa; identical to SEQ ID NO: 2822
  CDS (145)..(1185)

SEQ ID NO: 23054 - protein, 346 aa, Pseudomonas aeruginosa; identical to SEQ ID NO: 2823

SEQ ID NO: 23055 - DNA, 1352 bp, Pseudomonas cepacia; identical to SEQ ID NO: 2824
  CDS (223)..(1266)

SEQ ID NO: 23056 - protein, 347 aa, Pseudomonas cepacia; identical to SEQ ID NO: 2825

SEQ ID NO: 23057 - DNA, 1047 bp, Synechococcus sp; identical to SEQ ID NO: 2826
  CDS (1)..(1047)

SEQ ID NO: 23058 - protein, 348 aa, Synechococcus sp; identical to SEQ ID NO: 2827

SEQ ID NO: 23059 - DNA, 1190 bp, Aquaspirillum magnetotacticum; identical to SEQ ID NO: 2828
  CDS (112)..(1146)

SEQ ID NO: 23060 - protein, 344 aa, Aquaspirillum magnetotacticum; identical to SEQ ID NO: 2829

SEQ ID NO: 23061 - DNA, 1841 bp, Rhizobium leguminosarum bv. viciae; identical to SEQ ID NO: 2830
  CDS (32)..(1087)

SEQ ID NO: 23062 - protein, 351 aa, Rhizobium leguminosarum bv. viciae; identical to SEQ ID NO: 2831

SEQ ID NO: 23063 - DNA, 1047 bp, Rhizobium meliloti; identical to SEQ ID NO: 2832
  CDS (1)..(1047)

SEQ ID NO: 23064 - protein, 348 aa, Rhizobium meliloti; identical to SEQ ID NO: 2833

SEQ ID NO: 23065 - DNA, 2762 bp, Mycobacterium tuberculosis; identical to SEQ ID NO: 2834
  CDS (311)..(2683)

SEQ ID NO: 23066 - protein, 790 aa, Mycobacterium tuberculosis; identical to SEQ ID NO: 2835

SEQ ID NO: 23067 - DNA, 1249 bp, Methylomonas clara; identical to SEQ ID NO: 2836
  CDS (123)..(1151)

SEQ ID NO: 23068 - protein, 342 aa, Methylomonas clara; identical to SEQ ID NO: 2837

SEQ ID NO: 23069 - DNA, 1065 bp, Enterobacter agglomerans; identical to SEQ ID NO: 2838
  CDS (1)..(1065)

SEQ ID NO: 23070 - protein, 354 aa, Enterobacter agglomerans; identical to SEQ ID NO: 2839

SEQ ID NO: 23071 - DNA, 1125 bp, Streptomyces lividans; identical to SEQ ID NO: 2840
  CDS (1)..(1125)

SEQ ID NO: 23072 - protein, 374 aa, Streptomyces lividans; identical to SEQ ID NO: 2841

SEQ ID NO: 23073 - DNA, 1347 bp, Rhodobacter sphaeroides; identical to SEQ ID NO: 2842
  CDS (220)..(1251)

SEQ ID NO: 23074 - protein, 343 aa, Rhodobacter sphaeroides; identical to SEQ ID NO: 2843

SEQ ID NO: 23075 - DNA, 1065 bp, Vibrio cholerae; identical to SEQ ID NO: 2844
  CDS (1)..(1065)

SEQ ID NO: 23076 - protein, 354 aa, Vibrio cholerae; identical to SEQ ID NO: 2845

SEQ ID NO: 23077 - DNA, 1068 bp, Rhodobacter capsulatus; identical to SEQ ID NO: 2846
  CDS (1)..(1068)

SEQ ID NO: 23078 - protein, 355 aa, Rhodobacter capsulatus; identical to SEQ ID NO: 2847

SEQ ID NO: 23079 - DNA, 1533 bp, Helicobacter pylori; identical to SEQ ID NO: 2848
  CDS (275)..(1318)

SEQ ID NO: 23080 - protein, 347 aa, Helicobacter pylori; identical to SEQ ID NO: 2849

SEQ ID NO: 23081 - DNA, 1065 bp, Synechocystis sp; identical to SEQ ID NO: 2850
  CDS (1)..(1065)

SEQ ID NO: 23082 - protein, 354 aa, Synechocystis sp; identical to SEQ ID NO: 2851

SEQ ID NO: 23083 - DNA, 1351 bp, Arabidopsis thaliana (mouse-ear cress); identical to SEQ ID NO: 2852
  CDS (1)..(1320)

SEQ ID NO: 23084 - protein, 439 aa, Arabidopsis thaliana (mouse-ear cress); identical to SEQ ID NO: 2853

SEQ ID NO: 23085 - DNA, 1392 bp, Pseudomonas putida; identical to SEQ ID NO: 2854
  CDS (111)..(1178)

SEQ ID NO: 23086 - protein, 355 aa, Pseudomonas putida; identical to SEQ ID NO: 2855

SEQ ID NO: 23087 - DNA, 1053 bp, Mycobacterium tuberculosis; identical to SEQ ID NO: 2856
  CDS (1)..(1053)

SEQ ID NO: 23088 - protein, 350 aa, Mycobacterium tuberculosis; identical to SEQ ID NO: 2857

SEQ ID NO: 23089 - DNA, 1053 bp, Wolinella succinogenes; identical to SEQ ID NO: 2858
  CDS (1)..(1053)

SEQ ID NO: 23090 - protein, 350 aa, Wolinella succinogenes; identical to SEQ ID NO: 2859

SEQ ID NO: 23091 - DNA, 1110 bp, Vibrio vulnificus; identical to SEQ ID NO: 2860
  CDS (1)..(1110)

SEQ ID NO: 23092 - protein, 369 aa, Vibrio vulnificus; identical to SEQ ID NO: 2861

SEQ ID NO: 23093 - DNA, 1068 bp, Photorhabdus luminescens; identical to SEQ ID NO: 2862
  CDS (1)..(1068)

SEQ ID NO: 23094 - protein, 355 aa, Photorhabdus luminescens; identical to SEQ ID NO: 2863

SEQ ID NO: 23095 - DNA, 1110 bp, Gloeobacter violaceus; identical to SEQ ID NO: 2864
  CDS (1)..(1110)

SEQ ID NO: 23096 - protein, 369 aa, Gloeobacter violaceus; identical to SEQ ID NO: 2865

SEQ ID NO: 23097 - DNA, 1053 bp, Chromobacterium violaceum; identical to SEQ ID NO: 2866
  CDS (1)..(1053)

SEQ ID NO: 23098 - protein, 350 aa, Chromobacterium violaceum; identical to SEQ ID NO: 2867

SEQ ID NO: 23099 - DNA, 1128 bp, Synechococcus sp; identical to SEQ ID NO: 2868
  CDS (1)..(1128)

SEQ ID NO: 23100 - protein, 375 aa, Synechococcus sp; identical to SEQ ID NO: 2869

SEQ ID NO: 23101 - DNA, 1128 bp, Rhodopirellula baltica; identical to SEQ ID NO: 2870
  CDS (1)..(1128)

SEQ ID NO: 23102 - protein, 375 aa, Rhodopirellula baltica; identical to SEQ ID NO: 2871

SEQ ID NO: 23103 - DNA, 1113 bp, Prochlorococcus marinus subsp; identical to SEQ ID NO: 2872
  CDS (1)..(1113)

SEQ ID NO: 23104 - protein, 370 aa, Prochlorococcus marinus subsp; identical to SEQ ID NO: 2873

SEQ ID NO: 23105 - DNA, 1140 bp, Prochlorococcus marinus; identical to SEQ ID NO: 2874
  CDS (1)..(1140)

SEQ ID NO: 23106 - protein, 379 aa, Prochlorococcus marinus; identical to SEQ ID NO: 2875

SEQ ID NO: 23107 - DNA, 1140 bp, Prochlorococcus marinus; identical to SEQ ID NO: 2876
  CDS (1)..(1140)

SEQ ID NO: 23108 - protein, 379 aa, Prochlorococcus marinus; identical to SEQ ID NO: 2877

SEQ ID NO: 23109 - DNA, 1038 bp, Helicobacter hepaticus; identical to SEQ ID NO: 2878
  CDS (1)..(1038)

SEQ ID NO: 23110 - protein, 345 aa, Helicobacter hepaticus; identical to SEQ ID NO: 2879

SEQ ID NO: 23111 - DNA, 1119 bp, Haemophilus ducreyi; identical to SEQ ID NO: 2880
  CDS (1)..(1119)

SEQ ID NO: 23112 - protein, 372 aa, Haemophilus ducreyi; identical to SEQ ID NO: 2881

SEQ ID NO: 23113 - DNA, 1048 bp, Campylobacter lari; identical to SEQ ID NO: 2882
  CDS (9)..(1043)

SEQ ID NO: 23114 - protein, 344 aa, Campylobacter lari; identical to SEQ ID NO: 2883

SEQ ID NO: 23115 - DNA, 1077 bp, Burkholderia fungorum; identical to SEQ ID NO: 2884
  CDS (1)..(1077)

SEQ ID NO: 23116 - protein, 358 aa, Burkholderia fungorum; identical to SEQ ID NO: 2885

SEQ ID NO: 23117 - DNA, 963 bp, Mycobacteriophage CJW1; identical to SEQ ID NO: 2886
  CDS (1)..(963)

SEQ ID NO: 23118 - protein, 320 aa, Mycobacteriophage CJW1; identical to SEQ ID NO: 2887

SEQ ID NO: 23119 - DNA, 1563 bp, Zymomonas mobilis; identical to SEQ ID NO: 2888
  CDS (231)..(1250)

SEQ ID NO: 23120 - protein, 339 aa, Zymomonas mobilis; identical to SEQ ID NO: 2889

SEQ ID NO: 23121 - DNA, 1038 bp, Bacillus megaterium; identical to SEQ ID NO: 2890
  CDS (1)..(1038)

SEQ ID NO: 23122 - protein, 345 aa, Bacillus megaterium; identical to SEQ ID NO: 2891

SEQ ID NO: 23123 - DNA, 1038 bp, Bacillus megaterium; identical to SEQ ID NO: 2892
  CDS (1)..(1038)

SEQ ID NO: 23124 - protein, 345 aa, Bacillus megaterium; identical to SEQ ID NO: 2893

SEQ ID NO: 23125 - DNA, 1044 bp, Bacillus amyloliquefaciens; identical to SEQ ID NO: 2894
  CDS (1)..(1044)

SEQ ID NO: 23126 - protein, 347 aa, Bacillus amyloliquefaciens; identical to SEQ ID NO: 2895

SEQ ID NO: 23127 - DNA, 1047 bp, Listeria monocytogenes; identical to SEQ ID NO: 2896
  CDS (1)..(1047): m means a or c

SEQ ID NO: 23128 - protein, 348 aa, Listeria monocytogenes; identical to SEQ ID NO: 2897
  misc_feature (228)..(228): Xaa can be Pro or Gln

SEQ ID NO: 23129 - DNA, 1035 bp, Oryza sativa; identical to SEQ ID NO: 2898
  CDS (1)..(1035)

SEQ ID NO: 23130 - protein, 344 aa, Oryza sativa; identical to SEQ ID NO: 2899

SEQ ID NO: 23131 - DNA, 1035 bp, Campylobacter lari; identical to SEQ ID NO: 2900
  CDS (1)..(1035)

SEQ ID NO: 23132 - protein, 344 aa, Campylobacter lari; identical to SEQ ID NO: 2901

SEQ ID NO: 23133 - DNA, 2035 bp, Borrelia hermsii; identical to SEQ ID NO: 2902
  CDS (256)..(1326)

SEQ ID NO: 23134 - protein, 356 aa, Borrelia hermsii; identical to SEQ ID NO: 2903

SEQ ID NO: 23135 - DNA, 1487 bp, Chlamydomonas reinhardtii; identical to SEQ ID NO: 2904
  CDS (121)..(1365)

SEQ ID NO: 23136 - protein, 414 aa, Chlamydomonas reinhardtii; identical to SEQ ID NO: 2905

SEQ ID NO: 23137 - DNA, 1669 bp, Streptococcus suis; identical to SEQ ID NO: 2906
  CDS (469)..(1500)

SEQ ID NO: 23138 - protein, 343 aa, Streptococcus suis; identical to SEQ ID NO: 2907

SEQ ID NO: 23139 - DNA, 1439 bp, Peanut witches; identical to SEQ ID NO: 2908
  CDS (218)..(1228)

SEQ ID NO: 23140 - protein, 336 aa, Peanut witches; identical to SEQ ID NO: 2909

SEQ ID NO: 23141 - DNA, 1377 bp, Myxococcus xanthus; identical to SEQ ID NO: 2910
  CDS (201)..(1277)

SEQ ID NO: 23142 - protein, 358 aa, Myxococcus xanthus; identical to SEQ ID NO: 2911

SEQ ID NO: 23143 - DNA, 1404 bp, Acidiphilium facilis; identical to SEQ ID NO: 2912
  CDS (187)..(1251)

SEQ ID NO: 23144 - protein, 354 aa, Acidiphilium facilis; identical to SEQ ID NO: 2913

SEQ ID NO: 23145 - DNA, 1059 bp, Actinobacillus actinomycetemcomitans; identical to SEQ ID NO: 2914
  CDS (1)..(1059)

SEQ ID NO: 23146 - protein, 352 aa, Actinobacillus actinomycetemcomitans; identical to SEQ ID NO: 2915

SEQ ID NO: 23147 - DNA, 1565 bp, Alcaligenes eutrophus; identical to SEQ ID NO: 2916
  CDS (194)..(1255)

SEQ ID NO: 23148 - protein, 353 aa, Alcaligenes eutrophus; identical to SEQ ID NO: 2917

SEQ ID NO: 23149 - DNA, 1047 bp, Amycolatopsis mediterranei; identical to SEQ ID NO: 2918
  CDS (1)..(1047)

SEQ ID NO: 23150 - protein, 348 aa, Amycolatopsis mediterranei; identical to SEQ ID NO: 2919

SEQ ID NO: 23151 - DNA, 1035 bp, Bacteroides thetaiotaomicron; identical to SEQ ID NO: 2920
  CDS (1)..(1035)

SEQ ID NO: 23152 - protein, 344 aa, Bacteroides thetaiotaomicron; identical to SEQ ID NO: 2921

SEQ ID NO: 23153 - DNA, 1194 bp, Bifidobacterium longum; identical to SEQ ID NO: 2922
  CDS (1)..(1194)

SEQ ID NO: 23154 - protein, 397 aa, Bifidobacterium longum; identical to SEQ ID NO: 2923

SEQ ID NO: 23155 - DNA, 1062 bp, Bordetella pertussis; identical to SEQ ID NO: 2924
  CDS (1)..(1062)

SEQ ID NO: 23156 - protein, 353 aa, Bordetella pertussis; identical to SEQ ID NO: 2925

SEQ ID NO: 23157 - DNA, 1089 bp, Bradyrhizobium japonicum; identical to SEQ ID NO: 2926
  CDS (1)..(1089)

SEQ ID NO: 23158 - protein, 362 aa, Bradyrhizobium japonicum; identical to SEQ ID NO: 2927

SEQ ID NO: 23159 - DNA, 2058 bp, Campylobacter fetus; identical to SEQ ID NO: 2928
  CDS (401)..(1438)

SEQ ID NO: 23160 - protein, 345 aa, Campylobacter fetus; identical to SEQ ID NO: 2929

SEQ ID NO: 23161 - DNA, 1458 bp, Chloroflexus aurantiacus; identical to SEQ ID NO: 2930
  CDS (116)..(1171)

SEQ ID NO: 23162 - protein, 351 aa, Chloroflexus aurantiacus; identical to SEQ ID NO: 2931

SEQ ID NO: 23163 - DNA, 1053 bp, Chlamydophila caviae; identical to SEQ ID NO: 2932
  CDS (1)..(1053)

SEQ ID NO: 23164 - protein, 350 aa, Chlamydophila caviae; identical to SEQ ID NO: 2933

SEQ ID NO: 23165 - DNA, 1087 bp, Chromatium vinosum; identical to SEQ ID NO: 2934
  CDS (1)..(1044)

SEQ ID NO: 23166 - protein, 347 aa, Chromatium vinosum; identical to SEQ ID NO: 2935

SEQ ID NO: 23167 - DNA, 1346 bp, Clostridium perfringens; identical to SEQ ID NO: 2936
  CDS (172)..(1230)

SEQ ID NO: 23168 - protein, 352 aa, Clostridium perfringens; identical to SEQ ID NO: 2937

SEQ ID NO: 23169 - DNA, 1053 bp, Clostridium tetani; identical to SEQ ID NO: 2938
  CDS (1)..(1053)

SEQ ID NO: 23170 - protein, 350 aa, Clostridium tetani; identical to SEQ ID NO: 2939

SEQ ID NO: 23171 - DNA, 1161 bp, Corynebacterium efficiens; identical to SEQ ID NO: 2940
  CDS (1)..(1161)

SEQ ID NO: 23172 - protein, 386 aa, Corynebacterium efficiens; identical to SEQ ID NO: 2941

SEQ ID NO: 23173 - DNA, 1402 bp, Corynebacterium glutamicum; identical to SEQ ID NO: 2942
  CDS (133)..(1263)

SEQ ID NO: 23174 - protein, 376 aa, Corynebacterium glutamicum; identical to SEQ ID NO: 2943

SEQ ID NO: 23175 - DNA, 1409 bp, Corynebacterium pseudotuberculosis; identical to SEQ ID NO: 2944
  CDS (223)..(1332)

SEQ ID NO: 23176 - protein, 369 aa, Corynebacterium pseudotuberculosis; identical to SEQ ID NO: 2945

SEQ ID NO: 23177 - DNA, 1032 bp, Coxiella burnetii; identical to SEQ ID NO: 2946
  CDS (1)..(1032)

SEQ ID NO: 23178 - protein, 343 aa, Coxiella burnetii; identical to SEQ ID NO: 2947

SEQ ID NO: 23179 - DNA, 1047 bp, Enterococcus faecalis; identical to SEQ ID NO: 2948
  CDS (1)..(1047)

SEQ ID NO: 23180 - protein, 348 aa, Enterococcus faecalis; identical to SEQ ID NO: 2949

SEQ ID NO: 23181 - DNA, 1072 bp, Erwinia carotovora; identical to SEQ ID NO: 2950
  CDS (1)..(1029)

SEQ ID NO: 23182 - protein, 342 aa, Erwinia carotovora; identical to SEQ ID NO: 2951

SEQ ID NO: 23183 - DNA, 1137 bp, Fusobacterium nucleatum; identical to SEQ ID NO: 2952
  CDS (1)..(1137)

SEQ ID NO: 23184 - protein, 378 aa, Fusobacterium nucleatum; identical to SEQ ID NO: 2953

SEQ ID NO: 23185 - DNA, 1613 bp, Herbaspirillum seropedicae; identical to SEQ ID NO: 2954
  CDS (199)..(1254)

SEQ ID NO: 23186 - protein, 351 aa, Herbaspirillum seropedicae; identical to SEQ ID NO: 2955

SEQ ID NO: 23187 - DNA, 1143 bp, Lactobacillus plantarum; identical to SEQ ID NO: 2956
  CDS (1)..(1143)

SEQ ID NO: 23188 - protein, 380 aa, Lactobacillus plantarum; identical to SEQ ID NO: 2957

SEQ ID NO: 23189 - DNA, 1101 bp, Leptospira interrogans; identical to SEQ ID NO: 2958
  CDS (1)..(1101)

SEQ ID NO: 23190 - protein, 366 aa, Leptospira interrogans; identical to SEQ ID NO: 2959

SEQ ID NO: 23191 - DNA, 1126 bp, Mycoplasma mycoides; identical to SEQ ID NO: 2960
  CDS (79)..(1116)

SEQ ID NO: 23192 - protein, 345 aa, Mycoplasma mycoides; identical to SEQ ID NO: 2961

SEQ ID NO: 23193 - DNA, 1050 bp, Mycobacterium smegmatis; identical to SEQ ID NO: 2962
  CDS (1)..(1050)

SEQ ID NO: 23194 - protein, 349 aa, Mycobacterium smegmatis; identical to SEQ ID NO: 2963

SEQ ID NO: 23195 - DNA, 1044 bp, Oceanobacillus iheyensis; identical to SEQ ID NO: 2964
  CDS (1)..(1044)

SEQ ID NO: 23196 - protein, 347 aa, Oceanobacillus iheyensis; identical to SEQ ID NO: 2965

SEQ ID NO: 23197 - DNA, 1071 bp, Paracoccus denitrificans; identical to SEQ ID NO: 2966
  CDS (1)..(1071)

SEQ ID NO: 23198 - protein, 356 aa, Paracoccus denitrificans; identical to SEQ ID NO: 2967

SEQ ID NO: 23199 - DNA, 1320 bp, Pasteurella haemolytica; identical to SEQ ID NO: 2968
  CDS (157)..(1263)

SEQ ID NO: 23200 - protein, 368 aa, Pasteurella haemolytica; identical to SEQ ID NO: 2969

SEQ ID NO: 23201 - DNA, 1500 bp, Pasteurella multocida; identical to SEQ ID NO: 2970
  CDS (175)..(1239)

SEQ ID NO: 23202 - protein, 354 aa, Pasteurella multocida; identical to SEQ ID NO: 2971

SEQ ID NO: 23203 - DNA, 1023 bp, Porphyromonas gingivalis; identical to SEQ ID NO: 2972
  CDS (1)..(1023)

SEQ ID NO: 23204 - protein, 340 aa, Porphyromonas gingivalis; identical to SEQ ID NO: 2973

SEQ ID NO: 23205 - DNA, 1824 bp, Prevotella ruminicola; identical to SEQ ID NO: 2974
  CDS (501)..(1523)

SEQ ID NO: 23206 - protein, 340 aa, Prevotella ruminicola; identical to SEQ ID NO: 2975

SEQ ID NO: 23207 - DNA, 978 bp, Proteus vulgaris; identical to SEQ ID NO: 2976
  CDS (1)..(978)

SEQ ID NO: 23208 - protein, 325 aa, Proteus vulgaris; identical to SEQ ID NO: 2977

SEQ ID NO: 23209 - DNA, 1047 bp, Pseudomonas oleovorans; identical to SEQ ID NO: 2978
  CDS (1)..(1047)

SEQ ID NO: 23210 - protein, 348 aa, Pseudomonas oleovorans; identical to SEQ ID NO: 2979

SEQ ID NO: 23211 - DNA, 1068 bp, Pseudomonas putida; identical to SEQ ID NO: 2980
  CDS (1)..(1068)

SEQ ID NO: 23212 - protein, 355 aa, Pseudomonas putida; identical to SEQ ID NO: 2981

SEQ ID NO: 23213 - DNA, 1110 bp, Pseudomonas syringae; identical to SEQ ID NO: 2982
  CDS (46)..(1110)

SEQ ID NO: 23214 - protein, 354 aa, Pseudomonas syringae; identical to SEQ ID NO: 2983

SEQ ID NO: 23215 - DNA, 1980 bp, Pseudomonas tolaasii; identical to SEQ ID NO: 2984
  CDS (414)..(1472)

SEQ ID NO: 23216 - protein, 352 aa, Pseudomonas tolaasii; identical to SEQ ID NO: 2985

SEQ ID NO: 23217 - DNA, 1501 bp, Rhizobium etli; identical to SEQ ID NO: 2986
  CDS (242)..(1327)

SEQ ID NO: 23218 - protein, 361 aa, Rhizobium etli; identical to SEQ ID NO: 2987

SEQ ID NO: 23219 - DNA, 1098 bp, Rhizobium loti; identical to SEQ ID NO: 2988
  CDS (1)..(1098)

SEQ ID NO: 23220 - protein, 365 aa, Rhizobium loti; identical to SEQ ID NO: 2989

SEQ ID NO: 23221 - DNA, 1092 bp, Rhodopseudomonas palustris; identical to SEQ ID NO: 2990
  CDS (1)..(1092)

SEQ ID NO: 23222 - protein, 363 aa, Rhodopseudomonas palustris; identical to SEQ ID NO: 2991

SEQ ID NO: 23223 - DNA, 1047 bp, Rhodopseudomonas viridis; identical to SEQ ID NO: 2992
  CDS (1)..(1047)

SEQ ID NO: 23224 - protein, 348 aa, Rhodopseudomonas viridis; identical to SEQ ID NO: 2993

SEQ ID NO: 23225 - DNA, 1074 bp, Shewanella oneidensis; identical to SEQ ID NO: 2994
  CDS (1)..(1074)

SEQ ID NO: 23226 - protein, 357 aa, Shewanella oneidensis; identical to SEQ ID NO: 2995

SEQ ID NO: 23227 - DNA, 1235 bp, Spirulina platensis; identical to SEQ ID NO: 2996
  CDS (54)..(1151)

SEQ ID NO: 23228 - protein, 365 aa, Spirulina platensis; identical to SEQ ID NO: 2997

SEQ ID NO: 23229 - DNA, 1074 bp, Staphylococcus epidermidis; identical to SEQ ID NO: 2998
  CDS (25)..(1074)

SEQ ID NO: 23230 - protein, 349 aa, Staphylococcus epidermidis; identical to SEQ ID NO: 2999

SEQ ID NO: 23231 - DNA, 1140 bp, Streptococcus agalactiae; identical to SEQ ID NO: 3000
  CDS (1)..(1140)

SEQ ID NO: 23232 - protein, 379 aa, Streptococcus agalactiae; identical to SEQ ID NO: 3001

SEQ ID NO: 23233 - DNA, 1119 bp, Streptomyces ambofaciens; identical to SEQ ID NO: 3002
  CDS (1)..(1119)

SEQ ID NO: 23234 - protein, 372 aa, Streptomyces ambofaciens; identical to SEQ ID NO: 3003

SEQ ID NO: 23235 - DNA, 1134 bp, Streptomyces avermitilis; identical to SEQ ID NO: 3004
  CDS (1)..(1134)

SEQ ID NO: 23236 - protein, 377 aa, Streptomyces avermitilis; identical to SEQ ID NO: 3005

SEQ ID NO: 23237 - DNA, 1152 bp, Streptococcus mutans; identical to SEQ ID NO: 3006
  CDS (1)..(1152)

SEQ ID NO: 23238 - protein, 383 aa, Streptococcus mutans; identical to SEQ ID NO: 3007

SEQ ID NO: 23239 - DNA, 1137 bp, Streptococcus pyogenes; identical to SEQ ID NO: 3008
  CDS (1)..(1137)

SEQ ID NO: 23240 - protein, 378 aa, Streptococcus pyogenes; identical to SEQ ID NO: 3009

SEQ ID NO: 23241 - DNA, 1356 bp, Streptococcus parasanguis; identical to SEQ ID NO: 3010
  CDS (118)..(1263)

SEQ ID NO: 23242 - protein, 381 aa, Streptococcus parasanguis; identical to SEQ ID NO: 3011

SEQ ID NO: 23243 - DNA, 1416 bp, Streptomyces rimosus; identical to SEQ ID NO: 3012
  CDS (229)..(1359)

SEQ ID NO: 23244 - protein, 376 aa, Streptomyces rimosus; identical to SEQ ID NO: 3013

SEQ ID NO: 23245 - DNA, 1916 bp, Streptococcus thermophilus; identical to SEQ ID NO: 3014
  CDS (555)..(1694)

SEQ ID NO: 23246 - protein, 379 aa, Streptococcus thermophilus; identical to SEQ ID NO: 3015

SEQ ID NO: 23247 - DNA, 1271 bp, Streptomyces violaceus; identical to SEQ ID NO: 3016
  CDS (75)..(1208)

SEQ ID NO: 23248 - protein, 377 aa, Streptomyces violaceus; identical to SEQ ID NO: 3017

SEQ ID NO: 23249 - DNA, 1068 bp, Synechococcus elongatus; identical to SEQ ID NO: 3018
  CDS (1)..(1068)

SEQ ID NO: 23250 - protein, 355 aa, Synechococcus elongatus; identical to SEQ ID NO: 3019

SEQ ID NO: 23251 - DNA, 1023 bp, Thermus thermophilus; identical to SEQ ID NO: 3020
  CDS (1)..(1023)

SEQ ID NO: 23252 - protein, 340 aa, Thermus thermophilus; identical to SEQ ID NO: 3021

SEQ ID NO: 23253 - DNA, 1405 bp, Thiobacillus ferrooxidans; identical to SEQ ID NO: 3022
  CDS (196)..(1236)

SEQ ID NO: 23254 - protein, 346 aa, Thiobacillus ferrooxidans; identical to SEQ ID NO: 3023

SEQ ID NO: 23255 - DNA, 1314 bp, Tropheryma whipplei; identical to SEQ ID NO: 3024
  CDS (1)..(1314)

SEQ ID NO: 23256 - protein, 437 aa, Tropheryma whipplei; identical to SEQ ID NO: 3025

SEQ ID NO: 23257 - DNA, 1411 bp, Vibrio cholerae; identical to SEQ ID NO: 3026
  CDS (183)..(1247)

SEQ ID NO: 23258 - protein, 354 aa, Vibrio cholerae; identical to SEQ ID NO: 3027

SEQ ID NO: 23259 - DNA, 1044 bp, Vibrio parahaemolyticus; identical to SEQ ID NO: 3028
  CDS (1)..(1044)

SEQ ID NO: 23260 - protein, 347 aa, Vibrio parahaemolyticus; identical to SEQ ID NO: 3029

SEQ ID NO: 23261 - DNA, 996 bp, Wigglesworthia glossinidia brevipalpis; identical to SEQ ID NO: 3030
  CDS (1)..(996)

SEQ ID NO: 23262 - protein, 331 aa, Wigglesworthia glossinidia brevipalpis; identical to SEQ ID NO: 3031

SEQ ID NO: 23263 - DNA, 1035 bp, Xanthomonas axonopodis; identical to SEQ ID NO: 3032
  CDS (1)..(1035)

SEQ ID NO: 23264 - protein, 344 aa, Xanthomonas axonopodis; identical to SEQ ID NO: 3033

SEQ ID NO: 23265 - DNA, 1594 bp, Xenorhabdus nematophilus; identical to SEQ ID NO: 3034
  CDS (142)..(1218)

SEQ ID NO: 23266 - protein, 358 aa, Xenorhabdus nematophilus; identical to SEQ ID NO: 3035

SEQ ID NO: 23267 - DNA, 1044 bp, Xylella fastidiosa; identical to SEQ ID NO: 3036
  CDS (1)..(1044)

SEQ ID NO: 23268 - protein, 347 aa, Xylella fastidiosa; identical to SEQ ID NO: 3037

SEQ ID NO: 23269 - DNA, 1020 bp, Zymomonas mobilis; identical to SEQ ID NO: 3038
  CDS (1)..(1020)

SEQ ID NO: 23270 - protein, 339 aa, Zymomonas mobilis; identical to SEQ ID NO: 3039

SEQ ID NO: 23271 - DNA, 1660 bp, primary endosymbiont of Sitophilus oryzae; identical to SEQ ID NO: 3040
  CDS (11)..(1078)

SEQ ID NO: 23272 - protein, 355 aa, primary endosymbiont of Sitophilus oryzae; identical to SEQ ID NO: 3041

SEQ ID NO: 23273 - DNA, 1110 bp, Azospirillum lipoferum; identical to SEQ ID NO: 3042
  CDS (1)..(1110)

SEQ ID NO: 23274 - protein, 369 aa, Azospirillum lipoferum; identical to SEQ ID NO: 3043

SEQ ID NO: 23275 - DNA, 1017 bp, Geobacter sulfurreducens; identical to SEQ ID NO: 3044
  CDS (1)..(1017)

SEQ ID NO: 23276 - protein, 338 aa, Geobacter sulfurreducens; identical to SEQ ID NO: 3045

SEQ ID NO: 23277 - DNA, 1230 bp, Mycobacterium paratuberculosis; identical to SEQ ID NO: 3046
  CDS (1)..(1230)

SEQ ID NO: 23278 - protein, 409 aa, Mycobacterium paratuberculosis; identical to SEQ ID NO: 3047

SEQ ID NO: 23279 - DNA, 1083 bp, Lactobacillus johnsonii; identical to SEQ ID NO: 3048
  CDS (1)..(1083)

SEQ ID NO: 23280 - protein, 360 aa, Lactobacillus johnsonii; identical to SEQ ID NO: 3049

SEQ ID NO: 23281 - DNA, 1245 bp, Treponema denticola; identical to SEQ ID NO: 3050
  CDS (1)..(1245)

SEQ ID NO: 23282 - protein, 414 aa, Treponema denticola; identical to SEQ ID NO: 3051

SEQ ID NO: 23283 - DNA, 1068 bp, Wolbachia pipientis wMel; identical to SEQ ID NO: 3052
  CDS (1)..(1068)

SEQ ID NO: 23284 - protein, 355 aa, Wolbachia pipientis wMel; identical to SEQ ID NO: 3053

SEQ ID NO: 23285 - DNA, 1074 bp, Desulfovibrio vulgaris; identical to SEQ ID NO: 3054
  CDS (1)..(1074)

SEQ ID NO: 23286 - protein, 357 aa, Desulfovibrio vulgaris; identical to SEQ ID NO: 3055

SEQ ID NO: 23287 - DNA, 1557 bp, Bacillus licheniformis; identical to SEQ ID NO: 3056
  CDS (369)..(1415)

SEQ ID NO: 23288 - protein, 348 aa, Bacillus licheniformis; identical to SEQ ID NO: 3057

SEQ ID NO: 23289 - DNA, 1119 bp, Corynebacterium diphtheriae; identical to SEQ ID NO: 3058
  CDS (1)..(1119)

SEQ ID NO: 23290 - protein, 372 aa, Corynebacterium diphtheriae; identical to SEQ ID NO: 3059

SEQ ID NO: 23291 - DNA, 1038 bp, Mycoplasma mycoides; identical to SEQ ID NO: 3060
  CDS (1)..(1038)

SEQ ID NO: 23292 - protein, 345 aa, Mycoplasma mycoides; identical to SEQ ID NO: 3061

SEQ ID NO: 23293 - DNA, 1134 bp, Bdellovibrio bacteriovorus; identical to SEQ ID NO: 3062
  CDS (1)..(1134)

SEQ ID NO: 23294 - protein, 377 aa, Bdellovibrio bacteriovorus; identical to SEQ ID NO: 3063

SEQ ID NO: 23295 - DNA, 1086 bp, Parachlamydia sp; identical to SEQ ID NO: 3064
  CDS (1)..(1086)

SEQ ID NO: 23296 - protein, 361 aa, Parachlamydia sp; identical to SEQ ID NO: 3065

SEQ ID NO: 23297 - DNA, 1071 bp, Photobacterium profundum; identical to SEQ ID NO: 3066

SEQ ID NO: 23298 - protein, 356 aa, Photobacterium profundum; identical to SEQ ID NO: 3067

SEQ ID NO: 23299 - DNA, 24 bp, Primer
atggctatcgacgaaaacaaacag

SEQ ID NO: 23300 - DNA, 27 bp, Primer
ttaaaaatcttcgttagtttctgctac

SEQ ID NO: 23301 - DNA, 1191 bp, Escherichia coli K12
  CDS (1)..(1191)
atgattatttccgcagccagcgattatcgcgccgcagcgcaacgcattctgccgccgttcctgttccactatatggatggtggtgcatattctgaatacacgctgcgccgcaacgtggaagatttgtcagaagtggcgctgcgccagcgtattctgaaaaacatgtccgacttaagcctggaaacgacgctgtttaatgagaaattgtcgatgccggtggcactggctccggtgggtttgtgtggcatgtatgcgcgtcgtggcgaagttcaggcagccaaagcggcggacgcgcatggtattccgtttactctctcgacggtttccgtttgcccgattgaagaagtcgcgccagccatcaagcgcccaatgtggttccagctttatgtactgcgcgatcgcggctttatgcgtaacgcgctggagcgagcaaaagcagcgggttgttcgacgctggttttcaccgtggatatgccgacaccgggcgcacgctaccgtgatgcgcattcaggtatgagcggcccgaacgcggcaatgcgccgctacttgcaagcggtgacacatccgcaatgggcgtgggatgtgggcctgaacggtcgtccacatgatttaggtaatatctcagcttatctcggcaaaccgaccggactggaagattacatcggctggctggggaataacttcgatccgtccatctcatggaaagaccttgaatggatccgcgatttctgggatggcccgatggtgatcaaagggatcctcgatccggaagatgcgcgcgatgcagtacgttttggtgctgatggaattgtggtttctaaccacggtggccgccagctggacggtgtactctcttccgcccgtgcactgcctgctattgcagatgcggtgaaaggtgatatagccattctggcggatagcggaattcgtaacgggcttgatgtcgtgcgtatgattgcgctcggtgccgacaccgtactgctgggtcgtgctttcttgtatgcgctggcaacagcgggccaggcgggtgtagctaacctgctaaatctgatcgaaaaagagatgaaagtggcgatgacgctgactggcgcgaaatcgatcagcgaaattacgcaagattcgctggtgcaggggctgggtaaagagttgcctgcggcactggctcccatggcgaaagggaatgcggcatag

SEQ ID NO: 23302 - protein, 396 aa, Escherichia coli K12 [sequence omitted]

SEQ ID NO: 23303 - DNA, 1185 bp, Mycobacterium smegmatis
  CDS (1)..(1185)
atgtccaattggggtgactacgagaatgaaatctatggtcaggggctggtgggcgttgctcctactcttcccatgtcttatgccgactgggaagctcacgctcagcaggcgcttccgccgggagtgttgtcctacgtggccggcggttccggtgacgagcacacccagcgcgccaacgtggaggccttcaagcattgggggttgatgccccggatgctcatggcggccaccgaacgcgacctgtcggtggagctgtggggcaagacgtgggcggcgccgatgttcttcgctcccatcggggtcatcgcgctgtgcgcgcaggacggccatggtgacgcggccagcgcgcaggccagcgcccgtacgggggtgccgtacatcacgtcgacgctggccgtgagctcgctggaggacatccgcaagcatgccggtgacacgccggcgtacttccagctgtattacccggaagaccgcgaccttgccgagagcttcatccgccgagcagaggaagccggctacgacggtctggtgatcacgctggacacctggatcttcggttggcggccaagggatctcacgatctcgaacttcccgttcctgcgcgggttgtgcctgaccaactatgtcaccgatccggtgttccagaagaagttcaaggcgcattcgggtgtcgaggcagagggtctgcgcgacaacccgaggctggcggccgacttctggcacggcctgttcgggcattcggtgacgtgggaggacatcgattgggtgcggtcgatcaccaagatgcccgtcatcctgaagggcatccagcatcccgatgatgcgcgtcgcgcagtggacagcggtgtcgacggcatctattgctcgaaccacggcgggcgccaggccaacggtggtctcccggcgctggattgcctgcccgaggtcgtcaaggcctccggtgacacaccggtgttgttcgattccgggatccgtacgggcgcagacgttgtcaaggcgctcgcgatgggtgcgtcggccgtgggcatcgggcgtccgtacgcgtggggcgccgcgctgggaggctccaagggcatcgaacatgtcgctcggtcactactggccgaggcggacctcatcatggccgtcgacgggtaccgcaacctgaaggaattgacgatcgacgctctgcgtcccacccgctga

SEQ ID NO: 23304 - protein, 394 aa, Mycobacterium smegmatis
MSNWGDYENEIYGQGLVGVAPTLPMSYADWEAHAQQALPPGVLSYVAGGSGDEHTQRANVEAFKHWGLMPRMLMAATERDLSVELWGKTWAAPMFFAPIGVIALCAQDGHGDAASAQASARTGVPYITSTLAVSSLEDIRKHAGDTPAYFQLYYPEDRDLAESFIRRAEEAGYDGLVITLDTWIFGWRPRDLTISNFPFLRGLCLTNYVTDPVFQKKFKAHSGVEAEGLRDNPRLAADFWHGLFGHSVTWEDIDWVRSITKMPVILKGIQHPDDARRAVDSGVDGIYCSNHGGRQANGGLPALDCLPEVVKASGDTPVLFDSGIRTGADVVKALAMGASAVGIGRPYAWGAALGGSKGIEHVARSLLAEADLIMAVDGYRNLKELTIDALRPTR

SEQ ID NO: 23305 - DNA, 1245 bp, Mycobacterium leprae
  CDS (1)..(1245)
atggcagccaaacggcggatgcccagagtccacgacctggccccgctgatccagttcaaacggcccaaattcggagcgaccaaacgccgcctcgaggccgcgctgaccattcaggatctgcggtgcattgccaaacagcgcaccccaaaggccgcgttcgactataccgatggcgccgccgaggacgagctatccattaaacgagcccaacaagccttccgcgacatcgagtttcacccggctatcttgcgtgatgtcacgaacgtatgcgccggatgggatgtgctcgggcattcggtcttgttgccgttcggaatcgcgccaaccggattcactcggttgatgcataccgagggtgagattgccggcgcgcgggctgctgctgcagccgggatcccattttcgttatccactctcgccacctctgcgatcgaagatgtagtggccgccgttccgcagggccgcaaatggtttcagctgtacatgtggcgggatcgtgaccgctcaatggcgttggtcgagcgcgccgccgacgcagggtacgatgccctgctggtcacggtcgacgttccggtcgccggcgcgcggttacgtgacacccgcaacggcatgtcgatcccgccggcgttaacactgcgaactgtgttcgacgcgctgccacacccgcgctggtggattgacttgttgactaccgagcctctggcattcgcatcgttagatcgctggtcgggcactgtcagcgattacttaaacaccatgttcgaccccagcgtcacttttgacgatctggcgtggattaaaacccaatggcccggcaagttcgtagtgaaaggaatccagacgctcgacgacgctcgcgccgtcgttgagcgcggtatcgacggtgtcgtgttgtccaatcacggcgggcggcaacttgaccgggcaccggtgcccttccatctactacctacggtggcgcgtgaattcggcaaggacaccgagatactgttagataccggtatcatgtccggcgctgacattgtggcagcaattgcactgggagcccggtgcacactggtcgggcgagcctacctctacgggttgatggccggtggcgaagcgggcgtcaggcgcgcgatcgaaatcctggaaagcggggtgatccgcacgatgcaacttttaggtgtgacctgtttagaggaactctcgcccagacatgtgacgcaactacagcgactgggccccattgaaccaccagcatga

SEQ ID NO: 23306 - protein, 414 aa, Mycobacterium leprae
MAAKRRMPRVHDLAPLIQFKRPKFGATKRRLEAALTIQDLRCIAKQRTPKAAFDYTDGAAEDELSIKRAQQAFRDIEFHPAILRDVTNVCAGWDVLGHSVLLPFGIAPTGFTRLMHTEGEIAGARAAAAAGIPFSLSTLATSAIEDVVAAVPQGRKWFQLYMWRDRDRSMALVERAADAGYDALLVTVDVPVAGARLRDTRNGMSIPPALTLRTVFDALPHPRWWIDLLTTEPLAFASLDRWSGTVSDYLNTMFDPSVTFDDLAWIKTQWPGKFVVKGIQTLDDARAVVERGIDGVVLSNHGGRQLDRAPVPFHLLPTVAREFGKDTEILLDTGIMSGADIVAAIALGARCTLVGRAYLYGLMAGGEAGVRRAIEILESGVIRTMQLLGVTCLEELSPRHVTQLQRLGPIEPPA

SEQ ID NO: 23307 - DNA, 1098 bp, Nostoc sp. PCC 7120
  CDS (1)..(1098)
atgacagctatatccagtcccatcaacctatttgaatatgaacagttagccaaaactcatctatctcaaatggcttttgactactacattagtggggctggagatgaaatcacattacaagagaatcgcgcagtctttgaacgtattaaattgcgtccacgaatgctagtggatgttagccaaatcaacctcactacttctgttttgggacaacctctgcaattacctctattaattgcaccaatggcgtttcaatgtttggctcatacggaaggcgaactagccacagcaatggcggctgcatcggctgggacgggtatggttttgagtacgttgtccaccaaaagtttagaagaagtggcagaggttggtagtaaattttctccttctctacaatggttccaactttacatccacaaagaccggggtttgactcgcgctttggtcgaaagggcttatgcagcaggttacaaagcgttatgcttgactgtggatgctcccgtactcggacaacgggaacgagatagacgtaatgagtttgtgttacctccagggttgcatttggctaatctcacaacaatttccgggttaaatattcctcatgcaccaggagaatctgggttgtttacctattttgctcaacaactcaacccggctttaacatgggatgacttggaatggttgcagtctttatctcccctaccgttggtactcaaaggaattttgcgcggtgatgatgcggcgcgggcggtggaatatggagctaaagcaattgtagtgtcgaatcatgggggcaggcaacttgatggagcgatcgcctcactagatgccctccctgaaatagtcgcagccgtcaacggtaaagcagaagtcttactagatggcggaatccgtcggggtacagatattatcaaagccttagcaataggcgctcaagctgttctcataggtagaccagttttatggggactcgcagtaggaggacaagcaggcgtatctcatgttatctctctactacaaaaggagttaaatgtggcaatggcgctgataggctgttctcagttacaagatattgatactagttttctgcatttgtaa

SEQ ID NO: 23308 - protein, 365 aa, Nostoc sp. PCC 7120
MTAISSPINLFEYEQLAKTHLSQMAFDYYISGAGDEITLQENRAVFERIKLRPRMLVDVSQINLTTSVLGQPLQLPLLIAPMAFQCLAHTEGELATAMAAASAGTGMVLSTLSTKSLEEVAEVGSKFSPSLQWFQLYIHKDRGLTRALVERAYAAGYKALCLTVDAPVLGQRERDRRNEFVLPPGLHLANLTTISGLNIPHAPGESGLFTYFAQQLNPALTWDDLEWLQSLSPLPLVLKGILRGDDAARAVEYGAKAIVVSNHGGRQLDGAIASLDALPEIVAAVNGKAEVLLDGGIRRGTDIIKALAIGAQAVLIGRPVLWGLAVGGQAGVSHVISLLQKELNVAMALIGCSQLQDIDTSFLHL

SEQ ID NO: 23309 - DNA, 1146 bp, Agrobacterium tumefaciens
  CDS (1)..(1146)
atgcaactcaaagactgctataatttccacgatttccgccgcatggccaaacagcgccttcccggaccgatcttcaattacatagacggggcggccgatgacgaggtgacctatcgtcgaaacacggccgccttcgaaaactgcgatctcgttcccgacgtgctgcagggtgtggccgatgtggatatgtcggtcacggttatggggcaaaagctcgcgatgccggtctattgttccccaacagcgctacaacgcctctttcaccatcagggtgagaaggcggtcgcggccgccgcggggaaattcggcaccatgttcggcgtctcctcactcggcaccaccagcctcgaggaagcacgccggatcagcggtggcccacaggtctaccaattctatttccacaaagatcgcggcctcaaccgcgatatgatggcccgggcgaaaagcgccggcgtcgagaccatgatgctgacggtggatagcatcaccggcgggaaccgtgaacgtgacaagcgcaccggctttgccattcccttcaagctcaatctttccggtatcgcgcaatttgccatgaagcccgcctggggtatcaattacctcacgcatgagcgcttcagcctgccgcaactcgacgaccatattaaaatggacggcggcgccctttccatcagccgttatttcaccgagatgctcgacccttcgatgaattgggacgatgtggcgctgatggtgcgcgaatggggtgggcctttctgcctgaaggggatcatgtccgtggacgacgcccgccgcgcggtcgagattggctgcagcggtatcgtgctttccaatcacggtggccgtcagctcgatggctcccgcagcgccttcgaccagttggccgaaattgtcgatgcggtcggcgaccgcatcgacgtgatgatggacggcggcgtgcagcgtggcacccacgttctgaaggcgctatccctcggcgcaaaagccgtgggccttggccgttattacctttttccgcttgcagccgccgggcagccgggtgtggaacgtgcgctggaaacaatgcggatcgaaatcgagcgcgggatgaaactcatgggctgcaccacagtcgatcagctcacgcggcgaaatctgcgcttccactaa

SEQ ID NO: 23310 - protein, 381 aa, Agrobacterium tumefaciens
MQLKDCYNFHDFRRMAKQRLPGPIFNYIDGAADDEVTYRRNTAAFENCDLVPDVLQGVADVDMSVTVMGQKLAMPVYCSPTALQRLFHHQGEKAVAAAAGKFGTMFGVSSLGTTSLEEARRISGGPQVYQFYFHKDRGLNRDMMARAKSAGVETMMLTVDSITGGNRERDKRTGFAIPFKLNLSGIAQFAMKPAWGINYLTHERFSLPQLDDHIKMDGGALSISRYFTEMLDPSMNWDDVALMVREWGGPFCLKGIMSVDDARRAVEIGCSGIVLSNHGGRQLDGSRSAFDQLAEIVDAVGDRIDVMMDGGVQRGTHVLKALSLGAKAVGLGRYYLFPLAAAGQPGVERALETMRIEIERGMKLMGCTTVDQLTRRNLRFH

SEQ ID NO: 23311 - DNA, 1146 bp, Yersinia pestis
  CDS (1)..(1146)
atgatcatttctgcctcaacggattatcgcgccgccgcgcagcgtaaattgccgccgtttcttttccactacatcgacggtggtgcgtacaacgaacaaactctacggcgcaataccgccgatttggctgatatcgccctgcgccagcgtgtgctgaagaacatgtctgaactgagtctggaaacgcagcttttcggcgagacgcaggcaatgcctgttgtccttgggccagtcggtctgagcggcatgtacgcacggcgtggtgaagtgcaggccgcgcgggcggcggataaaaaaggtattcctttcaccctctcaaccctttcggtttgccctatcgaagaggtggctcctgccattgcccggccaatgtggtttcagctttatgtcctgaaagatcggggttttatgcgtaatgcactgacgcgtgcacaggccgctggcgtgaagacgttggtgtttaccgtagatatgccggtacctggcgcacgttaccgcgatgcacactctggtatgagtgggccgaatgctgccgctcgccgcttgcttcaggcgatagcccacccacagtgggcttgggatgtgggcttaaacggcaagccccatgacttggggaatatatcggcctatctcggtaaaccaaccacgctggaggattatatgggttggatagcgacaaatttcgacccatcgatctcgtggaaagatttggagtgggtacgtgagttctggcaaggaccgatgatcattaaaggtattctcgatccggaagatgccaaagatgcagtgaaatttggtgctgatggcattgtggtgtcaaaccacggcgggcgtcagcttgacggtgtgctctccaccgctcgtgccttgccagccattgcagatgctgtcaaaggggatatcactattctggctgattccggcatccgtactgggttggacgtcgtacgaatgatagcgctcggcgcggatagcgtgttgttaggccgtgccttcgtctatgctctggccaccgcaggagaagccggtgttatcaatctgctgacgctgatcgagcaagaaatgcgtgtggcgatgacgttgaccggagcgaagcgaattgccgatatcaaccgggattctttggcagtaagtgaacgggggtaa

SEQ ID NO: 23312 - protein, 381 aa, Yersinia pestis
MIISASTDYRAAAQRKLPPFLFHYIDGGAYNEQTLRRNTADLADIALRQRVLKNMSELSLETQLFGETQAMPVVLGPVGLSGMYARRGEVQAARAADKKGIPFTLSTLSVCPIEEVAPAIARPMWFQLYVLKDRGFMRNALTRAQAAGVKTLVFTVDMPVPGARYRDAHSGMSGPNAAARRLLQAIAHPQWAWDVGLNGKPHDLGNISAYLGKPTTLEDYMGWIATNFDPSISWKDLEWVREFWQGPMIIKGILDPEDAKDAVKFGADGIVVSNHGGRQLDGVLSTARALPAIADAVKGDITILADSGIRTGLDVVRMIALGADSVLLGRAFVYALATAGEAGVINLLTLIEQEMRVAMTLTGAKRIADINRDSLAVSERG

SEQ ID NO: 23313 - DNA, 1149 bp, Agrobacterium tumefaciens
  CDS (1)..(1149)
atgaaggctttatccatgggcaaaatcctgaccatagcggacctgaagcaacaggctcagcgtcgtgtgccgaaaatgttcttcgactatgccgatagcggcgcgtggacggaaagcacctaccgcgccaatgaggatgattttgccaagataaagctgcgccagcgcgtgctggtggatatgactgaccggtcgctggccacagaaatggttggcgagaaggtttcgatgccggtcgcgctctcccccaccgggctcaccggcatgcagcacgccgatggcgaaatgctggccgcaaaagcggcggaggaattcggcgtgcccttcacgctctccaccatgagcatctgctccatcgaggatgtcgcctcggtcacgtcaaaacccttctggttccagctttacgtgatgaaggaccgcgacttcgtcaataatctcatcgaccgcgccaaggcagcgggatgctcggcgctggtgctgacgctcgacctgcaaatcctcggccagcgccacaaggatttgcgcaacggcctgtccgcgccgccgaaattcacccccaaacatatctggcagatggcgacccggccgcaatggtgcatggacatggcgcgcaccaagcgccgcagcttcggcaatatcgtcggccatgcgaaaaacgtgtccgacctttcatcgctctccacctggacggccgaacaattcgatccgcgcctgtcctggcaggacgtcgaatggatcaagcaacgctggggcggcaagctgatcctcaagggtatccttgacgaggaagatgcccgcgccgcgatcgataccggcgccgatgccatcatcgtctccaaccatggcggccgccagctcgacggcgcccattcctccatcgccatgctgccgaagatcgtcgatgccgttggtgacaggatcgaagtgcacatggatggtggcatccgctccggccaggatgtgttgaaggcggtcgcacttggtgccaggggcacctatatcggccgccccttcctctacggccttggcgccggcggaaaacagggcgtgacaacggcgctcgagatcattcgcaaggaactggatatcagcatggcgctctgcggcaagcggctgatcacggatgtggaccgcagcattctggcttga

SEQ ID NO: 23314 - protein, 382 aa, Agrobacterium tumefaciens
MKALSMGKILTIADLKQQAQRRVPKMFFDYADSGAWTESTYRANEDDFAKIKLRQRVLVDMTDRSLATEMVGEKVSMPVALSPTGLTGMQHADGEMLAAKAAEEFGVPFTLSTMSICSIEDVASVTSKPFWFQLYVMKDRDFVNNLIDRAKAAGCSALVLTLDLQILGQRHKDLRNGLSAPPKFTPKHIWQMATRPQWCMDMARTKRRSFGNIVGHAKNVSDLSSLSTWTAEQFDPRLSWQDVEWIKQRWGGKLILKGILDEEDARAAIDTGADAIIVSNHGGRQLDGAHSSIAMLPKIVDAVGDRIEVHMDGGIRSGQDVLKAVALGARGTYIGRPFLYGLGAGGKQGVTTALEIIRKELDISMALCGKRLITDVDRSILA

SEQ ID NO: 23315 - DNA, 1191 bp, Salmonella enterica subsp. enterica serovar Typhi
  CDS (1)..(1191)
atgattatttcagcaaccagcgattatcgcgccgcagctcagcgcacgttgcctcctttcctcttccactacatcgacggcggcgcgtatgcggaatataccctgcgccgaaatgtggaagacctgtcgcaagtcgctctgcgccagcgcgtgctgaaaaatatgtccgatttaagcctggaaacgaccctgtttaacgaaacgttgtcgatgccggtggcattagcgccggtaggtctgtgcggcatgtacgcccgtcgcggcgaagtacaggccgccgccgccgcagacgcaaagggcattccgttcaccctttccaccgtctccgtctgtccgattgaagaagtagcccccacgcttaaacgcccgatgtggttccagctttatgtactgcgtgaccggggctttatgcgtaatgcgctggaacgagcaaaagcggcgggctgctccacgctggtctttaccgtggatatgccgacgccgggcgcgcgctaccgtgacgcccactccgggatgagcggcccaaacgcggccatgcgccgttactggcaggcggtgatgcaccctaaatgggcgtgggatgtcggcctgaacggtcgcccgcatgatttaggcaatatttccgcctatctgggtaaaccgaccggccttgaggactatatcggctggctggcaaataacttcgatccgtccatctcctggaaagatctggagtggatacgcgaattctgggacggcccaatggtgatcaaagggatcctcgatccagaagatgcccgcgatgcggtacgtttcggcgctgacggtatcgtggtgtcgaatcacggcggccgccagctcgatggcgtgctctcttccgcccgcgccctgcccgccattgccgatgcggtgaaaggcgatatcgccattctggcggatagcgggattcgtaacgggctggatgtcgtgcgtatgattgcgctgggggccgataccgtactgctgggtcgggcctatctctacgcgctggcgacggcaggaaaaactggcgtcgctaacctactggacctgatcgagaaagagatgaaagtcgccatgaccctgaccggcgcgaaatccattagcgaaatcagtggcgattcactggtgcaggaactggggaaaagtttgcccgccgcgctggcgccaatgagcaaaggcgatgccgcctga

SEQ ID NO: 23316 - protein, 396 aa, Salmonella enterica subsp. enterica serovar Typhi
MIISATSDYRAAAQRTLPPFLFHYIDGGAYAEYTLRRNVEDLSQVALRQRVLKNMSDLSLETTLFNETLSMPVALAPVGLCGMYARRGEVQAAAAADAKGIPFTLSTVSVCPIEEVAPTLKRPMWFQLYVLRDRGFMRNALERAKAAGCSTLVFTVDMPTPGARYRDAHSGMSGPNAAMRRYWQAVMHPKWAWDVGLNGRPHDLGNISAYLGKPTGLEDYIGWLANNFDPSISWKDLEWIREFWDGPMVIKGILDPEDARDAVRFGADGIVVSNHGGRQLDGVLSSARALPAIADAVKGDIAILADSGIRNGLDVVRMIALGADTVLLGRAYLYALATAGKTGVANLLDLIEKEMKVAMTLTGAKSISEISGDSLVQELGKSLPAALAPMSKGDAA

SEQ ID NO: 23317 - DNA, 1182 bp, Pseudomonas putida
  CDS (1)..(1182)
atgagccagaatctctttaacgttgaggactatcgcaagcttcggcaaaagcgcttgccgaagatggtctacgactatctggaaggtggggctgaagacgaatacggggtgaaacacaaccgcgacgtcttccagcaatggcgattcaaaccgaagcggctagtagacgtcagccgccgcagcctccaagcggaagtacttggaaagaggcagtcgatgcctctcttgattgggcctactgggctgaacggtgcgctgtggcctaagggggatctcgctttagctcgagcagcaaccaaggccggaatcccgttcgtgctgtcgaccgcctccaacatgtccattgaagacctcgcacgtcagtgtgatggcgatctgtggttccagctctatgtgatccaccgagagattgcgcaggggatggtgctcaaagccctgcacactggttacacgacactggtgcttactacggatgtggcggttaacggctatcgcgagcgcgacctgcataaccgattcaagataccaatgagctactccgcaaaggtggtgctggacggatgcctgcatccgcgctggtcgctcgacttcgtgcgacacggcatgccgcaactggccaatttcgtcagcagtcaaacgtctagcttagaaatgcaggcagcattgatgagccgccaaatggatgccagtttcaactgggaggcattgagatggctgcgtgacctctggccgcacaaactcctcgtaaaggggttgctcagtgctgaggacgccgatcggtgcatcgctgaaggtgcagacggcgtaatcctatcaaaccacggcggtcgccaactcgattgcgcgatatcgccaatggaagttttggctcaatcggtagcgaaaactggaaaaccagtgcttatcgatagcggcttccgacggggttcggacatcgttaaagcacttgcgctaggtgctgaggctgtactcctgggtcgtgcaactttgtatggccttgcagcacgaggtgaaacgggtgttgacgaggtgctaaccctcctaaaagcggatatcgaccgcacccttgcccagattggatgccctgacatcacctccctttctcctgattacctccaaaacgagggagtgactaacaccgctccagtcgatcacctcattggtaaaggaacacacgcatga

SEQ ID NO: 23318 - protein, 393 aa, Pseudomonas putida
MSQNLFNVEDYRKLRQKRLPKMVYDYLEGGAEDEYGVKHNRDVFQQWRFKPKRLVDVSRRSLQAEVLGKRQSMPLLIGPTGLNGALWPKGDLALARAATKAGIPFVLSTASNMSIEDLARQCDGDLWFQLYVIHREIAQGMVLKALHTGYTTLVLTTDVAVNGYRERDLHNRFKIPMSYSAKVVLDGCLHPRWSLDFVRHGMPQLANFVSSQTSSLEMQAALMSRQMDASFNWEALRWLRDLWPHKLLVKGLLSAEDADRCIAEGADGVILSNHGGRQLDCAISPMEVLAQSVAKTGKPVLIDSGFRRGSDIVKALALGAEAVLLGRATLYGLAARGETGVDEVLTLLKADIDRTLAQIGCPDITSLSPDYLQNEGVTNTAPVDHLIGKGTHA

SEQ ID NO: 23319 - DNA, 1137 bp, Vibrio cholerae
  CDS (1)..(1137)
atgatcatttccgcttcgaccgattaccgcgcggcagccaaagccaaactcccgccctttttgttccactacatcgatggcggctcgtatggagaacacacgctcagacgcaataccgatgatctggccgacattgccctgcgccagcgcgtgctgagtgatatgtctgagctgagtttagaaaccgagctgtttggcgaaaaaatggcgctgccgatcgccctttctcctgtgggtttaaccggtatgtatgcccgccgtggcgaagtgcaagccgcgcaagctgcggaagcgaaaggcattccttttactctttccacggtttcggtctgcccgattgaagaagtggcgccttcgattcatcgtcctatctggttccagctttacgttttaaaagatcgcggctttatgaaaaacgtgttggagcgtgccaaagccgctggcgtgaaaaatctggtgttcaccgtggatatgccagtaccgggcgcccgttaccgcgatatgcattctggtatgagcggtcctaacgctgcgatgcgccgtgtattgcaagccatggcacacccgagctgggcatgggatgtgggtttgcttggtaagccgcatgatttgggcaacatctccaaatatcgtggttcaccgaccaaactggaagactacatcggctggctgggcgcgaactttgacccttccatttcatggaaagacttagagtggatccgtgatttctgggacggcccaatgatcatcaagggcattttggatacggaagatgcaaaagatgcggtgcgttttggcgcagacggcattgtggtgtctaaccacggtggtcgccagttagatggggtgctttctaccgtgcaagcgctacccgcgattgccgatgcggtgaaaggcgacctgaaaattctggtcgattcaggtatccgcaccggtctagacgtggtacgcatgctggcactcggcgcagattgcaccatgctcggccgctcgtttatttacgctctagcagcgcaagggcgcgctggggtagaaaacctgctcgacctgtatgaaaaagagatgcgggttgccatgacactgacaggcgcaaagagcattgccgaactgtcacgcgattcattagtcaaaagataa

SEQ ID NO: 23320 - protein, 378 aa, Vibrio cholerae
MIISASTDYRAAAKAKLPPFLFHYIDGGSYGEHTLRRNTDDLADIALRQRVLSDMSELSLETELFGEKMALPIALSPVGLTGMYARRGEVQAAQAAEAKGIPFTLSTVSVCPIEEVAPSIHRPIWFQLYVLKDRGFMKNVLERAKAAGVKNLVFTVDMPVPGARYRDMHSGMSGPNAAMRRVLQAMAHPSWAWDVGLLGKPHDLGNISKYRGSPTKLEDYIGWLGANFDPSISWKDLEWIRDFWDGPMIIKGILDTEDAKDAVRFGADGIVVSNHGGRQLDGVLSTVQALPAIADAVKGDLKILVDSGIRTGLDVVRMLALGADCTMLGRSFIYALAAQGRAGVENLLDLYEKEMRVAMTLTGAKSIAELSRDSLVKR

SEQ ID NO: 23321 - DNA, 1173 bp, Neisseria meningitidis
  CDS (1)..(1173)
atgaaacgtgatttgagcaaaatgacctgcatcgaagacttgcgccgcgttgccaagcgcaaaatgccgcgtatgttttacgattacatcgattcgggttcgtggacagaaactacctaccgtgaaaacacttcggatttcaaagacatccgcttccgacaaaaggtattggtcaatatggaaggccgaagcctggagaccaaaatgatcgggcaggatgtgaaaatgccggtggcgattgcgccgacgggtttcacgggtatggcacacgccgacggtgaaattttggcggcgcgggcggcggagaagttcggcattccgtttacgctgtccacgatgtctatctgctcgattgaagacgttgccgagaacacttccgcaccattttggtttcagctttatgtgatgcgcgaccgcgagtttatggaaaacctgattaagcgcgcgaaggatgccaaatgttcggcattggtattgaccgctgatttgcaggttttggggcaacgccacaaagacatcaaaaacggcctgtccgcgccgccgaaaccgaccatcgccaatttaatcaatctggcgaccaagcccgaatggtgtatgaaaatgctgaacacggaacgccgcacgttccgcaatatcgttggacacgccaaaaacgtcggcgatttgtcctcgctgtcttcatggacttccgaacaattcgacccgcgcctgagctgggacgacgttgcacgcattaaagatttgtggggtggcaagctgattatcaaaggcattatggaacctgaagatgcggaaaaagcagcgaaaagcggtgcggacgcattggtcgtttccaaccacggcggccgccagctcgacgataccgtgtccgccatcaaagccttgcccgacatcgttagtgcagtcggcagcgacatcgaagtttggatggacagcggcatccgcagcggtcaggatattttgaaggcgtgggctttgggtgcgaaaggtacaatgataggtcgggcgtttctgtatggtttgggtgcgtatggtgaagaaggcgtaacccgtgcgctggaaatcctgtataaagaaatggatatatctatggcgtttacgggacaccgcgatattcaagatgtcgatgcttcgattttgagaggcaaagattggggcagggaaacggtttag

SEQ ID NO: 23322 - protein, 390 aa, Neisseria meningitidis
MKRDLSKMTCIEDLRRVAKRKMPRMFYDYIDSGSWTETTYRENTSDFKDIRFRQKVLVNMEGRSLETKMIGQDVKMPVAIAPTGFTGMAHADGEILAARAAEKFGIPFTLSTMSICSIEDVAENTSAPFWFQLYVMRDREFMENLIKRAKDAKCSALVLTADLQVLGQRHKDIKNGLSAPPKPTIANLINLATKPEWCMKMLNTERRTFRNIVGHAKNVGDLSSLSSWTSEQFDPRLSWDDVARIKDLWGGKLIIKGIMEPEDAEKAAKSGADALVVSNHGGRQLDDTVSAIKALPDIVSAVGSDIEVWMDSGIRSGQDILKAWALGAKGTMIGRAFLYGLGAYGEEGVTRALEILYKEMDISMAFTGHRDIQDVDASILRGKDWGRETV

SEQ ID NO: 23323 - DNA, 1152 bp, Caulobacter crescentus
  CDS (1)..(1152)
atgatcgtttcctcgaccacggactttcgcgaagcggcgcggcgcaggctgccccggttcctgttcgactatatcgacggcggcgcctatgccgagcggacgatggcgcgcaacatcgatgatctcgccgacatcgcgctgcggcagcgggtgctcatggacgtctccgtcgtcgacccgtcgaccaccctgttcggcgtccggcaggccttgccggtggctctggcgccggtcgggctgacaggcatgtacgcccgccgcggtgaatgccaggcggcgcgggcggcggcggccaagggtgtgccgttttgcctgtccacggtctcggtctgcgatgtcgacgaggtgcgggcggcctcagcaacgccgttctggtttcagctctacgtgctgcgagaccggggcttcatgcgggacctcttagcgcgggccagcgcggcgggcgccaccacgctggtgttcaccgtcgacatgcccgtgcccggcgcgcgctatcgcgacgcgcattcggggatgtcgggccccaacgccgccgcgcggcgtcttgtgcaggcggcgctgaagccggcctgggcctgggatgtcggcgtgatgggccatccccaccggctggggaatgtggcgccggccttgggcaaggcgtcggggcttcaggacttcatgggctggctggcggccaacttcgatccatcgatccagtggtcggacctgaaatggatccgtgacgcctggaaagggccgctggtcatcaagggcgttctggatcccgaggacgccaaggccgccgccgacatcggcgccgacggcgtcgtcgtttccaatcatggcggtcgtcagctggatggggtgctgtccagcgcccgcgccttgcccgccatcgccgacgcggtcggcgaccgattgaccgttctggccgacggcggcgtgcgctcgggcctggacgtcgtgcggatgctggcgctgggcgcgcgcggcgttctgatcggccgggcctacgcctacgccctggccgcgcgcggcgaggccggcgtgacgcaactgctggacctgatcgacaaggagatgcgcgtggccatggccctgaccggcgtgcgcgacgtggcctcgatcaacgagaccatcctggccgagcgcgttccgcgcgcagggtaa

SEQ ID NO: 23324 - protein, 383 aa, Caulobacter crescentus
MIVSSTTDFREAARRRLPRFLFDYIDGGAYAERTMARNIDDLADIALRQRVLMDVSVVDPSTTLFGVRQALPVALAPVGLTGMYARRGECQAARAAAAKGVPFCLSTVSVCDVDEVRAASATPFWFQLYVLRDRGFMRDLLARASAAGATTLVFTVDMPVPGARYRDAHSGMSGPNAAARRLVQAALKPAWAWDVGVMGHPHRLGNVAPALGKASGLQDFMGWLAANFDPSIQWSDLKWIRDAWKGPLVIKGVLDPEDAKAAADIGADGVVVSNHGGRQLDGVLSSARALPAIADAVGDRLTVLADGGVRSGLDVVRMLALGARGVLIGRAYAYALAARGEAGVTQLLDLIDKEMRVAMALTGVRDVASINETILAERVPRAG

SEQ ID NO: 23325 - DNA, 2422 bp, Saccharomyces cerevisiae
  CDS (441)..(2216)
tcacgcatacatcggaaggatcaccccccactcaagtcgttgcattgctaacatgtggcattctgcccatttttttcacgaaaattctctctctataatgaagacccttgtgccctggactctgtaatacttgaaactacttcctcaataatcgcttggagacctacccccacgcttttcaaacaaggcgctagcaaaaagcctgccgatatctccttgccccctcctcctgttcgagagaactacgacccgaccaataataatgtcatacaagaaccgccaagaaccaactgctgaaccttagatctccaatacttcagttggagtatgtgaatatataagtacctggtcgactaatcttcttgcatcttttcgtattcttacatcctatgtcgctaatacagttcccgcatagagaagaaagcaaacaaaagtagtcaatgctaaaatacaaacctttactaaaaatctcgaagaactgtgaggctgctatcctcagagcgtctaagactagattgaacacaatccgcgcgtacggttctaccgttccaaaatccaagtcgttcgaacaagactcaagaaaacgcacacagtcatggactgccttgagagtcggtgcaattctagccgctactagttccgtggcgtatctaaactggcataatggccaaatagacaacgagccgaaactggatatgaataaacaaaagatttcgcccgctgaagttgccaagcataacaagcccgatgattgttgggttgtgatcaatggttacgtatacgacttaacgcgattcctaccaaatcatccaggtgggcaggatgttatcaagtttaatgccgggaaagatgtcactgctatttttgaaccattacatgctcctaatgtcatcgataagtatatagctcccgagaaaaaattgggtccccttcaaggatccatgcctcctgaacttgtctgtcctccttatgctcctggtgaaactaaggaagatatcgctagaaaagaacagctaaaatcgctgctacctcctctagataatattattaacctttacgactttgaatacttggcctctcaaactttgactaaacaagcgtgggcctactattcctccggtgctaacgatgaagttactcacagagaaaaccataatgcgtatcataggatttttttcaaaccaaagatccttgtagatgtacgcaaagtagacatttcaactgacatgttgggttctcatgtggatgttcccttctacgtgtctgctacagctttgtgtaaactgggaaaccccttagaaggtgaaaaagatgtcgccagaggttgtggccaaggtgtgacaaaagtcccacaaatgatatctactttggcttcatgttcccccgaggaaattattgaagcagcaccctctgataaacaaattcaatggtaccaactatatgttaactctgatagaaagatcactgatgatttggttaaaaatgtagaaaaactgggtgtaaaggcattatttgtcactgtggatgctccaagtttaggtcaaagagaaaaagatatgaagctgaaattttccaatacaaaggctggtccaaaagcgatgaagaaaactaatgtagaagaatctcaaggtgcttcgagagcgttatcaaagtttattgacccctctttgacttggaaagatatagaagagttgaagaaaaagacaaaactacctattgttatcaaaggtgttcaacgtaccgaagatgttatcaaagcagcagaaatcggtgtaagtggggtggttctatccaatcatggtggtagacaattagatttttcaagggctcccattgaagtcctggctgaaaccatgccaatcctggaacaacgtaacttgaaggataagttggaagttttcgtggacggtggtgttcgtcgtggtacagatgtcttgaaagcgttatgtctaggtgctaaaggtgttggtttgggtagaccattcttgtatgcgaactcatgctatggtcgtaatggtgttgaaaaagccattgaaattttaagagatgaaattgaaatgtctatgagactattaggtgttactagcattgcggaattgaagcctgatcttttagatctatcaacactaaaggcaagaacagttggagtaccaaacgacgtgctgtataatgaagtttatgagggacctactttaacagaatttgaggatgcatgattatagcctagctttaaggctactttaaaaactttttatttattcatacatatatattatcaaacattcatataacttaatatcattcaaaaaaaaaaaaaaaaaaaaaaagaaaacatatacacatatatatttatgtttatagagagagagagaaaatttgaatttttgaatcatttgcaaagttatatgttttatacattatt

SEQ ID NO: 23326 - protein, 591 aa, Saccharomyces cerevisiae
MLKYKPLLKISKNCEAAILRASKTRLNTIRAYGSTVPKSKSFEQDSRKRTQSWTALRVGAILAATSSVAYLNWHNGQIDNEPKLDMNKQKISPAEVAKHNKPDDCWVVINGYVYDLTRFLPNHPGGQDVIKFNAGKDVTAIFEPLHAPNVIDKYIAPEKKLGPLQGSMPPELVCPPYAPGETKEDIARKEQLKSLLPPLDNIINLYDFEYLASQTLTKQAWAYYSSGANDEVTHRENHNAYHRIFFKPKILVDVRKVDISTDMLGSHVDVPFYVSATALCKLGNPLEGEKDVARGCGQGVTKVPQMISTLASCSPEEIIEAAPSDKQIQWYQLYVNSDRKITDDLVKNVEKLGVKALFVTVDAPSLGQREKDMKLKFSNTKAGPKAMKKTNVEESQGASRALSKFIDPSLTWKDIEELKKKTKLPIVIKGVQRTEDVIKAAEIGVSGVVLSNHGGRQLDFSRAPIEVLAETMPILEQRNLKDKLEVFVDGGVRRGTDVLKALCLGAKGVGLGRPFLYANSCYGRNGVEKAIEILRDEIEMSMRLLGVTSIAELKPDLLDLSTLKARTVGVPNDVLYNEVYEGPTLTEFEDA

SEQ ID NO: 23327 - DNA, 1152 bp, Lactococcus lactis subsp. lactis
  CDS (1)..(1152)
atgcatctatcatctacagatgtaaactttataaaaaataggagaactaagatgacttataaaactagtactgaaaacaaagcgttagaaattgtaaatgttaaatcacttgaaggtaaagtgaaacaaagtatggaggctgcgggaaataaaggtggctttggctatattcgtggtggctctgaagatgagtggacactgaatgaaaatacatcagcatttaacaaaaaacaaattatgcctcgagtattgagaggaattgattctgcagatttaagtacctcactctttggtataaaactaaaaacaccaattatccaagcgccagttgccgcccaaggccttgctcatgcagaaggagaagttgcaactgctaaagcgatggctgaagttggctcaatcttttcaattagtacttacggaagtacatcagtggaagacgccgcaaaagcagcaccagatgcaccgcaatttttccaattatatatgagtaaagatgataaatttaatgaatttcttttgaaaaaagctgtatcagctggagttaaggcgattattttaaccgctgattcaacactaggtggctatcgagaagaagacattgtcaatcatttccaatttccttttccaatgccaaatctagctgctttttcagaaagtgatggaacgggcaagggaatcagcgaaatctatgcagcagcaaaacaaggtcttgttttagaagatattcaaaaaattaaaaaaataactaatcttcctgtaattgttaagggggttcaatctcctatagatgcagatgatgccattaacgctggggcagacggtatctgggtttcaaatcatgggggaagacaattagatggaggacctgcttcaattgatgtcctacccctcatcgccaaaagtgttaatcatcgagttcctattgtttttgatagtggagttagacgtggggaacatgtcttcaaagctttagcacaaggagcagatgttgttgcggtaggtcgaccagttctttatgggttgaatttagggggagccaaaggtgttcaatctgtttttgaacacttaaacaaagagctaagtattactatgcaacttgctggaacaaaaaatattgaagaaatcaaacatacctcattgattgactaa

SEQ ID NO: 23328 - protein, 383 aa, Lactococcus lactis subsp. lactis
MHLSSTDVNFIKNRRTKMTYKTSTENKALEIVNVKSLEGKVKQSMEAAGNKGGFGYIRGGSEDEWTLNENTSAFNKKQIMPRVLRGIDSADLSTSLFGIKLKTPIIQAPVAAQGLAHAEGEVATAKAMAEVGSIFSISTYGSTSVEDAAKAAPDAPQFFQLYMSKDDKFNEFLLKKAVSAGVKAIILTADSTLGGYREEDIVNHFQFPFPMPNLAAFSESDGTGKGISEIYAAAKQGLVLEDIQKIKKITNLPVIVKGVQSPIDADDAINAGADGIWVSNHGGRQLDGGPASIDVLPLIAKSVNHRVPIVFDSGVRRGEHVFKALAQGADVVAVGRPVLYGLNLGGAKGVQSVFEHLNKELSITMQLAGTKNIEEIKHTSLID

SEQ ID NO: 23329 - DNA, 1248 bp, Pseudomonas aeruginosa
  CDS (97)..(1248)
aacggcggaatttccttccgccgatgccgacaattattccgcctgcggcggtacgtcgcgctctaccatccagccacccccgaaggagtggactgcatgagcgtcatcaccgatatcgaagacctgcgccgcctggcgcgcaagcgcgtgccgcggatgttctacgactacgccgactccggttcctggagcgaaggcacctaccgcgccaaccaggacgacttcgccgcgatcaagctgcgccagcgggtcgcgcggaatatcgagaaccgctcgctgcgcacccgcatgctcggccaggagatggccatgccggtggccatcgcgcccaccgggctggccggcatgcagcatgccgacggcgagatcctcgccgcccgcgccgccgccgagttcggcgtgcgctacaccctgtcgaccatgagcatctgttccctggaggacatcgccacggaagtcggccagccgttctggttccagctctacgtgatgcgcgaccgcgatttcatcgaacgcctgatcgaccgtgccaaggccgccggctgcgacgcgctggtgctgaccctcgacctgcagatcatcggccagcgccacaaggacctgaagaacggtctctcggcgccgccgcggccgaccctggccaacctgctgaacatcgccaccaagccgcgctgggcgctgggcatgctcggcacccggcgtcgcggtttcggcaacatcgtcgggcacgtcaagggcgtcgacgacatgggctcactgtccgagtggaccgcccgccagttcgacccgcggctgaactggggcgacgtcgaatggatcaagcggcgctggggcggcaagctggtgctcaagggcattctcgatgccgaggatgcgcggttggccgccgactccggcgccgatgcgctggtcgtcagcaaccatggcggacgccaactggacggcgcgccctcgaccatcagcgcgctgccggcgatcgtcgaggcggtgggcgagcgcatcgaggtctggctcgacagcggcatccgttccgggcaggacgtgctcaaggccatcgccctcggtgcgcgcgggaccatgatcggccgtccctatctctacgggctgggcgcgctggggcaggccggagtgacgcgggcgctggagatcatagcccgcgagctggacctgaccatggccttctgcggccataccgacatccgcgaggtcggccgggacatcctgttgccgggaagctatccgcgatag

SEQ ID NO: 23330 - protein, 383 aa, Pseudomonas aeruginosa
MSVITDIEDLRRLARKRVPRMFYDYADSGSWSEGTYRANQDDFAAIKLRQRVARNIENRSLRTRMLGQEMAMPVAIAPTGLAGMQHADGEILAARAAAEFGVRYTLSTMSICSLEDIATEVGQPFWFQLYVMRDRDFIERLIDRAKAAGCDALVLTLDLQIIGQRHKDLKNGLSAPPRPTLANLLNIATKPRWALGMLGTRRRGFGNIVGHVKGVDDMGSLSEWTARQFDPRLNWGDVEWIKRRWGGKLVLKGILDAEDARLAADSGADALVVSNHGGRQLDGAPSTISALPAIVEAVGERIEVWLDSGIRSGQDVLKAIALGARGTMIGRPYLYGLGALGQAGVTRALEIIARELDLTMAFCGHTDIREVGRDILLPGSYPR

SEQ ID NO: 23331 - DNA, 1176 bp, Caulobacter crescentus
  CDS (1)..(1176)
atggcccattacggcgactaccagaacgagatctatggggccgggctgcagggcgtgcgccccaaatggccggtcgacttcaagacgctggaagcgcgcgcgaccgccgccatgtcccccgatctgctcagctacgtgcaaggtggctgtggcgatgagttcacccagcgccggaacgccgacgcctttcacgactggggcgtcgtcccccggatgatggtcgacgcgtccaagcgcgacctgtcgatcgaactctttggtctgaagctgcccacgccgctgttcatgagccccatcggggtcatcggcatgtgcgcccaggacggacatggcgacatcgccaccgccgtcgcggcgcaaagaacgggcgtgcccgtaatggcctcaaccctggctaacgatccgattgaaaaggtcggcgcggcgctgggcgacggggtcggctttttccagctctatacgcccaaggaccgcgacctcgccgaaagcctgatccgccgggccgagaccgccggcttcaaggccctggtggtgacgctcgacacctgggtcacaggctggcggccgcgagatctcaacgacgcaaacttcccccagcttcggggccatgtcctgcaaaactacttcaccgacccgcgcttcctggagatcctgggcaagccggtggccgaggatcctgcgaccgcgatccgcacctggggcggcctgtttggcaagaccctgacctgggaggatctggcctggctcagatcggccaccaagctgcccatcgttctcaagggcatctgtcacccggacgacgcgcgccgggccgtggacctgggcgttgacggtgtcttttgctccaaccacggcggccgtcaggccaatggcggcatcgccgcgatcgacctgcttgaagatgtcgtcacggccagcgggaacacgccggtccttttcgattccggcgtgcgatccggatcggacgccgccaaggcgctggcgatgggcgcgcgggcggtcgggatcggtcggccttacgcctatggcctggcgatcggcggcgtcgacggcgtcgtccacgtgttgcggagcatcctcgccgagctcgacctactgatggccgtcgacggtttcccgaccctcgccgcgctccgtgacgcaggcgtgcgcccggttcgaagggccggcgtctaa

SEQ ID NO: 23332 - protein, 391 aa, Caulobacter crescentus
MAHYGDYQNEIYGAGLQGVRPKWPVDFKTLEARATAAMSPDLLSYVQGGCGDEFTQRRNADAFHDWGVVPRMMVDASKRDLSIELFGLKLPTPLFMSPIGVIGMCAQDGHGDIATAVAAQRTGVPVMASTLANDPIEKVGAALGDGVGFFQLYTPKDRDLAESLIRRAETAGFKALVVTLDTWVTGWRPRDLNDANFPQLRGHVLQNYFTDPRFLEILGKPVAEDPATAIRTWGGLFGKTLTWEDLAWLRSATKLPIVLKGICHPDDARRAVDLGVDGVFCSNHGGRQANGGIAAIDLLEDVVTASGNTPVLFDSGVRSGSDAAKALAMGARAVGIGRPYAYGLAIGGVDGVVHVLRSILAELDLLMAVDGFPTLAALRDAGVRPVRRAGV

SEQ ID NO: 23333 - DNA, 1146 bp, Pseudomonas aeruginosa
  CDS (1)..(1146)
atgatcatttccgcttccaccgactaccgcgccgccgcccaacgcaagctgccgccgttcctcttccactacatcgacggcggcgcctacgccgagtacaccctgcgccgcaacgtcgaggacctgtcggccatcgccctgcgtcagcgggtgctgaagaacatgtccgagctgagcctggaaacccgcctgttcgacgagaccctggcgatgccggtggcgctcgccccggtcggtctcaccggcatgtacgcccgccgcggcgaggtccaggcggcgcgcgcggcggcggcgaagggcgtgcccttcaccctgtcgacggtatcggtgtgcccgattgaggaggtcgccccggccatcgaccggccgatgtggttccagctctacgtgctgaaggaccgcggcttcatgcgcaacgccctggagcgggccaaggccgccggcgtcaccaccctggtgttcaccgtcgacatgccggtccccggcgcccgctaccgcgacgcccattccggcatgagcggcccctacgccgcgccgcgccgcatcctgcaagccatgacccacccggcctgggcctgggacgtcggcctgctgggcaagccccacgacctcggcaacatttccgcctaccgcggcaacccgaccggactggaggactacatcggctggctgggcgccaacttcgacccgtcgatttcctggaaggacctggagtggatccgcgagttctgggacggcccgatggtgatcaagggcatcctcgacccggaggatgccagggatgcggtgaagttcggcgccgacggcatcgtcgtctccaaccacggcgggcgccagctcgacggcgtgctgtccagcgcccgcgcgctgccggcgatagccgatgcggtgaagggtgaactggcgatccttgccgactccggcatccgcaccggtctcgacgtggtgcggatgatcgccctcggcgccgacagcgtgctgctcggccgcgccttcgtctacgccctggccgccgccggcgaggccggggtgcgcaacctgctcgaactgatcgaaaaggaaatgcgcgtggccatggtcctcaccggggccaagtcgatcggcgagatcagcgccgactcgctggtccgcgaactgggcgcctga

SEQ ID NO: 23334 - protein, 381 aa, Pseudomonas aeruginosa
MIISASTDYRAAAQRKLPPFLFHYIDGGAYAEYTLRRNVEDLSAIALRQRVLKNMSELSLETRLFDETLAMPVALAPVGLTGMYARRGEVQAARAAAAKGVPFTLSTVSVCPIEEVAPAIDRPMWFQLYVLKDRGFMRNALERAKAAGVTTLVFTVDMPVPGARYRDAHSGMSGPYAAPRRILQAMTHPAWAWDVGLLGKPHDLGNISAYRGNPTGLEDYIGWLGANFDPSISWKDLEWIREFWDGPMVIKGILDPEDARDAVKFGADGIVVSNHGGRQLDGVLSSARALPAIADAVKGELAILADSGIRTGLDVVRMIALGADSVLLGRAFVYALAAAGEAGVRNLLELIEKEMRVAMVLTGAKSIGEISADSLVRELGA

SEQ ID NO: 23335 - DNA, 1107 bp, Arabidopsis thaliana (mouse-ear cress)
  CDS (1)..(1107)
atggagataacaaacgtgatggaatatgagaagatcgcaaaggagaaattaccaaagatggtttatgattactatgcatctggtgctgaagatcaatggactcttcaagagaatcgaaacgctttctctaggattctatttaggcctcggattcttatcgatgtaagcaagattgatgtgagcacaacggttttagggtttaatatttctatgccaattatgattgctcctactgcaatgcagaaaatggctcatcctgatggcgagcttgcaaccgcgagagctacttctgctgctggaacaatcatgactttatcttcatgggctacttgtagtgttgaggaagttgcttcaaccggaccagggattcgttttttccaactttatgtttataaggatagaaatgtggttatacagcttgtgaaacgagctgaagaagctggattcaaagctattgctcttactgtagatactccaaggcttggacgcagagaatctgacatcaaaaacagattcgcgcttcctcgaggtctaacgttgaagaacttcgaagggttggatcttgggaaaatagacaagacgaatgactcagggctagcttcatatgttgctggtcaagttgatcaatcacttagctggaaggatataaaatggctccaatctatcacaagcttgccaattcttgtcaagggtgttattacagctgaggatgcaagaattgctgttgaatatggagctgcagggataatagtctctaaccacggagctcgtcagctagattatgttcctgcaactatagtggccttagaagaggtggttaaagccgtggagggtcggattccggtttttcttgacggtggggttcgccgtggaaccgatgtctttaaggcattggctcttggcgcttcaggtgtctttgtcgggaggccgagcttgttctcgcttgcagcggatggagaagcgggagttaggaagatgctacaaatgctaagagacgagtttgagcttacaatggcactaagtggttgccgttcactgagagagatcagccgaacccacatcaagactgattgggacactcctcattacctctcggccaagctgtag

SEQ ID NO: 23336 - protein, 368 aa, Arabidopsis thaliana (mouse-ear cress)
MEITNVMEYEKIAKEKLPKMVYDYYASGAEDQWTLQENRNAFSRILFRPRILIDVSKIDVSTTVLGFNISMPIMIAPTAMQKMAHPDGELATARATSAAGTIMTLSSWATCSVEEVASTGPGIRFFQLYVYKDRNVVIQLVKRAEEAGFKAIALTVDTPRLGRRESDIKNRFALPRGLTLKNFEGLDLGKIDKTNDSGLASYVAGQVDQSLSWKDIKWLQSITSLPILVKGVITAEDARIAVEYGAAGIIVSNHGARQLDYVPATIVALEEVVKAVEGRIPVFLDGGVRRGTDVFKALALGASGVFVGRPSLFSLAADGEAGVRKMLQMLRDEFELTMALSGCRSLREISRTHIKTDWDTPHYLSAKL

SEQ ID NO: 23337 - DNA, 1137 bp, Streptococcus pneumoniae
  CDS (1)..(1137)
atgtcatacaaaacaagcaatgcagaaggtcatgtagacttcatcaatacctatgatttggagccaatggcgcaacaagttattcctaaagcagcatttggctatatcgctagtggggcggaagatactttcactttaagagagaatatccgtgcctttaaccacaagctcatcgttcctcatacactttgcaatgtagaaaatccaagtacagagattgaatttgcaggtgaaaaactatcttctccaatcattatggcacctgttgcggctcataaattggcaaatgaacagggggaagtggcgactgcgcgtggtgtgcatgagtttggttctctttatacaaccagttcttactctactgttgaccttccagagatttctgaagccctccaagggacacctcattggtttcaattttactttagtaaggatgacggtatcaaccgccacatcatggaccgtgtgaaggctgaaggttataaagcgattgtcttgacggcagatgctactgtaggggggaatcgtgaagtggataagcgtaatggttttgtcttcccagttggcatgccgattgttgaagaatacctgccagaaggtgctggtaaatcaatggactttgtttacaaatcagctaaacaacgcttgtctccacgcgatgtagaatttatcgctgaatactctggtcttcctgtgtatgtcaagggaccacaatgccgtgaggacgttgaacgttcgcttgctgcaggagcttctggtatctgggtaaccaaccacggtggtcgtcaaatcgacggtggaccagctgcctttgactcgcttcaagaagtggcagaagcagttgatagacgtgtgccgattgtctttgactctggtgttcgtcgtggtcaacacgtctttaaagccttggcatcaggagcagacttggttgctattggacgccctgtcatctatggcttggctctcggtggtagtgtcggtgtgcgtcaagtctttgaacacttgaatgcggaattgaagacagttatgcaattgtctggaactcagaccattgaagatgtcaaacacttcaagctccgtcacaatccatacaacccaaccttcccagttgaccctcgtgacttaaaattgtattag

SEQ ID NO: 23338 - protein, 378 aa, Streptococcus pneumoniae
MSYKTSNAEGHVDFINTYDLEPMAQQVIPKAAFGYIASGAEDTFTLRENIRAFNHKLIVPHTLCNVENPSTEIEFAGEKLSSPIIMAPVAAHKLANEQGEVATARGVHEFGSLYTTSSYSTVDLPEISEALQGTPHWFQFYFSKDDGINRHIMDRVKAEGYKAIVLTADATVGGNREVDKRNGFVFPVGMPIVEEYLPEGAGKSMDFVYKSAKQRLSPRDVEFIAEYSGLPVYVKGPQCREDVERSLAAGASGIWVTNHGGRQIDGGPAAFDSLQEVAEAVDRRVPIVFDSGVRRGQHVFKALASGADLVAIGRPVIYGLALGGSVGVRQVFEHLNAELKTVMQLSGTQTIEDVKHFKLRHNPYNPTFPVDPRDLKLY

SEQ ID NO: 23339 - DNA, 1137 bp, Sinorhizobium meliloti
  CDS (1)..(1137)
atgacgcagattctcgaaatacgggacctgaaggccctggccagacggcgcgtgccgaagcttttcttcgattatgcggacagcggcgcatggacggagggaacctaccgcgccaacgaggaggatttcgccgggatcaagctgcgccagcgggtgctggtcgacatgtccgaccggtcgctcgaaacgacgatgatcggacagaaggtctcgatgccggtcgcgctcgcccccaccggcctgacgggcatgcagcatgccgacggcgagatgctggcggctcaggcggccgaggcgttcggcgtcccgttcacgctctcgaccatgagcatctgctcgatcgaggacgtcgcctcggtgacgacgaagccgttctggttccagctctatgtcatgcgcgagcgcgagttcgtgctcgatctgatcgaccgggccaaggccgcgaagtgttccgcgctcgtcatgacgctcgacctgcagatcctcggccagcgccataaggaccttcgcaacggcctgtccgcgccgccgcgactgacgccgaaacacctctggatgatggcgacgcggcccggctggtgcatgaagatgctcggcaccaaccgccgcaccttccgcaacatcgtcggccacgccaagagcgtcgccgacctctcctcgcttcaggcctggacgaacgagcagttcgacccgcagctttcctggaaggacgtcgagtggatcaaggagcgctggggcggtccgctgatcctcaagggcattctcgatccggaagacgcaaaaatggcggcgaagaccggcgccgacgcaatcatcgtctcgaaccacggcggccgccagctcgacggcgcgcattcctcgatcagcatgctgccgcgcatcgttgaggccgtcggcgaccagattgaggtacacctcgacggcggcattcgttccggccaggacgtccttaaggcgatcgcgctcggtgcgaaaggcacctatatcggccgccccttcctctacggcctcggcgcgctcggcaaggaaggcgtgacactcgcgctcgacatcatccgcaaggagatggacacgaccatggcgctctgcggcaaacgccgcatcaccgaggtcggccgcgacatcatcgccgagtag

SEQ ID NO: 23340 - protein, 378 aa, Sinorhizobium meliloti
MTQILEIRDLKALARRRVPKLFFDYADSGAWTEGTYRANEEDFAGIKLRQRVLVDMSDRSLETTMIGQKVSMPVALAPTGLTGMQHADGEMLAAQAAEAFGVPFTLSTMSICSIEDVASVTTKPFWFQLYVMREREFVLDLIDRAKAAKCSALVMTLDLQILGQRHKDLRNGLSAPPRLTPKHLWMMATRPGWCMKMLGTNRRTFRNIVGHAKSVADLSSLQAWTNEQFDPQLSWKDVEWIKERWGGPLILKGILDPEDAKMAAKTGADAIIVSNHGGRQLDGAHSSISMLPRIVEAVGDQIEVHLDGGIRSGQDVLKAIALGAKGTYIGRPFLYGLGALGKEGVTLALDIIRKEMDTTMALCGKRRITEVGRDIIAE

SEQ ID NO: 23341 - DNA, 1245 bp, Mycobacterium tuberculosis
  CDS (1)..(1245)
atggcggtcaaccggcgagtgcccagagtgcgcgatctggcacccctgctccagttcaacaggccgcagttcgacacctccaagcgccgcctgggcgccgcgctgaccatccaggacctgcgacgcattgccaaacggcgtacccctagggcggcgttcgactacgccgacgggggtgccgaggacgaactgtccatcgcgcgtgctcgacaagggttccgcgacatcgagtttcacccgacaatcctgcgtgacgtcaccaccgtgtgcgccggctggaacgtcctcggtcagcccaccgtcttgccattcgggatcgcgccaaccgggttcacccgcttgatgcacaccgagggcgagatcgccggcgcgcgggcggcggccgcggctgggatcccgttttcgctatccaccctggccacctgtgccatcgaagacctcgtcatcgctgtgccgcagggccgcaaatggttccagctgtatatgtggcgtgatcgagaccgctcgatggcattggtgcggcgcgtcgccgccgcgggatttgacaccatgctggtcacggtcgacgtcccggtcgccggtgcccggctacgcgatgtccgcaacgggatgtccatcccgccggcgctgacgctgcgaaccgttctcgacgcgatgggacacccgcggtggtggttcgacttgttgaccaccgaaccgctggccttcgcttcactggatcgctggcctggcaccgtcggcgagtacttgaacaccgtgttcgaccccagcctcaccttcgacgatttggcctggatcaagtcgcagtggccgggcaagctcgttgtcaaagggatccaaacactcgacgacgcccgcgccgtggtggaccgcggcgtcgacggcatcgtgttgtccaatcacggcggccgccagcttgaccgagccccggtacccttccacctgttgccccacgtggcacgcgaactgggcaaacacaccgaaatcctggtggacaccggcatcatgtcgggcgccgatatcgtcgcggcgatcgcgttgggggcacggtgcacgctgatcgggcgggcctacctttacgggctgatggccggtggtgaggcgggcgtcaaccgcgcgatcgagatccttcagacaggtgtgatccggaccatgcggctactgggcgtgacctgccttgaggagctgtcacctcggcacgtgacacaactgcggcggctcggccctatcggggcaccaacgtga

SEQ ID NO: 23342 - protein, 414 aa, Mycobacterium tuberculosis
MAVNRRVPRVRDLAPLLQFNRPQFDTSKRRLGAALTIQDLRRIAKRRTPRAAFDYADGGAEDELSIARARQGFRDIEFHPTILRDVTTVCAGWNVLGQPTVLPFGIAPTGFTRLMHTEGEIAGARAAAAAGIPFSLSTLATCAIEDLVIAVPQGRKWFQLYMWRDRDRSMALVRRVAAAGFDTMLVTVDVPVAGARLRDVRNGMSIPPALTLRTVLDAMGHPRWWFDLLTTEPLAFASLDRWPGTVGEYLNTVFDPSLTFDDLAWIKSQWPGKLVVKGIQTLDDARAVVDRGVDGIVLSNHGGRQLDRAPVPFHLLPHVARELGKHTEILVDTGIMSGADIVAAIALGARCTLIGRAYLYGLMAGGEAGVNRAIEILQTGVIRTMRLLGVTCLEELSPRHVTQLRRLGPIGAPT

SEQ ID NO: 23343 - DNA, 1062 bp, Deinococcus radiodurans
  CDS (1)..(1062)
atgtcgcttccctacctcaacctgcgcgagatggaacaggccgccgccggggtgctgccgcccgccgcctttgcctactacaccggcggcgcgaacgacgagcacaccctgcgcgagaaccgcgagggctacgcccggctgaagctgcggccccggatgctggtggacgtgtcgcacatcgacacctccacgacggtgctgggcctgccgctcgcctttccggtgggtgtggccccctgcgccctgcacggcctcgtgcaccccgacgccgaagtggcgactgcccgcgccgccgccagcttgggcagcctgatgacgctctcgaccatgagccaccggaccatcgaggacgtgtcggacgcggcgggcgggcagttctggtttcagctctacctctacaaggaccgcgaggtcagccgcgctctggtgcagcgggccgaggccgccggagcgcgggcactggtgctgacggtggacgcgccggtgctgggacgccgcgaagccatcatccggacgcccgtacacatcgagcctggcaccgtgctgcccaacatcggcccccgcgtgccgggcagcgagcatctggacgacctccagtatttcgactcgctgctcgaccccgccattacctggaacgacatcggctggctgcgcggtatcaccgggctgccgattgtcctcaaggggctgctcaccgccgaggacgttgccctcgccgtgcagcacggctgccacatctgggcgagcaaccacggcgggcggcaactcgacaccgccgtgactgccctcgatgccctgcccgaaatcgcggaggcggcgaacggacgggccgagatttatctcgacggcggcgtcacgcgcggcaccgatgtcctcaaagcgctcgcactcggggcgaacgcggtgtttctcgcccgcgccgtcctttacggcctcgcgctggcgggggaggacggcgcgcggcacacgctggagctgctgcgtgacgaggtgcggctggcaatgatgctgtgcggcaaaacgcaggtgagcgagctggggccggagctgatctggcgctga

SEQ ID NO: 23344 - protein, 353 aa, Deinococcus radiodurans
MSLPYLNLREMEQAAAGVLPPAAFAYYTGGANDEHTLRENREGYARLKLRPRMLVDVSHIDTSTTVLGLPLAFPVGVAPCALHGLVHPDAEVATARAAASLGSLMTLSTMSHRTIEDVSDAAGGQFWFQLYLYKDREVSRALVQRAEAAGARALVLTVDAPVLGRREAIIRTPVHIEPGTVLPNIGPRVPGSEHLDDLQYFDSLLDPAITWNDIGWLRGITGLPIVLKGLLTAEDVALAVQHGCHIWASNHGGRQLDTAVTALDALPEIAEAANGRAEIYLDGGVTRGTDVLKALALGANAVFLARAVLYGLALAGEDGARHTLELLRDEVRLAMMLCGKTQVSELGPELIWR

SEQ ID NO: 23345 - DNA, 1146 bp, Sinorhizobium meliloti
  CDS (1)..(1146)
atggcgctggtcaacatcgacgactttcgcgatctcgcccggcggcggcggccgaagatctttttcgactatatcgacggcggttccttcgaggaggagacgatgcgggcgaatcgctcggacttctcccgcctaaccctgcgccagaacgtgctggtcgagccgcagccgcaggaccttgccacggcctatctcgggaaacgtcatcccctgccgttcatgctcgggccggttggcttcctcggcctctattccggcaagggcgaggtcaaggccgtgcgggcggcgcatgccgcgggcatccccttctgcttatcaaccttttccatcgcctcactcgccgaccttcggatcgtcacggacgggccgctgcatttccagctctatgtgctggaggatcgctcgctctgcgaggaattcctacgagcggcagaatacgccggcgtcgacaccctgttcgtaacggtcgacaccgccattacgggcattcgcgaacgggacgtgcgaaacggattccgatcgctgacgcgggtgacgccggacctcttcgcgcgcctcgcgctgaagccgcgctggcttgcagaggtggtccttgccggcatgccgtcggtcagggccgtcgagcaccggccggaattcggtcgcggcgcgctggagcaggcggccaatctctcgcgccgaatcgacaagacgctgtcgtggaaggacatcgcctggctgcgcgaacgctgggcgggcaagctcgtgatcaaaggcgttctcacgcccgctgatgctgtgcgcgctcgcgatctcggctgcgatggggtggtggtttccaaccacggcggacgccagctcgacggtgccccgagcacgatccgagccctgcccagcattcgcgccaccgtgggaaccgacttctgccttatgcttgacggcggtatccgccgcggcgcggacgtcatcaaggcgatcgcactcggcgcagacggcgtgatgcttggccgggcttatgcctacggcctctcggccgccgggcaggcgggggtggccgaggtgattgccatcctcgagcgcgagatttcgatcagtcttgcgttgatggggattgcctcggtcgagcaactcaaggctctcggcgcggaagccgtctcgacactctga

SEQ ID NO: 23346 - protein, 381 aa, Sinorhizobium meliloti
MALVNIDDFRDLARRRRPKIFFDYIDGGSFEEETMRANRSDFSRLTLRQNVLVEPQPQDLATAYLGKRHPLPFMLGPVGFLGLYSGKGEVKAVRAAHAAGIPFCLSTFSIASLADLRIVTDGPLHFQLYVLEDRSLCEEFLRAAEYAGVDTLFVTVDTAITGIRERDVRNGFRSLTRVTPDLFARLALKPRWLAEVVLAGMPSVRAVEHRPEFGRGALEQAANLSRRIDKTLSWKDIAWLRERWAGKLVIKGVLTPADAVRARDLGCDGVVVSNHGGRQLDGAPSTIRALPSIRATVGTDFCLMLDGGIRRGADVIKAIALGADGVMLGRAYAYGLSAAGQAGVAEVIAILEREISISLALMGIASVEQLKALGAEAVSTL

SEQ ID NO: 23347 - DNA, 1125 bp, Aerococcus viridans
  CDS (1)..(1125)
atgaataacaatgacattgaatataatgcacctagtgaaatcaagtacattgatgttgtcaatacttacgacttagaagaagaagcaagtaaagtggtaccacatggtggttttaactatattgccggtgcatctggtgatgagtggactaaacgcgctaatgaccgtgcttggaaacataaattactatacccacgtctagcgcaagatgttgaagcgcccgatacaagtactgaaattttaggtcataaaattaaagccccattcatcatggcaccaattgctgcacatggtttagcccacactactaaagaagctggtactgcacgtgcagtttcagaatttggtacaattatgtccatctcagcttattctggtgcaacatttgaagaaatttctgaaggcttaaatggcggaccccgttggttccaaatctatatggctaaagatgaccaacaaaaccgtgatatcttagacgaagctaaatctgatggtgcaactgctatcatccttacagctgactcaactgtttctggaaaccgtgaccgtgatgtgaagaataaattcgtttacccatttggtatgccaattgttcaacgttacttacgtggtacagcagaaggtatgtcattaaacaatatctacggtgcttcaaaacaaaaaatctcaccaagagatattgaggaaatcgccggtcattctggattaccagtattcgttaaaggtattcaacacccagaagatgcagatatggcaatcaaacgtggtgcatcaggtatctgggtatctaaccacggtgctcgtcaactatatgaagctccaggttcatttgacacccttccagctattgctgaacgtgtaaacaaacgtgtaccaatcgtctttgattcaggtgtacgtcgtggtgaacacgttgccaaagcgctagcttcaggggcagacgttgttgctttaggacgcccagtcttatttggtttagctttaggtggctggcaaggtgcttactcagtacttgactacttccaaaaagacttaacacgcgtaatgcaattaacaggttcacaaaatgtggaagacttgaagggtctagatttattcgataacccatacggttatgaatactag

SEQ ID NO: 23348 - protein, 374 aa, Aerococcus viridans
MNNNDIEYNAPSEIKYIDVVNTYDLEEEASKVVPHGGFNYIAGASGDEWTKRANDRAWKHKLLYPRLAQDVEAPDTSTEILGHKIKAPFIMAPIAAHGLAHTTKEAGTARAVSEFGTIMSISAYSGATFEEISEGLNGGPRWFQIYMAKDDQQNRDILDEAKSDGATAIILTADSTVSGNRDRDVKNKFVYPFGMPIVQRYLRGTAEGMSLNNIYGASKQKISPRDIEEIAGHSGLPVFVKGIQHPEDADMAIKRGASGIWVSNHGARQLYEAPGSFDTLPAIAERVNKRVPIVFDSGVRRGEHVAKALASGADVVALGRPVLFGLALGGWQGAYSVLDYFQKDLTRVMQLTGSQNVEDLKGLDLFDNPYGYEY

SEQ ID NO: 23349 - DNA, 1511 bp, Spinacia oleracea (spinach)
  CDS (135)..(1244)
ccttttttttttttttttgggttttatatcccccaattatttgtcatctctgggtttcttcctcactctccccagagaaccaacttcaagagttcaatactaaggggggtgggtttaaatatattaggcagaagatggagatcacaaatgtgaacgagtatgaggccattgcaaagcagaaattgccaaagatggtgtatgactactatgcatctggtgcagaagaccagtggactcttgctgagaacagaaatgctttctccaggatcctgtttcgcccacgtatccttattgatgtaaccaacatcgacatgactacaactatcttgggattcaagatctcaatgcctatcatgatagccccaactgccatgcaaaagatggcacaccctgaaggggagtatgcgactgccagagcagcatcagcagctggaactatcatgacactgtcctcatgggctacatcaagtgtggaagaggttgcttcaacaggaccaggcatccgatttttccagctctatgtatacaaggacaggaatgtagttgctcaacttgtgagaagagctgagagggctgggttcaaggctattgcccttactgttgacacaccccgattgggacgtagagaagctgatatcaagaacaggtttgttttaccaccttttctaacattgaagaactttgagggtattgacctgggcaagatggacaaagcaaatgactctggcctttcctcatatgtcgctggtcagattgatcgatccctgagctggaaggatgttgcgtggcttcagacaatcaccagcctccccatccttgtgaagggtgtaattacagctgaggatgcaagactggccgttcaacatggggcagctggaattattgtatccaaccatggagctcgccaacttgattatgttcctgctactataatggctcttgaagaggttgtcaaagcagcacaaggtcgcattcctgttttcttggatggtggtgttcgtcgtggaactgacgttttcaaagcattggcattgggtgcagctggagtatttattggaaggcccgtggtgttttccctggctgcagaaggagaggctggtgttaagaaagtccttcagatgatgcgcgatgaatttgagctgacaatggcattgagtggttgtcgttccctcaaagaaatctcgcgcagccacattgctgctgactgggacggccctagttctcgtgctgttgccagattataacaagtttatataacttgtgcacaaataatgaaacctatgtttgagcaacggaaatgtaacagcatatccttttaagtttttctttttttttttcctacttaaaaagtgccttctttttcgttcaagaacttcatttttgatgactatcaatggatgccttatgtattttcaaatggctactctgcctttcattgtatattcttcttattttcccttttttaataatacttgatatatccatataactatatatttactcacctaaaa

SEQ ID NO: 23350 - protein, 369 aa, Spinacia oleracea (spinach)
MEITNVNEYEAIAKQKLPKMVYDYYASGAEDQWTLAENRNAFSRILFRPRILIDVTNIDMTTTILGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFVLPPFLTLKNFEGIDLGKMDKANDSGLSSYVAGQIDRSLSWKDVAWLQTITSLPILVKGVITAEDARLAVQHGAAGIIVSNHGARQLDYVPATIMALEEVVKAAQGRIPVFLDGGVRRGTDVFKALALGAAGVFIGRPVVFSLAAEGEAGVKKVLQMMRDEFELTMALSGCRSLKEISRSHIAADWDGPSSRAVARL

SEQ ID NO: 23351 - DNA, 2192 bp, Pichia anomala, Candida pelliculosa
  CDS (304)..(2025)
ttgtacttctccagcatcaattctcccactataatgaaagctctgtcccccaccgctttcccactgagaccacaatctcgtgggggactcttttactactccacagtattacgtaatcacagtgcttatttaaaaatgacttgggataggcaggtttcactaaaaccgaaaagttttggtgaaagcctcgaggtattcatcattcttgatatatatatttcaaggactgacctcccacaaacttttcccttcactttttaaatattcataaatacataacgagtgtcaatattccactgctcaatgtttaaaagccaattgagaacagcaactgctagatcaagctttagatctttagctagcaagctaaacccccagagattcaattcttcaaagactccacttctcaatgctacaaggggttcaaatcgttccaaaaattcattaatcgcattagccatctcattatcagctgtttcatcttcttattatctataccaaaaggacaaattcattagtgcagatgttcctcattggaaagatatagaactaacaccagaaattgtttctcagcataacaaaaaagatgatctatgggttgtcttgaacggtcaagtttatgacttaacagatttcttgccaaatcatccaggtggtcaaaaaatcattattagatatgctggcaaagatgctacaaagatctttgtaccaattcatccacctgatactattgaaaaatttatcccacctgaaaagcatcttggtccattagttggtgagtttgaacaggaagaagaagaattgagtgatgaagaaattgatagattggaaagaatcgaaagaaaaccaccattatcccaaatgataaatcttcatgattttgaaactattgctagacaaatcttaccaccacctgcattagcttattactgttccgctgcagacgatgaagtcacactaagagaaaatcataatgcttatcatagaatctttttcaacccaaaaatcttgattgatgttaaagatgttgatatttccactgaattctttggtgaaaagacatcagcaccattttatatatctgccactgcattggcgaaattgggccatccagaaggtgaagtcgctattgcaaaaggtgcaggtcgtgaagatgtcgtccaaatgatttctacattagcttcatgttcatttgatgaaatagccgatgcaagaatcccaggccaacaacaatggtatcaattgtatgttaatgcagatagatcaatcaccgagaaagctgtgagacacgcagaggaaagaggtatgaaaggtttattcataacagttgatgcgccatccttaggacgtcgtgaaaaagatatgaagatgaaattcgaagctgatagtgatgtccagggtgatgatgaagatattgatagaagtcaaggtgcttctcgtgctcttagctccttcattgatccttctttatcttggaaagatatcgcttttattaaatccattacaaagatgcctattgttattaaaggtgttcaaagaaaagaagatgtgttacttgctgctgaacatggattacaaggtgttgtcttatcaaaccatggtggtcgtcaattagattataccagagccccagtggaagttttagctgaagttatgccaatcttgaaagaaagaggtttagatcaaaagattgacatctttgttgatggtggtgttagaagaggtactgatgtcttgaaagctttgtgtcttggtgctaaaggtgttggtttaggtagacctttcttgtatgcaatgagttcatatggtgataaaggtgttactaaagctattcaattgttaaaagatgaaattgaaatgaatatgagattattaggtgtgaataaaattgaagaattgactcctgaattattggatactagaagtattcataacagagccgttccagttgctaaagattatctatatgaacaaaattatcaaagaatgagcggtgctgaatttagaccaggtatagaggattgaacaaattttgtacattatggaaaaaaaaattaacttgctatttatttaacggacatatgtagcatcaattttgttgacttgtggtaagaacacttattagttttcttctataagctgttggatttgttaattgtaatgggttaccttcaaaataaacagttatctag

SEQ ID NO: 23352 - protein, 573 aa, Pichia anomala, Candida pelliculosa
MFKSQLRTATARSSFRSLASKLNPQRFNSSKTPLLNATRGSNRSKNSLIALAISLSAVSSSYYLYQKDKFISADVPHWKDIELTPEIVSQHNKKDDLWVVLNGQVYDLTDFLPNHPGGQKIIIRYAGKDATKIFVPIHPPDTIEKFIPPEKHLGPLVGEFEQEEEELSDEEIDRLERIERKPPLSQMINLHDFETIARQILPPPALAYYCSAADDEVTLRENHNAYHRIFFNPKILIDVKDVDISTEFFGEKTSAPFYISATALAKLGHPEGEVAIAKGAGREDVVQMISTLASCSFDEIADARIPGQQQWYQLYVNADRSITEKAVRHAEERGMKGLFITVDAPSLGRREKDMKMKFEADSDVQGDDEDIDRSQGASRALSSFIDPSLSWKDIAFIKSITKMPIVIKGVQRKEDVLLAAEHGLQGVVLSNHGGRQLDYTRAPVEVLAEVMPILKERGLDQKIDIFVDGGVRRGTDVLKALCLGAKGVGLGRPFLYAMSSYGDKGVTKAIQLLKDEIEMNMRLLGVNKIEELTPELLDTRSIHNRAVPVAKDYLYEQNYQRMSGAEFRPGIED

SEQ ID NO: 23353 - DNA, 1599 bp, Rattus norvegicus (Norway rat)
  CDS (118)..(1179)
cgaactctcactgatatcagagcagacctgacttcacacagtggtacgaatgccatctcacagtgaaaggaaacccattgagacatgacactgagtaggcgcttaggaggcccagaaatgcctttggtgtgtttggcagactttaaggcacatgcgcaaaagcagctgtctaagacctcctgggactttattgaaggagaagctgacgacggcatcacctacagtgagaacatagcagcatttaaaagaatccgcctccgcccccgatacctgagagatatgtcaaaggtggacaccaggaccacaatccaagggcaggagatcagtgctcccatctgcatctcacccacagcctttcactccattgcctggccggatggagaaaagagcacagctagagctgctcaggaggccaacatctgctatgtcatcagcagttatgccagctattccctggaagatattgttgctgctgcccccgaaggctttcgttggttccaactctacatgaagtcagactgggacttcaacaagcagatggttcagagggcagaagccttgggtttcaaagctttggtgatcactatagatacgcctgtacttggcaataggcgacgggacaagagaaaccagctgaatttggaggcaaacatattgttgaaggatctccgagccctcaaagaggaaaagcccacacagtctgtccccgtgtcttttccgaaagcatctttctgctggaatgatctttccttgcttcagagtataactcggttgcccattatcctcaaagggattttgacgaaagaggatgcagagttagcaatgaagcacaacgtccaaggcatcgttgtttccaaccatggtgggaggcagcttgatgaggtttctgcttcaattgatgctctgagagaagtggtggctgctgtcaaagggaaaattgaagtgtacatggatggtggggttcgaactggcactgatgtgttgaaggcactggcccttggagctaggtgcatttttcttgggagaccaatcctttggggccttgcctgcaagggtgaagatggtgttaaggaagttttagatattctaacagcagaactccatagatgtatgaccctttcaggctgccagtcagttgctgagattagtccagacctgattcagttctccagattataaggacctactgagatccctacaagaggaagacaagacttcaacatagtgtgtgagcctattcttcttcggtccgatcatacctagtagtttgagccctctaccttgagaaatccagatggatgaagaaaagatagctaacagctaccagaggggtgcatttggatgaaggaataacatctaatgttctacaggataactataactgacaattaattgactatgtccaatagccatgttccagaaagaaaggaaatagttacatctggtgtgacatgccaattaccttcatttgattattatgtacactatacattattgaaacgtcatactgtgccataattatgtgcaattactatgtatcaattaaaacaacaatatatatttaaaaatgaaaaaaaaaaaaaaaaaaaaaaaaaaaaa

SEQ ID NO: 23354 - protein, 353 aa, Rattus norvegicus (Norway rat)
MPLVCLADFKAHAQKQLSKTSWDFIEGEADDGITYSENIAAFKRIRLRPRYLRDMSKVDTRTTIQGQEISAPICISPTAFHSIAWPDGEKSTARAAQEANICYVISSYASYSLEDIVAAAPEGFRWFQLYMKSDWDFNKQMVQRAEALGFKALVITIDTPVLGNRRRDKRNQLNLEANILLKDLRALKEEKPTQSVPVSFPKASFCWNDLSLLQSITRLPIILKGILTKEDAELAMKHNVQGIVVSNHGGRQLDEVSASIDALREVVAAVKGKIEVYMDGGVRTGTDVLKALALGARCIFLGRPILWGLACKGEDGVKEVLDILTAELHRCMTLSGCQSVAEISPDLIQFSRL

SEQ ID NO: 23355 - DNA, 1473 bp, Oryza sativa (rice)
  CDS (42)..(1151)
tgtcactcaagagcggtgcagggttcacaaggcaggagaaaatgggggagatcaccaatgtcatggagtaccaggccatcgcgaatcaaaaccttccgaaaatgatctacgactactactcctctggagctgaggatgattggactctcaaggaaaacagggaggccttctccgcgatcttgtttcgtccccgcatcctgatcgatgtctccaaaatcgacatgtccgcaactgttcttgggttcaagatatcaatgcccataatgattgctcccagtgccatgcagaagatggctcaccctgacggagagtatgcaacagccagggcagcttcagcagcaggaactataatgacactgtcatcttgggctacttcaagtgttgaggaggtcgcctcaactggaccaggaaatccgtttctccacctatacttgtgcaaggacaggaatgtggttgaacaccttgtcaaaaaaaccaaaagagctgggttcaaggcgatcgcactgaccgtggacgctccgcgactgggacgcagggaaactgacatcaagaacaggttcgttctgccgccatacttgacactgaagaaattcgaaggcctggacctccccgagatggacaagagcaacgattccgggctggcctcctacgtcgccgggcaaatcgatcgcgccctcacctggaaggatgtgaagtggctgcaaagcatcacgtcgctgccgatcctcgtcaagggcgtcatcaccgcggaagatgcgaagctggccgtgcactccggcgcggcggggatcatcgtgtcgaaccacggcgcgcggcagctggactacgtcccggcgaccatcagcgccctggaggaagtggtcacggcggcggcggggcgcatcccggtgtacctcgacggcggcgtccgccgcggcaccgacgtcttcaaggcgctcgccctcggcgccgccggcgtcttcatcgggaagccggtggtgttcgcgctggcggcggaggggaaggccggggtgaggaacctgctgcggatgatgcgggaggagttcgagctcaccatggcgttcagcggatgcacctcgctcgccgacatcacccgcgcccacatctacacggacgccgaacgcctcgcccgccccttccccaggttgtgaagacctccccgccgccgccgtcggcgaattctagccaaacaataaacaatatcgacgacgccagagagcacgccgattaattaattaggtaatttttgcaaaagaatcttgtcgatccacacgcgcgcaagcaacacacgtgctccgtgcacccctcgtaactgggtcgttcatgctcttaatcccaacgattaattatactggtataatctttgtaatttcgagtactgtacacctagttggcatctgtatatctcgccttaagatatttacggaaccggtttatatactcctttaatttttaaaaaaaaaaaaaaaaaaa

SEQ ID NO: 23356 - protein, 369 aa, Oryza sativa (rice)
MGEITNVMEYQAIANQNLPKMIYDYYSSGAEDDWTLKENREAFSAILFRPRILIDVSKIDMSATVLGFKISMPIMIAPSAMQKMAHPDGEYATARAASAAGTIMTLSSWATSSVEEVASTGPGNPFLHLYLCKDRNVVEHLVKKTKRAGFKAIALTVDAPRLGRRETDIKNRFVLPPYLTLKKFEGLDLPEMDKSNDSGLASYVAGQIDRALTWKDVKWLQSITSLPILVKGVITAEDAKLAVHSGAAGIIVSNHGARQLDYVPATISALEEVVTAAAGRIPVYLDGGVRRGTDVFKALALGAAGVFIGKPVVFALAAEGKAGVRNLLRMMREEFELTMAFSGCTSLADITRAHIYTDAERLARPFPRL

SEQ ID NO: 23357 - DNA, 1146 bp, Haemophilus influenzae
  CDS (1)..(1146)
atgattatttcatcagctagcgattatcgtgaagcggcgcgtcgccgtgttcctccctttatgttccattatgccgatggcggttcttatgccgagcaaacacttgcgcgtaatgtgagtgatttggaaaatattgctttaagacaacgtgtcttaaaagatatgtctgaattggatactagtatagaattatttggtgaaaaactttcaatgccaactattcttgcaccagttggggcgtgcggaatgtatgcgcgtcgtggagaagtacaagcagcacaagcggcggacaataaaggtgtgccgtttaccctttcaacagtatcaatttgtccaattgaagaagtcgcccctgcgattaagcgtccaatgtggtttcagctttatgtgttaaaagatcgtggttttatgaaaaacgcgcttgagcgtgcgaaagcagcaggctgttctactttagtgtttacggtcgatatgcctactccaggtgcacgttatcgtgatatgcactcaggtatgagcgggccttacaaagaaattcgccgtgtattacaaggctttacacacccattctgggcgtatgatgtgggtatcaaaggcaaaccgcacaccttgggtaatgtttcaacttatatgggtagacaaataggtttagatgactatattggctggctaacagaaaactttgatccatcaatttcgtggaaagatttagagtggatccgtgagttttgggaaggtccaatggtcattaaaggtattctcgaccctgaagatgcgaaagatgcggtgcgtttcggtgctgatggaattgttgtttcaaatcacggtggccgtcagttagatggcgtgctttcaagtgcaagagcgttgccaccaattgccgatgcagtgaaaggggatattaaaattattgccgattcaggtattcgcaatggtttagacatagtccgtatgttggcattaggggcagatgcaacaatgttaggtcgagcatttgtttatgctttaggggcagaaggtcgtcaaggtgttgaaaatatgctcgacattttcaaaaaagagatgcacgtagcgatgacattaaccagcaatcgtactattgccgatattaaaccagaggctttggttgatctaagtaaactttaa

SEQ ID NO: 23358 - protein, 381 aa, Haemophilus influenzae
MIISSASDYREAARRRVPPFMFHYADGGSYAEQTLARNVSDLENIALRQRVLKDMSELDTSIELFGEKLSMPTILAPVGACGMYARRGEVQAAQAADNKGVPFTLSTVSICPIEEVAPAIKRPMWFQLYVLKDRGFMKNALERAKAAGCSTLVFTVDMPTPGARYRDMHSGMSGPYKEIRRVLQGFTHPFWAYDVGIKGKPHTLGNVSTYMGRQIGLDDYIGWLTENFDPSISWKDLEWIREFWEGPMVIKGILDPEDAKDAVRFGADGIVVSNHGGRQLDGVLSSARALPPIADAVKGDIKIIADSGIRNGLDIVRMLALGADATMLGRAFVYALGAEGRQGVENMLDIFKKEMHVAMTLTSNRTIADIKPEALVDLSKL

SEQ ID NO: 23359 - DNA, 1381 bp, Cucurbita sp. (cucurbit)
  CDS (94)..(1197)
tcgctcttctttgttatctttaacccatcttcatcacttcgcttcatccattttcactgccgcatagaaggttgtgagtactctgtttgaaagatggagattaccaatgtcactgagtatgaggctattgcaaaggagaagttgccaaagatggtatatgactactacgcatctggtgctgaagaccagtgggccctgaaggagaaccgcaatgccttttccaggattttattccgtccccgtattcttatcgacgtaagtaagatagacatgtctacgactgtgctgggattcaaaatttcaatgcctattatgattgctccaactgccatgcaaaagatggctcaccctgaaggggagtatgcaaccgcccgagcagcatctgcagcaggcactaccacgaccctttcctcgtgggctacctctagtgtggaagaagttgcctccactggacctggcattcgtttcttccagctatatgtgtacaaggatagaaacgtggtggcgcaacttgtgagaagagctgaaaaagctggattcaaagccattgccctgactgtggacactccaaggcttggtcgcagggaagctgatatcaagaacagatttactttgccaccatttttgacattgaagaactttgagggattggatcttggtaaaatggaccaggcagacgactctggacttgcctcatatgttgcggggcagatcgaccgtactctcagctggcaggatgtgaagtggctgcagaccatcaccaagttgccaattctagtgaagggtgtacttactgctgaggacacaaggatcgccgttcaaagtggagctgctggaattattgtttcaaatcatggagctcgccaactcgactatgtccctgcaaccatcatggctttagaagaggttgtcaaagctgctagaggcgaagttcctgttttcttggacggcggtgttcgacgtggaacagacgttttcaaagcattagcactcggcgcatctggcatatttattgggaggccagtggtgttctctttggcagcagagggcgaggctggtgtgaggaaagttcttcagatgttgcgtgacgagtttgagctgataatggcgttgagcgggtgccgctcacttcaggagatcacacgcaaccacattgtagccgactgggacactcctcgtgttgtaccgaggctatgagagatggttgtgttgtgtatgcaagcaaggaacagcaattggcagtgttgaattcttggggttctgatactatagcatatgaacgatgctctgttatgataagcatatgtgatgtcttcttgaatgggatattacattcatcctatattgtttctgttgccaataatggaaaaaaggtattttg

SEQ ID NO: 23360 - protein, 367 aa, Cucurbita sp. (cucurbit)
MEITNVTEYEAIAKEKLPKMVYDYYASGAEDQWALKENRNAFSRILFRPRILIDVSKIDMSTTVLGFKISMPIMIAPTAMQKMAHPEGEYATARAASAAGTTTTLSSWATSSVEEVASTGPGIRFFQLYVYKDRNVVAQLVRRAEKAGFKAIALTVDTPRLGRREADIKNRFTLPPFLTLKNFEGLDLGKMDQADDSGLASYVAGQIDRTLSWQDVKWLQTITKLPILVKGVLTAEDTRIAVQSGAAGIIVSNHGARQLDYVPATIMALEEVVKAARGEVPVFLDGGVRRGTDVFKALALGASGIFIGRPVVFSLAAEGEAGVRKVLQMLRDEFELIMALSGCRSLQEITRNHIVADWDTPRVVPRL

SEQ ID NO: 23361 - DNA, 1074 bp, Amycolatopsis orientalis
  CDS (1)..(1074)
atgacgtacgtttccctggccgacctcgaacgtgccgcccgggatgtcctgcccggcgagatcttcgactttctcgctgggggtagcggcaccgaggcgtctctggtggccaaccgcaccgcgctggagcgggtcttcgtgatcccccggatgctgcgtgacctgacggacgtcaccaccgagatcgacatcttcggccggcgcgccgcgctgccgatggcggtcgcaccggtcgcgtaccagcggttgttccatccggagggcgagctcgcagtggctcgcgcggccagggacgccggcgtgccgtacaccatctgcacgctgagcagcgtttcgctggaggagatcgcggccgtcggcggccggccgtggttccagctgtactggctgcgggatgagaagcggtctctggaccttgtccgccgcgcggaggacgcaggctgcgaggcgatcgtgttcaccgtcgacgtgccgtggatgggcaggcggttgcgggacatgcgcaacggcttcgcgttgccggagtgggtgacggcggccaacttcgacgccggaacggccgcacaccgccgtacccaaggggtttcggccgtcgccgaccacaccgcgcgcgaattcgccccggccacatgggaatccgtggaggcggtccgcgcgcacacggaccttccagtggtgctcaaggggatcctcgcggtcgaggacgcccgtcgcgccgtcgacgcgggtgcaggcggaatcgtggtgtccaaccacggaggtcgtcagttggacggtgccgtgcccggaatcgagatgctgggcgagatcgtcgccgcggtctccggcggctgcgaggtgttggtggacgggggaatccgcagtggcggggacgtcctcaaggcgaccgctctcggtgcgtcggccgtgctggtcgggcggccggtgatgtgggcgctggccgcggcaggccaggacggcgttcggcagctgctcgaactgctcgccgaagaagttcgcgacgcgatgggcctggcgggttgcgagtcggtgggcgcggctcgccggctgaacacgaaactgggggttgtttga

SEQ ID NO: 23362 - protein, 357 aa, Amycolatopsis orientalis
MTYVSLADLERAARDVLPGEIFDFLAGGSGTEASLVANRTALERVFVIPRMLRDLTDVTTEIDIFGRRAALPMAVAPVAYQRLFHPEGELAVARAARDAGVPYTICTLSSVSLEEIAAVGGRPWFQLYWLRDEKRSLDLVRRAEDAGCEAIVFTVDVPWMGRRLRDMRNGFALPEWVTAANFDAGTAAHRRTQGVSAVADHTAREFAPATWESVEAVRAHTDLPVVLKGILAVEDARRAVDAGAGGIVVSNHGGRQLDGAVPGIEMLGEIVAAVSGGCEVLVDGGIRSGGDVLKATALGASAVLVGRPVMWALAAAGQDGVRQLLELLAEEVRDAMGLAGCESVGAARRLNTKLGVV

SEQ ID NO: 23363 - DNA, 1134 bp, Streptomyces coelicolor
  CDS (1)..(1134)
atgcgggagccgctcacgctcgacgacttcgcacgactcgcacgcgggcaactgcctgccgccacctgggacttcattgcgggcggcgcggggcgggagcggaccctcgccgccaacgaggccgtcttcggagccgtacggctgcggcccagggcactgcccggcatcgaggagccggacacctccgtggaggtgctcggctcccggtggccggcgcccgtgggcatcgcgccggtggcctaccacgggctcgcccaccccgacggcgaaccggcgaccgccgcggcggcgggcgcgctcggactcccgctcgtcgtcagcaccttcgccggccggagcctcgaagaggtggcccgcgcggcgagcgcaccgctgtggctccagctgtactgcttccgcgaccacgagaccaccctgggcctggcccgcagggcccgcgacagcggctaccaggcgctggtgctcaccgtcgacaccccgttcaccggccgccggctgcgcgacctgcgcaacggcttcgcggtccccgcccacatcaccccggccaacctgaccggcacggcggcggccggcagcgccacccccggcgcgcacagcaggctggccttcgaccgccgcctggactggtccttcgtggcccgcctgggcgcggcgagcggcctgccggtgctggccaagggcgtgctgaccgcgccggacgccgaggccgcggtcgcggcgggcgtcgcgggcatcgtcgtctccaaccacgggggccgccaactcgacggcgcaccggccaccctggaggcgctgcccgaggtggtgtccgccgtgcgcggacgctgcccggtcctcctcgacggcggcgtccgcaccggcgccgacgtcctcgccgccctggccctcggtgcccgtgccgtcctggtcgggcgccccgcgctgtacgcgctggcggtcggcggcgcctcgggcgtgcgccggatgctcaccctgctgaccgaggacttcgcggacacgatggtgctcaccggccacgccgccaccggcacgatcggcccggacaccctggccccgccgcaccacgccccgccgcaccacgggccgcccaccgcgccccgcccggcgccgcaccgagacaggagccacggatga

SEQ ID NO: 23364 - protein, 377 aa, Streptomyces coelicolor
MREPLTLDDFARLARGQLPAATWDFIAGGAGRERTLAANEAVFGAVRLRPRALPGIEEPDTSVEVLGSRWPAPVGIAPVAYHGLAHPDGEPATAAAAGALGLPLVVSTFAGRSLEEVARAASAPLWLQLYCFRDHETTLGLARRARDSGYQALVLTVDTPFTGRRLRDLRNGFAVPAHITPANLTGTAAAGSATPGAHSRLAFDRRLDWSFVARLGAASGLPVLAKGVLTAPDAEAAVAAGVAGIVVSNHGGRQLDGAPATLEALPEVVSAVRGRCPVLLDGGVRTGADVLAALALGARAVLVGRPALYALAVGGASGVRRMLTLLTEDFADTMVLTGHAATGTIGPDTLAPPHHAPPHHGPPTAPRPAPHRDRSHG

SEQ ID NO: 23365 - DNA, 1227 bp, Nocardia uniformis
  CDS (50)..(1180)
ccccgcgcgtggggaggcggcgtgcccgacggacaggaggcaacgagccatgggcgtccgcaactccgcagggggcggcgcggaagaccccgaggacctggctgaggtggaacgggccgccgccgcccggctgccgggggacgtgcgcgacttcatcgcgggcggcagcggcgacgaggtgacgctggccgccaaccgcgcggcgctcgacgacgtggccctgctccccagggtgctcgcgggtgtccaggcggccgacacgagcacctcgctcgtgggcacggcggccacgctgcccgtcgccgtggcgccgatgggctaccagtgcctcgtccaccccgacggcgaggtcgcggctgccgccgcggcgggcgccgccggcgtccccttcaccgtcggcacgctgagcagccggtcggtcgaggagatcgccgagaccggcgcgtcgctgtggttccagctctactggctgcgcgatcgcggcctggtcgccgaactcgtggcgcgggccgaggcggcgggctgccgggcgctggtgatcaccgtggacgtgccggtgatgggccgcaggctccgggacgtgcgcaacgggatcaccctgccccggaccgtccgggccgtccacctcgccgacggcccgtcatccgcgcacgagccgcgccaggtcggctccggcgtcgcccagcacacgagcgcggtcttcgaccccgcgttcgggtggcgcgacctggagtggctgcgggcgcgcaccaggctccccctggtggtcaagggcgtgctcgacccgcgcgacgccaccaggtgcgtcgagctgggcgcctcggcggtggtggtgtccaaccacggcgggcggcagctcgacggcgcggcgcccagcgcggtggccctgccgcgcgtcgtcgacgcggtggcgggcgcggccgaggtgctgttcgacagcggcgtccgcggcggcgtcgacgtgctgcgcgccctcgcgctcggcgcgaccggcgtgctgctcggccgcccaatcctgtgggggctcgcggtcggcggcgagcgcggcgcggcgcgggtgctggaactgctgcgcaccgagttcgcgcaggccctgctgctcgccgggtgcgccgacgtcgacgcggccaggggactcgcgaccgcgcaggccgcgccgacccggcgaggtgcgccctgaccgcctcggggaccgcgatcggggccggggcgcggggtcaggggaag

SEQ ID NO: 23366 - protein, 376 aa, Nocardia uniformis
MGVRNSAGGGAEDPEDLAEVERAAAARLPGDVRDFIAGGSGDEVTLAANRAALDDVALLPRVLAGVQAADTSTSLVGTAATLPVAVAPMGYQCLVHPDGEVAAAAAAGAAGVPFTVGTLSSRSVEEIAETGASLWFQLYWLRDRGLVAELVARAEAAGCRALVITVDVPVMGRRLRDVRNGITLPRTVRAVHLADGPSSAHEPRQVGSGVAQHTSAVFDPAFGWRDLEWLRARTRLPLVVKGVLDPRDATRCVELGASAVVVSNHGGRQLDGAAPSAVALPRVVDAVAGAAEVLFDSGVRGGVDVLRALALGATGVLLGRPILWGLAVGGERGAARVLELLRTEFAQALLLAGCADVDAARGLATAQAAPTRRGAP

SEQ ID NO: 23367 - DNA, 1698 bp, Rhodotorula graminis
  CDS (1)..(1698)
atgtcatttgcacgcgtgcgcacagctctacgctgccagagagcggcagcttcgcccgcgccgccaaaggtgcaggcgcgccgcttcgcaaacaaagcagcaccgcacgccagcgcgtcgagcgcaggcagccgagccttccatctcggtcttgcagcaggcgctgccctggccgtcggtggagccggactctacctcttctctcgctctccagtccttctcgatgctcagctgccggtcaagcaacgcgggcgagcccgcagtatctcggctgccgaggttgcgaagcacaattcgcgcgactcgatgtgggtctgcatcgacgatgaggtctgggatatcaccaactttgtcgagcttcaccctggaggcgccaaagtgctcgagcagaatgctggcaaggatgtgaccaaggtcttcaagtcgatccacccgccgaaaacgctcgaaaagttcttgacggatgataatttcgtcggacggattgacgtcgacgaggtgaccaagattggcggcggcaagaatgcagaagacttgcgcattgagcaggcgcggaaggagctcaggaacgtcgagacggttgtctgcctggacgagttcgaggagatctcgcagaagatcttgtccgagatggcgatggcatactacggaacaggagccgaaacggagcagacgttgcgcgacgaacgcgaggcgtggcaaagggtccgcttccgtccgcgggtcctgcgcaagatgcgacacatcgacaccaacaccaccttcctcggcattcccactcccctccccatctttgttgctcccgccggcctcgctcgtctcggccaccccgacggcgagcaaaatatcgttcgcggcgtcgccaagcacgacatcttgcaagtcgtgtcatcgggcgcaagttgctcgatcgacgagatcttcgaggtgaaggagccagaccagaacctggcgtggcagttctacgtccattcggacaagaagatcgcggaggagaagctgaagagggctctcgcgctgggcgccaaggccatcttcgtcacggtggacgtgcccgtcctgggcaagcgcgagcgcgatctcaagctcaaggcgcgcagccagaactacgagcatccgatcgcagcgcaatggaaagcggcaggaagcaaggtagaggagaccattgccaaacgtggagtgtccgacattcccgacactgctcacatagacgccaacttgaactgggatgacatcgcttggatcaaggagcgcgctccgggcgtacctatcgtcatcaagggtgtcggatgtgttgaggacgtcgaactggcgaagcaatatggggcggacggcgttgtcttgtccacgcacggcgcacggcagcttgatggcgctcgtgcacctctcgatgtgctcattgaggtccggcgcaagaacccggctcttctcaaggaaatagaagtctacgttgacggacaagcccgccgtggaaccgacgtgctcaaggcactgtgcctcggcgcccgcggcgtcggcttcggccgaggattcctctacgcccagtcggcgtacggagcagatggcgttgacaaggcgatccgcatccttgagaacgagattcagaacgcaatgcgcctcctcggcgccaacacgttggcagatcttaagccggaaatggtcgagtgcagcttcccggagcggtgggtgcccgagtag

SEQ ID NO: 23368 - protein, 565 aa, Rhodotorula graminis
MSFARVRTALRCQRAAASPAPPKVQARRFANKAAPHASASSAGSRAFHLGLAAGAALAVGGAGLYLFSRSPVLLDAQLPVKQRGRARSISAAEVAKHNSRDSMWVCIDDEVWDITNFVELHPGGAKVLEQNAGKDVTKVFKSIHPPKTLEKFLTDDNFVGRIDVDEVTKIGGGKNAEDLRIEQARKELRNVETVVCLDEFEEISQKILSEMAMAYYGTGAETEQTLRDEREAWQRVRFRPRVLRKMRHIDTNTTFLGIPTPLPIFVAPAGLARLGHPDGEQNIVRGVAKHDILQVVSSGASCSIDEIFEVKEPDQNLAWQFYVHSDKKIAEEKLKRALALGAKAIFVTVDVPVLGKRERDLKLKARSQNYEHPIAAQWKAAGSKVEETIAKRGVSDIPDTAHIDANLNWDDIAWIKERAPGVPIVIKGVGCVEDVELAKQYGADGVVLSTHGARQLDGARAPLDVLIEVRRKNPALLKEIEVYVDGQARRGTDVLKALCLGARGVGFGRGFLYAQSAYGADGVDKAIRILENEIQNAMRLLGANTLADLKPEMVECSFPERWVPE

SEQ ID NO: 23369 - DNA, 1212 bp, Streptococcus iniae
  CDS (1)..(1212)
atggaaaataaatcagaaatgataaatgcgactactatagagttcaaaacaagcagtgctgaaggcagcgttgattttgtaaatgtctttgaccttgaaaaaatggctcaaaaagttattcctaaaggggcctttggttatatagcaagtggtgctggagataccttcaccttacatgaaaatattcgttcatttaatcataaattgattcctcacggattaaaaggcgtggaaaatccaagtactgaaataacttttattggcgataaattagcgtcaccaattattttagcacctgtcgcggcgcacaaattagccaatgagcaaggggaaatcgcaagtgccaaaggtgttaaagaatttggaacaatctatacaaccagttcttattcaacaactgatttacctgaaatttcacaaacacttggtgattcaccacattggttccaattctattatagtaaagatgatggtattaacagacacatcatggaccgtttgaaagctgaaggggtaaaatcaattgttctaacagttgatgcgacagttggtggaaaccgtgaagttgataagcgtaatggctttgttttccctgttggaatgccaattgttcaagagtatctcccaaatggggcaggaaaaacaatggactatgtttataaagctactaaacaagccctatcaccaaaagatgttgaatacattgcacaatattcaggcttgcctgtatatgttaaagggccacaatgtgcagaagatgcctttcgtgctttagaagctggagcttcaggaatttgggtaacgaatcatggtggccgtcaattagatggtggtccagcagcctttgattctctccaagaagttgctgaatctgttgatcgccgtgtaccaattgtctttgattctggtgtgagacgcggacaacatgtctttaaagccttagcatctggtgcagatcttgtagcacttggccgtcctgttatttacggcttagcaatgggtggtagcgtaggaacacgtcaagtctttgaaaaaattaatgatgaacttaaaatggttatgcaattagctggtacacaaaccatcgacgatgttaaacattttaaattgcgtcataacccatatgattcttccattccatttagcccaaaatgctttaaaattagattaatctttagacggcccaatcagatattagggcagtttttttaa

SEQ ID NO: 23370 - protein, 403 aa, Streptococcus iniae
MENKSEMINATTIEFKTSSAEGSVDFVNVFDLEKMAQKVIPKGAFGYIASGAGDTFTLHENIRSFNHKLIPHGLKGVENPSTEITFIGDKLASPIILAPVAAHKLANEQGEIASAKGVKEFGTIYTTSSYSTTDLPEISQTLGDSPHWFQFYYSKDDGINRHIMDRLKAEGVKSIVLTVDATVGGNREVDKRNGFVFPVGMPIVQEYLPNGAGKTMDYVYKATKQALSPKDVEYIAQYSGLPVYVKGPQCAEDAFRALEAGASGIWVTNHGGRQLDGGPAAFDSLQEVAESVDRRVPIVFDSGVRRGQHVFKALASGADLVALGRPVIYGLAMGGSVGTRQVFEKINDELKMVMQLAGTQTIDDVKHFKLRHNPYDSSIPFSPKCFKIRLIFRRPNQILGQFF

SEQ ID NO: 23371 - DNA, 1409 bp, Mesembryanthemum crystallinum
  CDS (68)..(1180)
actagcttcccagaaaacttggcagcccaaaagtagaaaaaagggggcactatccatttaggtgaagatggagataaccaatgtgaacgagtatgaggccattgcaaagcagaagttgcctaagatggtgtatgactactatgcatcaggtgcagaggaccagtggactttggctgagaaccgaaacgccttctcaaggatcctgtttcgcccacgtattctgatcgatgtaaccaaaatcgacatgaccacaactgtattgggattcaagatttcaatgcctatcatgattgccccaactgctatgcagaagatggcacaccctgaaggagaatatgcaacagcaagagcagcatcagcagctggaaccatcatgacactgtcctcatgggctacatctagtgtggaagaggttgcttcaactggaccgggcatcagatttttccagctctatgtatacaaaaacaggaatgttgttgaacaacttgtgaggagagctgaaagggctggctttaaggccattgctcttactgttgacacacccagattgggacgtagagaagctgacattaagaataggttcactctaccccctttcctaacattgaagaactttgagggccttgaccttggcacaatggacaaagcagatgactctggccttgcctcatatgttgctggtcaaattgatcggtctctgagctggaaggatgtgaagtggctacaaacaatcactagcctccccattcttgtgaagggtgtacttactgccgaggatgcgagactgtctgttcaaaatggagcagctggtattattgtatccaaccatggagctcgccaacttgattatgtaccttccactataatggctctcgaagaggttgtcaaagcaacacaaggtcgtatccctgtgttcttggatggtggtgtccgccgtggaactgatgttttcaaagcattggcactcggagcttctggaatatttattggaagacccgtagtgttctccttggctgcagaaggagaggctggtgttaggaaggtcctccagatgatgcgtgatgagtttgagctgaccatggcactaagtggttgccgttcaatccaagaaatcagccgtaaccatattgttgctgactgggattctgctggctcttctcgcattgcaccaaggttataagagtaatgtatacacaccatggaagctgcattttgagcaacaaaaatcgaaccaataatattcttaagcttttatatactaaagcgcatgcctttgattgatgaactttcatttttgatttgcaactatcaatggatgcttatgtacttttgaatggctactctgccttccctgtatattatttttttcccttttaaattttattaatatagctctatattttcctgcc

SEQ ID NO: 23372 - protein, 370 aa, Mesembryanthemum crystallinum
MEITNVNEYEAIAKQKLPKMVYDYYASGAEDQWTLAENRNAFSRILFRPRILIDVTKIDMTTTVLGFKISMPIMIAPTAMQKMAHPEGEYATARAASAAGTIMTLSSWATSSVEEVASTGPGIRFFQLYVYKNRNVVEQLVRRAERAGFKAIALTVDTPRLGRREADIKNRFTLPPFLTLKNFEGLDLGTMDKADDSGLASYVAGQIDRSLSWKDVKWLQTITSLPILVKGVLTAEDARLSVQNGAAGIIVSNHGARQLDYVPSTIMALEEVVKATQGRIPVFLDGGVRRGTDVFKALALGASGIFIGRPVVFSLAAEGEAGVRKVLQMMRDEFELTMALSGCRSIQEISRNHIVADWDSAGSSRIAPRL

SEQ ID NO: 23373 - DNA, 1062 bp, Desulfotalea psychrophila
  CDS (1)..(1062)
atggaaattattcgttcatcacctatccgcagcatatacagaggaaaaaaaatgaaagaagtcagagatagggctagaaagctcatgggaaaacagtgccgggtatgccctgcctgtaatggtagagcatgtgcaggtgaagtgccgggcatgggcgggctggggacaggatcgtctttcaagagtaatttcgaagccctggccgaggtaaaatttaatatgcgcctcctccacgatgtggtggagcccgataccagcgttaccatactcggcagaaaaatggccctgcccgtacttgcggcccccatcggcggcatctcctataatatgggcggagcaatctcagaaaaagattatgttcgagcaattgtcaacggttgccgggcaaaatcaattatcggctgtaccggcgacggggtaccggaggtcatccaccaggaaggttttgcggctatcaaggctgcggacggcgaggccattccatttataaagccctgggatgatgaagagctcttggcaaagctcgccggggccaaggccaccggctgcctggccatcggcatggacattgatgcggccggtcttatcaccctccgcctgcagggacgacctgtttctgccaagactccggcaaagcttgctgagatcatcaagagcacgggaatgaaattcgtcctcaagggagtaatgactgcggacgaggccgaacttgccctcgaggcaggttgcgaggccattgtcgtctccgatcatggcggtcgggtactggatcacacccccggtaccgccgaggtactgcctgaaatagcagaacgggttaagggcagaatgaccatctttgtcgatggtggagtccgtaccggtggagatgtcctcaaaatgctcgccctcggggccgatgcggtaatgatcggcagaccattttctgtcgctgccgtcggtggcctgcaagcaggtgtagaaaagtatatcgaccagctgagtaccgaactcaaacaggccatgaccctcaccggaacagcagctgccgcaagtgtctcgccaaacatcattcgcagatag

SEQ ID NO: 23374 - protein, 353 aa, Desulfotalea psychrophila
MEIIRSSPIRSIYRGKKMKEVRDRARKLMGKQCRVCPACNGRACAGEVPGMGGLGTGSSFKSNFEALAEVKFNMRLLHDVVEPDTSVTILGRKMALPVLAAPIGGISYNMGGAISEKDYVRAIVNGCRAKSIIGCTGDGVPEVIHQEGFAAIKAADGEAIPFIKPWDDEELLAKLAGAKATGCLAIGMDIDAAGLITLRLQGRPVSAKTPAKLAEIIKSTGMKFVLKGVMTADEAELALEAGCEAIVVSDHGGRVLDHTPGTAEVLPEIAERVKGRMTIFVDGGVRTGGDVLKMLALGADAVMIGRPFSVAAVGGLQAGVEKYIDQLSTELKQAMTLTGTAAAASVSPNIIRR

SEQ ID NO: 23375 - DNA, 1677 bp, Debaryomyces hansenii CBS767
  CDS (1)..(1677)
atgattggattccgttctactctccttaagcacaaacccattggtagacttagttatagactgagacttcgtttcagcactagagcgttgaaatcaccgtttaatggggaacggaaaataaagtccggggtatgggtacctagcatcattttattaggtacgattacagccttcatttccaaggatgataacattgcattggattcgaaacagacacagggtgtcacagttgaagaattgaggaagcataattcggcttctgagggtatttgggtcgcacttaatggccaagtttacgatttgactgatttcttggtacaacacccaggaggtgctgatattatcacgcactatgcgggttgtgatgctagtcttattttcaataagttccatgctaaggatgtgtttagcaaatatttatcgccagaaaattatcttggtccattaataggagaaatggagaaagcagccgatattaccgaagataacgacgaagataggcttgagagaatagaaaacaaacctcctttggctgcgatgttcaatttatccgattttgaatatgtagctaaggcaatacttccaaaaagtgcttggtcgtattactcgggaggttctgatgatgaggtaactatgagggaaaataataatgcattccttaggattttttttaatccaaaagtcttaattgatactgctgatattgatatgtcgactgagatgttaggcacgaagacagacgctcctttttattgttctgctgctgctgctgcaaaacttggtcaccctgatggtgaattatcgatcgccgatggatgcggatcggagaatattatccagatgatttcaagtgctgcatcctattctttcgatgagattagtgactttgcaaaaaaaagcacttcccaatggtttcagttatatgtgcataaggacaggactctgagttacgagatgattgacgcttgtgagaaaaagggaattaaggctatatttgtgactgttgacactcccttgtttggacgtagagaaaaggacttgaggtttaaagtaggacagacagatgatgacgagagtgacgaaacttccggtggcggtgacgattttattctttcgtatagagatgctgggttatgttgggatgatattgacaaattcaagaaagcaactaacttgcctatcgttatcaaaggtgtccagagagtggaggatgtgttacttgcgatagaacataaagtagacggagtggtattgtccaaccatggtggtagacaacttgattttgcaagagctccaattgaggttttggctgacgttatgccagttttaagagaaaagaagttagaaaacgaaattgaaatttatgtcgacggggggattagaagaggaagtgatgtaattaaggctttatgtttaggtgcaaagggtgttggactcggaagatcgtttttgtacgcaaatagtgcctatgggaagaagggagtagtcaaagcctgtgaattgttgaaggacgaaatagctagagacatgaaattacttggggtttccaaacttgaagatttaaagcccgaattattggatttgagaagcttatattctagaccaatataccaatctgttgtgggttcaaactatgaaccattgtaccttccaaagtttaaaaatgaagatgattaa

SEQ ID NO: 23376 - protein, 558 aa, Debaryomyces hansenii CBS767
MIGFRSTLLKHKPIGRLSYRLRLRFSTRALKSPFNGERKIKSGVWVPSIILLGTITAFISKDDNIALDSKQTQGVTVEELRKHNSASEGIWVALNGQVYDLTDFLVQHPGGADIITHYAGCDASLIFNKFHAKDVFSKYLSPENYLGPLIGEMEKAADITEDNDEDRLERIENKPPLAAMFNLSDFEYVAKAILPKSAWSYYSGGSDDEVTMRENNNAFLRIFFNPKVLIDTADIDMSTEMLGTKTDAPFYCSAAAAAKLGHPDGELSIADGCGSENIIQMISSAASYSFDEISDFAKKSTSQWFQLYVHKDRTLSYEMIDACEKKGIKAIFVTVDTPLFGRREKDLRFKVGQTDDDESDETSGGGDDFILSYRDAGLCWDDIDKFKKATNLPIVIKGVQRVEDVLLAIEHKVDGVVLSNHGGRQLDFARAPIEVLADVMPVLREKKLENEIEIYVDGGIRRGSDVIKALCLGAKGVGLGRSFLYANSAYGKKGVVKACELLKDEIARDMKLLGVSKLEDLKPELLDLRSLYSRPIYQSVVGSNYEPLYLPKFKNEDD

SEQ ID NO: 23377 - DNA, 1137 bp, Debaryomyces hansenii CBS767
  CDS (1)..(1137)
atgaatcgtgctgttacttatgacgataaagtccattgcattgctgatcttgaacttgaagcaaataaaaagcttcctccaatggttcgtgatttttatggtggaggttccatggatcttaataccgttcgagaaaacaaatctgcttatgatcgttacagtttaagaccaagagtaatggtagatgttaccgaggtggatacaagtactacttgtttgggatctaatgttgcatttccattagggttttctccatctgctaatcatggactagctcatcctgatgccgaacgtggtacgtccagagcagctgctaagaagaagattaatatggcactttcaagttggaccaatacttctccaaaagttgtcgcggaacaaggtaaggatgctggtatctcatatgcccatcaattgagtgctgttaaagaccaagatgtaactatgtccattattcgtaatgcagaagcttgtgggtataaggctattttcttgagtgttgactgtccattgttaggaagaagactaaatgaaatgaaaaatacctttactttaccttcgaattgtaaattcccatgttatccgtttatcaaagggggtgacatggtgagcagtgatgatcgtactcaatatgaaactacgctcacctggtcttatattaaagaattaaagaagaagaccaatatggaaatttggttaaaagggatcctcactggtgaagatgctgaaatggccgttaatgctggagcagatggtattattgtatcgaatcacggtggaagacagcttgacggtgccttgtccacgttggatgcattacctgatgttgttgcggcagttaatggtagaatcccagttcacattgatgggggcattagaagaggaagtgatattttcaaagctcttgccttaggcgctgaccattgctgggttggccgtgttgccgtttgggggcttgcttataaaggagaagaaggtgtttctattgcattaaatattttgcatgatgaattccgtttagttatggcattaatgggttgcacttctgtcaaagacatcaagccagaacacctcgctaggatgtcttccgatggaagattccacaaggttacacgtatagcggaagctaagttatag

SEQ ID NO: 23378 - protein, 378 aa, Debaryomyces hansenii CBS767
MNRAVTYDDKVHCIADLELEANKKLPPMVRDFYGGGSMDLNTVRENKSAYDRYSLRPRVMVDVTEVDTSTTCLGSNVAFPLGFSPSANHGLAHPDAERGTSRAAAKKKINMALSSWTNTSPKVVAEQGKDAGISYAHQLSAVKDQDVTMSIIRNAEACGYKAIFLSVDCPLLGRRLNEMKNTFTLPSNCKFPCYPFIKGGDMVSSDDRTQYETTLTWSYIKELKKKTNMEIWLKGILTGEDAEMAVNAGADGIIVSNHGGRQLDGALSTLDALPDVVAAVNGRIPVHIDGGIRRGSDIFKALALGADHCWVGRVAVWGLAYKGEEGVSIALNILHDEFRLVMALMGCTSVKDIKPEHLARMSSDGRFHKVTRIAEAKL

SEQ ID NO: 23379 - DNA, 1482 bp, Yarrowia lipolytica CLIB99
  CDS (1)..(1482)
atggtttccgtcgaagaagtcgctaaacacaactccaaggactcttgctgggtcattttgcatggaaaggcctatgatctgaccgagttcctgcctgagcatcctggaggacaggctatcattctcaagtacgctggaaaggacgccaccaaggcttttgacccaatccaccctcgtgatgtggtcgataagttcttggataaggacaagcacctgggagaggtgactggagagattgccgccgaagaagaagaggaagtcactccagaggaaaaggcgcgtcttgagcggtacgagaaccgtcctcccctcagccagatcttcaactcgttcgattttgagtacgtggctagacacaccatgtctcccaacgcatgggcgtactactcttctggatccgatgacgagatcactgtcagagaaaaccacagagccttccacaaaatctggttccgaccacgagtgctggtagatgtcaaaaacgtggacatttccaccaccatgctgggcacaaagtcatccgtaccgttttacatcaccgctacagctctaggtaaattgggccatcccgagggagaagtggtgctcacacgtggagccgacaagatggatgtcattcagatgatccccactctggcctcgtgctcgttcgacgagattgtggacgccgccacagacaaacagactcagtggatgcagctgtacgtgaacatggatcgagaggtgaccaaaaagattgtgcagcacgccgaaaagcggggagtcaagggtctgttcatcactgtggacgctcctcagcttggacgacgagaaaaggacatgcgaaccaaattcggagatcctggagctcaagttcagcagtccgacgactctgtggaccgatctcagggagctgctcgagccatttcctcgttcatcgacccctctctgtcgtggaaggacatcccctggttccagagcatcaccaagatgcccatcattctcaagggtgttcagtgtgctgaagatgcgctcaaggctgtggaatacaaggtggacggtatcctgctgtctaaccatggaggtcgacagctggagtttgcccggccctcaatcgaggtgctggtcgaagtcatggctgctctgagggcaaagggatggcaggattacatcgaggtgtacattgacggaggtataagacgagccactgacgttatcaaggctctgtgtctgggtgccaaaggagtgggtattggacggcctttcctgtatgctatgagcacatatggagaggatggcgtgtgccatctgatccagctgctcaaggatgagatggaaatgaacatgcgtctgattggagccaccaagattgaggatctcaaccccagcatggttgacctcaagagcatcttcacccactcggcagacaccgctcgggacattctgggagagaatgtttaccaacatatggagatgcctcttttcaagggcagcaagctgtag

SEQ ID NO: 23380 - protein, 493 aa, Yarrowia lipolytica CLIB99
MVSVEEVAKHNSKDSCWVILHGKAYDLTEFLPEHPGGQAIILKYAGKDATKAFDPIHPRDVVDKFLDKDKHLGEVTGEIAAEEEEEVTPEEKARLERYENRPPLSQIFNSFDFEYVARHTMSPNAWAYYSSGSDDEITVRENHRAFHKIWFRPRVLVDVKNVDISTTMLGTKSSVPFYITATALGKLGHPEGEVVLTRGADKMDVIQMIPTLASCSFDEIVDAATDKQTQWMQLYVNMDREVTKKIVQHAEKRGVKGLFITVDAPQLGRREKDMRTKFGDPGAQVQQSDDSVDRSQGAARAISSFIDPSLSWKDIPWFQSITKMPIILKGVQCAEDALKAVEYKVDGILLSNHGGRQLEFARPSIEVLVEVMAALRAKGWQDYIEVYIDGGIRRATDVIKALCLGAKGVGIGRPFLYAMSTYGEDGVCHLIQLLKDEMEMNMRLIGATKIEDLNPSMVDLKSIFTHSADTARDILGENVYQHMEMPLFKGSKL

SEQ ID NO: 23381 - DNA, 1149 bp, Yarrowia lipolytica CLIB99
  CDS (1)..(1149)
atgcctatcacccagaagattctgtcgctcagcgatctggaggccgcggccatgccctacgccgaaaaggcgcctcgagactactgggaaaccggatccaacgatctgctgactctggcagagaaccaaaacgccttcaactacctcaagatccgggcccgagccatgcggggcgtcggcaccattgacatctcgcccaaggtggagctgtttggccgaaagttccgtgcccccatcggtgtggccccctcagcctaccaccagatggcggatgattccggcgagtgtggcacagctgcggcttgtcaggcccgaaactggcccatgggactttcctctttctccaacaagcctctggaggaagtccgagaggctggacctgatgcagctctcttcttccagctctacgtgttcaagaacaagaagacgtcagagaacctggtcaagaaggccgaaaaggccggcttcaaggccattgcgctgaccgtcgacactccctacctcggaaaccgatacgccgacgtgcgaaacaacttcaagctgccatcgcatctctctgcccgaaacttcgagggcaccaccgaccagcctattgacaacgccgccgaggccgactcgtgggcccgaaagatcttcaacggcgaggagtgtccccccgacgccaacgtggtcgaccccgatatcaactgggccgaaaccatcccttggctgcgatccatcaccaacatgcagatctgggtcaagggagtcgtgactgccgaggacacccatgccgccattgaggccggcgtggacggaatctgggtctccaaccacggtggccgacagctggactccggtctggccaccattgacgctctccccgaggtggtcgaggccgctgctggccgagtccccatccacattgacggaggcatccgacgaggaggagacgtgttcaaatgccttgctctgggcgccgatttcgtgtggctgggccgacctgccatctggggtctcaagtacgacggccaggccggcgtggagctcatggagcagatcatcgaggacgatcttaagctcaccatggctctggctggcaccaagaccgtggccgagatcaaccgaagctgtctggttcgaatcggacccgccatcgtcaagctttag

SEQ ID NO: 23382 - protein, 382 aa, Yarrowia lipolytica CLIB99
MPITQKILSLSDLEAAAMPYAEKAPRDYWETGSNDLLTLAENQNAFNYLKIRARAMRGVGTIDISPKVELFGRKFRAPIGVAPSAYHQMADDSGECGTAAACQARNWPMGLSSFSNKPLEEVREAGPDAALFFQLYVFKNKKTSENLVKKAEKAGFKAIALTVDTPYLGNRYADVRNNFKLPSHLSARNFEGTTDQPIDNAAEADSWARKIFNGEECPPDANVVDPDINWAETIPWLRSITNMQIWVKGVVTAEDTHAAIEAGVDGIWVSNHGGRQLDSGLATIDALPEVVEAAAGRVPIHIDGGIRRGGDVFKCLALGADFVWLGRPAIWGLKYDGQAGVELMEQIIEDDLKLTMALAGTKTVAEINRSCLVRIGPAIVKL

SEQ ID NO: 23383 - DNA, 1770 bp, Kluyveromyces lactis NRRL Y
  CDS (1)..(1770)
atgagatcagccgtaagagtttttggtaagaaccgtgttagtgggttgagatttgctagcaccagtagtaaatctccaattcataagtctagtgctactctgcgttttgggagatcagctaagtctggctatagtgcgttttcgttcggtaagaaagtcatcactggtggtgcctttcttgttgccggttcggttggtattgcattgatttctcaattcaatgatagcgttgaaaatggtgccaaggtcgatatgacgaaaccaaaggtttctccaacagaagtcgcaaagcactcttctcccaaagactgttgggtggtcattgagggttacgtatacaatttgactgatttcatcagcgcccatcctggtggtccagctatcattgagaacaacgcaggaaaagatgtgaccaagatctttgctccaattcatgctccagatgtcatcgaaaaatacattgctccagagaacagaattggtccactagatggtacaatgcctgatgacttggtctgtgctgcattgaccccaggtgaaactcccgaagatgtggcaagaaaggaacaattgcgtcaatctttacccgatattgattccttggttaacatctatgatttcgaattcttggcatcccaaatcttgactaagcaagcttggtcttactactcttctgccgctgatgatgaagttacacatagagaaaaccacgctgcataccatcgtatattcttcaagccaagaatcttggttaacgttaaggaagttgacacttccactacaatgttaggtgaaaaagtcggtgttccattttatgtgtctgccaccgcattgtgtaaactaggtaaccccaaggaaggtgaaaaggacatcgcaagaggttgcggtgaaagtgacgtgaaacctgttcaaatgatttccactttggcttcttgttctttacaagaaatcgtggaagcagccccatctaaggaacaaatccaatggttccaattgtatgtgaacagtgaccgtaagatcactgaagatctaatcaagaacgttgaaaaattaggattaaaggccattttcgttacagtagatgctccttccttaggtaacagagaaaaagatgctaaagtcaaatttacaaactcaaacggtgccaaggctatggaaaaaagtaaggttaaggaatctaagggtgcttctagagctctctcgtcattcattgatcctgcattaaactgggatgatatcatcgaatttaagaaaaagaccaaattgccaatcgtcatcaagggtgttcaatgtgttgaagatgtcttgaaagctgctgaaatcggtgttgcaggtgtcgttctatctaaccacggtggtagacaattggatttctctagggctcctatcgaagtgttggctgagactatgccagtgctaagagaaaagaaattggatgataaaatcgaaattttcattgatggtggtgttagaagaggtaccgatatcctaaaggcattgtgtcttggtgccaagggtgtcggtctaggtagaccattcttatactctaacagttgctacggtaaagaaggtgtcaagaaagccattgagctattaaaggacgaattggaaatgtcgatgagattactcggtgtcacaagtatagaccaattatccgaaaaatacctagatctatctacaatccatggtagaactgtcaatgttcctcgcgataacctataccgtgaggtatatgtcccacatgaaccaactcaattcttagaggaatga

SEQ ID NO: 23384 - protein, 589 aa, Kluyveromyces lactis NRRL Y
MRSAVRVFGKNRVSGLRFASTSSKSPIHKSSATLRFGRSAKSGYSAFSFGKKVITGGAFLVAGSVGIALISQFNDSVENGAKVDMTKPKVSPTEVAKHSSPKDCWVVIEGYVYNLTDFISAHPGGPAIIENNAGKDVTKIFAPIHAPDVIEKYIAPENRIGPLDGTMPDDLVCAALTPGETPEDVARKEQLRQSLPDIDSLVNIYDFEFLASQILTKQAWSYYSSAADDEVTHRENHAAYHRIFFKPRILVNVKEVDTSTTMLGEKVGVPFYVSATALCKLGNPKEGEKDIARGCGESDVKPVQMISTLASCSLQEIVEAAPSKEQIQWFQLYVNSDRKITEDLIKNVEKLGLKAIFVTVDAPSLGNREKDAKVKFTNSNGAKAMEKSKVKESKGASRALSSFIDPALNWDDIIEFKKKTKLPIVIKGVQCVEDVLKAAEIGVAGVVLSNHGGRQLDFSRAPIEVLAETMPVLREKKLDDKIEIFIDGGVRRGTDILKALCLGAKGVGLGRPFLYSNSCYGKEGVKKAIELLKDELEMSMRLLGVTSIDQLSEKYLDLSTIHGRTVNVPRDNLYREVYVPHEPTQFLEE

SEQ ID NO: 23385 - DNA, 1671 bp, Kluyveromyces lactis NRRL Y
  CDS (1)..(1671)
atgatatctactagagttgcaagcagatccgccagaattgcatttaaaggtgtcggcaatgccgcaagaatcaacgttgcaaatcgtttcttgagaactaaggcttctccttctgctcagaggaaaccgtccgaatctaagtcgaaatttaataaaactacaaaggcttctcttcttactggtgcctcttctttgaccctttttctatcttactttctttctgataatgataaagacggtgtttcggttaaagaggttaaaatgcacaacagaatcgatgattgctggattgtcatcgataatgaggtttacgatattaccaagttcttgtctcaacatccgggtggtgtagcaagattgatggagtttgctggtagggatgcaactgaaaggttctaccagatgcattctagtgcgactctggagaagatgaaggaacatttggtttacattggtaaattgaaaggtgcatttgataaagagctctctgaagaagagattagaatcatagaacacaaggccaagattccaccattgagaaaaatattctgtttatctgacttcgaagcagtggccaagcaggtgttgccaaaatctacgttcttttactatgccactggttcctctgatgaatatactcttcgtgaaaaccattatgcctatagtagagtgttcttcagaccgaagatcctgcaagatatcgaggaagtcgataccagtacgaaattcttgggcgccaaagttgacttaccaatttacattacagcctttgctggttctagacttgcccatcctatgggtgaactgaacttgcaatctgcggcttacgatgctaacgttatgcaaatggtgccaaaacagaactcctacagccatgaagaattcttcccacatgtcccagatgatcaaaaccaatggttgcaattccactttgacactcaagaagaacttgataacttggataaatgggtcgaaagagcaggcactctaccaagtgctaaggggttgtttttcaatgtagatcttgcagatattggcaacagagaaaaggactcaagacaaagagcctctcaacctggtagtgaatacttagatgaaatgactgataataagttcggaagtcatccaaagattacctggagcaccatcgagagagtcatgaaaaacactcatcttccagtggctttgaaaggtgttcaaagaggcgaagacgttgtgatcgctgctcaaaagggggtgaaagctgtcattttgtctaaccacggtggtagacaattagacttttccagaccacctctagaagttcttgtcgaagctaagcaaatgttgaaagaaaagaacttagatggcaaaattgaaatctatctagatggtggtgttcgtagaggatcagacatcctcaaagccctttgtctaggtgctacaggtgtcggtatgggacgaccattcctttacgcgatgtctggttatggggaggaaggtgttacccatctattcaacattcttcgcactgaaattgagaataacatgagactgttgggtgttgacaaaatcgaggacctcgatgaatcattggtagacttcagaagtctttcattcaagaaccctaggatcaatgatgcactttatgaccaagcatatgagccattgcaattccctgaatttaagtaa

SEQ ID NO: 23386 - protein, 556 aa, Kluyveromyces lactis NRRL Y
MISTRVASRSARIAFKGVGNAARINVANRFLRTKASPSAQRKPSESKSKFNKTTKASLLTGASSLTLFLSYFLSDNDKDGVSVKEVKMHNRIDDCWIVIDNEVYDITKFLSQHPGGVARLMEFAGRDATERFYQMHSSATLEKMKEHLVYIGKLKGAFDKELSEEEIRIIEHKAKIPPLRKIFCLSDFEAVAKQVLPKSTFFYYATGSSDEYTLRENHYAYSRVFFRPKILQDIEEVDTSTKFLGAKVDLPIYITAFAGSRLAHPMGELNLQSAAYDANVMQMVPKQNSYSHEEFFPHVPDDQNQWLQFHFDTQEELDNLDKWVERAGTLPSAKGLFFNVDLADIGNREKDSRQRASQPGSEYLDEMTDNKFGSHPKITWSTIERVMKNTHLPVALKGVQRGEDVVIAAQKGVKAVILSNHGGRQLDFSRPPLEVLVEAKQMLKEKNLDGKIEIYLDGGVRRGSDILKALCLGATGVGMGRPFLYAMSGYGEEGVTHLFNILRTEIENNMRLLGVDKIEDLDESLVDFRSLSFKNPRINDALYDQAYEPLQFPEFK

SEQ ID NO: 23387 - DNA, 1155 bp, Acinetobacter sp
  CDS (1)..(1155)
atgattatttcttcttcaaatgattatcgcgaagcagcaaagcgccgcttgccaccatttctgtttcactatatcgatggtggggcgtatgcagaatatacgcttaagcgaaatgttgaagatttatcgcaaattgcgttacgccagcgtgtactcaatgacatgtctagcttgagtttggaaacaaaactgtttaacgaaacactttcgatgcccgttgctttatcacctgtaggcttaactgggatgtatgcgcgtcgtggcgaagtgcaggccgctgtcgccgccgataaaaagggtattccctttaccatgtcgacagtttcggtatgcccaattgaagaagtgacacctgcgatcaagcgtccaatgtggtttcagctttacgtattgcgtgatcgtggctttatgaaaaatgcgctggaacgtgccaaagctgcgggttgctcaacactggtgtttaccgtagatatgcctgttcctggcgcgcgctatcgtgatgcacattcgggaatgagtgggccaaatgcggcgatgcgtcgttatttacagtctatgatgcacccgcaatgggcttgggatgtcggattgttgggtcgtcctcacgatttggggaatatttcaaaatatttgggtaaaaccacaggacttgaagattatattagctggttgggctccaattttgacccatccatttcatggaaagatttggagtggattcgtgagttttgggatggcccaatggtgattaaaggcattctagatcctgaagatgccaaagatgctgtgcgttttggggcagatggaattgtggtgtctaatcatggggggcgtcagcttgatggtgtgatgtcttcagcgcgagcgatgccagcgattgcagaagcagtgaaaggtgacctgaccattctggccgattcgggcattcgtaatggtctggatgtcgtgcgtatgctcgccttgggtgcagacagcgtaatgttaggtcgtgcctttatctatgcattggctgcacagggcgggcaaggtgtatccaacttgcttgatctgattgataaagaaatgcgcgttgccatgaccttgacgggtgcaaaaaccattgccgatatcaatgaaagttgtctggtcgaaatgaataaactcatacaatcctaa

SEQ ID NO: 23388 - protein, 384 aa, Acinetobacter sp
MIISSSNDYREAAKRRLPPFLFHYIDGGAYAEYTLKRNVEDLSQIALRQRVLNDMSSLSLETKLFNETLSMPVALSPVGLTGMYARRGEVQAAVAADKKGIPFTMSTVSVCPIEEVTPAIKRPMWFQLYVLRDRGFMKNALERAKAAGCSTLVFTVDMPVPGARYRDAHSGMSGPNAAMRRYLQSMMHPQWAWDVGLLGRPHDLGNISKYLGKTTGLEDYISWLGSNFDPSISWKDLEWIREFWDGPMVIKGILDPEDAKDAVRFGADGIVVSNHGGRQLDGVMSSARAMPAIAEAVKGDLTILADSGIRNGLDVVRMLALGADSVMLGRAFIYALAAQGGQGVSNLLDLIDKEMRVAMTLTGAKTIADINESCLVEMNKLIQS

SEQ ID NO: 23389 - DNA, 1782 bp, Candida glabrata CBS138
  CDS (1)..(1782)
atgcaaaggtacatatttaagacaccacattccagggtgctacgatctttaccaagacatgccatcaattccacaacaaaaagaggtattgtctcgacgaggagctctttaaataaccaattcttcaactccgagagacaaaggaagagttataaatggttctggagtatcgggttgacagtcggtctgacagcagcaattgctgataatctccacaacaaaaaagatatttataatgatgccaaatttgacagttcaaaacccaaaatttcacccagtgaagttataaaacataatacaccggaggactgctgggtagtcatagatggctacgtttacgatttaaccaattttattgctttgcacccaggtggtccggatattataaaaacgaatgctgggaaagatgtaactgcaatctttgatccaatccatccgccagatgccatagaaaagtacataaaacccgaacagcatattggtcccctagatggtaaattggatgcagagtacatatgtccaccttatgcgccaggtgaaaccccagatgatattgcaagaaaagctgctttgagagctagattaccacctttgagctcaattatgaacctatatgattttgaatacttagcatcacaaatcctgtctaaacaggcatgggcatattactcttctgctagtgatgatgaggtcagttaccgtgagaaccacaatgcataccacagaatttttttcaatccaaaggttcttgttgatgtcagtaaagtcgatacctctacagaaatgctaggccataaagttgatgttccattctatgttaccgcaacagcattgtgtaaactaggtaatccaaaagaaggtgaaaaagacatcgctagaggatgtggtcaaggaccaaacaagactccacaaatgatttcaacgttagcttcctgttctgttgatgagattgtaaatgctgcaccatcaaaagaccaagtcatatggtaccaactatatgttaactctgatcgtaagataactgaaaacttgataaagcatgtcgaagacttaggcgttaaagctatatttgttacagttgatgccccaagtttaggttctagagagaaggacaaaaaggttaagttcaacaatactatgagtggaccaaagagcatgaagaaatctgatgtaggggaatcagaaggtgccgctcaaaccttgtctaaatttatcgatccttctttgtcctggcaagacatcaaaatactaagaaagaaaactaaattgcccatagttatcaaaggtgtgcaaagagttcaggatgtcgttaaagctgcagaaataggctgtaatggtgttgttctatcgaatcatggtggtagacagttggattttgctagggctccgattgaagttcttgctgaaactatgcctgtcttgaaggagaagaaactggacaagaactttgaagtatttgtagatggtggtgttcgccgtggtactgatgtgataaaagcactatgtcttggggcatctggtgttggtctgggtagaccatttttgtatgccaactcctgttatggaaaggatggtgtgcaaaaggcgattgatctattgaaaacagagattgaaatgaacatgagattgctgggtgttacatccattaaggacatgaatcctgaactattagatctttcttcattgcatggtaggactgtcaatgtaccaaaggattcgttgtatgttaatgtttacaacaagcctgagctagctgagttcttagacgatgccagcgattga

SEQ ID NO: 23390 - protein, 593 aa, Candida glabrata CBS138
MQRYIFKTPHSRVLRSLPRHAINSTTKRGIVSTRSSLNNQFFNSERQRKSYKWFWSIGLTVGLTAAIADNLHNKKDIYNDAKFDSSKPKISPSEVIKHNTPEDCWVVIDGYVYDLTNFIALHPGGPDIIKTNAGKDVTAIFDPIHPPDAIEKYIKPEQHIGPLDGKLDAEYICPPYAPGETPDDIARKAALRARLPPLSSIMNLYDFEYLASQILSKQAWAYYSSASDDEVSYRENHNAYHRIFFNPKVLVDVSKVDTSTEMLGHKVDVPFYVTATALCKLGNPKEGEKDIARGCGQGPNKTPQMISTLASCSVDEIVNAAPSKDQVIWYQLYVNSDRKITENLIKHVEDLGVKAIFVTVDAPSLGSREKDKKVKFNNTMSGPKSMKKSDVGESEGAAQTLSKFIDPSLSWQDIKILRKKTKLPIVIKGVQRVQDVVKAAEIGCNGVVLSNHGGRQLDFARAPIEVLAETMPVLKEKKLDKNFEVFVDGGVRRGTDVIKALCLGASGVGLGRPFLYANSCYGKDGVQKAIDLLKTEIEMNMRLLGVTSIKDMNPELLDLSSLHGRTVNVPKDSLYVNVYNKPELAEFLDDASD

SEQ ID NO: 23391 - DNA, 1152 bp, Bartonella quintana
  CDS (1)..(1152)
atgattatttcttcaacatttgattaccgcaaagcagcaaagcgccggcttcccccttttctttttcactatattgatggtggggcttatgctgaggaaacgatgcgacgtaattatgcggatcttcaagcacttgcactgcgtcaaaggattctaaggcaggttggtgaagttgatctttcaattaagctttttgatcaaaggcttaatctaccgattgtgcttgcacctgttgggttaaccggcatgtatgcgcgtcgtggtgaggtaaaagctgcgcgtgcggcagttgcgaaaggcattccttttacactctcctcagtttcagtttgctcccttgcagaagtgcatgcagaggttggaagtggattttggtttcaactttatgttctcaaagatcgtgggtttatgcgtgatgttttggagcgatcttggctggctggtgtacgtacattggtctttacagttgatatgccggtccctggtgcccgttatcgtgatgctcattcggggatgtctggaccttatgccggattacgccgtattttacaggctgttgtccatccacactgggcttggaatgttggtattatggggcgtccacatgatcttggaaatgtttctacttatcttcaaaagaaaattacattggaagactatgttggttggcttggcgcaaattttgatccatcaattggttggtctgatctgcaatggattcgagatttttggaagggaaaaatgattttgaagggtattctcgatccacaagatgcgcgagaggcggtgcaatttggtgctgatggtattgttgtttccaatcatggtggacgtcaacttgacggtgtattgtcaactgcacgggcattaccggcaattgcggaggttgtaacgggtgatttaaccattttagctgattctggtgttcgttctggtcttgatgttgtacgcatgatagcccaaggtgcagatgcagttatgattggtcgtgcttttatttatgcgcttgcagcagcaggtgagaaaggtgttatgcatctccttgatctttttgctaatgaaatgcgggtagctatgacattgactggtgtgcgcgcagttaaagaaatcacacatgagagtttagcaagtacagatgctcttaaccaatga

SEQ ID NO: 23392 - protein, 383 aa, Bartonella quintana
MIISSTFDYRKAAKRRLPPFLFHYIDGGAYAEETMRRNYADLQALALRQRILRQVGEVDLSIKLFDQRLNLPIVLAPVGLTGMYARRGEVKAARAAVAKGIPFTLSSVSVCSLAEVHAEVGSGFWFQLYVLKDRGFMRDVLERSWLAGVRTLVFTVDMPVPGARYRDAHSGMSGPYAGLRRILQAVVHPHWAWNVGIMGRPHDLGNVSTYLQKKITLEDYVGWLGANFDPSIGWSDLQWIRDFWKGKMILKGILDPQDAREAVQFGADGIVVSNHGGRQLDGVLSTARALPAIAEVVTGDLTILADSGVRSGLDVVRMIAQGADAVMIGRAFIYALAAAGEKGVMHLLDLFANEMRVAMTLTGVRAVKEITHESLASTDALNQ

SEQ ID NO: 23393 - DNA, 1152 bp, Bartonella henselae
  CDS (1)..(1152)
atgattatttcctcaacattagattaccgtaaagcagccaaacgtcggcttcctccttttctgtttcactatattgatggcggagcttatgctgaggaaacaatgcgacgcaattatgcagatcttcaagcacttgcactgcgtcaaaggattttgagaggggttggtgaagttgatctttcaaccaagctttttgatcaaacgcttgatttgcccattatacttgcaccggttggcttaacaggtatgtatgcgcgtcgcggtgaggtacaagccgcgcgtgcagctgttgcaaaagggattccttttaccctatcctctgtttcagtttgccccattgcagaagtgcagaaagcagttggaagtgcattttggtttcaactttatgttcttaaagatcgagggttcatgcgtgatgtattagagcggtcttgggcatctggggtgcgcaccttggtttttacagttgatatgccggttcctggtgcacgttatcgtgatgcgcattcaggaatgtctggatcttatgctgggttgcgccgtattttgcaggcttttattcatccacattgggcttggaatgttggtattatggggcgtccacatgatcttggaaatgtttctacctatttgcaaaagaaaattgcattggacgattatattggttggcttggagcaaattttgatccatcaatcggttggcatgatttacaatggattcgagatttttggaaggggaaaatgattctgaaaggtatccttgatccagaggatgcacgagaagcgatacaatttggtgctgatggtattgttgtttctaatcatggtggacgccaacttgatggtgtcttatcaacagtacgtgcattgccagcaattgcagaggctgtaaagagtgatttgactattttagtggattctggtgttcgttctggccttgatgttgtacgtatgatagcacaaggtgcggatgctgttatgattggtcgtgcttttgtttatgcgcttgcagcagcaggtgagaaaggtgttgcgcacctcattgatctttttgcgaatgaaatgcgcgtggcgatgacattgacaggtgtacgcgcgattaaagagatcacacgggaaagtttagcaagtccagatgtttttgagcaatga

SEQ ID NO: 23394 - protein, 383 aa, Bartonella henselae
MIISSTLDYRKAAKRRLPPFLFHYIDGGAYAEETMRRNYADLQALALRQRILRGVGEVDLSTKLFDQTLDLPIILAPVGLTGMYARRGEVQAARAAVAKGIPFTLSSVSVCPIAEVQKAVGSAFWFQLYVLKDRGFMRDVLERSWASGVRTLVFTVDMPVPGARYRDAHSGMSGSYAGLRRILQAFIHPHWAWNVGIMGRPHDLGNVSTYLQKKIALDDYIGWLGANFDPSIGWHDLQWIRDFWKGKMILKGILDPEDAREAIQFGADGIVVSNHGGRQLDGVLSTVRALPAIAEAVKSDLTILVDSGVRSGLDVVRMIAQGADAVMIGRAFVYALAAAGEKGVAHLIDLFANEMRVAMTLTGVRAIKEITRESLASPDVFEQ

SEQ ID NO: 23395 - DNA, 1276 bp, Xenopus laevis
  CDS (96)..(1166)
tttggatctagagggggcgcaggcaacctgcccttgttataactttccctggatattgggccggaatcagcaggcctgtgcttggggacgcagagatgtcccttatttgcctggcagactttgaggcctacgccaaggagaacctgcccaaagccacgtgggaatattacgcagccggtgcggacgaatgctgtacaagggatgataacctgcaggcattcagaaggatccgcctgaggccccggatgctccgtgatgtctcagtaatggacacaaagaccacagtgttaggggaagagatcagctgccctattggtattgcccccacggcattccactgcctggcctggcccgatggcgagatgagcacggctagagcggctgaagctctgaacctcctgtatgtggccagtacctacgccacctgctctgtggaagaaatttcccaggctgccccagaaggactgcgttggttccagctctacgtataccgggaccgtaagttgtccgagcagctcatccgtcgagtggaggccctgggcttcaaggctttggttctaacggtggatgtgccctacacgggcaagcgaagaaccgacatccgcaataacttccgccttccaccgcacctcaaggtcaagaactttgagggagtgtttgagggacacagtggccccgataactatggtgtcccagtcaataccctggacccatcagtaagctggaaggacatttgctggctgcgcagtgtgactaagctaccaatcgtcatcaagggaatcctaaccaaggaggacgcggagttagcagtggtgtacggtgtccaggggatcattgtctccaaccatggagggcgccaactggatggagagctcgccacgattgatgccctgtcagaaatcgcggaagtggtgcaaggccggatagaagtctacttagatggtgggatacgaacaggaagtgacgttctgaaagcgatcgctctgggtgccaagtgcgtgttcctgggacgccccattgtctggggtctcacctacaagggagaagaaggagtgaagggaatcctgcagatactcacagacgaattccggctctccatggccctctcaggctgccggaacgtctccgaagtcaaccggaacctcattcatgtggctaaactgtagggccgggatctggcaccattgctgtttggagggatcagaggggccaatgctgcccggggtaccaacctgcaaataaaactcgtgctgctcaactgaaaaaaaaaaaaaaa

SEQ ID NO: 23396 - protein, 356 aa, Xenopus laevis
MSLICLADFEAYAKENLPKATWEYYAAGADECCTRDDNLQAFRRIRLRPRMLRDVSVMDTKTTVLGEEISCPIGIAPTAFHCLAWPDGEMSTARAAEALNLLYVASTYATCSVEEISQAAPEGLRWFQLYVYRDRKLSEQLIRRVEALGFKALVLTVDVPYTGKRRTDIRNNFRLPPHLKVKNFEGVFEGHSGPDNYGVPVNTLDPSVSWKDICWLRSVTKLPIVIKGILTKEDAELAVVYGVQGIIVSNHGGRQLDGELATIDALSEIAEVVQGRIEVYLDGGIRTGSDVLKAIALGAKCVFLGRPIVWGLTYKGEEGVKGILQILTDEFRLSMALSGCRNVSEVNRNLIHVAKL

SEQ ID NO: 23397 - DNA, 1304 bp, Xenopus laevis
  CDS (111)..(1181)
gatgagtctgttacatggagcaatggggagaggattcaggagggaaccaagagaagggggagacggacacaaacagagaacccccagtgccagtgctcggggtcgcagggatgtccctcatttgtctggcagacttcgaggcctacgccaaggagaacctgcccaaagccacgtgggaatattacgcagccggtgcagatgaatgttataccagggatgataacctgcagggattcagaaggatccgcctgaggccccggatgctccgtgatgtctcagtaatggacacaaagaccaccgtgttaggggaagacatcagctgccccattgctattgcccccactgcattccactgcctggcctggtctgatggggagatgagcacagcgagagcggctgaagctctgaagctcctgtatgtggccagtacctacgccacctgctctgtggaggagatttcccaggctgccccagaaggtctgcgttggttccagctctacgtctaccgggaacgcaagttgtccgagcggctgatccggcgagtggaggccctgggcttcaaggctttggtcctgacggtggatgtgccctacacgggcaagcgcagaaccgacatccgcaataacttccaacttccaccgcatctcaaggtcaagaactttgaaggggtgtttgagggacacagtggccctgataactacggcgtccccctcaataccctggacccatcagtcagctggaaggacatttgttggctgcgcagtgtgactaatctgccaatcgtcatcaagggaatcctgaccaaggaggacgcggagctggcggtggtgtatggagtccaggggatcattgtgtccaaccatggagggcgccaactggatggagaactcgccacgatcgatgccctgtcggagattgtggaggtggtgcaaggccggatagaagtctatttagatggtgggatacgaactggaagtgacgttctgaaagccatcgctctgggagccaagtgtgtgttcctgggacgccccattgtgtggggtctcacctacaagggagaagaaggggtgaagggaatcctgcagatactcaccgatgaattccggctctccatggccctctcaggctgccggaacatctccgaagtcaaccggaatctcatccatgtggctaaactctaaggccggaaccgcctggagggatcagaggggccaacgctgctccgggtaccaacctgcaaataaatctggtgctgctcatctgaaatgaaaccttatttatccctcatcaaaaaaaaaaaaaaa

SEQ ID NO: 23398 - protein, 356 aa, Xenopus laevis
MSLICLADFEAYAKENLPKATWEYYAAGADECYTRDDNLQGFRRIRLRPRMLRDVSVMDTKTTVLGEDISCPIAIAPTAFHCLAWSDGEMSTARAAEALKLLYVASTYATCSVEEISQAAPEGLRWFQLYVYRERKLSERLIRRVEALGFKALVLTVDVPYTGKRRTDIRNNFQLPPHLKVKNFEGVFEGHSGPDNYGVPLNTLDPSVSWKDICWLRSVTNLPIVIKGILTKEDAELAVVYGVQGIIVSNHGGRQLDGELATIDALSEIVEVVQGRIEVYLDGGIRTGSDVLKAIALGAKCVFLGRPIVWGLTYKGEEGVKGILQILTDEFRLSMALSGCRNISEVNRNLIHVAKL

SEQ ID NO: 23399 - DNA, 1155 bp, Picrophilus torridus
  CDS (1)..(1155)
atgacaaattatggtttgaattaccagctgagaacatatttaaaaattgatggcaacgacatgcccgtatcaattaatgactggcatgacctggcaatgaaaaagcttgataatggcccatggggatatcttgagggttccgccggttccaatgataccgaaaaaaataatgaaagatcttttttaaagtatagaataaggccaaggtatcttagagatgtctcgaatatagatatgtcaataaggctttttggaaaaagatttgagacgccttttatacttgggccgataggcgtaacgtcaattattcataatgatggcgatattgcaatagcaaaggcagcagaaaatcttggaatgccctttgcattaagtactgtgtcatcatacagcatagaggatgttgcaaaagcagcgccaaatgcggaaaggtggtttcagctctacccgggcagggataaaaatattatgaaaagcatgattagaagggcggaaaaatcaggctacagtgcaattatagtgactgttgatacaaccatgcttggctggcgtgaaacagatctaaaaaatgcctacctgccgttcttgcttggttatggaattgcaaattatataacagatcctgagttcaatgcaagactcgataaaagtccggaggaggatatgaatgcagcaatagaggagtttctttccatttacgtgaatccaggatttacctgggatgacttttcagagataaggtcatggacgaggcttccattaattataaagggtataacacatattgatgatgtgaaaaaggcctttgattataatgctgatgccgtggttatatcgaatcatggaggcagacaggttgatggtgcaatttcatcaatagatgcacttcatgaactttctttaaatgatataaatggcacaatattatttgatagcggcataaggcatgcggctgatgccttcaaggccattgcccttggtgcatccgcagttcttataggcaggccatacatatacgcactggccgttgcaggccaggctggaattgaaagatacatggatcagttaagatcagaatttaatttggaaatggccctttccggatatggatctttaagtgaattaaacagggaaacaatatatgttcaaaaatga

SEQ ID NO: 23400 - protein, 384 aa, Picrophilus torridus
MTNYGLNYQLRTYLKIDGNDMPVSINDWHDLAMKKLDNGPWGYLEGSAGSNDTEKNNERSFLKYRIRPRYLRDVSNIDMSIRLFGKRFETPFILGPIGVTSIIHNDGDIAIAKAAENLGMPFALSTVSSYSIEDVAKAAPNAERWFQLYPGRDKNIMKSMIRRAEKSGYSAIIVTVDTTMLGWRETDLKNAYLPFLLGYGIANYITDPEFNARLDKSPEEDMNAAIEEFLSIYVNPGFTWDDFSEIRSWTRLPLIIKGITHIDDVKKAFDYNADAVVISNHGGRQVDGAISSIDALHELSLNDINGTILFDSGIRHAADAFKAIALGASAVLIGRPYIYALAVAGQAGIERYMDQLRSEFNLEMALSGYGSLSELNRETIYVQK

SEQ ID NO: 23401 - DNA, 1140 bp, Rhodopseudomonas palustris
  CDS (1)..(1140)
atgaaagagatcacctgcatcgaagacctccgccagatccacaagcgccgggtgccgaagatgttcttcgactacgtcgaccacggctcctatgccgaggagacgctgcgggccaatgtggatgacctgaagcggatcaagttccgccagcgcatcctggtcgacatctccaagcgcgatctcgcgaccaccattttgggcgacacctacgcgatgccgctgatcctggcgccggtcggctcgaccgggatgcagcatgccgatggcgaaatccacgcctgccgcgccgcgcaggccgccggcatcccctacacgctgtcgacgatgtcgatctgctcgatcgaggacgtcgcggccaacgtcgagaagccgttctggtttcagctctacgtgatgcgtgaccgcggcttcgccaaagcgctgatcgagcgcgcgatcgccgccaagtgcagcgcgctggtgctcacggtcgacctgcaggtgatcggccagcgccatcaggacatcaagaacggcatgacggtgccgccgcaactgttcaagctgaagaacgtcatcgacatcgccaccaagccgcgctgggtgaagggcattctcggcacgccgcggcgcaatttcggcaacatcgccggccacctgcccggctccaaggatctggagtcggtgtccgcctgggtggcgtcgcagttcgacgcatcgctgaactggcgcgacatcgactggatccgctcgatctggccgggcaagctgatcatcaagggcatcctcgacgtcgaggacgcgcgcgaggcggtgaaggtcggcgccgaagcgctggtggtgtcgaaccatggcggacgccagctcgacggcgcaccgtcgtcgatcgaagtgctgccggagatcgtccacaccgtcggctcgcatatcgaagtaatgttcgacggcggcatccgctccggccaggacgtgatgcgcgcactcgcgctcggcgccaagagctgcatgatcggccgcgcctatatctacggccttggcgcctatggcggcccgggcgtcgccaaggcgatcgacatcatcggcaaagagctgtcgaccacgatgggcctgtgcggcgtcaattcgatccacgagatcgacgagaaggtgctggcggattaa

SEQ ID NO: 23402 - protein, 379 aa, Rhodopseudomonas palustris
MKEITCIEDLRQIHKRRVPKMFFDYVDHGSYAEETLRANVDDLKRIKFRQRILVDISKRDLATTILGDTYAMPLILAPVGSTGMQHADGEIHACRAAQAAGIPYTLSTMSICSIEDVAANVEKPFWFQLYVMRDRGFAKALIERAIAAKCSALVLTVDLQVIGQRHQDIKNGMTVPPQLFKLKNVIDIATKPRWVKGILGTPRRNFGNIAGHLPGSKDLESVSAWVASQFDASLNWRDIDWIRSIWPGKLIIKGILDVEDAREAVKVGAEALVVSNHGGRQLDGAPSSIEVLPEIVHTVGSHIEVMFDGGIRSGQDVMRALALGAKSCMIGRAYIYGLGAYGGPGVAKAIDIIGKELSTTMGLCGVNSIHEIDEKVLAD

SEQ ID NO: 23403 - DNA, 1140 bp, Alcaligenes faecalis
  CDS (1)..(1140)
atgattatttcctcctcgaccgactaccggcgtgccgcccaaaaacggctgcctccctttttgttccactacattgatggtggcgcctatgccgagcacaccctgcgccgcaatgtggacgatctggcggaggtcgccctacgccagcgcgtcctcaaagacatgagccagctggacaccagcattgatctgtttggcgaaaaattgtccatgccggtggctctgtctccggtcggactgacgggtatgtacgcacgccggggagaagttcaggctgcccgggccgccgatgcacgcggtattccctttaccatgtccagcgtatccgtgtgcccgatcgaagaagtggcgcctcgtcttagccgacccatgtggtttcagctctacgtgctgaaagaccgtggcttcatgcgcaatgcactggaacgcgcccaggctgccggttgcagcaccttggtctttaccgtggatatgcccgtacccggcgcgcgctaccgtgacgcacactcgggcatgagcggccccaacgccgccctgcgccgctacgctcaggccgtcatgcatccgcgctgggcctgggatgtaggtttgctgggtcgtccgcacgatttgggcaatatctcgcgttacctgggcaaacccacgggcctggaagactatatgggttacttgggcgccaactttgacccatccatctcctggaaggacctggagtggatccgtgaattctggaaaggccccatgctgatcaaaggcatcctggacccggatgatgcccgcgacgccgtgcgctttggagcggatgggatcatcgtctcgaaccacggtggccgccagcttgacggcgtcctgtcctcggcccgcgccctgccggccattgccgatgctgtcaaaggccagatcaagattctggcggactccggtatccgcagtggtctggacgtagtgcgcatgattgccctgggtgccgatgccgccatgctgggacgcgcctacatctatgcactggccgccgccggacaatccggagtcgaccacctgctgggcctgattgaaaaagaaatccgcgtcgccatgacgctgaccagcgtcagcagcatctctcagatcacctccgagctgcttgtccgggagccttga

SEQ ID NO: 23404 - protein, 379 aa, Alcaligenes faecalis
MIISSSTDYRRAAQKRLPPFLFHYIDGGAYAEHTLRRNVDDLAEVALRQRVLKDMSQLDTSIDLFGEKLSMPVALSPVGLTGMYARRGEVQAARAADARGIPFTMSSVSVCPIEEVAPRLSRPMWFQLYVLKDRGFMRNALERAQAAGCSTLVFTVDMPVPGARYRDAHSGMSGPNAALRRYAQAVMHPRWAWDVGLLGRPHDLGNISRYLGKPTGLEDYMGYLGANFDPSISWKDLEWIREFWKGPMLIKGILDPDDARDAVRFGADGIIVSNHGGRQLDGVLSSARALPAIADAVKGQIKILADSGIRSGLDVVRMIALGADAAMLGRAYIYALAAAGQSGVDHLLGLIEKEIRVAMTLTSVSSISQITSELLVREP

SEQ ID NO: 23405 - DNA, 1439 bp, Oryza sativa
  CDS (67)..(1176)
aatcaagcagctgttttcttgtttggtccagagtggtgtaggtgattcggctagctcagcgcgaagatgggggagatcaccaatgtcacggagtaccaggccatcgcgaagcagaagcttccgaagatgatctacgactactatgcatctggggccgaggacgagtggactctccaggagaacagggaggccttcgccaggatcctgtttcgcccacgcatactgatcgacgtatccaagattgacatggccacaacagtcctggggttcaagatttcaatgcccattatgattgctccctctgccatgcagaagatggctcacccagatggagagtatgcaactgcgcgtgctgcatcagcagcgggcactataatgacattgtcatcatgggctacttcaagcgttgaggaggttgcctcaactggaccagggattcgtttcttccagctttatgtttacaaagacaggagggtggtggagcagcttgttaggagagctgaaagggctggattcaaggcgattgcgcttacggtggatactccgcgacttggccgtagggaggctgacatcaagaacaggtttgttctgccaccatttttgacactgaagaactttgaaggcctggagctggggaaaatggaccaggctagcgattcaggactggcttcttacgtcgccgggcaaatcgatcgcaccctgagctggaaggatgtgaagtggctgcagaccatcaccacgctgccgatcctggtgaagggagtgatcactgcagaagacacgaggctcgccgtggagaacggcgcggccggcatcatcgtgtccaaccacggcgcccgccagctggactacgtcccggccaccatcagcgccctcgaggaggttgtgaaggcggctcgcgggcagctccccgtcttcctcgacggcggcgtccgccgcggcaccgacgtcttcaaggcgctcgccctcggcgccgccggcgtcttcatcgggaggccggtggtgttctcgctggcggcggcgggggaggccggagtccggaacgtgctgcagatgctccgcgacgagttcgagctcaccatggcgctcagcggctgcacctccctcgccgacatcacccgcaaccacgtcatcaccgaggccgacaagctcggcgtcatgccgtctcgcttgtaaacaacaacgacggcgaacttgtcgccgtcgatcgatcaccggccggccgccgcgacacgctttgccggccgacggatgatcggccgggaatgaagaagaaggtagtagctgccgaagaaaagattggaagatgcaaagttctataattttggatgatgctgcgtcatgtacttttgttaattgtcgagtgattgatcacctgtacctaattaaatggtttattggattattggcggtttatactaaacgaacaaattaatacc

SEQ ID NO: 23406 - protein, 369 aa, Oryza sativa
MGEITNVTEYQAIAKQKLPKMIYDYYASGAEDEWTLQENREAFARILFRPRILIDVSKIDMATTVLGFKISMPIMIAPSAMQKMAHPDGEYATARAASAAGTIMTLSSWATSSVEEVASTGPGIRFFQLYVYKDRRVVEQLVRRAERAGFKAIALTVDTPRLGRREADIKNRFVLPPFLTLKNFEGLELGKMDQASDSGLASYVAGQIDRTLSWKDVKWLQTITTLPILVKGVITAEDTRLAVENGAAGIIVSNHGARQLDYVPATISALEEVVKAARGQLPVFLDGGVRRGTDVFKALALGAAGVFIGRPVVFSLAAAGEAGVRNVLQMLRDEFELTMALSGCTSLADITRNHVITEADKLGVMPSRL

SEQ ID NO: 23407 - DNA, 1095 bp, Actinoplanes teichomyceticus
  CDS (1)..(1095)
atgaccaccgctgtgctgcggctggacacggtcgacgatttccggctgcgcgccgaggcgacgctgaccgccgcggtccgtgacttcgtggccggcggcagcgactcggagaccaccctggcggccaaccgggcggcgctggaccgggtgacgatcgtcccgcgggtgctgaccggcgggcccgacccggaaccgggcgccacgctggccggggcccgcagcgcgctgccgctggccgtggcgccgatggcgtaccagcggctgttgcacccggagggggagctggcgacggcgcgcgccgcggcggccgccggtgtccccttcgtggtcagcacgctcagcagcgtcccggtcggcgagctggccgcggccggcggcgaacagtggttccagttgtactggctcaacgacgaccgcgacacgatgaacctggtccaccgggccgaggacgccggctgccgggtgctgatggtgaccgtggacgttccggtgatgggccggcgcctgcgggacatccgcaacgagttcgtgctgcccgccgaggtgcgggcggcgaacgtcgcgtccggggcgatgagcgcggcgcacgatcgcgccgacgccggctccgccttgatcgcgcacaccaaccgcgcgttccatccggcgctcacctgggcgcacctggaggcgctgcgctcgcggaccaccctgccgatcgtggtgaagggcatcctggaccccgcggacgcccgccgcgcggccgagatcggcgcgaccggcgtggtgatctccaaccacggcggccgccagctcgacggcgcgccggccagcgtcaccatgctgcccgccgccgtcgcggccgtcccggacacctgccaggtgttcgtggacagcggcatccgcagcggcaccgacatcctgcgggcgctggcgctcggcgcgcacggtgtgctgatcgggcggccgatgctgtgggggctggcggcgggtggcgagaccggcgccgccggggtgctggccgtgctggacgccgagttgcgcgcggcgatgcggctggccggttgcgccgacgtcgcggcggcccggcggctgaccgccaccaccgggtgctga

SEQ ID NO: 23408 - protein, 364 aa, Actinoplanes teichomyceticus
MTTAVLRLDTVDDFRLRAEATLTAAVRDFVAGGSDSETTLAANRAALDRVTIVPRVLTGGPDPEPGATLAGARSALPLAVAPMAYQRLLHPEGELATARAAAAAGVPFVVSTLSSVPVGELAAAGGEQWFQLYWLNDDRDTMNLVHRAEDAGCRVLMVTVDVPVMGRRLRDIRNEFVLPAEVRAANVASGAMSAAHDRADAGSALIAHTNRAFHPALTWAHLEALRSRTTLPIVVKGILDPADARRAAEIGATGVVISNHGGRQLDGAPASVTMLPAAVAAVPDTCQVFVDSGIRSGTDILRALALGAHGVLIGRPMLWGLAAGGETGAAGVLAVLDAELRAAMRLAGCADVAAARRLTATTGC

SEQ ID NO: 23409 - DNA, 1293 bp, Thermus thermophilus
  CDS (1)..(1293)
atgatcggacgaagggtccagcagcggatctacctggaaggcctcatgggcaggcgccctcccctccccgtgcgcccggacgccctcgaggcggaagcccaaaagcgcatgtccccggaggccttcgcttacgtggcgggcggggcgggcctggagtggaccatggaggcgaaccgggaggccttccgccgcctcgccctccttccccggatgctccgagggaccaagccgcccggcctcggcgtggaactttgggggcgccggtgggccgcgcccctcttcctctgccccatcggggttttggagctcgcccaccccgaggccgagctcgccgccgtccgggccgccgccaagaggggcctcccctttatggtttccaaccaagcctcccaccccctggaacgggtggtggaggcggccaaggcggtcaaccccgaggcccccgtcttcttccagctctaccactccacggaccccagggcggtggagagcttcctccgccgggcggaaaaggcggggtgcgccggggtggtgctcaccgtggacacggtccagctggggtggcggccccgggacctggacctcggccacctccccttcctcaaggggcagggcctcgccgtctacctcacggaccccgcctttttgggggccctggacgagcccctggaaggccccgccttccgccccaagcccaccctcgccctcctcaggaacctcctcgccctgaggcgaacggggaggcgctacgggctaagcctcatccagatgcagaaggcggtgcgccgcttcgtggccacctactcctacccggagctttcctgggaggaggtgcggcgggtgcgggaaagcaccgccctgcccctcctcctcaaggggatcctccaccccgaggacgccctgcgggccgtggagctgggcgtggacggggtctacgtctccaaccacgggggaaggcaggtggacggaagcctcgccgccctccatgcgcttccccaggtggtccaggcggtggagggccgggtgcccgtcctcatggacagcggcgtccgcaccggggccgacgccgtcaaggccctggccctgggcgcccgggcggtgggcctcggccgcccctacgtctacgccctggccctgggcggggaggaaggggtgggggcgtttctggaccacttcctggcggagctggagctcaccctggccctctcgggcgtgggaagcctggaggagctcggcccccacttcctcgccaaggaaaaccccccgccccaaggggggcggggaggggcctaa

SEQ ID NO: 23410 - protein, 430 aa, Thermus thermophilus
MIGRRVQQRIYLEGLMGRRPPLPVRPDALEAEAQKRMSPEAFAYVAGGAGLEWTMEANREAFRRLALLPRMLRGTKPPGLGVELWGRRWAAPLFLCPIGVLELAHPEAELAAVRAAAKRGLPFMVSNQASHPLERVVEAAKAVNPEAPVFFQLYHSTDPRAVESFLRRAEKAGCAGVVLTVDTVQLGWRPRDLDLGHLPFLKGQGLAVYLTDPAFLGALDEPLEGPAFRPKPTLALLRNLLALRRTGRRYGLSLIQMQKAVRRFVATYSYPELSWEEVRRVRESTALPLLLKGILHPEDALRAVELGVDGVYVSNHGGRQVDGSLAALHALPQVVQAVEGRVPVLMDSGVRTGADAVKALALGARAVGLGRPYVYALALGGEEGVGAFLDHFLAELELTLALSGVGSLEELGPHFLAKENPPPQGGRGGA

SEQ ID NO: 23411 - DNA, 1185 bp, Mycobacterium paratuberculosis
  CDS (1)..(1185)
atggccgacgaatggtttgaaaccgtcgccatcgctcagcaacgggccaagcggcggttgccgaaatccgtttatgcggccctgatcgcggccagcgaaaagggaatcacggtctccgacaacgtcgaagcgttcggcgaactcggtttcgccccgcatgtcgtcggcgccccggccaagcgtgagctgacgacaaccgttatgggacaagagatctcgatgccggtgctgatctcgccgaccggtgtgcaggccgtcgacccggacggcgaggtcgctgtcgcgcgcgccgccgcggcccgcggcaccgctatgggcctgtcctccttcgccagcaagccgatcgaggaagtcatcgcggtgaaccccaaggtgttcttccaggtgtactggctgggtgggcgcgacgcgatcgccgagcgggtggagcgggcccggcaggccggcgcggtcgggctgatcgtcaccaccgactggtcgttctcgcacgggcgggactggggcagccccaagatccccgaggagatgaacctgcgcaccatcctgcggttgtccccggaggcggtgttcaagccccgctggctgtggaagttcggcaagacgctgcggccgccggagttgcgggtgcccaaccagggccgccgcggcgagcccggcccgccgttcttcgccgcctacggcgagtggatgggcacgcccccgccgacctgggaggacatcgcctggctgcgtgagctgtggggcgggccgttcatgctcaagggcgtgatgcgcgtggacgacgccaaaagggcggtggatgccggggtttcggccatctcggtgtccaaccacggcggcaacaacctggacggcacgccggcgtcgattcgcgccctgcccgcgatcgccgaggcggtcggcgaccagatcgaggtgttgctggacggcggtgtccggcgcggcagcgacgtcgtcaaggcggtggcgctgggggcgcgcgcggtgatgatcggccgggcctacctgtggggcctggccgccgccggccaggccggggtggagaacgtcctcgacatcctgcgcgggggcatcgactcggcgctgatgggtctggggcattcctcggtgcacgatctcgggccgagcgacatcctggtgccgcccgggttcacccgggcgctgggcgtgccgccggccggctga

SEQ ID NO: 23412 - protein, 394 aa, Mycobacterium paratuberculosis
MADEWFETVAIAQQRAKRRLPKSVYAALIAASEKGITVSDNVEAFGELGFAPHVVGAPAKRELTTTVMGQEISMPVLISPTGVQAVDPDGEVAVARAAAARGTAMGLSSFASKPIEEVIAVNPKVFFQVYWLGGRDAIAERVERARQAGAVGLIVTTDWSFSHGRDWGSPKIPEEMNLRTILRLSPEAVFKPRWLWKFGKTLRPPELRVPNQGRRGEPGPPFFAAYGEWMGTPPPTWEDIAWLRELWGGPFMLKGVMRVDDAKRAVDAGVSAISVSNHGGNNLDGTPASIRALPAIAEAVGDQIEVLLDGGVRRGSDVVKAVALGARAVMIGRAYLWGLAAAGQAGVENVLDILRGGIDSALMGLGHSSVHDLGPSDILVPPGFTRALGVPPAG

SEQ ID NO: 23413 - DNA, 1179 bp, Mycobacterium paratuberculosis
  CDS (1)..(1179)
atggccttcgccgagtatcagaacgagctctacgaccagtcgttgcacggcaaccagccgcagtatccgatcagattcgaggagctggaggccaaggcgtcggcggcgatgaccccgaaggtgctggggtacgtcgccggcggcgccggcgacgagcacacccagcgggccaactgcgaggcgttcaagcggtggggcttgtacccgcggatggggatcgcccccgaacagcgcgacatgtccgtcgagctgttcggcacccggttcccgtcgccgatattcatggcgcccatcggcgtgatcggggtgtgcgaccccgacggccacggcgacctggcctgcgttcgggcctcgatccgcaccggcgtcccgttcttcgtcggcacgctgtcggccgatccgatggaggacctggccgacgaattgggcgacaccccagcgtttttccagctctacaccccaccggaccgcaagatggccgccagcctggtgcaccgggccgaggcggccagcttcagcggcatcgccgtcaccctggacacctgggtgaccggctggcggccccgcgacctgagcggcgggaactacccccaggtgcccagcggatgcctggccaactacaccagcgatccggtttttcgcgccgggttgagccgcggcgaagaccccaccgaggcggcggtgcgcaagctgccgatcttcggcgggccgttccggtgggaggacctggaatggctgcggtcgcggaccagcctgccgctgatggccaagggcatctgccaccccgacgacgtgcgccgcgccaaagacattggggtggacgccgtttactgctccaaccacggcggccggcaagccaacggcgggttgccctgcctggactgcctgcccggggtggtcgaggcggctgacgggttgccggtgctgttcgactcgggtgtgcgcagcggggccgacatcgtcaaggcgctggcgctgggggcgaccgcggtcggcatcggccgcccctacgcctacgggctggcgctcgggggcgtcgacggcatcgtgcacgtgctgcgctcgctgctggccgaggccgacctgatcatggccgtcgacggctacccctcgctgaaggacctgacgccggacgcgcttcgccgcgtcgaacatgttgcaccacaacgttattcgtag

SEQ ID NO: 23414 - protein, 392 aa, Mycobacterium paratuberculosis
MAFAEYQNELYDQSLHGNQPQYPIRFEELEAKASAAMTPKVLGYVAGGAGDEHTQRANCEAFKRWGLYPRMGIAPEQRDMSVELFGTRFPSPIFMAPIGVIGVCDPDGHGDLACVRASIRTGVPFFVGTLSADPMEDLADELGDTPAFFQLYTPPDRKMAASLVHRAEAASFSGIAVTLDTWVTGWRPRDLSGGNYPQVPSGCLANYTSDPVFRAGLSRGEDPTEAAVRKLPIFGGPFRWEDLEWLRSRTSLPLMAKGICHPDDVRRAKDIGVDAVYCSNHGGRQANGGLPCLDCLPGVVEAADGLPVLFDSGVRSGADIVKALALGATAVGIGRPYAYGLALGGVDGIVHVLRSLLAEADLIMAVDGYPSLKDLTPDALRRVEHVAPQRYS

SEQ ID NO: 23415 - DNA, 1161 bp, Mycobacterium paratuberculosis
  CDS (1)..(1161)
atggcgttcggcgactaccagaacgagatctacttccgcggcctgggcggggtggcgccgtcgctgccgatggccttcgccgagctggagtcccgcgccgagcgggccatgtcgccgtcggtgtggtcctacgtcaccggcggcgccggcgacgaacgcacccagcgggccaaccgggaggcgttcgaccgctggggcctgatcccgcgcatgttcgtcggcgccgccgaacgcgacctgtcggtgcagatgttcggcctgaccctgccgtcgccggtgttcatggcgccgatcggcgtcatcggcatctgcgcccaggacggccacggcgacctcgccaccgcgcgggcggccgcggccaccggcgtccccatggtcgtttccaccctgaccgccgacccgatggaagacgtcgccgcgcagttcggcgacacccccggcttctttcagctctacacgccgaaggaccgggagctggccgccagcctcgtgcaccgggccgaggccgccggcttcaagggcatcatcgtcaccctggacacctggatccccggctggcgaccgcgcgacctgtccaccgccaactttccccagctgcgggggatgtgcctgagcaactacaccagcgatccggtgttccgcgccgccctggcgcgcccgcccgaggaggacccgcagggcaccgtgctgcagtggatatcgaccttcggaaacccgctgacctgggacgacctgccctggcttcggtcgctgaccgatctgccgctgatcatcaagggcatctgccaccccgacgacgcccgccgcgcccgcgacggcggcgtcgacggcatctactgctccacccacggcggacgccaggccaacggcgggctgccggcgctggactgcctgcccggggtgatcgaggcggccgacggtctgccggtgctgttcgactccgggatccgcagcggcgccgacgtcgtcaaggcgctcgcgctgggcgccaccgcggtcggcatcggccgcccgtatgcgtatggcctggcgctcggcggcgtcgacggcatcgtgcacgcgctgcgctcgatcctggccgaggccgacctcatcatggccgtcgacggatatccgacgcgcaaagatctcaccccggacacgcttcggcgcgtcgtctga

SEQ ID NO: 23416 - protein, 386 aa, Mycobacterium paratuberculosis
MAFGDYQNEIYFRGLGGVAPSLPMAFAELESRAERAMSPSVWSYVTGGAGDERTQRANREAFDRWGLIPRMFVGAAERDLSVQMFGLTLPSPVFMAPIGVIGICAQDGHGDLATARAAAATGVPMVVSTLTADPMEDVAAQFGDTPGFFQLYTPKDRELAASLVHRAEAAGFKGIIVTLDTWIPGWRPRDLSTANFPQLRGMCLSNYTSDPVFRAALARPPEEDPQGTVLQWISTFGNPLTWDDLPWLRSLTDLPLIIKGICHPDDARRARDGGVDGIYCSTHGGRQANGGLPALDCLPGVIEAADGLPVLFDSGIRSGADVVKALALGATAVGIGRPYAYGLALGGVDGIVHALRSILAEADLIMAVDGYPTRKDLTPDTLRRVV

SEQ ID NO: 23417 - DNA, 1263 bp, Mycobacterium paratuberculosis
  CDS (1)..(1263)
atgggagtccaacggcgagtgcccagggtgcgcgacctcgcgccactgatgcagttcaagcggcccgagttcaacgcgaccaaacgccgcctgcgatccgcccacaccatcgaggacctgcgccgcatcgccaaacgccgcaccccgaaggcggccttcgactacaccgacggcgccgccgaggacgagctgtccatccagcgcgcccgacaagccttccgcgacatcgagtttcacccgacgatcctgcgtgacgtcagcaccgtgaccgcgggatgggatgtgctgggcgggccggtggcgttgccgttcgggatcgccccgaccggcttcacccggctgatgcacaccgagggcgagatcgccggtgcgcgggcggcggcgcgggcgggcatcccgttctcgctgtccaccctgggcacctgcgcgatcgaggacctggcggccgcagttccccagtcgcgcaagtggtttcagctgtacatgtggaaaaaccgggaacgctcgatggcgctggtgcgccgggccgccgacgcaggtttcgacaccctgctggccaccgtcgacgtcccggtgtccggggcgcggctgcgggacaaccgcaacggcatgacgatcccgccgacgctgacgctgcgcaccgtgctggacgcggtgccgcacccgaaatggtggttcgacctgttgaccaccgagccgctggcgttcgcgtcgctggatcgctggcccggcaccgtcgcggagtatctgagcaccatgttcgaccccagcctcaccttcgacgacctggagtggatcaaggcgcggtggccgggaaagctggtggtgaaggggattcagacgctggacgacgcccgcgccgtcgtcgaccgcggcgccgacggcatcgtgttgtcgaatcatggtgggcgccaactggatcgggccccggtgccgttccacctgctgtccaccgtggcgcgcgagctgggcaagcacaccgagatcctgctggacaccgggatcatgtcgggcgccgacatcgtcgcggcgatcgcgctgggggcccgctgcaccctggtcgggagggcgtatctgtacgggctgatggccgggggtgaggccggcgtgacccgggcgatcgagatcctggccgaaggcgtgatccggacgatgcggctgctgggcgtcacctgtctcgaggagctgtcgccgcggcatgtgacgccgctgcggcggctggcgccgctgccgcccgtcgagccgccagtgacgcccgcgtga

SEQ ID NO: 23418 - protein, 420 aa, Mycobacterium paratuberculosis
MGVQRRVPRVRDLAPLMQFKRPEFNATKRRLRSAHTIEDLRRIAKRRTPKAAFDYTDGAAEDELSIQRARQAFRDIEFHPTILRDVSTVTAGWDVLGGPVALPFGIAPTGFTRLMHTEGEIAGARAAARAGIPFSLSTLGTCAIEDLAAAVPQSRKWFQLYMWKNRERSMALVRRAADAGFDTLLATVDVPVSGARLRDNRNGMTIPPTLTLRTVLDAVPHPKWWFDLLTTEPLAFASLDRWPGTVAEYLSTMFDPSLTFDDLEWIKARWPGKLVVKGIQTLDDARAVVDRGADGIVLSNHGGRQLDRAPVPFHLLSTVARELGKHTEILLDTGIMSGADIVAAIALGARCTLVGRAYLYGLMAGGEAGVTRAIEILAEGVIRTMRLLGVTCLEELSPRHVTPLRRLAPLPPVEPPVTPA

SEQ ID NO: 23419 - DNA, 1104 bp, Oryza sativa
  CDS (1)..(1104)
atggagctaatcacaaacgtctccgagtatgagcagcttgcaaagcagaagctgccgaagatgatctacgactactacgcctctggtgcagaagatcaatggactctcaaggagaacagggaggccttctcaagaattctgtttcgaccgcgaatactgattgatgtatcccgtatcaacatggctacaaatgtcttgggcttcaacatttccatgcccataatgattgctccctcagccatgcagaaaatggcccaccccgaaggagagcttgctactgcaagagcagcttctgctgcaggaacaataatgacattgtcttcatggtccacttctagtgttgaagaggttaattcagcagcgccggggatacgtttcttccaactctatgtttacaaggataggaatatagtacggcaacttgtcagaagggctgaattggctggttttaaggcgattgcactcactgtcgacactccaaggcttggtcgcagggaagctgacatcaagaacagattcaacttacctccacatctggtattgaagaattttgaagcgctggatctcggcaagatggacaagacaaatgattctggccttgcttcctatgttgctagccaagttgaccgctctctgtcttggacggacgtgaagtggctacagacaatcacctcgttgccgatcttagtgaaaggagtcatgactgcagaagatactaggcttgctgtcgaaagtggcgcggccggtatcatcgtgtccaaccatggagctcgccagctagattatgttcctgcaactatcagctgcctggaagaggtcgtcagggaggcaaaggggcggctgccggtgttcctcgacggcggcgtccgccgtggcacggacgtgttcaaggccctggcgctgggagcttcaggagtatttattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtag

SEQ ID NO: 23420 - protein, 367 aa, Oryza sativa
MELITNVSEYEQLAKQKLPKMIYDYYASGAEDQWTLKENREAFSRILFRPRILIDVSRINMATNVLGFNISMPIMIAPSAMQKMAHPEGELATARAASAAGTIMTLSSWSTSSVEEVNSAAPGIRFFQLYVYKDRNIVRQLVRRAELAGFKAIALTVDTPRLGRREADIKNRFNLPPHLVLKNFEALDLGKMDKTNDSGLASYVASQVDRSLSWTDVKWLQTITSLPILVKGVMTAEDTRLAVESGAAGIIVSNHGARQLDYVPATISCLEEVVREAKGRLPVFLDGGVRRGTDVFKALALGASGVFIGRPVLFSLAVDGEAGVRKVLQMLRDELELTMALSGCTSLAEITRNHVITDSDRIRRSRL

SEQ ID NO: 23421 - DNA, 1089 bp, Photorhabdus luminescens
  CDS (1)..(1089)
atgacaggagcctataaaacaaatagtgcagaaaaatccctcgatatcattaatctttatgacttggaagaagaagcacgtaaattgattccaacgccccaatttgactatatcagcggcggttcaggtgatgaatggactctacgtgaaaacaccagagcctttgacgatttccaaattattccccgctatctcgcaggagtaaaagagcctgacacaacaaccgaattgctcggcagtaacgtggatatgcctatttttattcctccaatagccgcacatgggctggctcatactaccgctgaattgggaacagcgagaggcgctgcctctgccggtaccctgtttactgcacaaactctgtctaattcatctcttgaagagatagcaaaagtgagtaacggacccaaatggtttcaaatttatttaaccaaagatatgggtattaaccgtgaactgatacgccgggccaaagcgatgggagcaactgccatcgtctttacagtcgatttagagtggagtggtaacagagaagcagataaacgtaataaatttattttcccacactcactgccattccctaatatccctggcgctcccgtaggagcaaccttatcagaaattacagagctatttaaacgggatcttaatttcagtgatttggagttcctcgccaaagaatcgggcctcccaatcatcgtgaaaggcattcaatctgccgaaaatgctaaagagtgtgttaaccacggtgccgcagcgattcaagtttctaatcacggtggtcggcagttagatactgtcccggcagcaattgcctcattaccgcacattgttgaagctgttggatctaaaattccagtctatctagacggaggcatccgccgcggtacccatgtgtttaaagcactcgcattgggtgccaaagctgtcgctatcggtaggcccattttgtatgcgctggcattaggtggagcaccaggcgtaacttccattttaaacctacttaaggatgagctgaaacttagcatgaaactggcaggatgtgcagccattaaggatatagagagaaaatttattagtttgatttaa

SEQ ID NO: 23422 - protein, 362 aa, Photorhabdus luminescens
MTGAYKTNSAEKSLDIINLYDLEEEARKLIPTPQFDYISGGSGDEWTLRENTRAFDDFQIIPRYLAGVKEPDTTTELLGSNVDMPIFIPPIAAHGLAHTTAELGTARGAASAGTLFTAQTLSNSSLEEIAKVSNGPKWFQIYLTKDMGINRELIRRAKAMGATAIVFTVDLEWSGNREADKRNKFIFPHSLPFPNIPGAPVGATLSEITELFKRDLNFSDLEFLAKESGLPIIVKGIQSAENAKECVNHGAAAIQVSNHGGRQLDTVPAAIASLPHIVEAVGSKIPVYLDGGIRRGTHVFKALALGAKAVAIGRPILYALALGGAPGVTSILNLLKDELKLSMKLAGCAAIKDIERKFISLI

SEQ ID NO: 23423 - DNA, 1149 bp, Photorhabdus luminescens
  CDS (1)..(1149)
atgagcaacaaattacttaacgtggcggattaccgcactttggcgaagaaaaaattaccaaagataatttttgactacctagagggcggtgcggaggatgaaaaagggctacgctataatcagcagatttttgatcgctggcgttttataccccatcgattaattgacgtcagtaaaagggatatttcatgtactttgtttaataaggtatggtcagcaccttttgctattgctcctactgggcttaatgccacttttcggccaaatggcgatttgattcttgcccgggtggcagcgaaagagaacattccttttatactctccagtgcggcgaacatgacaattgaagatgtggctagacagtgtgacggagaaaaatggttccagctttatgtagtatgtcccgaactggcagaacaaatggtgaagcgggcgttggcctctgattacaccactttggtaattaccgttgatgttgcggttaatggctatcgggaacgggatatacgtaaccagttctgtctgcctttgcgctatcgtcccgccgtgctgcttgacggctgccttcatccaagctggttgctgcgctttttatgtaacggaatgcctcaattggcgaatttcgtcatgacggagaacataggcgtagatgttcaggtcgcagtaatgagtcgacaaatggatgctagctttaactggcaaagcttggaacagttgcgagctttatggccacataagctcttggtgaaagggcttgtccgaccagaggaagctaaaaaatgtattgaactgggagctgatggtgtgatcctgtccaatcacggtgggagacagcttgatggcacactttccccaatggaaacgttaagtgccacggtacaggcgatgtatcaacctgtcttgatcgatagtggcttccgtcgaggatctgatatcgttaaagcgttggctctgggagcaaatatggtgttgctgggaagggcggtattgtatggccttgcagcgactggtgaacaaggcgtcagtgaggtgatccgtttactaaaagaagatatagaacgtacattggtgcatataggctccccttcaatcagggggttgactcccgattttgttcacaattgttggcagtttgcaacggtcaaataa

SEQ ID NO: 23424 - protein, 382 aa, Photorhabdus luminescens
MSNKLLNVADYRTLAKKKLPKIIFDYLEGGAEDEKGLRYNQQIFDRWRFIPHRLIDVSKRDISCTLFNKVWSAPFAIAPTGLNATFRPNGDLILARVAAKENIPFILSSAANMTIEDVARQCDGEKWFQLYVVCPELAEQMVKRALASDYTTLVITVDVAVNGYRERDIRNQFCLPLRYRPAVLLDGCLHPSWLLRFLCNGMPQLANFVMTENIGVDVQVAVMSRQMDASFNWQSLEQLRALWPHKLLVKGLVRPEEAKKCIELGADGVILSNHGGRQLDGTLSPMETLSATVQAMYQPVLIDSGFRRGSDIVKALALGANMVLLGRAVLYGLAATGEQGVSEVIRLLKEDIERTLVHIGSPSIRGLTPDFVHNCWQFATVK

SEQ ID NO: 23425 - DNA, 1380 bp, Neurospora crassa
  CDS (1)..(1380)
atggacgccaaatccccccacattaagaaccgcgacactcccccatggggcctctaccagcggaatatgttttggagatacaacgaccgcgaactgccaccttttaacacccacccagacgtcctcgaacgcctcgcctcccgcaaactctcgcaaaacggctggctctacgcctcgtccaacgccggactctcccacacccacctcgccaaccgacaagccttcttccggcacaagctcgtgccgagacaactaatcgacaccaacgagcggtccacgcgcatctctctgtttgacgggaaatgggaggtctcagcgccctttggcatcgcacccgtgggaatcaacaagatctaccacgatcagggagagctggcggtcgccaaggcggcgggtgagctggggctggtgtatagtttgagtacggcggggagttttcccattgaggacgtcggggaggcgaacgaagaggggagagccaaccggttcaaggccaatgagaatctagatgtggacggggaaggttcggaaggtgggaacgaaaactcgaaaaaagttcccgaagcgccccggtttttccagctctacatgcctcacgacgacaagttgacgctgagcttactcaagcgggcgcacgagtccggcttccaagcgtgtatcctgaccacggacacgtcgcagctagggtggcgacacgacgatgtcgcaacgagcaactatgctttttaccgcggcatcggcggagaactgggcttcacggatcccgtctttcaaaagagaatggccgaggccggggtggacccccagaaagacgccgtgaaggcagcgagtatgtggatcgacaccatctggcatggtcgggcgtggtcgtgggagaaggccgtgtgggcgcgcgagaagtggcaggagattgcagggaaagataaacttttcctgatcaagggaatccaaagcgtgaatgacgcgaaaaaggcggcggatttggggtttgagggcgtggtggtgagtaaccatgcgggaagacaggtggatggggcggtgggcagtttggatgcgctggagagcattgtgaaggcggttggggagaggagggggtttacggtcatgtttgatagtggggtgagaggggcggcggacgtgatgaaggcgctggcgctgggagccaagtttgtgtttattgggagactgtggatttgggggttggccatcatgggggaggaaggtgtgaggcatgtgttgaggagtctgttggcggattttgacattctcatgaatgtgatgggggtgaggagtgtggacgagattgatgcgagtcttttggaaagtgggccgagggtttatgggttgttgaatgagaagaaggtaggaggtagagtgtag

SEQ ID NO: 23426 - protein, 459 aa, Neurospora crassa
MDAKSPHIKNRDTPPWGLYQRNMFWRYNDRELPPFNTHPDVLERLASRKLSQNGWLYASSNAGLSHTHLANRQAFFRHKLVPRQLIDTNERSTRISLFDGKWEVSAPFGIAPVGINKIYHDQGELAVAKAAGELGLVYSLSTAGSFPIEDVGEANEEGRANRFKANENLDVDGEGSEGGNENSKKVPEAPRFFQLYMPHDDKLTLSLLKRAHESGFQACILTTDTSQLGWRHDDVATSNYAFYRGIGGELGFTDPVFQKRMAEAGVDPQKDAVKAASMWIDTIWHGRAWSWEKAVWAREKWQEIAGKDKLFLIKGIQSVNDAKKAADLGFEGVVVSNHAGRQVDGAVGSLDALESIVKAVGERRGFTVMFDSGVRGAADVMKALALGAKFVFIGRLWIWGLAIMGEEGVRHVLRSLLADFDILMNVMGVRSVDEIDASLLESGPRVYGLLNEKKVGGRV

SEQ ID NO: 23427 - DNA, 1563 bp, Neurospora crassa
  CDS (1)..(1563)
atgaccaaaccaccaaaagtattcacggcagaggaagttgccaaacaccgatcgccaaagagctgctgggtagtcctttacggtaatgtctatgacgtgaccgaattcctgccctctcacccggccggcgacaaaatcatcctccagctcgccggccgtgatgccacgaccgagtatgatccgattcacccgccaggcacgctcgaggagaacctcaagcccgaggccaagctaggcatcatcgacgacgcatcgctagccaagctccaccagaaagaaagcgaggcccgcgcaaaggcaacaggctcggccatgggcaccaccacgcacaccacctcagcccagcaatccgagaaagccgcgccgccgccgctccacaccctcctcaactttgacgagatcgaagcagcagccaagactcaggtctccaaaaagtgctggtcctattatttctccgccgccgatgacctttacaccaagacccacaacacccgcgccttccgggacatccttctgcgcccgcgcgtcttcatcgactgcacaaaggccgacacctccaccacgttgttgggccacaaggtcggcacaccactctacgtctcgcccgcggcgctggcccgcctggcgcacccggacggcgaagccggcatcgccaagggcatctcctcgttcggggccatgcagctagtcagcaacaacgcatccatgacgcccgagcaaatcgtggccgaggccataccgggagccgtctttggctggcagctgtacgtgcagacgactcgctcgaaatccgaggcaatgctggcgcgcatcaacaagctgcgcgaccacttcaagtgcatcgtcctcaccctcgacgcgccacacccgggcaagcgcgagcacgacgaaaagtccaaccttgaagcggcgggcgagtttgtcgagtccgccagcaacgccaagacggacgccgaaaagaagcccggcggcggcggcgtggggcaacagctgttctggggcaccgcggccgacttgacgtgggagacaacgcttccctggctgtccaagcatacggatttgccaattgtgttgaagggcatccagacgcatgaagatgcatacctggcggcgcagtatgcgaggaaacacccgggcactgtgaaagcgatcattctttcgaatcatggcgggcgcgcgctcgacacggcgccgccggcggtgcataccttgttggagatcaggaagtactgcccggaggtgtttggggcggtcgaggtgtggattgatggcggggttaagagggggacggatgtggtgaaggcattgtgtttgggtgcgaaggcggtcggtgtggggagggcggcgctttgggggcttggggctggtggatggcagggtgttgagagaacctttgatatccttcagcaggagatcattacatgcatgaagcttttgggagcaaagacggtgaatgatcttggtccacgattcatcaacacccgaaaagtcgagcgagacatctttgatggggatgccggtctcgacaagaacgggttgtggacatctcgtgccaagctctga

SEQ ID NO: 23428 - protein, 520 aa, Neurospora crassa
MTKPPKVFTAEEVAKHRSPKSCWVVLYGNVYDVTEFLPSHPAGDKIILQLAGRDATTEYDPIHPPGTLEENLKPEAKLGIIDDASLAKLHQKESEARAKATGSAMGTTTHTTSAQQSEKAAPPPLHTLLNFDEIEAAAKTQVSKKCWSYYFSAADDLYTKTHNTRAFRDILLRPRVFIDCTKADTSTTLLGHKVGTPLYVSPAALARLAHPDGEAGIAKGISSFGAMQLVSNNASMTPEQIVAEAIPGAVFGWQLYVQTTRSKSEAMLARINKLRDHFKCIVLTLDAPHPGKREHDEKSNLEAAGEFVESASNAKTDAEKKPGGGGVGQQLFWGTAADLTWETTLPWLSKHTDLPIVLKGIQTHEDAYLAAQYARKHPGTVKAIILSNHGGRALDTAPPAVHTLLEIRKYCPEVFGAVEVWIDGGVKRGTDVVKALCLGAKAVGVGRAALWGLGAGGWQGVERTFDILQQEIITCMKLLGAKTVNDLGPRFINTRKVERDIFDGDAGLDKNGLWTSRAKL

SEQ ID NO: 23429 - DNA, 2097 bp, Neurospora crassa
  CDS (1)..(2097)
atggatgaaatcaacccccttcccggcaactaccatcaagctctcaagcttatcgacgaggcacacgcccaggatccgagatcggtcgagaggaagtccggttccgtgccgtttgagctcgattatgcccagcatatgacacgctggctggcggtcagggaacctagagcgtcgcccgttttgcaacttgcatgccgggctcagcatttccgaagatgggaaatcccgcgaagcagctatcccatgactcggcccggatatctcacctggcgcgccaagctcaagtcccaagcggcaaagcaggtggccgagctgctcgcggacgcttccatccagcctccgctgagccaggaggagatcgaccgggtggccgccctggtaaggaaagaggatctcaagaccgatagcgacactcaggtccttgaggacgtcgcatgcctagtattcctggacgagcagtttgaagattttgagaagcgggcggacattgacgaggagaagatggtgggcatcttgaggaagacatggggcaagatgagtccgtctggacatgcgctggccctccagatgcacttgagcgaacgggctaagatcctgatcgaaaaggctttgggtaatgtagggagggggaggacccttttcaatagggtgatgatggcctgtatgtgcccctgccggcccggacaaccccactcccgtcccgcctccattccggggcgggggactgatggtggatccccgcctggtccaagtctcaaccgttttaaggtgtcttcagagctcggggccacttcccccgagttcattctggctattctcttgtgtcacgacccttccctccagccctcccaaccccccctccacaccctcctctcaacccacgacttcctctccgccgccgcttcatcctttccccccaaaacccacgccttcgtcacctcggccgccaccgactgccacacccaccgctccaactcgcacacttactccctcatcaccctgcggccccgcatcctccacgacgtttctcgcgtctccatttccactcgcatcctcgaccaccttgtctcctctcccatcttcgcagccgccacctctttgggaaccaccgttcaccctgatggcgaaaaggcgatcggaagggcttgtaaaaagctgggggtgggcatgacgatcagtaccagcgctagtttttccgtgggtgaaatcgcgagggctgtagaggactgtgagactgtcactgagagaaaagaaaaagaagaaaaagaagaaaaagaagaaaaagcaattccaccattgtggttccagctttatgtggacaaagaccggagcaaatccgaaaagctgctaaagcaggcggtggacgcgggggtgaaagccgtgtttttgactgttgacgcgccggtgccggggaaaagggaggcggatgagaggatttcggcggaggaagcggtagggctgtcttcttcaggggtgccgatgacgggagagaaggcggagaatgaccagtccggaggcgggctggggaggatcacaggaaagtttctggatgctagtgtctcatggggagatattgcttggttgaggaggtgtttaccagaggaggtgaagattgtgttgaagggcgtgcaaacggctgcggatgcggtcagggccatggaggcgggcgtagagggaatcgtggtgtcgaatcatggggggaggagcttggatacggcgccagcgacgattttggtattgctggagttgcaaaggtgttgtccgcaggtttttgacaagatggaggtgttggttgatggaggggtgacgcgcggtacggatgttttcaaggccttgtgtttgggcgccagtggagtggggattgggagggggatcttgtatggacttggatatggggaggaaggggtgaggagatatgtgcagatattaaatgatgagttggagacgacgatgaagatgtgtgggattacgagtctggatcaggtgcatccggggttgcttaacacgagggcggttgatcaacttgtgccagagacggttgaggaggaacatccatatgccaaatggaggccatcgctgaggaagaaggtaagttga

SEQ ID NO: 23430 - protein, 698 aa, Neurospora crassa
MDEINPLPGNYHQALKLIDEAHAQDPRSVERKSGSVPFELDYAQHMTRWLAVREPRASPVLQLACRAQHFRRWEIPRSSYPMTRPGYLTWRAKLKSQAAKQVAELLADASIQPPLSQEEIDRVAALVRKEDLKTDSDTQVLEDVACLVFLDEQFEDFEKRADIDEEKMVGILRKTWGKMSPSGHALALQMHLSERAKILIEKALGNVGRGRTLFNRVMMACMCPCRPGQPHSRPASIPGRGTDGGSPPGPSLNRFKVSSELGATSPEFILAILLCHDPSLQPSQPPLHTLLSTHDFLSAAASSFPPKTHAFVTSAATDCHTHRSNSHTYSLITLRPRILHDVSRVSISTRILDHLVSSPIFAAATSLGTTVHPDGEKAIGRACKKLGVGMTISTSASFSVGEIARAVEDCETVTERKEKEEKEEKEEKAIPPLWFQLYVDKDRSKSEKLLKQAVDAGVKAVFLTVDAPVPGKREADERISAEEAVGLSSSGVPMTGEKAENDQSGGGLGRITGKFLDASVSWGDIAWLRRCLPEEVKIVLKGVQTAADAVRAMEAGVEGIVVSNHGGRSLDTAPATILVLLELQRCCPQVFDKMEVLVDGGVTRGTDVFKALCLGASGVGIGRGILYGLGYGEEGVRRYVQILNDELETTMKMCGITSLDQVHPGLLNTRAVDQLVPETVEEEHPYAKWRPSLRKKVS

SEQ ID NO: 23431 - DNA, 1506 bp, Neurospora crassa
  CDS (1)..(1506)
atggctccccaaacaccactgaccggcgtcgaggtcgccaagcacaacacccaggatgactgctgggtcattgtccacggcaaggcctacgacatcacagagttcctccccgagcaccccggtggcatgaagatcatcctcaagtatgccggcaaggatgctaccgaggagtttgatcccatccatcccccagacactctcgagaagtacctggccaaggacaagcacctgggccccgtcgacatgtccaccgtcgtgactgagaaggccgaggttgatcccgaggagcaggcgcgcttgaagcgcattgaggagatgcccttgctcgagcagtgctacaacctgcttgactttgaggcggtggccaagagggttatgaagaagaatgcctgggcttactactctagcgcggcggatgatgaaattactcttcgcgaaaaccacgccgccttccatcgtatctggttccgccccaaggttctcgttgatgtcgaaaaggtcgacttcagcaccacgatgctcggaaccaaggttgatattcccttctacgtcacggccactgcccttggcaagctcggccacgttgagggcgaggttctgctcactcgcgccgccaagaagcacaacgtcgtccagatgatccccactctcgcctcctgcgcctttgacgagatcatggacgccgccgagggcgatcaagtccagtggctgcagctctacgtcaacaaggaccgcgccatcaccgaacgcatcatcaagcacgccgaaaagcgcggctgcaaggccctcttcatcaccgtcgatgcgccccagctcggtcgtcgtgagaaggacatgcgcgtcaagttcaccgacgacggcagcaacgtccagaagggccatgagaccaatcgcaacgagggtgcggcccgcgccatcagcagcttcatcgaccccgccctcagctggaaggacattccctggttccagagcgtcaccaagatgcccatcatcctcaagggcgtccagcgcgtcgaggatgtgatcaaggccgttgaggccggcgtgcagggtgttgtcctgtccaaccacggtggtcgccagctcgagttcgcccgctcgggcattgaggttctcgccgagaccatgccggtgctgcgcgagctcggcctggaggacaagatcgaggtctacatcgacggcggcatccgtcgcgccaccgacattctcaaggccctctgcctgggcgccaagggtgtcggtatcggtcgccccttcctgtacgccatgtcggcgtacggattcgatggtgttgaccgcgccatgcagctgctcaaggacgagatggagatgaacatgcgcctgattggcgcgaccaagatcgaggacctcaaccccggcatgctggatctcaggagtctatacaaccacggcgcgccgccaacggatacgctgtcgaacatctcgtatgatgctttgattagcccggcccagagggtcaagtttgcggaaaagtccaagatctag

SEQ ID NO: 23432 - protein, 501 aa, Neurospora crassa
MAPQTPLTGVEVAKHNTQDDCWVIVHGKAYDITEFLPEHPGGMKIILKYAGKDATEEFDPIHPPDTLEKYLAKDKHLGPVDMSTVVTEKAEVDPEEQARLKRIEEMPLLEQCYNLLDFEAVAKRVMKKNAWAYYSSAADDEITLRENHAAFHRIWFRPKVLVDVEKVDFSTTMLGTKVDIPFYVTATALGKLGHVEGEVLLTRAAKKHNVVQMIPTLASCAFDEIMDAAEGDQVQWLQLYVNKDRAITERIIKHAEKRGCKALFITVDAPQLGRREKDMRVKFTDDGSNVQKGHETNRNEGAARAISSFIDPALSWKDIPWFQSVTKMPIILKGVQRVEDVIKAVEAGVQGVVLSNHGGRQLEFARSGIEVLAETMPVLRELGLEDKIEVYIDGGIRRATDILKALCLGAKGVGIGRPFLYAMSAYGFDGVDRAMQLLKDEMEMNMRLIGATKIEDLNPGMLDLRSLYNHGAPPTDTLSNISYDALISPAQRVKFAEKSKI

SEQ ID NO: 23433 - DNA, 1809 bp, Brachydanio rerio
  CDS (151)..(1224)
aaaagaagtaacttattgagcacatcggccggaaacaactaatcaacgtgcggatgccacaatcaaaggctagttcatgtgtgaactaaactgtggttgatggttgcagtgttaaagagtcaaaatagagaagaaggtgtctgtgcagaaatgactatggtatgtctggatgattttgaggaatatgcgaagcagcacctctcaaagtctacatgggactattacgaagctggagctgatgaatgttgcacccgagatgacaacttgcaggcctataaaaggattcgcttgaggccacggatcttgcgtgacgtgtcgatcaatgacactcggacctctgtgctgggacgggaaataagctttcctgttggaattgcacccacagctttccactgcctggcctggcatgagggagaactggccactgccagagctactgaggcgttgaacacatgttatatagccagcacttacgccacatgttcagtggaggagatcgcagcagcagcacccaacggttaccgctggttccagctgtacttgtaccgcgaccggaagctttcggagcagattgtacacagagtggaggctcttggctataaggctctggtgcttacagtagacgtgccttacactggcaaacgtcgcaatgatatacgcaaccagttcaagctaccaccacacctgaaggtcaagaactttgaggggatgttccaggagcaaacagaagcccaggaggaatacgggatcccagctaatactctggacccatcgatcagctggaaggatgtttgctggctccagtctctgacacggctgcctattattatcaagggcatcctcactaaagaggacgcagagctggctgtagagcatggcgtccagggcataattgtgtctaatcatggtggccggcaactggatggagggcctgcaacgatagattgtctgcctgagatagtggacacagtgcagggccgggtcgaggtctacatggacggagggatccgtacaggcaatgacgtgctgaaggccatagccttgggagccagatgtgtgtttattggcaggccggcaatctggggcctcgcttacaagggggaggatggagtgaaagaaatcttaaatattctacatgatgagtttcgcttatccatggtgttggcaggctgcagaaatgttgctgagatcaacaggaacctcattcagttctccagactttgagaagcaaaatggactataataatttctactttaacactacaaagatccatatactattactaaatgtacacaagaaaactctgttgcttttagtcgcaagaatagcatatctacaattgttaacagtgtattgatggttttaatacttgtttttcagtaagcatcaagaacagaaaagggaaatccccacactattttcattgagagaatcaagagtgaattatctttaaaccttcactcattacagattgcttcaaatcagcttcacaacagtaaataacaaaatagaattggtattaggtacaatttaattcatgattatgaataaatcacttctaatttatctataaagcagccatacacaagataaaagtttgatcaatgcatatgctaaaagaaaagcttcttattaataagctaagtgatcggttttaataaatactgaacatacagttaatatttggtcaaaataacaagtgtggcaaaattaaacaacatgtaattctttagctgactgtgtgttaatattttaagttatattatttactttacaataaatactacgccctttcaaaaaaaaaaaaa

SEQ ID NO: 23434 - protein, 357 aa, Brachydanio rerio
MTMVCLDDFEEYAKQHLSKSTWDYYEAGADECCTRDDNLQAYKRIRLRPRILRDVSINDTRTSVLGREISFPVGIAPTAFHCLAWHEGELATARATEALNTCYIASTYATCSVEEIAAAAPNGYRWFQLYLYRDRKLSEQIVHRVEALGYKALVLTVDVPYTGKRRNDIRNQFKLPPHLKVKNFEGMFQEQTEAQEEYGIPANTLDPSISWKDVCWLQSLTRLPIIIKGILTKEDAELAVEHGVQGIIVSNHGGRQLDGGPATIDCLPEIVDTVQGRVEVYMDGGIRTGNDVLKAIALGARCVFIGRPAIWGLAYKGEDGVKEILNILHDEFRLSMVLAGCRNVAEINRNLIQFSRL

SEQ ID NO: 23435 - DNA, 1173 bp, Prochlorococcus marinus
  CDS (1)..(1173)
atgggcgctaatgtttcatcaccggcagttgtaaatattagcgatctacgcttattggcggagaaaaggcttcctagaatggtttttgactatatagatagtggtgctgatagagagcaaaccttatctcaaaattgcgcagcatttaatgaaatattttttcgtccaagatgtgctgttgcaacaccaacttgcaatttaactacttcagttcttgatcaagagtttcagcttccctttatgcttgcgccggtaggtagcagtcgtttgttttacccaaaaggagaagttgtagcagctagagaagcagggaaggcaggaacaggttatacactatccactttgtctggttgcagattagaagatgtgaaggaagcaactaactctcctgcgtggtatcagttgtatttgcttggtggccgtgatgtcgccttgaaaacaattcagcgagcgaagttggcaggcttttccgcaatagttgtgacgattgatacccctgtttcaggattaagagaacgtgatttgcttaatgggactaaagagttgctttctagaaatccaatcaaaatgcttccttatctttctcaaatggttgttaaaccctgctggatgactcagtggttgggggatggtggcttaatgagctttccaaatgttgaacttgaagatgggcccatgggctataccgaaattggccctgccttagaggcatccgttgtgacttgggaagatctcaaatggattagagaagcttggggtggcaagattgttgttaaaggtgttcatattggagatgatgctcgtaaggcccttgctttaggcgttgatgcaattgttgtatctaatcatggagcacgccaattagatagcgttgctcccactattcgtgttttacctgaggttgtaaaagctgtaaatgggaaaatagatgttttgttagatggaggtattagacgtgggggcgatgttattaaagccttatgtcttggagctaagggagtgttgattggtagggcatatgcttatgggttagccgctgctggcgggccaggtgttgcgagggcaattgaaattattaaaactgatgttttacgtacgatgaaattattagggtgcgattcagtaaaaagtttaaataattcttttataactattcctgaaagttggaaatag

SEQ ID NO: 23436 - protein, 390 aa, Prochlorococcus marinus
MGANVSSPAVVNISDLRLLAEKRLPRMVFDYIDSGADREQTLSQNCAAFNEIFFRPRCAVATPTCNLTTSVLDQEFQLPFMLAPVGSSRLFYPKGEVVAAREAGKAGTGYTLSTLSGCRLEDVKEATNSPAWYQLYLLGGRDVALKTIQRAKLAGFSAIVVTIDTPVSGLRERDLLNGTKELLSRNPIKMLPYLSQMVVKPCWMTQWLGDGGLMSFPNVELEDGPMGYTEIGPALEASVVTWEDLKWIREAWGGKIVVKGVHIGDDARKALALGVDAIVVSNHGARQLDSVAPTIRVLPEVVKAVNGKIDVLLDGGIRRGGDVIKALCLGAKGVLIGRAYAYGLAAAGGPGVARAIEIIKTDVLRTMKLLGCDSVKSLNNSFITIPESWK

SEQ ID NO: 23437 - DNA, 1146 bp, Haemophilus ducreyi
  CDS (1)..(1146)
atgattattgcatcagcaaatgactatcgtgaagcggctcgccgtcgtgttcccccgtttatgttccactatgcagatggtggttcattttccgaacgtactttagcgcgtaatgtaagtgatttagccgatcttgcacttcgccaacgagtattaaaagatatgtcgcaattgaacacggaaattgaattgtttggcgaaaagctcgcaatgccaattgttttagcgcctgttggtgcgttaggaatgtatgctcgtcgcggagaagtacaagctgcacaagccgctgaaaataaaggcttgccgtttacattatcgacagtttcagtttgtcctattgaagaagttactccagcaattaaaagaccaatgtggtatcaactctatgtgttgaaagatcgtggttttatgaaaagtgtgttagaacgggcaaaagcagcaggttgttcaacattagtatttactgtggatatgccaaccccgggagcacgttatcgtgatttgcattcgggtatgagcggtaagtacaaagaaattcgccgagtgctacaagctatgacacatcctcgttgggcgtgggacgttggtataaatggtaagccacatacattaggtaatgtttcaggctataccggtaaatcggtcggtttagatgattatgcggtatggttagcggataattttgatccatccatttcatggaaagatttagagtggatccgtgatttctgggacggcccgatggtgattaaaggcattttagatgttgaagatgcgaaagatgcggttcgttttggtgcggatgggattgtcgtatctaaccacggtggacgccaactagatggtgcattatcgagtgctaaagcattaccttccattgctgatgcagtgaaaggcgagatcaaaattctagctgactcaggtattcgaaatggtctagatgtcgtgcgtatgatcgcattaggcgctgatgctacactgattggccgtgcatttgtttatgcattatcagcagctggacgcgcaggtgtagaaaatatgttagatattttcagaaaagaaatgcacgttgcaatgacgttaacaagtaatgcgagaattagtgatattaatcgtgatgcattagttgatctgactaaaatataa

SEQ ID NO: 23438 - protein, 381 aa, Haemophilus ducreyi
MIIASANDYREAARRRVPPFMFHYADGGSFSERTLARNVSDLADLALRQRVLKDMSQLNTEIELFGEKLAMPIVLAPVGALGMYARRGEVQAAQAAENKGLPFTLSTVSVCPIEEVTPAIKRPMWYQLYVLKDRGFMKSVLERAKAAGCSTLVFTVDMPTPGARYRDLHSGMSGKYKEIRRVLQAMTHPRWAWDVGINGKPHTLGNVSGYTGKSVGLDDYAVWLADNFDPSISWKDLEWIRDFWDGPMVIKGILDVEDAKDAVRFGADGIVVSNHGGRQLDGALSSAKALPSIADAVKGEIKILADSGIRNGLDVVRMIALGADATLIGRAFVYALSAAGRAGVENMLDIFRKEMHVAMTLTSNARISDINRDALVDLTKI

SEQ ID NO: 23439 - DNA, 1197 bp, Bordetella pertussis
  CDS (1)..(1197)
atgaaaacccatgacgccctgcagcgccgcgcgctgtgcatcgacgacctgagagcgtgggccaggaaggcgctgcccaagggcttgttcgagttcgtcgaccgcggaacggaggacgagttcctgttgtcgcgcaaccgccgcagcctggacgaactgcggctgctgcccagggtgatgcgcgatgtctcgcgcaggaactgctcgacccattacttcggccaggcgagttcgatgcccatgatcatcgcgcccaccggcgcggccggcctgctggcctacgagggggaatacctgatggccaaggccgccgcgcgcgccggcatccccttcgtgctttccacggcgtccatcgtctccatggaacgggtggcccaggccggcggcgatctgtggttccagctttacatgctgccggacctgggggcgtcctatcggctcatggaccgcgcccgcaacgcgggttaccgggccctcatggtgaccctggacacgccggtgtcgcccaaccgcgaatacaacgtcaggaaccatttcaccctgccgatgcaaatctccagccgcaacgcgctggacgtgatgcggcggccggcctggatctggaacgtgttcttccgctacctcttgcgcaacggcgtgccgatgctggagaactacccggacgaataccgccagcgcctggacgcgtcgggcaagggccgcatgtcgctgcccaagacggactcgatcacctgggagagcctgcgtgcgctgcgccgtcattggcgcggtccgctgatcgccaagggcatcctgcatccggaggatgcccggatggcgcgcgactgcggcgtcgacgccatcgtcgtctccaaccatggcgggcgcaacttcgatgcggcggccacgccgatcgaggcgctgccgcgcatcgtcgacgagatcgcagacaaggccgaggtcttcgtcgacagcggttttcgccgcggcgtcgatgtggccaaggcgcttgcgctgggcgcgcgcggcgtgctgctgggccgcgcgccgctatggggcgtggccagcgccggcgaacccggcgcattgcatgcgttggaactgatgcgcgaagagctgcttcgaagcatggcgtttctcggctgcgaaagcctggcggcgctggaccgcgggctgctggcgccggccacgctgccgcgcaatggaggatggccatga

SEQ ID NO: 23440 - protein, 398 aa, Bordetella pertussis
MKTHDALQRRALCIDDLRAWARKALPKGLFEFVDRGTEDEFLLSRNRRSLDELRLLPRVMRDVSRRNCSTHYFGQASSMPMIIAPTGAAGLLAYEGEYLMAKAAARAGIPFVLSTASIVSMERVAQAGGDLWFQLYMLPDLGASYRLMDRARNAGYRALMVTLDTPVSPNREYNVRNHFTLPMQISSRNALDVMRRPAWIWNVFFRYLLRNGVPMLENYPDEYRQRLDASGKGRMSLPKTDSITWESLRALRRHWRGPLIAKGILHPEDARMARDCGVDAIVVSNHGGRNFDAAATPIEALPRIVDEIADKAEVFVDSGFRRGVDVAKALALGARGVLLGRAPLWGVASAGEPGALHALELMREELLRSMAFLGCESLAALDRGLLAPATLPRNGGWP

SEQ ID NO: 23441 - DNA, 1182 bp, Bordetella pertussis
  CDS (1)..(1182)
atgcggcctggccatcgccgccgtttctggagctctcatgtcgtcttccgcactgcccctgtccgccgcctccgccgcccgcgccgccgcctgccgcggccgattttcggctacgtggcgggcgcggccgaggataaccaggcacacgacgacaaccggcgcgccttcgccgaatacggattcctgccgcgcgtgctggtggacgtctcggcgcgtcatacgcgcaccgagctcttcggccaggaatgggccgcgccctttggcgtcgcccccatgggcatcagcgccctgtcggcctaccgcggcgacatcgtgctggcccgcgcggcgcgcgcggcgggcatccccgccatcatgagcggatcgtcgctcatcccgctcgaggaagtggcgcgccaggcgccgggcacctggttccaggcctacctgcccggcgaccccgggcgcatcgacgcgctggtcgagcgcgtggcgcgcgccggctactggacgctggtgctgaccgtggacattccagtctcggccaaccgcgagaacaatgtgcgcacgggcttctccaccccgctcaagcctggcctgcggctggcttgggacggcctgagccgcccgcgctggctggccggcaccttcctgcgcaccctgctggcgcacgggatgccgcatttcgagaactcgttcgccacgcgcggcgcgcccatcctgtcggccaacgtgctgcgcgatttctcggcgcgcgaccacctggactggagccatgtgcagcgcatccgccggtcctggcgcggcgagctggtcatcaagggcatcatgcatccgcgcgacgccgccctggcgcgcgcccatggggccgacggcatcatcgtctcgaaccacggcgggcgccagctcgatggcgcctgcgcgcccctgcgcgtgctgcccgacatcgccgaggcggccggcgccatggccgtcatgatggacagcggcatccggcgcggcggcgacgtgctcaaggcgctggcgctgggggcgcgcttcgtgttcctgggccggcccttcaactatgccgccgcggtgggcggcgaagccggcgtggcgcacgccatcggcctgctgcgcgaggagatcgaccgcaacatggccatgctgggcgtgacgcgctgcaccgccatggcgcccgggctgctgcgccgtctgtaa

SEQ ID NO: 23442 - protein, 393 aa, Bordetella pertussis
MRPGHRRRFWSSHVVFRTAPVRRLRRPRRRLPRPIFGYVAGAAEDNQAHDDNRRAFAEYGFLPRVLVDVSARHTRTELFGQEWAAPFGVAPMGISALSAYRGDIVLARAARAAGIPAIMSGSSLIPLEEVARQAPGTWFQAYLPGDPGRIDALVERVARAGYWTLVLTVDIPVSANRENNVRTGFSTPLKPGLRLAWDGLSRPRWLAGTFLRTLLAHGMPHFENSFATRGAPILSANVLRDFSARDHLDWSHVQRIRRSWRGELVIKGIMHPRDAALARAHGADGIIVSNHGGRQLDGACAPLRVLPDIAEAAGAMAVMMDSGIRRGGDVLKALALGARFVFLGRPFNYAAAVGGEAGVAHAIGLLREEIDRNMAMLGVTRCTAMAPGLLRRL

SEQ ID NO: 23443 - DNA, 1164 bp, Bordetella parapertussis
  CDS (1)..(1164)
atgacccagaacctttctacgatcacctgcatcgaagatctgcgcgtcatcgcgcaaaagcgcgtgccgcgcatgttctacgactacgccgattcaggcgcctggacggaaagcacctatcgcgccaacgaaagcgacttccagcgcatcaagctgcgccagcgcgtcgccgtcgatatggaaggccgttcgctgcgcaccaccatggcgggcagcgacgccgtgatgccggtggccatcgcgcccaccggcctgaccggcatgcagcacgccgacggcgagatcctggccgcgcgcgccgccgccgagttcggcgtgccgttcaccttgtcgaccatgagcatctgctcgatcgaggacgtcgcccagggcagcggcaagcccttctggttccagctctacgtcatgcgcgaccgcgagttcgtcggcgacctgatcgatcgggccaaggcggcggggtgctcggcgctggtgctgacgctggacctgcagatcctcggccagcgccacaaggacatcaagaacggcttgtccgcgccgcccaagccgacgctgcgcaacctgatcgacctggcgttcaagccgcgctggtgcctgggcatgctgggcacgcggcgacgcaccttcggcaacatcgtcggccacgccaagggcgtgaccgacctgtcgtcgctgtcgtcctggacggccgagcagttcgacccgcgcctgagctgggacgatgtcgaatggatcaagcggcgctggggcggcaagctgatcctcaagggcatcctggatgccgaggacgcccgtctcgcggccgagagcggcgccgacgccctgatcgtcagcaaccatggcggccgccagctcgatggcgcgatttcctccatcaacgccctgccggccatcgcggaggcggtcggctcgcgtatcgaagtgtggatggacggcggcatccgctccggccaggatgtgctcaaggcggtggcgctgggcgcgcgcggcaccatgatcgggcgggcgttcctctatggcctgggcgcctacggccaggccggcgtgacgcgggcgctcgagatcctctacaaggaaatggacgtcaccatggcgctgtgcggccacaagcacatcagccagatagaccgcggcatcctgatgccgggcacctatccgcagtaa

SEQ ID NO: 23444 - protein, 387 aa, Bordetella parapertussis
MTQNLSTITCIEDLRVIAQKRVPRMFYDYADSGAWTESTYRANESDFQRIKLRQRVAVDMEGRSLRTTMAGSDAVMPVAIAPTGLTGMQHADGEILAARAAAEFGVPFTLSTMSICSIEDVAQGSGKPFWFQLYVMRDREFVGDLIDRAKAAGCSALVLTLDLQILGQRHKDIKNGLSAPPKPTLRNLIDLAFKPRWCLGMLGTRRRTFGNIVGHAKGVTDLSSLSSWTAEQFDPRLSWDDVEWIKRRWGGKLILKGILDAEDARLAAESGADALIVSNHGGRQLDGAISSINALPAIAEAVGSRIEVWMDGGIRSGQDVLKAVALGARGTMIGRAFLYGLGAYGQAGVTRALEILYKEMDVTMALCGHKHISQIDRGILMPGTYPQ

SEQ ID NO: 23445 - DNA, 1209 bp, Bordetella parapertussis
  CDS (1)..(1209)
atgtcgtcttccgcactgcccctgtccgccgcctccgccgcccgcgccgccgccgttcccgcctcgctgcgcaagctgctgtcgctcaatgacttcgaagcggcggcgcggcgccgcctgccgcggccgattttcggctacgtggcgggcgcggccgaggacaaccaggcactcgacgacaaccggcgcgccttcgccgaatacggattcctgccgcgcgtgctggtggacgtctcggcgcgccatacgcgcaccgagctcttcggccaggaatgggccgcgccctttggcgtcgcccccatgggcatcagcgccctgtcggcctaccgcggcgacatcgtgctggcccgcgcggcgcgcgcggcgggcatccccgccatcatgagcggatcgtcgctcatcccgctcgaggaagtggcgcgccaggcgccgggcacctggttccaggcctacctgcccggcgaccccgcgcgcatcgacgcgctggtcgagcgcgtggcgcgcgccggctaccggacgctggtgctgaccgtggatattccagtctcggccaaccgcgagaacaatgtgcgcacgggcttctccaccccgctcaagcctggcctgcggctggcttgggacggcctgagccgcccgcgctggctgaccggcaccttcctgcgcaccctgctggcgcacgggatgccgcatttcgagaactcgttcgccacgcgcggcgcgcccatcctgtcggccaacgtgctgcgcgatttctcggcgcgcgaccacctggactggagccatgtgcagcgcatccgccggtcctggcgcggcgagctggtcatcaagggcatcatgcatccgcgcgacgccgccctggcgcgcgcccatggggccgacggcatcatcgtctcgaaccacggcgggcgccagctcgatggcgcctgcgcgcccctgcgcgtgctgcccgacatcgccgaggcggccggcgccatggccgtcatgatggacagcggcatccggcgcggcggcgacgtgctcaaggcgctggcgctgggggcgcgcttcgtgttcctgggccggcccttcaactatgccgccgcggtgggcggcgaagccggcgtggcgcacgccatcggcctgctgcgcgaggagatcgaccgcaacatggccatgctgggcgtgacgcgctgcaccgccatggcgcccgggctgctgcgccgtctgtaa

SEQ ID NO: 23446 - protein, 402 aa, Bordetella parapertussis
MSSSALPLSAASAARAAAVPASLRKLLSLNDFEAAARRRLPRPIFGYVAGAAEDNQALDDNRRAFAEYGFLPRVLVDVSARHTRTELFGQEWAAPFGVAPMGISALSAYRGDIVLARAARAAGIPAIMSGSSLIPLEEVARQAPGTWFQAYLPGDPARIDALVERVARAGYRTLVLTVDIPVSANRENNVRTGFSTPLKPGLRLAWDGLSRPRWLTGTFLRTLLAHGMPHFENSFATRGAPILSANVLRDFSARDHLDWSHVQRIRRSWRGELVIKGIMHPRDAALARAHGADGIIVSNHGGRQLDGACAPLRVLPDIAEAAGAMAVMMDSGIRRGGDVLKALALGARFVFLGRPFNYAAAVGGEAGVAHAIGLLREEIDRNMAMLGVTRCTAMAPGLLRRL

SEQ ID NO: 23447 - DNA, 1194 bp, Bordetella bronchiseptica
  CDS (1)..(1194)
atgagcgctcgccccggcctggagtcggcattggcctgcgtgcacgactatcggtcgctggcgcggcgccggctgtcgcgtttcgcgttcgattacctggaaggcggcgccgaggacggcaggacgctgcggcgcaacctggccgcctacggcaagctggtgttcaacccgcgggtattgacggacgtcagcgcggtcgacacccgcgtgccggtgctggggcgcgagcagcactcgcccatgatcgtcggcccgaccggcctgaacgggctgtactggccccgcgcggacgaggcgctggcccgcgcggcgcatgcggccggcctgccgttcgtgctgtcgacggcctcgacctcgctgatcgaggacgtgcgcgcggccagcgcgggcgacctgtggctgcaactgtacgtgcagaccgatcgctcgatcgccgagaccatgatgcgccgcgcccgcgaggcgcgcttttcgacgctgatggtgacggtggatacgccggtgcatggcacccgcgaccatgatgtgcgcaatggctttcgcctgcccctgcggcccggaccgcggctgatgctggatttcgccgcgcatccgcgctggtgcctgcgcatgctgcgccagcgcggcgggccgcagctggtcaacctggcgcgcagcatgggcgagcaggccagcctgaaccggcaggccgccgccatgagccggcagatggacatggggctgggctgggacgcgctgccatggctgcgccggcactggcaggggccggtgctggtaaagggcatcctgtcggtcgaggacgcgcgcctggcgctgcgccacggcgccgatggcattgtcctgtccaaccacggcgggcggcagctcgagggcgcgcccagcgcgctggaggtattgccgcgcgtcatggacgcggtggggacgcggcttgccgtgctggtcgatggcggggtgcggcgcggcagcgacgtggccaaggcccgcgccctgggcgcgcaggccgtgctgctgggccgtgcgccgctgtacgggctggccgcgcgcgggccgcgcggcgtggccgaggtcctggccatcctgcagcgcgagctggagacgacgctgcggctggtcggctgccccgcggcgcggcggctgggcgatcatgcgctgctgccggttcgcgatgaccccgcgcaggagaccgcgccgtga

SEQ ID NO: 23448 - protein, 397 aa, Bordetella bronchiseptica
MSARPGLESALACVHDYRSLARRRLSRFAFDYLEGGAEDGRTLRRNLAAYGKLVFNPRVLTDVSAVDTRVPVLGREQHSPMIVGPTGLNGLYWPRADEALARAAHAAGLPFVLSTASTSLIEDVRAASAGDLWLQLYVQTDRSIAETMMRRAREARFSTLMVTVDTPVHGTRDHDVRNGFRLPLRPGPRLMLDFAAHPRWCLRMLRQRGGPQLVNLARSMGEQASLNRQAAAMSRQMDMGLGWDALPWLRRHWQGPVLVKGILSVEDARLALRHGADGIVLSNHGGRQLEGAPSALEVLPRVMDAVGTRLAVLVDGGVRRGSDVAKARALGAQAVLLGRAPLYGLAARGPRGVAEVLAILQRELETTLRLVGCPAARRLGDHALLPVRDDPAQETAP

SEQ ID NO: 23449 - DNA, 1101 bp, Nonomuraea sp
  CDS (1)..(1101)
atgcacgaaagtcccgtctgcctcgccgagtacgaggagatcgccgccaaggtcctccccgccgacgtccgggacttcatcgacggcgggagcggccgcgagcagaccctccgtgcgaatcgggccgccttcgaccgggtgttcctggtgccgcgggtgctccaggacgtgtcggcgtgctccacccgtgcgacgctgctgggccaccccgcgacgatgccggtggcggtggcccccgtcgcctaccaccggctcgtgcatcccgacggtgagctggcgacggcccgggcggcgcgggacgccggggtcccgttcaccgtcagcaccttgagcagcgtcccggtggaggacgtcaccgccctggggggacacgtctggttccagctctactgccttcgcgagcacgccgccaccctcggcctgatccgccgggccgaggacgcggggtgccgggcgttgatgctcacgctcgatgtgccgtggatgggccgcaggccacgtgacatccgcaaccggttccgcctgcccccgcacgtgcggcccgtgcacctgacggcgaactccgggaccgaggctcatcggggtgcctccggcggctccgcgctggcggcgcacacggccatggagctctccgccgcggtggactggtcgtacctcgagaccctccgggccgccagcgggctcccgctggtggtcaagggcattctgcaccccgaggacgcccgccgcgccgcggacctcggcatcgacggcatcgtggtctccaaccacggcggacgtcagctcgacggcgccgtggccagtctcgacgcgctgccgggggtggcggagagcgtcgggggccgctgcgagatcatgctcgatggtggcgtccggtcgggagccgacgtcctcaaggcgctggcgctcggggcgtcgggtgtgctcgtcggacgccccgtgatctggggtctggccgcggacggcgaacggggggtccgtacggtgctcggcctcctgggtgccgagatcgaggacgggctcggcctggcaggctgcggcgacgtcgccgcagcccaggcactcaggacgacccgccccggcgcggggttcgtctcctga

SEQ ID NO: 23450 - protein, 366 aa, Nonomuraea sp
MHESPVCLAEYEEIAAKVLPADVRDFIDGGSGREQTLRANRAAFDRVFLVPRVLQDVSACSTRATLLGHPATMPVAVAPVAYHRLVHPDGELATARAARDAGVPFTVSTLSSVPVEDVTALGGHVWFQLYCLREHAATLGLIRRAEDAGCRALMLTLDVPWMGRRPRDIRNRFRLPPHVRPVHLTANSGTEAHRGASGGSALAAHTAMELSAAVDWSYLETLRAASGLPLVVKGILHPEDARRAADLGIDGIVVSNHGGRQLDGAVASLDALPGVAESVGGRCEIMLDGGVRSGADVLKALALGASGVLVGRPVIWGLAADGERGVRTVLGLLGAEIEDGLGLAGCGDVAAAQALRTTRPGAGFVS

SEQ ID NO: 23451 - DNA, 1170 bp, Streptomyces avermitilis
  CDS (1)..(1170)
atggccaagcactgggccgacttccagtacgagatctatctgaacggaatgacgggtgccgtaccgcggctgcccaccgatctgactcggctggaggaactcaccgagcagcggctcggccccggtccggtcggctatgtggcgggcggcgcgggcaatggcagcaccgcccgcgccaaccggtccgcgctcgaccggcgccggatcgtgccccggatgctgcgtgatgtgcacgaacgcgacctgtccgtcgaggtgttggggcggacgctgcccgcgccgctggcgctcgccccggtcggcgtgctgtcgatcatgcacccggacgcggagtccgccgccgcgcgggccgccgccgcgcagggtgtcccgtacatcctgtcctcggcctccagcacccccatggagcgggtcgcggaggcgatgggcgacgcggagcgctggttccagctgtactgggcgaaggaccgcgaggtcacccggagcttcctgaaccgggcgaaggcggccgggtacaccgcgctgttcgtcaccctcgacacgccgctgctggcctggcggccgcgggatctcgaccaggcgtatctgccgttcctgcacggcgtgggcaccgccaactacttcaccgacccggcgttccgggcgggcctggccaagccggtgcacgaggatccgaacgctgccgtgatgcacttcgtgagcatgttcgcggaccccggcaagacctggcccgacctcgagttcctgcgggagaactgggacggcccgatcgtcctcaagggcatcctgcacccggacgacgcccggcgggccgcgagcgccgggatggacggtgtggtcgtctccaaccacggcggccgccaggtcgccggttccgtggcggcggccgacgcgctgccgcgtgtggtggaggcggcgggcgaccggctgaccgtcctcttcgacagtgggatccgcacgggcgacgacatcttcaaggcgctcgcgctcggcgcgcgggcggtgctcgtcggacgaccgtacgcgtacgggctcggactcgacgggcaggcgggcgtcgagcacgtcgtgcgctgtctgctcgccgagttcgacctcaccctggcgctgtccgggcacgccgggccggggacgctcagccccgacgacctgatcgaggaaaccgtatga

SEQ ID NO: 23452 - protein, 389 aa, Streptomyces avermitilis
MAKHWADFQYEIYLNGMTGAVPRLPTDLTRLEELTEQRLGPGPVGYVAGGAGNGSTARANRSALDRRRIVPRMLRDVHERDLSVEVLGRTLPAPLALAPVGVLSIMHPDAESAAARAAAAQGVPYILSSASSTPMERVAEAMGDAERWFQLYWAKDREVTRSFLNRAKAAGYTALFVTLDTPLLAWRPRDLDQAYLPFLHGVGTANYFTDPAFRAGLAKPVHEDPNAAVMHFVSMFADPGKTWPDLEFLRENWDGPIVLKGILHPDDARRAASAGMDGVVVSNHGGRQVAGSVAAADALPRVVEAAGDRLTVLFDSGIRTGDDIFKALALGARAVLVGRPYAYGLGLDGQAGVEHVVRCLLAEFDLTLALSGHAGPGTLSPDDLIEETV

SEQ ID NO: 23453 - DNA, 1086 bp, Nitrosomonas europaea
  CDS (1)..(1086)
atgggcgagttactgcctaagcttgcaaccattccggaaggaatacaaagcgcagccgattacctgcctttagccagagaacgcctgctgccggcagtctggcactacctggaagaaggcagcggcaatcaggtaacactgcacaccaataactgcgtattcgattcgatccggcttataccccggcccatggccgatgtgcgagacggtcatacccgtatcaccctgtttggccagacactggcacatcctgtcatcctggcaccactcgcctaccagcgcctgtatcacccgcatggagaatcggccagcgccatggcggccaacgcacaggggggacaactgtgtgtaagcagcctggcaagccagacactggaagaaatcatcactgcagccgggcagcctttatggtttcagttgtattggcaggaagatcgtccgagaacactgaaactattgcgccgggccgttaccgcgggctatcaggcgatcgtattcacggtggatgcaccgatcaaacaggcaaccattcaactgcccgccagcatcagcgcggtcaatctggatacaccagcgccgtttccggcacttctgccgcatcaaagccaggtattcaatggctggatggcgcaagcgccccgctgggaggatcttgcctggctgagagcgcaaacctcgttgccactgctggtaaagggcatcctgcatccggaggatgccaggaaggtgataaatctgggatacgatggactagtagtctccaaccatggcgggcgcgtgctggatggcgctcctgcgagcctggcgtgtcttccggaaatcgtcagcactgtatccggccggggaaaggtattgttcgacagcggtatccgcaatgggcgcgatatttataaagcgctggcgctcggagccgatgccgtactgattggccgtccctacatctgggggctggcaacggtcggtgctctgggtgtggcccatgtcatccgcctgctgagggatgaactggaaatgaccatggcacttaccggcacagccagtattagagaaattacccgggagaaaataatttctgatcgggactga

SEQ ID NO: 23454 - protein, 361 aa, Nitrosomonas europaea
MGELLPKLATIPEGIQSAADYLPLARERLLPAVWHYLEEGSGNQVTLHTNNCVFDSIRLIPRPMADVRDGHTRITLFGQTLAHPVILAPLAYQRLYHPHGESASAMAANAQGGQLCVSSLASQTLEEIITAAGQPLWFQLYWQEDRPRTLKLLRRAVTAGYQAIVFTVDAPIKQATIQLPASISAVNLDTPAPFPALLPHQSQVFNGWMAQAPRWEDLAWLRAQTSLPLLVKGILHPEDARKVINLGYDGLVVSNHGGRVLDGAPASLACLPEIVSTVSGRGKVLFDSGIRNGRDIYKALALGADAVLIGRPYIWGLATVGALGVAHVIRLLRDELEMTMALTGTASIREITREKIISDRD

SEQ ID NO: 23455 - DNA, 1486 bp, Zantedeschia aethiopica
  CDS (100)..(1203)
gctccgttggcttctcctttttcctcccacgctcttctgtgcacatagcggctacagggcagagtcgtaggtgctgtgtggggggagtgagctgcgagcatggagatcactaatgtcagcgagtatgaggcggttgccaaggataagctgccgaagatggtgtacgactactatgcttctggcgcagaggaccagtggaccctcaaggagaacagaaacgccttctctaggattctgtttcggcctcgcatactcatcgacgtaaccaagatagatatgaccaccaccgtactgggatacaagatatcgatgcccatcatgatcgctcccactgccatgcagaagatggctcaccttgatggagagtacgccacggcaagggcagcatcagcagctggcacaattatgacattatcatcttgggctacatctagtgttgaagaggttgcctcaactgggcctggcattcgcttctttcagctctatgtttacaaggacaggaatgtggtggcgcagcttgttagaagagctgaaagggctggcttcaaggccattgccctcacggtggacactccaaggcttggacggagggaatcggatatcaagaacaggtttactctacctccgcatttgaccctcaaaaactttgaggggttggacctcggcaagatggataagagtaatgactctggactggcgtcgtacgttgctgggcaaattgatcggtccctaagttggaaggatgtcaagtggctgcagacgatcacctcaatgccaattttggtcaaaggagtcatgaccgctgaggacacaaggttggccgtacaagccggggctgctggcatcatcgtctccaaccacggggctcgccagctcgattacgttccagcaaccatcagttgtctggaagaggttgtgaaagctgcacaaggccgggttcccgttttcctggacggtggcgttcgtcgtggaacggatgtcttcaaggctttggcactgggagcttctgggatatttattgggaggccggtggtgttctctttggctgcggaaggtgaggctggtgtgaggaaggtgcttcaaatgctccgcgaggagttcgagctcaccatggcactcagtggatgcctctcgctcaaggacatcacacgcaaccacatcctcactgagggggacgttcaccgcacagcgtccaggttataagagactacatcatcacaaataatctccattaatgtgatgaatagattctacacttgaggtggccgcacacgttgtttggttcgacaaaggtatggctgagagctctaagttctactggctcatgatgattaccgctgctagttaagaaggggagccttatttgaaattccttgttcataaaataaatgcctctggagtacttctaaactcgtcttatgagctgctctttttacttgatatatacaagggatatattcagtcccaaaaaaaaaaaaaaaaaaaa

SEQ ID NO: 23456 - protein, 367 aa, Zantedeschia aethiopica
MEITNVSEYEAVAKDKLPKMVYDYYASGAEDQWTLKENRNAFSRILFRPRILIDVTKIDMTTTVLGYKISMPIMIAPTAMQKMAHLDGEYATARAASAAGTIMTLSSWATSSVEEVASTGPGIRFFQLYVYKDRNVVAQLVRRAERAGFKAIALTVDTPRLGRRESDIKNRFTLPPHLTLKNFEGLDLGKMDKSNDSGLASYVAGQIDRSLSWKDVKWLQTITSMPILVKGVMTAEDTRLAVQAGAAGIIVSNHGARQLDYVPATISCLEEVVKAAQGRVPVFLDGGVRRGTDVFKALALGASGIFIGRPVVFSLAAEGEAGVRKVLQMLREEFELTMALSGCLSLKDITRNHILTEGDVHRTASRL

SEQ ID NO: 23457 - DNA, 1188 bp, Streptococcus pyogenes
  CDS (1)..(1188)
atgtcaatggcacaaaaaacagtcatcaccgaagaaacaaccgattttgttatggatttcaaaacaagtagcgctgagggaaatgttgattttattaacgtttttgaccttgagaaaatggcacaacaggtcatccctaaaggagcctttggttatattgctagtggtgctggtgatacctttaccctccatgaaaatattcgctcatttaatcataaattaattgtccctcactccctcaaaggggttgaaaatccgtcaacagagattacgtttgatggtgattacttaacctctcctcttattttagcacctgtagcggctcataaactggccaatgaacaaggagaagtagcgtctgctaaaggattgaaagaatttggaagtatctacaccactagttcctactcaacaactgacctgccagaaatcagtgctgccttaggtgggacaccccattggtttcaattttattacagtaaagacgatggcattaatcgtaatattatggatcgtgtcaaagcacaaggttgcaaagctatcgttttgacagcagatgcaacagttggaggaaaccgcgaagttgataggcgaaacggttttgtttttccggtcggtatgccaattgttcaagaatatttacctgatggtgcaggtaaaacaatggattatgtctataaatcagctaaacaagcgcttacctcaaaagatattgaatatatcgcaacctactcaggcctgcctgtttatgtcaaaggaccacagtgtgctgaggataccttgcgggcattggacgcaggagcatcaggtatctgggtaaccaatcatggtggccgtcaattagatggtggtccagctgcttttgattccttacaagaagtcgctgaagcagttgatcacaaagttcctattgtctttgactcaggtataagatggggtcaacatattttcaaagctcttgcttcaggtgctgaccttgttgccttggggcgtccagcgatttacggcttggctatgggaggaagcattggtactcgtcaggtctttgaaaagttaaatgacgagttaaaaatggtcatgcaactggctgggacacaaactatccaagatgttaaagcctttaaccttcgccataatccgtatgattcatcgattccatttgatcaaaatgcgctacgcttagattag

SEQ ID NO: 23458 - protein, 395 aa, Streptococcus pyogenes
MSMAQKTVITEETTDFVMDFKTSSAEGNVDFINVFDLEKMAQQVIPKGAFGYIASGAGDTFTLHENIRSFNHKLIVPHSLKGVENPSTEITFDGDYLTSPLILAPVAAHKLANEQGEVASAKGLKEFGSIYTTSSYSTTDLPEISAALGGTPHWFQFYYSKDDGINRNIMDRVKAQGCKAIVLTADATVGGNREVDRRNGFVFPVGMPIVQEYLPDGAGKTMDYVYKSAKQALTSKDIEYIATYSGLPVYVKGPQCAEDTLRALDAGASGIWVTNHGGRQLDGGPAAFDSLQEVAEAVDHKVPIVFDSGIRWGQHIFKALASGADLVALGRPAIYGLAMGGSIGTRQVFEKLNDELKMVMQLAGTQTIQDVKAFNLRHNPYDSSIPFDQNALRLD

SEQ ID NO: 23459 - DNA, 1146 bp, Pseudomonas putida
  CDS (1)..(1146)
atgatcatttctgcctctaccgactatcgcgccgcggcccaacgcaagctgccccccttcctgttccactacgctgacggcggcgcctacgccgagcacaccctgcgccacaacgtctcggacctggccggcatcgccctgcgccagcgcgtgctgaacaacatgtccgagctcagcctggaaaccaagctgttcgacgaaaccctgagcatgccggtggccttggccccggtcggcctcaccggcatgtacgcccgccgtggcgaagtgcaggccgcacgcgcagcggcggcccatggcatcccgttcaccatgtcgactgtgtcggtgtgcccgatcgaagaagtggcacccgccatcaaccggccgatgtggttccagctgtatgtactcaaggaccgcggcttcatgcgcaatgccctggagcgcgccaaggccgccggcgtcaagaccctggtgttcaccgtggacatgcccgtacccggtgcccgctaccgcgacgcccactctggcatgagcggcaagaacggcccgctgcgccgcgtgctgcaagccatgacccaccccgagtgggcatgggatgtgggcgtgatgggccgcccgcatgacttgggcaacatctccaaataccgtggcaaccccaccggccttgccgactacatcggctggctgggcaacaacttcgacccgtccatttcctggaaagacctggagtggatccgcgagttctgggacggcccgatgatcatcaagggcattctcgatgccgatgacgcccgcgatgcggtcaagttcggtgccgacggtatcgtggtgtccaaccacggcggccgccagctcgacggcgtgctgtccagcgcccgtgccctgccggccattgccgacgcggtcaaaggcgacctgaagattctggccgactcgggcattcgcagcggcctggacgtggtgcgcatgatcgccctgggtgccgacaccgtactgatcggccgcgccttcctttacgcccttgccgtgcatggccaggccggcgtgaaaaacctgcttgagctgttcgaaaaggaaatgcgcgtggccatggtgctgaccggtgccaagtcgatcagcgagatcacccgcgactcgctggtacgcgaactgggcgcctag

SEQ ID NO: 23460 - protein, 381 aa, Pseudomonas putida
MIISASTDYRAAAQRKLPPFLFHYADGGAYAEHTLRHNVSDLAGIALRQRVLNNMSELSLETKLFDETLSMPVALAPVGLTGMYARRGEVQAARAAAAHGIPFTMSTVSVCPIEEVAPAINRPMWFQLYVLKDRGFMRNALERAKAAGVKTLVFTVDMPVPGARYRDAHSGMSGKNGPLRRVLQAMTHPEWAWDVGVMGRPHDLGNISKYRGNPTGLADYIGWLGNNFDPSISWKDLEWIREFWDGPMIIKGILDADDARDAVKFGADGIVVSNHGGRQLDGVLSSARALPAIADAVKGDLKILADSGIRSGLDVVRMIALGADTVLIGRAFLYALAVHGQAGVKNLLELFEKEMRVAMVLTGAKSISEITRDSLVRELGA

SEQ ID NO: 23461 - DNA, 1101 bp, Lactobacillus plantarum
  CDS (1)..(1101)
atgacagttattaatggatatgaacagagtgatcgtgagcaaaagttaacgattttaaatttaccatcattggaagcagctgctaaaaagatcatcccgagcggaggctttggctatattagtggtgggtcagaagacgaatggactttaaagcagaatacaatggcctttaaccatgttcaaattgtgccacgagcattgacggatatggaacagccaagcacacagactcaggcttttggcatagatctcaaaacgcctattatgatggctccagcggccgctcaaggattggcacatgcacggggtgaagctgcgactgctgaagggatggctcaagttggggcacttatggctcagagtacttactcttcaacgtcaattgcagatactgccgcagctggtaaaggtgcgccccaatttttccaattatatatgagcaaagattgggattttaatcagagtttactggatgaagcagtgaaggctggtgctaaggcaatcattttgacagttgatgcaacagttgacggttatcgtgaagctgatattatcaacaatttccagtttccaatcccaatggctaacttgactaagttcagcgaaggggatggtaaagggaaaggtatcatggaaatctatgctgctgcggcgcaaaagattagcccggctgatgttcggcgtattacggaatatacgaatttaccagttattgtgaaggggattcagtcaccagaagatgccttgttagcaatcggggctggtgctcagggtatctatgtttcaaaccatggcggtcggcaactaaatggtggtccagcttcctttgatgttttacacgagattgcgcaagccgttaatgggcgcgtcccaataatttttgatagcggtgttcggcgtggctcccatgtctttaaggcgttagccaatggtgcagatctggtggcacttgctcggccgattatctatggattagcattgggtggtgcgcagggtgtcgcttccgtagtgagtcaccttaatgatgagctgttgatcgatatgcaactagcgggaactaagacgattgaagatgttaaacgtgctaaattacttaggtag

SEQ ID NO: 23462 - protein, 366 aa, Lactobacillus plantarum
MTVINGYEQSDREQKLTILNLPSLEAAAKKIIPSGGFGYISGGSEDEWTLKQNTMAFNHVQIVPRALTDMEQPSTQTQAFGIDLKTPIMMAPAAAQGLAHARGEAATAEGMAQVGALMAQSTYSSTSIADTAAAGKGAPQFFQLYMSKDWDFNQSLLDEAVKAGAKAIILTVDATVDGYREADIINNFQFPIPMANLTKFSEGDGKGKGIMEIYAAAAQKISPADVRRITEYTNLPVIVKGIQSPEDALLAIGAGAQGIYVSNHGGRQLNGGPASFDVLHEIAQAVNGRVPIIFDSGVRRGSHVFKALANGADLVALARPIIYGLALGGAQGVASVVSHLNDELLIDMQLAGTKTIEDVKRAKLLR

SEQ ID NO: 23463 - DNA, 1137 bp, Bradyrhizobium japonicum
  CDS (1)..(1137)
atgaagcacatcacctgtatcgacgatcttcgcgcgctgcataagcgccgcgtgccgaaggcgttcttcgattattgcgaccgcggctcctatgccgaggaaacgctgcgcgccaaccgcgaggacatgcaggcgatcaagttccgccagcgcatcctggtcgacgtctccaagcgcgacacctcgaccacgatcctcggcgagacctcgaccatgccgctggtgctcgcgcccgtgggcctgctgggcatgcagcatggcgacggcgagatccacgcctgccgcgccgcacaggccgccggcatcccgttcacgcagtcgacgatgtcgatctgctcgatcgaggacatcgccgccagtgtcgagaagccgttctggttccagctctacgtgatgaaggaccgcggcttcatcaaggcgctgatcgaacgcgcgatcgcggcgaaatgctcggcgctggtgctgaccgtcgatctccaggtgatcggccagcgccaccaggacatcaagaacggcatgaccgtgccgccggaatggtcgctctcgaagctgatcgatttcgccaccaagccggcctgggtgtcgggtgtgttgcagggcaagcgccgcaccttcggcaatctcgccggccacctgaaggtcagcgacgacatcacgtcgctgtcgacctggatcaactcgcagttcgacacctcgctgaactggaacgacatcgattggatccgcagcatctggccgggcaagctggtcctgaagggcattctcgacgtcgaggacgccgagctcgccgcgaagaccggcgcgcaggcgatcgtggtctccaaccatggcggccggcagctcgacggcgcaccgtcctcgatcgaggtgctgcccgagatcgtcgatgccgtcggtgacaggatggagatcatgttcgacggcggcatccgctccggccaggacgtgatgcgcgcgctcgcgctcggcgcaaagtcctgcatgatcggccgcgcctatgcctatggcttaggggccggcggccaggccggcgtcgccaaggcgatcgacatcatccagaaggaactgctgacgaccatgggcctgtgcggcgtcaacaggatcgaggagatcgacgatcacatcatcgcggtgtga

SEQ ID NO: 23464 - protein, 378 aa, Bradyrhizobium japonicum
MKHITCIDDLRALHKRRVPKAFFDYCDRGSYAEETLRANREDMQAIKFRQRILVDVSKRDTSTTILGETSTMPLVLAPVGLLGMQHGDGEIHACRAAQAAGIPFTQSTMSICSIEDIAASVEKPFWFQLYVMKDRGFIKALIERAIAAKCSALVLTVDLQVIGQRHQDIKNGMTVPPEWSLSKLIDFATKPAWVSGVLQGKRRTFGNLAGHLKVSDDITSLSTWINSQFDTSLNWNDIDWIRSIWPGKLVLKGILDVEDAELAAKTGAQAIVVSNHGGRQLDGAPSSIEVLPEIVDAVGDRMEIMFDGGIRSGQDVMRALALGAKSCMIGRAYAYGLGAGGQAGVAKAIDIIQKELLTTMGLCGVNRIEEIDDHIIAV

SEQ ID NO: 23465 - DNA, 1185 bp, Bradyrhizobium japonicum
  CDS (1)..(1185)
atgtgcttgctgagaaccatgtggggtttcccttatgataagaacggtgtggctcgagggcttacagtgaccccggtttgcatagacgactatcgaagcctggcgaagcgacgccttccacgaatggtgttcgactatcttgatgggggagccgaaagcgaacgtagtttgcaccgaaatcttggagcttttgcggcgatcaattttgctccgcggcggcttgtcgatgtcagccatcgcaattcatccgtatctctattcggacggacgcttccaacgccctttgtggtcgcaccgacaggccttaacggtgctttgtggcctgacggcgatgttgcgttagcccgggccgctcgcagtgcagggatcccgtttgtactttcgaccgcatcaaacgcgacaattgaggacgtcgcggaacgggcgggcggtgatctttggttccagctttatgtcgtgcagcgagatctagcccggctgcttgtcggcagggccaaagaagcgggttaccgtgtgctggttctcaccgttgatgttgctgtgaatggcaaaagggatcgtgatctgcgaaatggatttgcgattccgttccgccaaactccccgatcggttctggacgccgtaactcatccacggtgggcgctcggccagatccgccacggattgcctcagctcgcaaattttgccagccctgacgcaaccgacgtgaatgcacaggccgccttgatgcgccggcagatggatgccagtttctgttggcaggatcttcaggcgctccgcgacgcctggccgggtaggcttatagtgaagggcattatgactgcgaccgacgtaaatcgatgccgggaacttggcgttgatgccgtcgttctgtccaatcatggcggaaggcagatcgaggacgttcaggcgcccatagatttgttagcggaaatctcgaatcagaatgcgatgccgctcctcgttgatggcggcatacgccgcggagcagatgcggtaaaggcgttagcgctcggtgccaaagcggtgttgttgggacgtgcaatcctttatgggctcgccgctgcaggcgaagaaggggctggtcacgtgcttcaaatccttactgccgagttcgatacgacgctggcacttgtcggctgtccagaccccgcacgtctcaatcgccagttcattcaattgtga

SEQ ID NO: 23466 - protein, 394 aa, Bradyrhizobium japonicum
MCLLRTMWGFPYDKNGVARGLTVTPVCIDDYRSLAKRRLPRMVFDYLDGGAESERSLHRNLGAFAAINFAPRRLVDVSHRNSSVSLFGRTLPTPFVVAPTGLNGALWPDGDVALARAARSAGIPFVLSTASNATIEDVAERAGGDLWFQLYVVQRDLARLLVGRAKEAGYRVLVLTVDVAVNGKRDRDLRNGFAIPFRQTPRSVLDAVTHPRWALGQIRHGLPQLANFASPDATDVNAQAALMRRQMDASFCWQDLQALRDAWPGRLIVKGIMTATDVNRCRELGVDAVVLSNHGGRQIEDVQAPIDLLAEISNQNAMPLLVDGGIRRGADAVKALALGAKAVLLGRAILYGLAAAGEEGAGHVLQILTAEFDTTLALVGCPDPARLNRQFIQL

SEQ ID NO: 23467 - DNA, 1134 bp, Bradyrhizobium japonicum
  CDS (1)..(1134)
atgaacgaaaaaccccgcatccagccggaaaggaacgtcgaactcggcgccagcagcgagccgttccagaatctgcacgaattcatccgcaaagcacgcgccaacctcaaccagaatgcctgggactatatcgtcggcgccgccgagaccgagaccacgatgcgccgcaaccggatggcgctggacgagatcgcttttcgcccgcgcgtgctgcgcgacgtgcgcaaggtcgatggctccgtcgagcagttcggccgcaggatgcgcctgccggtggtgctcgcccctgtcggcgcgctcgagatcttcgatccggatggcgccgcgagcgtcgcgcgcgccgccggcacctttggggcggcgcacatgctgagctcggtgtccgagcctggcctggagaagaccgccgcagccgcccccgacgcgctgcgtctctaccagctctacgtgcgcggcgacgacgccttcgtcgccgatgtcgtcagccgggccgaaaagcacgcctacgccgccttctgcctgaccgtcgacaccgcccattacagccgtcgcgaacgtgacatcgccaagcgctacgttcgcgagagccgcctgcgcgccaccggcggcgatttccagaaaggcctggaatggcggaccgtgaagatgatcaaggacaagttcaagattccgctgatcctgaaaggtatcgccaccgccgaggacgccctgatcgcgctcgatcacggcgtcgaatggatctacgtctccaaccatggcggccgccagctcgatcacggccgcggcgccatgcatgtgctgcctgagatcgtcgaggccgtgaagggccgcgccaagatcatggtcgatggcggcttcggccgcggcaccgacatcgtcaaggcgatcgcggcgggcgccgacctcgtcggcatcggccggttgcaatgctgggcgctggcggcggccggcgaagccggcgtgacgcggatgctggagcttctggaggacgaggtgctgcgctgcctcggcctgttgggcgccacctcgttcgccgaggtcaacaagtcctgcctgcatccggccaccgcgacgaacacgccgagcgtgttcagcgcgttcccgctgttcgaccacgaaccttaccggtactga

SEQ ID NO: 23468 - protein, 377 aa, Bradyrhizobium japonicum
MNEKPRIQPERNVELGASSEPFQNLHEFIRKARANLNQNAWDYIVGAAETETTMRRNRMALDEIAFRPRVLRDVRKVDGSVEQFGRRMRLPVVLAPVGALEIFDPDGAASVARAAGTFGAAHMLSSVSEPGLEKTAAAAPDALRLYQLYVRGDDAFVADVVSRAEKHAYAAFCLTVDTAHYSRRERDIAKRYVRESRLRATGGDFQKGLEWRTVKMIKDKFKIPLILKGIATAEDALIALDHGVEWIYVSNHGGRQLDHGRGAMHVLPEIVEAVKGRAKIMVDGGFGRGTDIVKAIAAGADLVGIGRLQCWALAAAGEAGVTRMLELLEDEVLRCLGLLGATSFAEVNKSCLHPATATNTPSVFSAFPLFDHEPYRY

SEQ ID NO: 23469 - DNA, 1254 bp, Corynebacterium efficiens
  CDS (1)..(1254)
atggtcaagcgccagctgcccaacccgtccgagatgcttgagctgatgaagttcaagaagccggagctcaacgcgaagaagcgccgtctggattcggcgctgacgatctatgatctgcggaagatcgcgaagcgtcgcacgccggcggccgccttcgactacaccgacggtgccgccgaggccgagctgtccatcaagcgcgcccgcgaggcgttcgagaacatcgaattccatccggacatcctcaaacctgcggagaatgtggacccgtccacgcagatcctcggcggccactccgccctgccgttcggtatcgcgcccaccggtttcacccgcctcatgcagacggagggggagatcgccggggccggagctgcgggggcagccggaattcccttcacgctgtcgacactgggcaccacctccatcgaggatgtcaaggccaccaacccgcagggccgcaactggttccagctctacgtcatgcgcgaccgggagatctcctacggtctggtggagcgcgcggccgcggcgggtttcgacaccctcatgttcaccgtcgacacccccatcgcgggttaccgcatccgggatacccgcaacggcttctccatcccaccgcagctgaccccgggcaccgtcctcaacgccatcccgcgaccgtggtggtggatcgatttcctcaccaccccgaccctggaattcgcgtccctgtcctccaccggcggcaccgtcggtgatctgctcaactccgcgatggaccccaccatctcctatgaggacctcaaggtcatccgcgagatgtggcccgggaaactgctggtcaagggcgtgcagaacgttcccgatgcggtgaaactcctggaggggggcgtcgacggcctgatcctgtccaaccacggcggccgccagctcgaccgcgcgccggtaccgttccatctcctgccacaggtacgccgggaggtcggttccgagccgaccatcatgatcgacaccggcatcatgaacggcgcggacatcgtcgcagccatcgctctcggcgccgatttcaccctcatcgggcgtgcctacctctacggcctcatggccggcggccgccagggcgtggaccgcaccatcgagatcctgcgcaccgagatcacacgcaccatggcgctgctaggagtgtccacactcgacgagctcgaaccgcgccacgtcacccagctgaccacgctggtgcccatcagcgacaccacgcgtacccacgtctaa

SEQ ID NO: 23470 - protein, 417 aa, Corynebacterium efficiens
MVKRQLPNPSEMLELMKFKKPELNAKKRRLDSALTIYDLRKIAKRRTPAAAFDYTDGAAEAELSIKRAREAFENIEFHPDILKPAENVDPSTQILGGHSALPFGIAPTGFTRLMQTEGEIAGAGAAGAAGIPFTLSTLGTTSIEDVKATNPQGRNWFQLYVMRDREISYGLVERAAAAGFDTLMFTVDTPIAGYRIRDTRNGFSIPPQLTPGTVLNAIPRPWWWIDFLTTPTLEFASLSSTGGTVGDLLNSAMDPTISYEDLKVIREMWPGKLLVKGVQNVPDAVKLLEGGVDGLILSNHGGRQLDRAPVPFHLLPQVRREVGSEPTIMIDTGIMNGADIVAAIALGADFTLIGRAYLYGLMAGGRQGVDRTIEILRTEITRTMALLGVSTLDELEPRHVTQLTTLVPISDTTRTHV

SEQ ID NO: 23471 - DNA, 1146 bp, Brucella suis
  CDS (1)..(1146)
atgtccaatatcgttgaaatcgccgatctgaagcggcttgcccggcgccgcgtccccaagatgtttttcgactatgccgattctggcgcctggactgagtccacctaccgggcaaacgaagacgacttcaagaagatcaagctgcggcagcgggttctggttgacatgaccaaccgctcgctcgaaacgaccatgatcggcgagaaagtggccatgcccgtggcgcttgccccgaccggcctgacaggcatgcagcatgccaatggcgaaatgctcgcggcacaggcggcagaagctttcggtgttcccttcaccctttccaccatgagcatctgctccatcgaggatgtcgcctcggtgacgaagaagccgttctggttccagctctatgtgatgcgggaccgcgatttcgtaaaaaacctgattggccgcgccaaggctgccggttgctcggccctggttctcacccttgatctccagattctcggccagcgccacaaggatatccgcaacggcctttccgctccgccgaaatttacgcccaagcatatctggcagatggcgacctgccccgcctggtgccttggaatgctgggtacgcagcggcgcaccttccgcaacattgccggccatgcgaaaaatgttaccgatctgtcgtcgctgtcttcctggacggcagaacagttcgatccgcagctcaactggagcgacgtcgagtggatcaaggaacaatggggcggcaagctcatcctcaagggtattctcgacgtcgaagatgccaaaatggccgcgaaatccggtgctgacgccattatcgtatccaatcatggcggacgccagctcgacggcgccccctcatccatctccatgctgcaaccgattgttgaagccgtgggcgacagaatcgaggttcatgtcgatggcggcattcgttccggccaggacgtgctgaaagcgcgcgcactcggcgcacagggcgtttatatcggccgtccgttcctttatggccttggcgccatgggcaaggaaggcgtgacgcttgcactggaaatcatccgcaaggaaatggacatcaccatggccctctgcggcaaacgcgacatcaatgaaatcgacaagtcgattatccattcgatcgatttctga

SEQ ID NO: 23472 - protein, 381 aa, Brucella suis
MSNIVEIADLKRLARRRVPKMFFDYADSGAWTESTYRANEDDFKKIKLRQRVLVDMTNRSLETTMIGEKVAMPVALAPTGLTGMQHANGEMLAAQAAEAFGVPFTLSTMSICSIEDVASVTKKPFWFQLYVMRDRDFVKNLIGRAKAAGCSALVLTLDLQILGQRHKDIRNGLSAPPKFTPKHIWQMATCPAWCLGMLGTQRRTFRNIAGHAKNVTDLSSLSSWTAEQFDPQLNWSDVEWIKEQWGGKLILKGILDVEDAKMAAKSGADAIIVSNHGGRQLDGAPSSISMLQPIVEAVGDRIEVHVDGGIRSGQDVLKARALGAQGVYIGRPFLYGLGAMGKEGVTLALEIIRKEMDITMALCGKRDINEIDKSIIHSIDF

SEQ ID NO: 23473 - DNA, 1218 bp, Escherichia coli
  CDS (1)..(1218)
atgcctctttcccgacgtaattttattcagaatgccgttttaggaatatctgccgcagggctgtcagctgcgccggcccttgccaaaaatatctcatcttcaacggcacatatcatcagtaaaacgtctggacatgctgatacatcgaccagcaagtctcttcatatcatcagtctggacagactggaggcttcagcaaaagatgtgatgacggaagctgcgtatgcatatattgctcatggtgctggagatgagtggacgtatcatgagaaccgcagggcattcagtgattatcctttgttacctcaccgactcagtggagttgctgcccacagcattgatatccggactgaccttttgggccatcatctggaacaccccctgctgatagcacctatgggcgcgcatatgttcgtccatccggaaggggaggtgattgctgcagcgggtgcagaaaaggccggggcactttatgaatcatcaggggcatccaaccgctctctggaggatattgcaaaagccagtaaaggacctaaatggttccagctgtattttaacgcggatgctggtgttacccgaagtttactggagcgtgcaaaagcggcaggctattcagccattattatcacagcggatgcgcttggtcccgggacaagtgatgcttttctcagcatgagctcgcctttccctgcaggagcgacgttcggtaatcatgacccccgttacggtggcaaaggtgatttttttaaccaaaaagttgagctgaccccggctgatattgagtttgtaaaaaaaatcaccgggctgccagtcattgtcaagggaatcctcagaggtgaggatgcagtggttgctattgatgcaggagcagatgccatccaggtgtctaatcatggtggtcgccagattgatggtgttccttctgccatcagccagttgcaggaagttgctgcaagagtcgggcacaaagttccggtcatttttgacagcggtattcgcagggggattgatgttgtaagggctatctctcttggggcaacggctgttgcggtcggacgtcctgttctttatggcatcgcagcaggtggtgtcgggggcgttgccagtgtcattgagcacctgaagacggagttgaggacggcaatgttactgagtggtgctcgtacacttaaggatttgtctcagggctttatcagaaacaaggagactgagcattga

SEQ ID NO: 23474 - protein, 405 aa, Escherichia coli
MPLSRRNFIQNAVLGISAAGLSAAPALAKNISSSTAHIISKTSGHADTSTSKSLHIISLDRLEASAKDVMTEAAYAYIAHGAGDEWTYHENRRAFSDYPLLPHRLSGVAAHSIDIRTDLLGHHLEHPLLIAPMGAHMFVHPEGEVIAAAGAEKAGALYESSGASNRSLEDIAKASKGPKWFQLYFNADAGVTRSLLERAKAAGYSAIIITADALGPGTSDAFLSMSSPFPAGATFGNHDPRYGGKGDFFNQKVELTPADIEFVKKITGLPVIVKGILRGEDAVVAIDAGADAIQVSNHGGRQIDGVPSAISQLQEVAARVGHKVPVIFDSGIRRGIDVVRAISLGATAVAVGRPVLYGIAAGGVGGVASVIEHLKTELRTAMLLSGARTLKDLSQGFIRNKETEH

SEQ ID NO: 23475 - DNA, 1179 bp, Pseudomonas resinovorans
  CDS (1)..(1179)
atgcgtcgtttttaccggggccgcgacttgagtcgggtccacagcgttgccgaactggccgacatggcccgccggcgcctgccgtatttcgcctgggaatacctgagcggcggggcgcaggatgaactgaccctcaccgacaacctcgatgggttcagcgcctatggcctgcacgcccgcgccatggtgccgtgccatccgcccgccacggcgcgggccgtgctggggcgggtgttgcccgtgcccctgctgatcgggccgaccggctacaacggcttactgcaccgcgatgccgacattcacctggcccgggcggccacggcccgaggcttgccgttttgcctgagcaccgctgccaatacttcccttgaggcattggtggcggcggtgccagaagtgaacctgtggttccagctctacgccatgggcgacccccgtgtgcaaaacgacctgctgcgccgcgccgctgccgtgggcagccgcaccctgctgttgacctgcgatgccatggtgctgggcaaccgcgagtgggaccggcgcaatttcgccaagccgcgccagttggcgtggcgcaacacgctcgacgtgctgcgccacccgcgctggctgcagcaagtgatgtggccggccgggctgccgggcatgggcaacctggagccttacctgccgctcaacgaacgcaatgccttgggttcgatggcgtttatcggccggcagatggacagcttgctcgactgggacaaactggcgcgcctacgcgaccaatggggtgaacgcctgctgctcaaaggcgtgctgcacccggcggacgtcgagcgcgccattgccctggggctcgatggggtggtggtgtccaaccacggcggccggcaattggatggcgccccgagcagcctcgccgccctggccgccgtcgccccccaggcccgcggccggctcagcctgctgctggacggcggcattcgccggggcagcgacatcgtcaaggccctggccctgggcgccgatgccgtgctgctgggccgcgccaccctctacggcgtcgccgtggctggcgaagcgggcgccgggcgggccctggatctgttgacccaggaactggtgcaaaccctcaacctgatgggctgcacccacctcagccacttgggccgcgacaacctgtgggagcgcaggaggtaa

SEQ ID NO: 23476 - protein, 392 aa, Pseudomonas resinovorans
MRRFYRGRDLSRVHSVAELADMARRRLPYFAWEYLSGGAQDELTLTDNLDGFSAYGLHARAMVPCHPPATARAVLGRVLPVPLLIGPTGYNGLLHRDADIHLARAATARGLPFCLSTAANTSLEALVAAVPEVNLWFQLYAMGDPRVQNDLLRRAAAVGSRTLLLTCDAMVLGNREWDRRNFAKPRQLAWRNTLDVLRHPRWLQQVMWPAGLPGMGNLEPYLPLNERNALGSMAFIGRQMDSLLDWDKLARLRDQWGERLLLKGVLHPADVERAIALGLDGVVVSNHGGRQLDGAPSSLAALAAVAPQARGRLSLLLDGGIRRGSDIVKALALGADAVLLGRATLYGVAVAGEAGAGRALDLLTQELVQTLNLMGCTHLSHLGRDNLWERRR

SEQ ID NO: 23477 - DNA, 1433 bp, Oryza sativa
  CDS (73)..(1173)
gactcgtactgtttctgatatcattgattgctatcctcctcctcctccttcctcccctaaatctctagagaaatggaggacaatctaccagtcaatgtccgggagtatcaagaactcgccaaaaaagcgttgccaaagatggcttatgattacatcaatgggggagcagaggatgagcacacactgagggagaatatcgcagcatacacaagaattatattacgacctcgcgttcttgtggatgtgagcaagatagacatgtcaacaactttattaggatacaccatgcgttcacccataattgtggctccaactggggggcacaaattagcacatccagaaggggagaaggctacagcaagagctgcagcatcatgtaacgccataatggttctttccttttcttccagttgcaagattgaggatgttgcctccagttgcaatgccattcgcttttatcagctatatgtgtataagaataggaatgtttcagcaacattagtacggcgggccgagagttgtggattcaaggcacttcttttgacagttgacactcctatgctcggtcggcgtgaagcagatatccgaaacaaaatggttttcccacggagtggtaatctcgaaggtttaatgacaacagatgaccatgataccacaaacggttctcagctcgaacgattcgcacgagcgacgctggatccatcattatcatggaaggatatagagtggctcaagtccataaccagcatgccgatctttctcaagggcatcgtcaccgctgaggacgcgaggagagcagtggaggccggggtggccggcgtgatcgtctccaaccacggcgcgcggcagctggactacgcgccggcgaccatcgccgccctggaagaggtggtcagggcggtggccggcgccgtgccggtgctggtcgacggcggaatccggcgaggcactgacgtgttcaaggccctggcgctcggcgcacgggcggtcatggttgggaggccggtgttcttcgggctggcggcgaggggggaggcaggcgcgaggcacgtgatcgagatgctcaacggcgagctggaggtggccatggcgctctgcggctgccggagcgtcggcgagatcacccgcagccatgtcatgaccgagggtgacaggatcaggtccctgctctgatgaatcatttctcatctggccaatgcagcttcaggtctaaaaatacaagtgggctatgggccaacccgtaaaccgatttataggtaataaaatttgaccgacccgtgaatctatttatatgtaaaattagtgggtaatccaaagtctacttatttggtctataactataagtggcttcgcggatcagtccagttacatcatattcaggtctcaatgtgagagactttagtatatgcagtatattgcaattggatttatgg

SEQ ID NO: 23478 - protein, 366 aa, Oryza sativa
MEDNLPVNVREYQELAKKALPKMAYDYINGGAEDEHTLRENIAAYTRIILRPRVLVDVSKIDMSTTLLGYTMRSPIIVAPTGGHKLAHPEGEKATARAAASCNAIMVLSFSSSCKIEDVASSCNAIRFYQLYVYKNRNVSATLVRRAESCGFKALLLTVDTPMLGRREADIRNKMVFPRSGNLEGLMTTDDHDTTNGSQLERFARATLDPSLSWKDIEWLKSITSMPIFLKGIVTAEDARRAVEAGVAGVIVSNHGARQLDYAPATIAALEEVVRAVAGAVPVLVDGGIRRGTDVFKALALGARAVMVGRPVFFGLAARGEAGARHVIEMLNGELEVAMALCGCRSVGEITRSHVMTEGDRIRSLL

SEQ ID NO: 23479 - DNA, 2029 bp, Mus musculus
  CDS (223)..(1284)
ccacgcgtccggacccacgcgtccgcccacgcgtccgcccacgcgtccgggctttgcatggctacctctacatactgctattgctggctattggaagaccttagtgtcagaatcttcttgtgtacaagccctgaatggtgtgaccaacccaagttcctacagcatctttgcagctgttgatctcactctttcgttcctattggagaaactaccggcccagcaatgtctttgctgtgtttggcagactttaaggcacaagcacaaaagcagctgtctaagacctcctgggattttattgaaggagaagctgatgatggcataacctacaatgacaacttggcagcatttagaagaatccgcctccgccccagatacctgagagatgtgtcaaagatagacaccaggaccacaatccaagggcaggagatcaatgcccccatttgcatctcacccacagcctttcattcaattgcctgggcagatggagaaaagagcacagctaaagctgctcagaaggccaacatctgctatgtcatcagcagttatgccagctatactgtggaagacattgttgctgctgcccctggaggcctccattggttccaactttatgtgcagccagactgggacatcaacaagcagatggttcagaggatagaagccttgggtttcaaagctttggtggtcactgtagatgcgcctgtacttggcaataggcgagggaacaagagaagcctgctggatttggaggcaaacataaagctgaaggatctccgatcccctggagagagcaagtctggacttcctactcccctgtctatgccaagtacatcttcctgctggaatgatctccccttgcttcagagtatgactcggttgcccattatcctcaaagggattttgacaaaagaggatgcagaattagcagtgaagcacaacatccgaggcatcattgtttccaaccatggcgggaggcagcttgatgaggttcctgcatctattgatgctctgagagaagtggtggctgccgtcaatgggaaaattgaagtgtacatggatggtggggttcgaaccggcaatgatgtgttgaaggcactagcccttggagctaggtgcatttttcttgggagaccaatcatttggggccttgcctgcaagggtgaagatggtgttaaggaagttttagatattctaaaagaagaactccacacttgtatggccctttcaggctgccggtcagttgctgagatcagtccagacctgattcagttctccagattataaggacctactgagattgcctacaagagaaagacaagctttcaacatagtgtgtgatgctgttcttcttgggtcccattcataatagaagtttaagccctctaccctcaaaaattgagacagatggagaaaagataggctacagctaccagagggtgcatttggatgaagaaataacatctaatgttctacaggaaactagagttaacaattaattgactatatcaaaaagccatgttctagcaagaaaggaaatagttagatctgatgtgacataccagttaccttcatttgatcagtagtgcattatacataattgaaatgtcatactgtgccataattatgtgtaattactatgtatcaattaaaatatcaatatatgttcaaaaagaaatggggacagggttatcctgattttattcattccctcctgcaagaaatatttttaaaacatcaatatatgtagtcaaattctgaagcatagtacagcatgtgaattattcaagtttctgtcacagcatgttacagaaatattatgatctattgcctaatgtccattgttaacagaagctgacctcaataaaaaaacaagaggaagattttgaaactcatatttaaaactttatgactaaattaaaattaaatattccagtcatttactgatacatgaaaaagaagatatctttattctggtcataatcattttgtcaaataaatctaagccttttcaatgaaaaaaaaaaaaaaa

SEQ ID NO: 23480 - protein, 353 aa, Mus musculus
MSLLCLADFKAQAQKQLSKTSWDFIEGEADDGITYNDNLAAFRRIRLRPRYLRDVSKIDTRTTIQGQEINAPICISPTAFHSIAWADGEKSTAKAAQKANICYVISSYASYTVEDIVAAAPGGLHWFQLYVQPDWDINKQMVQRIEALGFKALVVTVDAPVLGNRRGNKRSLLDLEANIKLKDLRSPGESKSGLPTPLSMPSTSSCWNDLPLLQSMTRLPIILKGILTKEDAELAVKHNIRGIIVSNHGGRQLDEVPASIDALREVVAAVNGKIEVYMDGGVRTGNDVLKALALGARCIFLGRPIIWGLACKGEDGVKEVLDILKEELHTCMALSGCRSVAEISPDLIQFSRL

SEQ ID NO: 23481 - DNA, 1101 bp, Streptomyces toyocaensis
  CDS (1)..(1101)
atgggccacggcagtgagacggcggccgctccggcccactgcctggccgacttcgaacgcgccgccgcttcggtcctgcccgccgacgtgcgggacttcgtcgcgggaggaagcggagccgaggtcacgctcgacgccaaccgcaccgcgctggaccgcgtcttcctcgtcccccgggtgctcagggacgtgtcgcggtgcacggctgactccaccctgctgaagcggcccgtcccgatgccggtcgccgtcgcgcccgtcgcctaccagcaactggtccaccccgatggcgagagggccgccgcccgggcggccaaggcggccggcgtgccgttcaccgcgagcacgctgagcagtgtcccgatcgaagagctcacggcgatcggcggaacggtctggttccagctctaccggctccgggacgccgcgcagtccctggaactcgtccgcagagcggaggacgcgggctgtgaggcgatcatgctcaccgtcgacgtgccgtggatggggcgccggctgcgcgacgtacgcaaccgtttcgccctgcccagccatgtgcgggcggccaacatcagcaccggctcgaccgcgcaccgacggcatgccgacagctccgcggtagccgtccacacgggccaggccttctcctccgcgacgacgtggtcgtcgttggcggccctgcggaagcagacccggctccccctgctgctcaagggtgtcctggcggccgaggacgcggtgcgggcggtcgagtccggggtcgacgcggtcgtggtctccaaccacgggggccgccagcttgacggagccgttcccagcatcgatgtgctgccggaggtggccgcggccgtgaacgacggctgcgaagtgctgttggacagcggcatccgcagcggcaccgacgtgctcagggcgctcgctctcggggcgtccggtgtcctggtgggccgaccgctgatctggggcctggccgcggccggagaggccggtgcccgccgggtgctcgacctgctggccgacgaactccgcgacgccctcggcctgtcgggctgcgacggtgtcgccgcggccaggcagttgcgcaccctcgtccccggctga

SEQ ID NO: 23482 - protein, 366 aa, Streptomyces toyocaensis
MGHGSETAAAPAHCLADFERAAASVLPADVRDFVAGGSGAEVTLDANRTALDRVFLVPRVLRDVSRCTADSTLLKRPVPMPVAVAPVAYQQLVHPDGERAAARAAKAAGVPFTASTLSSVPIEELTAIGGTVWFQLYRLRDAAQSLELVRRAEDAGCEAIMLTVDVPWMGRRLRDVRNRFALPSHVRAANISTGSTAHRRHADSSAVAVHTGQAFSSATTWSSLAALRKQTRLPLLLKGVLAAEDAVRAVESGVDAVVVSNHGGRQLDGAVPSIDVLPEVAAAVNDGCEVLLDSGIRSGTDVLRALALGASGVLVGRPLIWGLAAAGEAGARRVLDLLADELRDALGLSGCDGVAAARQLRTLVPG

SEQ ID NO: 23483 - DNA, 1372 bp, Arabidopsis thaliana
  CDS (70)..(1161)
gaaaaagttagcctgacattcttggttctgcttctggttttcttctgctggcttcttcagatagattagatggatcaaatcgttaatgtggatgagtttcaagagctggctaaacaagccctccctaagatgtactatgatttctacaatggaggagcagaggatcaacacactctcaatgaaaatgtccaagctttccgtagaatcatgtttaggccgagggttctcgttgatgtgagcaaaatagatatgtctaccaaaatattgggttaccctatctctgctccaatcatgattgctccaacaggaaatcataagttggctcatcttgaaggagaaaccgctactgcgaaagctgcagctgcgtgtaatactatcatgatagtatcatacatgtcttcatgcacttttgaggagattgcttccagttgtaacgctgttcggtttcttcaaatatatgtgtacaagagacgggacataactgctcaggtggtgaaaagagctgagaaagctgggtttaaggccatagttctgactgttgatgttcctagacttggtagaagggaagctgatataaagaacaaaatgatatccccgcagctgaagaatttcgaaggtttattttcaaccgaagtccgacctagtaaaggttcaggggtacaagccttcgcctctcgtgcatttgatgcttcatttagctggaaggacattgaatggttaagatctattacagagttacctattctggtcaaagggatactcacccgagaagacgctcttaaggctgttgaagctggtgtagatggaataattgtatctaaccatgggggtcgccagctcgactattcccctgctacaataactgttttagaagaggttgttcaagttgttagaggtaggattccggttttgcttgatggaggagtaagacgagggacagatgttttcaaagccctggcacttggagcacaagctgttcttatagggaggcctatgatctatgggcttgcagctaagggtgaagatggagtgaaaaaagtgattgatatgttaaagaatgagtttgagattactatggctctttctggttgtccaaccattgatgacataaccagaaaccatgttaggacagagaatgagagacttcactctatgctctgatccaaaaaaccaacagatatggtctgagaaacttaatcagacagctgaagaaccgtggcaaccagcagccatgttagaagaacaaggactgaagcatggattcaattcaacactcatcttttgaaaagtacatatgataaacatattgaatgcttgtctgacacaatgatgtggttagtgcataaaatataaatataaaggaaagagctgc

SEQ ID NO: 23484 - protein, 363 aa, Arabidopsis thaliana
MDQIVNVDEFQELAKQALPKMYYDFYNGGAEDQHTLNENVQAFRRIMFRPRVLVDVSKIDMSTKILGYPISAPIMIAPTGNHKLAHLEGETATAKAAAACNTIMIVSYMSSCTFEEIASSCNAVRFLQIYVYKRRDITAQVVKRAEKAGFKAIVLTVDVPRLGRREADIKNKMISPQLKNFEGLFSTEVRPSKGSGVQAFASRAFDASFSWKDIEWLRSITELPILVKGILTREDALKAVEAGVDGIIVSNHGGRQLDYSPATITVLEEVVQVVRGRIPVLLDGGVRRGTDVFKALALGAQAVLIGRPMIYGLAAKGEDGVKKVIDMLKNEFEITMALSGCPTIDDITRNHVRTENERLHSML

SEQ ID NO: 23485 - DNA, 1340 bp, Arabidopsis thaliana
  CDS (153)..(1244)
gtcttggtctccgacaggaccgactctgttctcgtgttcttttttccctgtcatttccagatttcataaagctaaaagatatctaatttctttgtttaccagagacttaaactggtttctgtatcttttactgggttctttcagatatataaatggatcaaatcgttaacgtggatgagtttcaagagctggccaaacaggccctccctaagatgtactatgatttctacaatggaggagcagaggatcaacacactctcaatgaaaatgtccaagctttccgtagaatcatgtttaggcctagggttcttgttgatgtgagcaacatagatatgtctacaagtatattgggttacccaatctcagctcccatcatgattgctccaacagcaatgcataagttggctcatcctaaaggagaaatcgccacagcgaaagctgcagctgcgtgtaacactatcatgatagtaccattcatgtctacttgcactattgaggaggttgcttccagttgtaacgctgttcggtttcttcaaatatatgtgtacaagagacgtgatgtaacagctcagattgtgaaaagagctgaaaaagctggattcaaggctatagttctaactgttgatgttcccagacttggtagaagggaagcagatataaagaacaaaatgatatccccacagctgaagaattttgaaggcttagtttcaaccgaagtccgacctaatgaaggttcaggggttgaagcctttgcctctagtgcatttgatgcttcgttaagctggaaggatatcgaatggttaagatctattacaaagttgccaattctggtcaaagggttactcacacgtgaagacgctcttaaggctgttgaagccggtgtagatggaatagtggtatccaaccacggggctcgccagctcgactattccccggctacgataactgttttagaagaggttgttcatgttgtgaaaggtaggattccggttttgcttgatggaggagtaagacgaggaacagatgttttcaaagcgctggcgctcggagcacaagctgttcttatagggaggcctatagtctatgggcttgcagctaagggtgaagatggagtgaaaaaagtgattgatatgctgaaaaatgagtttgagattactatggccctttctggctgtccaaccattgatgacgtaaccagaaaccatgttaggacagagaatgagagaattaaatctatgctctgatcctaaaaccaacagatctagtctcagagacttaatcagacagttggacaacagtatgaaatactgtcaatgcacataaataaaaagctctatttc

SEQ ID NO: 23486 - protein, 363 aa, Arabidopsis thaliana
MDQIVNVDEFQELAKQALPKMYYDFYNGGAEDQHTLNENVQAFRRIMFRPRVLVDVSNIDMSTSILGYPISAPIMIAPTAMHKLAHPKGEIATAKAAAACNTIMIVPFMSTCTIEEVASSCNAVRFLQIYVYKRRDVTAQIVKRAEKAGFKAIVLTVDVPRLGRREADIKNKMISPQLKNFEGLVSTEVRPNEGSGVEAFASSAFDASLSWKDIEWLRSITKLPILVKGLLTREDALKAVEAGVDGIVVSNHGARQLDYSPATITVLEEVVHVVKGRIPVLLDGGVRRGTDVFKALALGAQAVLIGRPIVYGLAAKGEDGVKKVIDMLKNEFEITMALSGCPTIDDVTRNHVRTENERIKSML

SEQ ID NO: 23487 - DNA, 1218 bp, Corynebacterium glutamicum
  CDS (1)..(1218)
atgaagttcaaaaagccagagctcaacggcaagaaacgacgcctagactccgcgctcaccatctacgacctgcgtaaaattgctaaacgacgcaccccagctgccgcgttcgactacaccgacggcgcagccgaggccgaactctcaatcacacgcgcacgtgaagcattcgaaaacatcgaattccacccagacatcctcaagcctgcagaacacgtagacaccaccacccaaatcctgggcggaacctcctccatgccattcggcatcgcaccaaccggcttcacccgcctcatgcagaccgaaggtgaaatcgcaggtgccggagctgcaggcgctgcaggaattcctttcaccctgtccaccctgggcactacctccatcgaagacgtcaaggccaccaaccccaacggccgaaactggttccagctctacgtcatgcgcgaccgcgaaatctcctacggcctcgtcgaacgcgcagccaaagcaggattcgacaccctgatgttcaccgtggatacccccatcgccggctaccgcatccgcgattcccgcaacggattctccatcccgccacagctgaccccatccaccgtgctcaatgcaatcccacgcccatggtggtggatcgacttcctgaccaccccaacccttgagttcgcatccctttcctcgaccggcggaaccgtgggcgacctcctcaactccgcgatggatcccaccatttcttacgaagacctcaaggtcatccgtgaaatgtggccaggcaagctcgtagtcaagggtgtccagaacgttgaagactccgtcaaactcctcgaccaaggcgtcgacggcctcatcctctccaaccacggtggccgtcaactcgaccgcgcaccagtcccattccacctcctgccacaggtacgcaaggaagtcggatctgaaccaaccatcatgatcgacaccggcatcatgaacggcgccgacatcgtcgcagccgtagccatgggcgctgacttcaccctcatcggtcgtgcctacctctacggactcatggccggaggccgcgaaggcgtcgaccgcaccatcgccattctccgcagcgagatcacccgcaccatggctctcctcggtgtttcctccctcgaagaactcgagccacgccacgtcacccagctggccaagatggttccagtttctgacgcaactcgttctgcagcggcggagatttag

SEQ ID NO: 23488 - protein, 405 aa, Corynebacterium glutamicum
MKFKKPELNGKKRRLDSALTIYDLRKIAKRRTPAAAFDYTDGAAEAELSITRAREAFENIEFHPDILKPAEHVDTTTQILGGTSSMPFGIAPTGFTRLMQTEGEIAGAGAAGAAGIPFTLSTLGTTSIEDVKATNPNGRNWFQLYVMRDREISYGLVERAAKAGFDTLMFTVDTPIAGYRIRDSRNGFSIPPQLTPSTVLNAIPRPWWWIDFLTTPTLEFASLSSTGGTVGDLLNSAMDPTISYEDLKVIREMWPGKLVVKGVQNVEDSVKLLDQGVDGLILSNHGGRQLDRAPVPFHLLPQVRKEVGSEPTIMIDTGIMNGADIVAAVAMGADFTLIGRAYLYGLMAGGREGVDRTIAILRSEITRTMALLGVSSLEELEPRHVTQLAKMVPVSDATRSAAAEI

SEQ ID NO: 23489 - DNA, 1161 bp, Xanthomonas campestris
  CDS (1)..(1161)
atgatcatttctgccgcttccgattaccgcgccgccgccgaagcccgcttgccgccgttcctgttccactacattgatggcggcgcgtatgccgagcacaccttgcggcgcaatgtctcggacctggcggatatcgcgttgcgtcagcgcgtgctgcgcaatatgtccgatctcagcctgagcaccgagctgttcggcgagacgctggcgatgccggtggcgctggcaccggtggggctcaccggcatgtacgcacgccgcggcgaagtgcaggccgcgcgtgcagccgctgcgcgcggcattccgttcacgctgtccacggtgtcggtgtgcccgatcgaggaagtggcaccagcgatcgaccgcccgatgtggttccagctgtatgtgctcaaggaccgcggcttcatgcgcaacgcgctggagcgcgccaagaccgccggggtgaccacgctggtgttcacggtggacatgcccacgcccggcgcgcgctaccgcgatgcgcactcgggcatgagcgggcctaacgcgtcgctgcggcgcatgctgcaggcgatgacgcacccgcgctgggcgtgggacgtgggcctgctcggcaaaccgcatgacctgggcaacatctccacctaccgcggcagccccaccggattgcaggattacatcggctggctggcggccaatttcgacccctccatctcgtggaaggacctggaatggatccgcgagttctggaccgggccgatggtgatcaagggcatcctcgacccggaggacgcacgcgacgcggtgcgcttcggcgccgacggcatcgtggtgtccaaccatggcgggcgccagctcgatggcgtgctgtccagcgcgcgcgcattgccggcgattgccgatgcagtgaagggcgagctgaagatcctggccgactcgggcattcgcagtgggttagatgtggtgcgcatgctggcgctgggtgccgatgccgtattgctcggccgcgcgttcgtctacgcactggccgccggcggccaggccggcgtggaaaacctgctgaccctgatcgagcgcgagatgcgcgtggcgatgatcctcaccggcacgcattcggtggccgagatcagcggcgacgcgttgagccgggtaacgcgcgaggcggcggttgtgccttga

SEQ ID NO: 23490 - protein, 386 aa, Xanthomonas campestris
MIISAASDYRAAAEARLPPFLFHYIDGGAYAEHTLRRNVSDLADIALRQRVLRNMSDLSLSTELFGETLAMPVALAPVGLTGMYARRGEVQAARAAAARGIPFTLSTVSVCPIEEVAPAIDRPMWFQLYVLKDRGFMRNALERAKTAGVTTLVFTVDMPTPGARYRDAHSGMSGPNASLRRMLQAMTHPRWAWDVGLLGKPHDLGNISTYRGSPTGLQDYIGWLAANFDPSISWKDLEWIREFWTGPMVIKGILDPEDARDAVRFGADGIVVSNHGGRQLDGVLSSARALPAIADAVKGELKILADSGIRSGLDVVRMLALGADAVLLGRAFVYALAAGGQAGVENLLTLIEREMRVAMILTGTHSVAEISGDALSRVTREAAVVP

SEQ ID NO: 23491 - DNA, 1167 bp, Xanthomonas axonopodis
  CDS (1)..(1167)
atgatcatttccgccgcttccgactaccgcgccgccgccgaagcacgcctgccgcccttcctgttccattacatcgatggcggcgcgtatgccgagcacaccttgcggcgcaatgtctcggacctggccgatgtggcgctgcgccagcgggtgctgcgcaatatgtcggatctgcgcctgagcaccgagctgttcggcgaaaccctggcgatgccggtggccttggcgccggtcggcctcaccggcatgtatgcacgccgcggcgaagtgcaggccgcgcgtgcggcggccgcgcgcggtattccgttcaccctgtccacggtgtcggtgtgcccgatcgaagaagtggcaccggccatcgaacggccgatgtggttccagctctatgtgctcaaggaccgtggcttcatgcgcaatgcgctggagcgcgccaaggcggcgggcgtgaccacgctggtgttcaccgtggacatgcccacgcccggcgcgcgctaccgcgatgcgcactcgggcatgagcgggcccaacgcctcgctgcggcgcatgctgcaggcggtgacgcacccgcgctgggcgtgggacgtgggcctgctcggcaaaccgcacgatctgggcaacatctccgcctaccgcggcagccccaccggcctgcaggattacatcggctggctgggcgccaacttcgacccgtcaatcgcctggaaagacctggaatggatccgcgaattctggaccgggccgatggtgatcaagggcatcctggacccggaggacgcacgcgatgcggtgcgcttcggtgccgacggcatcgtggtctccaaccacggcggccgtcagctcgacggcgtgctgtccagcgcacgcgcactaccggccattgccgatgcggtgaagggcgagctgaagattctggccgattcgggcatccgcagcgggctggacgtggtgcgcatgctcgcgctcggtgccgatgcggtattgctggggcgcgcgttcgtctacgcgttggcggccgccgggcaggccggcgtggaaaacctgctgaccctgatcgaaaaggaaatgcgcgtggcgatgacgctgaccggcacgcattccatcgccgacatcagcgccgacgctttgagccgggtgacgcgcgagcgtgccgatgcgatctcgccataa

SEQ ID NO: 23492 - protein, 388 aa, Xanthomonas axonopodis
MIISAASDYRAAAEARLPPFLFHYIDGGAYAEHTLRRNVSDLADVALRQRVLRNMSDLRLSTELFGETLAMPVALAPVGLTGMYARRGEVQAARAAAARGIPFTLSTVSVCPIEEVAPAIERPMWFQLYVLKDRGFMRNALERAKAAGVTTLVFTVDMPTPGARYRDAHSGMSGPNASLRRMLQAVTHPRWAWDVGLLGKPHDLGNISAYRGSPTGLQDYIGWLGANFDPSIAWKDLEWIREFWTGPMVIKGILDPEDARDAVRFGADGIVVSNHGGRQLDGVLSSARALPAIADAVKGELKILADSGIRSGLDVVRMLALGADAVLLGRAFVYALAAAGQAGVENLLTLIEKEMRVAMTLTGTHSIADISADALSRVTRERADAISP

SEQ ID NO: 23493 - DNA, 1260 bp, Mycobacterium tuberculosis
  CDS (1)..(1260)
atggccgaagcgtggtttgaaacggtagccatcgcgcagcaacgcgcgaagcggaggctgccgaaatcggtttactcgtccctgattgcggccagtgaaaagggaatcacggtcgccgacaatgtcgcagcattcagcgagctcgggttcgcgccgcacgtcatcggggcgacagataaacgtgacttgtcgacgaccgttatggggcaagaagtttcgttgccagtgattatttcgccgaccggtgttcaggcggtcgatcccggcggtgaagtcgccgtcgcgcgggccgcggccgcccggggtactgtgatgggattgtcctcgtttgccagcaagccgatcgaggaggtcattgccgccaaccccaagaccttcttccaggtctactggcagggcgggcgcgacgcgctcgctgaacgcgtcgaacgggcgcggcaggccggcgcggtcggcctggtcgtcaccaccgactggacgttctcgcacgggcgcgactggggcagccccaagatccccgaagagatgaacttgaagaccatcctgcggctatccccggaggcgatcacccggccgaggtggttgtggaagttcgccaagacgctacggccaccggacctacgggtgcccaaccagggccggcgcggcgagcccggcccaccgttcttcgcagcctacggcgaatggatggcaacacctccgccgacctgggaagatatcggctggctgcgcgaactgtggggcggaccgttcatgctcaagggcgtcatgcgggtcgacgatgccaaaagagctgtggatgccggggtttcggcgatctcggtatccaaccatggtggcaacaatttggatgggacgccagcatcgatccgggccctgcccgcggtctcggcggcggtcggcgatcaggtcgaagtgttgctcgacggcggcatccggcggggcagcgatgtcgtcaaggcggtggcgctgggcgcgcgcgcggtaatgattggtcgcgcttacctgtggggcttggccgccaacggccaagccggggtcgagaatgtactcgacatcctgcgcggtggtatcgactcggctctgatgggtctcgggcatgcctctgtccatgacctcagcccagccgacatcctcgttcccaccggttcatccgcgacctgggtgtgccctcccgacgggacgtttagccggatgttgagctgggcccaaattggggttggccctcccattaccacagagatgctcgcgacggaatga

SEQ ID NO: 23494 - protein, 419 aa, Mycobacterium tuberculosis
MAEAWFETVAIAQQRAKRRLPKSVYSSLIAASEKGITVADNVAAFSELGFAPHVIGATDKRDLSTTVMGQEVSLPVIISPTGVQAVDPGGEVAVARAAAARGTVMGLSSFASKPIEEVIAANPKTFFQVYWQGGRDALAERVERARQAGAVGLVVTTDWTFSHGRDWGSPKIPEEMNLKTILRLSPEAITRPRWLWKFAKTLRPPDLRVPNQGRRGEPGPPFFAAYGEWMATPPPTWEDIGWLRELWGGPFMLKGVMRVDDAKRAVDAGVSAISVSNHGGNNLDGTPASIRALPAVSAAVGDQVEVLLDGGIRRGSDVVKAVALGARAVMIGRAYLWGLAANGQAGVENVLDILRGGIDSALMGLGHASVHDLSPADILVPTGSSATWVCPPDGTFSRMLSWAQIGVGPPITTEMLATE

SEQ ID NO: 23495 - DNA, 1203 bp, Salmonella typhimurium
  CDS (1)..(1203)
atgaaaactcatcacctcattcgggtagtggcctcgctggcaatgttggcaacatcaggcctggcttatgctgaagagtacaaagccagtacggacgaaaaagcaataaaaatgacgaacgtagcctccctggaagcgcgcgttcaggccaaaatggagaaaggggcatttggttatattcgcggtggagccgaagatgagaataaccttcgcagcaacaccgaaagctttgacaaaaaatatattatgccgcgcgtattacagggcattgagttaaaagagatcgatttatcaacgcagctactgggtattccgcttaaaacgcctataatccaggcaccgatggcggcgcagggcctggcccacgcctccggagagttggcgacggcgaaaggcatggcgcaggtcggttcgattttctcgttgagcacctatggcaacaagaccatcgaagaggtggctaacgtttccgggaaaaatccgttcttcttccagctttatatgagtaagaataatcaatttaacgaatttattcttgcacaagcggtaaagcatggcgctaaagcgattattctgaccgtagattcgcctgtcggtggttatcgggaagaagatattaaaaataacttccagttcccgttgggctttgcaaacctggaaatgttcgccagaaaaaatgacgatggttcaaaaactggcaaaggagcagggataagtgaaatttacgcgcaggctaaacaagcctttacgccggaggatattgcctatgtacatcgtatttccggtctgccggttatcgtaaaaggcattcagtcgccggaggatgctgaaattgctatccaggccggggccgcaggaatatgggtttctaaccatggtggccgtcaattagacagcgggccgtcctcattcgatatgcttcctgcgattgcaaaagtcgtcaacaagcgagtgcctgttatttttgacagtggagtacgccgtggttcgcacatattcaaagcgttagccagcggggcggatattgtggcggttggccggcctgtattatacggtcttaatcttggcggcgctcagggtgtggcatcagtgattgaacagctaaacaaagagctgacaattaacatgatgttgggtggcgccagaaatattgaacaagtgaaaacgacacgcttgttaactgaaaaagatctgccccagtaa

SEQ ID NO: 23496 - protein, 400 aa, Salmonella typhimurium
MKTHHLIRVVASLAMLATSGLAYAEEYKASTDEKAIKMTNVASLEARVQAKMEKGAFGYIRGGAEDENNLRSNTESFDKKYIMPRVLQGIELKEIDLSTQLLGIPLKTPIIQAPMAAQGLAHASGELATAKGMAQVGSIFSLSTYGNKTIEEVANVSGKNPFFFQLYMSKNNQFNEFILAQAVKHGAKAIILTVDSPVGGYREEDIKNNFQFPLGFANLEMFARKNDDGSKTGKGAGISEIYAQAKQAFTPEDIAYVHRISGLPVIVKGIQSPEDAEIAIQAGAAGIWVSNHGGRQLDSGPSSFDMLPAIAKVVNKRVPVIFDSGVRRGSHIFKALASGADIVAVGRPVLYGLNLGGAQGVASVIEQLNKELTINMMLGGARNIEQVKTTRLLTEKDLPQ

SEQ ID NO: 23497 - DNA, 1095 bp, Rhizobium meliloti
  CDS (1)..(1095)
atgagcaaaggcgaggaagctacatgccctccccatttgggcgacttcgagagcttgcaagagatcatacagaaggcccaaggagctctaccaaaggaaaaatgggatagcctcgtaggtggggcggaaaccgaaacgaccctcaaacgcaaccgcttggcaatcgattccattgccttcaagccgcgtgtgctgcgtaatgtgagcgtggtagacctctcgattgagcatttcggtcgaaggttgcgcttgccaatctttcttgctcccaccggtccgctgaacctgttcggcccaggtggaggggcagccgtggcatcaggcgctcaggtgttcggggtcgcccatatgctcagttcgggatgcacaccactcgagtccgtcgccgaggcggccccttcagcactacgaatggcgcaactctacgtcagaggcgacgatgcctccgtccataaatacgttggtcgtgcgctggcatccggctgtgccgcaatctgcctaactgtcgatagcgccgtcctcgctcgccgcgaccgcgatattgccaatcgacatcggacggctggattaggaaagtggcctggtcaggcgtaccaggccggtctcgattggcggaccgtcaagttgatcaaggactcctacgacattccactcgtgctgaaaggaattgccacagtcgaggacgctcgtatcgcagtcgatcatggcgtggactggatttatgtttcgaaccatggtggccgccagctcgaccatggccgaggtacgatggatgtactgccagaaatcatcgacgccgtgggcggccaagcaaaggtgatggtcgacggagggttctgtcgtgggacggacatcataaaggcactagcaataggcgcaaacctcgttggtcttggtcgcatgcagtgctatgcattggcggcggggggcgaggcagcaataattcgcatgcttgagctgattgaagacgagatgctgcgttccatggctctgcttggtgtgccgactattggcgacttggatcgatcatatctgtatccagcggtcccggtcacgatcccaagcgccttgagcgcatttccgctcataaattga

SEQ ID NO: 23498 - protein, 364 aa, Rhizobium meliloti
MSKGEEATCPPHLGDFESLQEIIQKAQGALPKEKWDSLVGGAETETTLKRNRLAIDSIAFKPRVLRNVSVVDLSIEHFGRRLRLPIFLAPTGPLNLFGPGGGAAVASGAQVFGVAHMLSSGCTPLESVAEAAPSALRMAQLYVRGDDASVHKYVGRALASGCAAICLTVDSAVLARRDRDIANRHRTAGLGKWPGQAYQAGLDWRTVKLIKDSYDIPLVLKGIATVEDARIAVDHGVDWIYVSNHGGRQLDHGRGTMDVLPEIIDAVGGQAKVMVDGGFCRGTDIIKALAIGANLVGLGRMQCYALAAGGEAAIIRMLELIEDEMLRSMALLGVPTIGDLDRSYLYPAVPVTIPSALSAFPLIN

SEQ ID NO: 23499 - DNA, 1212 bp, Rhizobium meliloti
  CDS (1)..(1212)
atgatttcctcatcccgccttatcgaaaaagtgctattgattcggccgttcgggtttgaggggcagatgcgtctgaaagattgttacaatttccacgatttccgtcggatggcaaaacggcgcctgccgtcgccgatcttcaactatatcgatggcgcggccgatgacgaggtcacctaccggcgcaacacggctgcgttcgagggctgcgatctggttccgaatgtcctgcgcggcgtcggcgacgtcgacatgtcggtgacggtcatggggcaaaggctggcgatgcccgtctattgctcgccgacggcgcttcagcgtctgttccaccatcagggcgaacgtgcggtggcggcagcggctgcgaagttcggcaccatgttcggtgtctcctcgctcggcaccgtcagtctggaagaggcccggcggatttgcgacggtccgcaggtctaccagttttacttccacaaggatcgtggattgaaccgcgagatgatggcgcgcgccaagcaggccggcatcgaggtgatgatgctgacggtcgacagcatcaccgggggcaatcgcgagcgcgacaagcgaacggggtttgccattcctttcaagctcaatctcgccggtatcacgcaatttgcgatcaagccctcctgggcggtcaactatgttcgccatgagcctttcaggctgccccagctggaaaaccatgtcgatatgggccgcggcgcgatgtcgataagccgctatttcaccgagatgctcgatccgtccatgtcctgggacgacgtcgccgagatggtgcagcactggggcggccagttttgcctgaaaggcgtgatttcggtcgaggatgccaagcgcgcggtcgagatcggctgcaccggaatcgtgctctccaatcacggcgggcgccagctcgacggttcacgcaccgcattcgaccagcttgacgagatcgtccaggccgtcggggacaggatagatgtgatgatggacggcggcgtgcagcgcggcacccatgtgctcaaggcgctctcgttgggagcgaaggcggtcgggcttggccgttactatctcttcccgctcgctgcggcaggacaggctggcgtcgaacgggcgctcgaactgatgcgtgtcgagatcgaacgcggcatgaagctgatgggctgctcatcggtcgacgagcttacaaaagaaaacctgcgtttccggtga

SEQ ID NO: 23500 - protein, 403 aa, Rhizobium meliloti
MISSSRLIEKVLLIRPFGFEGQMRLKDCYNFHDFRRMAKRRLPSPIFNYIDGAADDEVTYRRNTAAFEGCDLVPNVLRGVGDVDMSVTVMGQRLAMPVYCSPTALQRLFHHQGERAVAAAAAKFGTMFGVSSLGTVSLEEARRICDGPQVYQFYFHKDRGLNREMMARAKQAGIEVMMLTVDSITGGNRERDKRTGFAIPFKLNLAGITQFAIKPSWAVNYVRHEPFRLPQLENHVDMGRGAMSISRYFTEMLDPSMSWDDVAEMVQHWGGQFCLKGVISVEDAKRAVEIGCTGIVLSNHGGRQLDGSRTAFDQLDEIVQAVGDRIDVMMDGGVQRGTHVLKALSLGAKAVGLGRYYLFPLAAAGQAGVERALELMRVEIERGMKLMGCSSVDELTKENLRFR

SEQ ID NO: 23501 - DNA, 1077 bp, Amycolatopsis balhimycina
  CDS (1)..(1077)
atgacgtacgtttccctgggcgacctcgaacgtgccgctcgcgacgtcctccccggcgagatctgggacttcctcgccggggggagcggcgccgaggcatcgctgacggccaaccgcaccgcgctcgaccgggttttcgtggttccccggatgctgtgcgacctgaccggcagcaccaccgaggccgagctcctgggccggcgcgccgcgctcccgatggcggtcgcgccggtcgcgtaccagcggttgttccaccccgagggcgagctggcggccgctcgcgcggctcgcgacgccggcgtgccgtacaccatctgcaccttgagcagcgtcccgctcgaggaggtcgcggccgtcggcggccggccgtggttccagctgtactggctgcgtgacgagaagcggtcgctggagctcgtgcgccgcgcggaagacgccgggtgcgaagcgatcgtgttcaccgtggacgtgccgtggatgggacggcggtggcgggacatgcgcaacggcttcgcgttgccggaatcggtgacagcggccaacttcgacgccggatcggccgcgcaccgccgcacgcgcggggcctcggccgtggccgaccacaccgcgcgcgagttcgcccccgccacctgggagtcggtggcgacggtccgcgcgcacacggacctgccggtggtgctcaagggcatcctcgccgccgaggacgcccgccgtgccgtcgaggccggggccgacgggatcgtggtgtccaaccacggaggtcgtcagttggacggcgcggtgcccgggatcgaggtgctgggcgagatcgccgccgaggtctccggccgctgcgaagtgctgctggacggcggaatccggaccggcggggacatcctcaaggcggccgcgctgggcgcgtcgggcgtgctggtcgggcggcccgtgatgtgggggctggccgcggcgggccaggagggcgtccggcaggtgttcgaactgctcgccgccgaactccggaacgcgctgggcctggcgggctgtgactcggtgagcgcggccggccggctgggcacgagggtcccccgctacggctga

SEQ ID NO: 23502 - protein, 358 aa, Amycolatopsis balhimycina
MTYVSLGDLERAARDVLPGEIWDFLAGGSGAEASLTANRTALDRVFVVPRMLCDLTGSTTEAELLGRRAALPMAVAPVAYQRLFHPEGELAAARAARDAGVPYTICTLSSVPLEEVAAVGGRPWFQLYWLRDEKRSLELVRRAEDAGCEAIVFTVDVPWMGRRWRDMRNGFALPESVTAANFDAGSAAHRRTRGASAVADHTAREFAPATWESVATVRAHTDLPVVLKGILAAEDARRAVEAGADGIVVSNHGGRQLDGAVPGIEVLGEIAAEVSGRCEVLLDGGIRTGGDILKAAALGASGVLVGRPVMWGLAAAGQEGVRQVFELLAAELRNALGLAGCDSVSAAGRLGTRVPRYG

SEQ ID NO: 23503 - DNA, 1119 bp, Streptomyces lavendulae
  CDS (1)..(1119)
atggcctgcgatgactccggcgggggcgcggcggcggtctggctcgacatggaggacgtcgagcgggccgccgccgcggcgctgccgcccgacgtgtgggacttcatcgccgggggcagcggccgggaactgtcgctcgcggccaaccgggcggcgttcgacgccgtgttcgtgcgcccccggatcctccgggacgtgtccgggtgcggcgcggagtcgacgctgctcgggcgtgcggtgcgcatgccggtggcgatcggaccggtggcctatcaccgactggtgtgtcccgagggcgagttggcgaccgcgcgggccgcgaaggcggcgggggtgcccttcaccctggcgacgctgagcagtgtgccggtggaggaggtcacggcggtaggcggctcggtgtggttccagctgtactggctgcgtgacaccgggcggacgctggatctggtccgcaggggggaggacgcgggctgcgaggcgatcgtgctcaccgtcgacgtgccgtggatgggccgccggctgcgtgatgtccgcaatggattcgccctgccggatcacgtccgcgcggtccatctgggcggtggcgcctcgacggcacaccgcgggggcgacggtgcgtcagccgtggccgtgcacacggcggagaccttctcccggtccctgacctggtcgaacgtggagcggttgcgcgagtgcacgcggctgccgatcgtactcaagggcgtgctggctcccgaggacgcgcggcgcgcggtggaacacggcgtcgacgccgtgggggtctccaaccacggtggccgccagttggacggcgcgctgaccgccgtggacgcactgccagaggtggtggaggccgtaggcggcacttgcgagatcctcctggacggcggtgtgcgcagcggcacggacgtcctcaaggccctcgccctcggtgcgtcgggcgtactggtcggtcgcgccccggtctggggccttgcggccggcggcgaggacggcgtccggcaggtgctggaactcctggccgccgaagtgacggacgcgctggggctggccggatgtgcgggggtcgcggaggcgcgggagctggacgcggtggtggcacggggccgccggtag

SEQ ID NO: 23504 - protein, 372 aa, Streptomyces lavendulae
MACDDSGGGAAAVWLDMEDVERAAAAALPPDVWDFIAGGSGRELSLAANRAAFDAVFVRPRILRDVSGCGAESTLLGRAVRMPVAIGPVAYHRLVCPEGELATARAAKAAGVPFTLATLSSVPVEEVTAVGGSVWFQLYWLRDTGRTLDLVRRGEDAGCEAIVLTVDVPWMGRRLRDVRNGFALPDHVRAVHLGGGASTAHRGGDGASAVAVHTAETFSRSLTWSNVERLRECTRLPIVLKGVLAPEDARRAVEHGVDAVGVSNHGGRQLDGALTAVDALPEVVEAVGGTCEILLDGGVRSGTDVLKALALGASGVLVGRAPVWGLAAGGEDGVRQVLELLAAEVTDALGLAGCAGVAEARELDAVVARGRR

SEQ ID NO: 23505 - DNA, 1137 bp, Rhizobium loti
  CDS (1)..(1137)
atgagcgacattctcaccatcgcggacctcaaggatctcgcccgccggcgcgtgcccaagatgtttttcgactatgccgattcaggcgcctggaccgagagcacctatcgggccaacgaggaagatttccagaagatcaagttccgccagcgcgtgatggtcgacatgagcaaccggtcgctggaatcgaccatgatcggccagaaagtgtcgatgccggtggcgctggcgccgaccggcctgaccggcatgcagcacgccgatggcgagatgctggcggcgaaggcggcggaggaattcggcgtgcctttcaccctgtcgacgatgagcatctgctcgatcgaggatgtcgcctcggcgacgacgaaaccgttctggttccagctctatgtgctgcgcgacaaggatttcgtgctcgatttgatcgaccgcgccaaggcggcgaaatgctcggcgctggtcctgacgctcgatctgcagatccttggccagcgccacaaggatgtgcgcaacgggctttcggcgccgcccaagatgacgctggccaacatcatcgacctggccagcaagccacgctggtgcctgggtatcgccggcaccaagcgccgtaccttccgcaacatcgtcggccacgccaagggtgtcggcgacgtgtcttcgctgtcgtcctggacaaacgagcagttcgacccgcagctgtcgtggaaggatgtcgcctggatcaaggaacgctggggcggcaagctgatcctgaaaggcatcctcgacaaggaggacgcgctgatggcggccaagaccggcgccgacgcgatcgtggtttccaaccatggcgggcgccagctcgatggcgcatcgtcctcgatcatggtgctcgaagaaatcgcggacacggtcggcgacagaatagaggtgcatatggacggcggcatccgctccggccaggacgtcctgaaggcgctctgcctcggcgccaagggcacctatatcggccggccgttcctttacggcctcggtgcgctcggcaaggaaggggttaccaaagcgttggaaatcatccgcaaggagatggacatcacgctggctctgtgcggaaagcgtctagtcaccgacatgggcaaggaccagctccggcgctag

SEQ ID NO: 23506 - protein, 378 aa, Rhizobium loti
MSDILTIADLKDLARRRVPKMFFDYADSGAWTESTYRANEEDFQKIKFRQRVMVDMSNRSLESTMIGQKVSMPVALAPTGLTGMQHADGEMLAAKAAEEFGVPFTLSTMSICSIEDVASATTKPFWFQLYVLRDKDFVLDLIDRAKAAKCSALVLTLDLQILGQRHKDVRNGLSAPPKMTLANIIDLASKPRWCLGIAGTKRRTFRNIVGHAKGVGDVSSLSSWTNEQFDPQLSWKDVAWIKERWGGKLILKGILDKEDALMAAKTGADAIVVSNHGGRQLDGASSSIMVLEEIADTVGDRIEVHMDGGIRSGQDVLKALCLGAKGTYIGRPFLYGLGALGKEGVTKALEIIRKEMDITLALCGKRLVTDMGKDQLRR

SEQ ID NO: 23507 - DNA, 1059 bp, Rhizobium loti
  CDS (1)..(1059)
atgccacttgacatcgaaacccggtttctcggcttggcggattttgaaccggctgcgcgagaggtgttgccgcatgcggtctacgagttcattgccgggggtgctggcgacgaaatcaccaagcgtgacaatgaagcggcattcgaccgcatcaggttgaggcagcgtgtgctgcgcgatgtcacaagacttgataccgcgatcacactctttgggcaaaggctgacgcatccgatcatcctggccccaatagcataccagcgactggcgcatccggaaggcgaggtggccacggcgcgcggcgccggagtggcggaagcggtgttcattctgggtactacggcgacggcggcgatcgaggattgcgtggcggagagccagtctcctgtgtggttcctgctttattggcaaagcgaccgcggtttcaatggcgaactcgtatcgcgcatggcggcactgggcgcaaaggcgatcagcgtaacggtcgacctgccaacgccaggcgatcgccgtaggcaattccgggcaggcttcaaaattcccgacagcctcgcaacgccgtacttcaaggaccggaacaccggcgtgctcaaagttggcactgcgcaaaagcgggccatgccgacctgggcggatattgcctggctgcgttcgctgacaaccctgccgcttatcctgaagggtatcctcgatcctgacgatgccgagcaagccatcggaactggtgcagatgctatagtcgtctcgaaccacggttcgcgtaacctcgacacactgccggcagccatcgacgccctgcccgccatcgcggagcgggtggccggccggatccccatcatcctcgatggcggcgttaggcgtggcaccgacgttttgaaggcgattgcgctaggggcaagcgctgtcatgattggccgcccttatgtctacgccctagcaacggctggtgccgagggcgtagcccactgcgtcaacctgcttcgccgtgacttcgagatggcaatggcgctaaccggccgggcgcgcctcggcgaaatcgaccggtcggtaatctggtga

SEQ ID NO: 23508 - protein, 352 aa, Rhizobium loti
MPLDIETRFLGLADFEPAAREVLPHAVYEFIAGGAGDEITKRDNEAAFDRIRLRQRVLRDVTRLDTAITLFGQRLTHPIILAPIAYQRLAHPEGEVATARGAGVAEAVFILGTTATAAIEDCVAESQSPVWFLLYWQSDRGFNGELVSRMAALGAKAISVTVDLPTPGDRRRQFRAGFKIPDSLATPYFKDRNTGVLKVGTAQKRAMPTWADIAWLRSLTTLPLILKGILDPDDAEQAIGTGADAIVVSNHGSRNLDTLPAAIDALPAIAERVAGRIPIILDGGVRRGTDVLKAIALGASAVMIGRPYVYALATAGAEGVAHCVNLLRRDFEMAMALTGRARLGEIDRSVIW

SEQ ID NO: 23509 - DNA, 1146 bp, Rhizobium loti
  CDS (1)..(1146)
atgcgactcaacgactgtcataacttctcagatttccgccgcatggcgcagcgaaggctgccggggccgatcttcgactacatcgatggcgcggccgacgacgaggtcacctatcgccgcaacaccgaaagtttcgagacctgcgacctcgtccccaacgtgctgcgcggggtgaatgagatcgacatgtcggtgacggtgatggggcagaagctggcgatgccgttctactgctcgccgaccgccctgcagcggcttttccatcaccagggcgagcgcgcagtggccaaggccgccgccaaatacggcaccatgttcggtgtctcctcgcttggcaccgtcagcctcgaggaggctcgaagcatcagcagcagtccgcaggtctaccagttctatttccaccgggatcgcggcctcaaccgggcgatgatgcagcgggcgaagcaagttggcgtcgaggtgatgatgctgaccgtcgacagcataacgggcggcaatcgcgagcgcgacaagcgcaccggctttgccattcccttcaagctcaacctcgcggggatggcgcagttcgcgctcaagccggcctgggcgatcaattatttcacgcatgaagggttcaagctgccgcagctcgacgagcatgtcgacatgggcggcggcacgatgtcgatcagccgctatttcaccgaaatgctcgatccgtcgatgacctgggacgatgtcgccgagatggtcaggcagtggtcggggccgttctgcctcaagggcatcatgtcggtcgaggacgccaaacgcgccgccgagatcggctgcagcggcattgtgctttccaatcatggcggccggcagctggacgggtcgcgggcggcattcgaccagctggccgagatcgtcgaggccgtcggcgaccggatcgatgtcatcatggatggcggcgtgcagcgcggcacacatgtgctgaaggccctctcgctcggcgccaaggcggtcggcatcggccgttactatctgtttccgctggcggcggccggccagccgggtgtcgaaagggcgcttgaacagatgcgggtcgagatcgagcgcggcatgaagctgatgggctgcagttcgatcggacaattgtcgcgccagaatctccgatttaggtaa

SEQ ID NO: 23510 - protein, 381 aa, Rhizobium loti
MRLNDCHNFSDFRRMAQRRLPGPIFDYIDGAADDEVTYRRNTESFETCDLVPNVLRGVNEIDMSVTVMGQKLAMPFYCSPTALQRLFHHQGERAVAKAAAKYGTMFGVSSLGTVSLEEARSISSSPQVYQFYFHRDRGLNRAMMQRAKQVGVEVMMLTVDSITGGNRERDKRTGFAIPFKLNLAGMAQFALKPAWAINYFTHEGFKLPQLDEHVDMGGGTMSISRYFTEMLDPSMTWDDVAEMVRQWSGPFCLKGIMSVEDAKRAAEIGCSGIVLSNHGGRQLDGSRAAFDQLAEIVEAVGDRIDVIMDGGVQRGTHVLKALSLGAKAVGIGRYYLFPLAAAGQPGVERALEQMRVEIERGMKLMGCSSIGQLSRQNLRFR

SEQ ID NO: 23511 - DNA, 1167 bp, Pasteurella multocida
  CDS (1)..(1167)
atgaaagatttatcaaaaatgacctgccttgaagacttacgccgtgttgcgcaacgtaaagtgccaaaaatgttttatgactatgtagtttcaggatcttggagcgaaagcacattgcatgccaaccgtaatgattttcaagcaattaagctacgtcaacgtgttttagtggatatggaaggtcgctcactggaaagcacaatgattggtcaacaagtcaaaatgccattagccattgcgccaaccggctttactggcatggttcaccccgacggtgaaatccatgcggcgcgtgcggcagaaaaatttggcattcccttttctctatcgaccatgtccatctgttctattgaagatgtggcagagcatacgagcgcaccattttggtttcaactctatgtcatgcgtgatcgtgagttcatgcgcaatttgattaaacgtgcacaagcagccaaatgctctgcactgattctgacagccgatctgcaagtgctcggacagcgccatcgtgatatcaaaaatggcttatccgccccacctaaacccactttaagaaactggataaatcttgccaccaaattggaatggagcttaaaaatgctcggtacacaacgccgtactttccgtaatattgtcggtcatgccaaaaatgttggcgatttatcctcactcacttcatggacctcagaacaatttgatccgcgtttaagctgggatgatgtggcagaaattaaagcattatggggaggtaaactcatcattaaagggataatggaaccagaagatgccgaaatggcggtgaaatccggtgctgatgccattgtggtatccaaccatggtggtcgtcagctagatggtgcgttatcctcgattcaagccttgccaaatatagtgagtgccgtagggaacgagattgaagtctggctagacagtggcattacgagtggtcaagatatgctgaaagcatgggcgatgggtgcgcgtggtttcatgactggtaaagcctttttacatggtctcggggcgtatggggaagctggggtacatcgtttactggaaattttctataaagaaatggatgtatctatggcgtttactggtcatcgtaacttaaaagacgtgaccgaagcaattttggtgaaaggcacttaccctaccgcaaactga

SEQ ID NO: 23512 - protein, 388 aa, Pasteurella multocida
MKDLSKMTCLEDLRRVAQRKVPKMFYDYVVSGSWSESTLHANRNDFQAIKLRQRVLVDMEGRSLESTMIGQQVKMPLAIAPTGFTGMVHPDGEIHAARAAEKFGIPFSLSTMSICSIEDVAEHTSAPFWFQLYVMRDREFMRNLIKRAQAAKCSALILTADLQVLGQRHRDIKNGLSAPPKPTLRNWINLATKLEWSLKMLGTQRRTFRNIVGHAKNVGDLSSLTSWTSEQFDPRLSWDDVAEIKALWGGKLIIKGIMEPEDAEMAVKSGADAIVVSNHGGRQLDGALSSIQALPNIVSAVGNEIEVWLDSGITSGQDMLKAWAMGARGFMTGKAFLHGLGAYGEAGVHRLLEIFYKEMDVSMAFTGHRNLKDVTEAILVKGTYPTAN

SEQ ID NO: 23513 - DNA, 1170 bp, Streptomyces rishiriensis
  CDS (1)..(1170)
atgggtgccatcagattcgctctgccgaagcagggccggccgatcagcatcgccgggtaccgaacggccgcccgccgggtcctgcccgacctggtgtgggcgtacgtggagaacggcgcggacgattccgtcacgttggcggccaaccggtctgcgttcgcccgctggtccctgcgtcaacgagtgctgcgcagttccgccgggcggaaaacggctgcccggttcggagacaccgagctggcgattccggtgatgattgcgccgaccgggatcaacggactggtgcactggcgcggcgagttggcaaccgcatgcggtgcggccgcagccggtagcaggatcgtgttgagcacggcagcgtcttattctgtcgaagaggtcgccgcggcgagcccggtcggacactggctccaggtctatccgtggcgcgatcgagaactcatggactggctgctcgagcgcggccgacgatcggattgccccacgctggtggtcacggttgacacaccggtgttcggaaaccgcgaaccggaacggctgcagggcatgagcatcccgcccgtgctcacccccaggcacgtgttggacgccgcgctgcacccccgatgggcgtacaaagtcctgcgccaccagcgggtgttcacgggcaacctggtcgggatgagcggagtgagggccggcgcgctcgcagcgaaagtgcgccgggaacggatgatggccggcgaactcgactgggacgacttcgccagggtccgcgcgcagtggcagggactctgttacgtcaagggaatcctggacgcagacgacgcagaacgcgctgtctcgctcggtgcggacgggatcatcgtgtccaatcacggcggccgacagctggacggcgccccggccacactggacgcgctgccggggatcgccgaccggctggcccaccgggccacggtgctcatcgacggcgggatccgcagaggcaccgacgtggtgaaggctctgtgcctcggtgcggacggctgcctgatcggtcggccggcgctctacggactcgccgtgggcggcgagtccggggtcgaacacgtgctcagcatcctgcgcgaggaaatcgaccgcaccctggcgctcatgggctgctcggacatcgccgatctcggccgggactggctcatccccgggtag

SEQ ID NO: 23514 - protein, 389 aa, Streptomyces rishiriensis
MGAIRFALPKQGRPISIAGYRTAARRVLPDLVWAYVENGADDSVTLAANRSAFARWSLRQRVLRSSAGRKTAARFGDTELAIPVMIAPTGINGLVHWRGELATACGAAAAGSRIVLSTAASYSVEEVAAASPVGHWLQVYPWRDRELMDWLLERGRRSDCPTLVVTVDTPVFGNREPERLQGMSIPPVLTPRHVLDAALHPRWAYKVLRHQRVFTGNLVGMSGVRAGALAAKVRRERMMAGELDWDDFARVRAQWQGLCYVKGILDADDAERAVSLGADGIIVSNHGGRQLDGAPATLDALPGIADRLAHRATVLIDGGIRRGTDVVKALCLGADGCLIGRPALYGLAVGGESGVEHVLSILREEIDRTLALMGCSDIADLGRDWLIPG

SEQ ID NO: 23515 - DNA, 1224 bp, Schizosaccharomyces pombe
  CDS (1)..(1224)
atgttccgcaactacaattggtttgacgcaaaagagcccatttcatatgagtccgaaatttacgctaaaggtctcaagtttcaaagaccccaaatcaccgtagatggcagacactgggagcaactggctgttgagcgaatgaccaaggatgccgccggctacgtttacggatgtgcaggaaaaagagagacatatgataaaaatatggaatcctttaagaaatggtccatcattcctaaccgtctcatcaagtctggtttccccgacttgtctaccactgtctttggccaaaaatatccttttcctattgccttggctcctgtaggagtacaaaaaattttcaatccagagggtgaaagtggatcgtgtgccgctgcaactagagagcatataccctatattatcagtactgcgtctgcaaccagctttgaagatatagaaaaggctagtggtcctggagagagatggtatcaactttattggccaagcaatgaccatcaagacattaccattagtttgctcaaccgcgccaagaaaacgggctgcagagttttgatagttactcttgacacatttattcttggatggcgtccctcagacatggacaatggttacgatccattcttaaatcctgacagcatcggtgttgaacacggattttccgaccccgttttccgtaagcagtttaaggagaagcatggtgtggaagtcgaagaaaatatgttagaggcagctaaagagtttgctggaattgtctttcctggaatcagccatgattgggaagacttgaagttccttcgtaaacattgggatggcccaattgttctcaaaggtatcatgaatgttcctgatgctaagaaggcagttgaatatggcatgcagggcatcgttgtatcaaatcatggcggtagacaacaagatggaggtgttgcttccttgacgatgctaccaaagatcgtagatgctgttggtgataaattagatgttctatttgactctggtgttcgttcaggtgctgacattgccaaggcccttgcattaggagctaagatggttttaatcggtcgtccctatgtttacgggttagcccttgaaggttcatccggtgttagtcatgtcattcgttgtctcttgggagatttggaattaacgctacatctatctggtattgtatctgtgaaaccaaaggacttaaaccgtgatgtcttatataaggaggaataa

SEQ ID NO: 23516 - protein, 407 aa, Schizosaccharomyces pombe
MFRNYNWFDAKEPISYESEIYAKGLKFQRPQITVDGRHWEQLAVERMTKDAAGYVYGCAGKRETYDKNMESFKKWSIIPNRLIKSGFPDLSTTVFGQKYPFPIALAPVGVQKIFNPEGESGSCAAATREHIPYIISTASATSFEDIEKASGPGERWYQLYWPSNDHQDITISLLNRAKKTGCRVLIVTLDTFILGWRPSDMDNGYDPFLNPDSIGVEHGFSDPVFRKQFKEKHGVEVEENMLEAAKEFAGIVFPGISHDWEDLKFLRKHWDGPIVLKGIMNVPDAKKAVEYGMQGIVVSNHGGRQQDGGVASLTMLPKIVDAVGDKLDVLFDSGVRSGADIAKALALGAKMVLIGRPYVYGLALEGSSGVSHVIRCLLGDLELTLHLSGIVSVKPKDLNRDVLYKEE

SEQ ID NO: 23517 - DNA, 1164 bp, Drosophila melanogaster
  CDS (64)..(1164)
ggaggtgcgtcaagaggtgttgtcaaacattgtatatttccattctcctgttatataacagccatggctttggtttgcgtagaggactttgaaaagaaggccgttgggcaactggagaagaatgccctggactactaccgtagcggagccggtgagcagttcaccttgggactgaatcgcgaggccttccgccggctacgcttgcgacctcgttgtttgagagatgtctcccgcctggacattagtaccaagatcttcggcgagcagatgcagtggcctctgggcattgctccgacggctatgcagaagatggcccatccggacggcgaggtaggcaatgccagggcggccggaaaagccggctccatctttatactcagcacactgtccaccacttcgctggaggatttggcagccggtgccccggataccatcaaatggttccaactgtacatctacaaggatcgtaccataacggaaaagctggtacgtcgtgccgagaaggcgaacttcaaagcgctcgtcctgaccatcgatgctccaatctttggacaccgtagagccgatgtgcgcaacaacttcagcttgccgtcgcacctgtcattggccaatttccagggcgttaaggctactggagtgggtaatgccgctatgggcgcctcaggcattaatgagtacgtctccagccagtttgatccaaccataacctggaaggatattgcctggttgaagggcatcactcatctgcccattgtggtcaagggagtgctgactgccgaagatgctgtgttggcccaggagtttggatgcgccggactcattgtttccaaccacggtgctcgtcagatcgatacggttccggcctcgatcgaagccctgccggagatcgtaaaggccgtgggagataatctggtggttatgctggacggaggcattatgcagggcaatgatatcttcaaggctttggctttgggagccaagacggtctttgtgggtcgtccggctgtctggggattggcctacaatggacagaaaggcgtggaggagatgctgagtgtgctgagaaaggactttgagaccaccatggcgctgatcggttgccaaaatttgggagacatcacgtcggcaatggtggtacatgagagtcaatatgccaagctgtaa

SEQ ID NO: 23518 - protein, 366 aa, Drosophila melanogaster
MALVCVEDFEKKAVGQLEKNALDYYRSGAGEQFTLGLNREAFRRLRLRPRCLRDVSRLDISTKIFGEQMQWPLGIAPTAMQKMAHPDGEVGNARAAGKAGSIFILSTLSTTSLEDLAAGAPDTIKWFQLYIYKDRTITEKLVRRAEKANFKALVLTIDAPIFGHRRADVRNNFSLPSHLSLANFQGVKATGVGNAAMGASGINEYVSSQFDPTITWKDIAWLKGITHLPIVVKGVLTAEDAVLAQEFGCAGLIVSNHGARQIDTVPASIEALPEIVKAVGDNLVVMLDGGIMQGNDIFKALALGAKTVFVGRPAVWGLAYNGQKGVEEMLSVLRKDFETTMALIGCQNLGDITSAMVVHESQYAKL

SEQ ID NO: 23519 - DNA, 1164 bp, Rhodobacter sphaeroides
  CDS (1)..(1164)
atgcccgtcatcacctgcatcgaggacctgaagcggatgcaccgccgtcgggcgccccgcatgttcttcgactattgcgagtcgggcagctacaccgagcagaccttccgcgacaattgctcggatttccagaagatccgcctccggcagaaggtcgcggtggacatgctcggccgctcgacccgctcggagatgatcggcgagccggtggccatgccggtggcgctcgcgccggtgggcatgaccgggatgcagtgcgccgatggcgagatcaaggcggcgcgcgcggccgaggccttcggcgtgccctacacgctctccaccatgtcgatctgctcggtcgaggacgtggccgcggccacgaccaagcccttctggttccagctctatgtgatgaaggacgaggaattcgtcgatggcatgctcgagcgggtgaagaaggcgggctgctcggcgctggtgctgacgctcgacctgcagatcctcggccagcgccacaaggatctgcggaacggcctctcggcgccgccgaagatgacgctgccggtgatgctcgacctcgccaccaaatggggctgggggctcgagatgctgaagacccaccgccgcagcttcggcaacatcgtgggccatgccaagggcgtgggcgacacctcgagccttgcgagctggactgccgaacagttcgacccgcagctcgactggggcaagatcgcccggctgcgcgacaagtggggcggcaagctgatcctgaagggcatcctcgacgaggaggatgcgcgccgcgcggccgacttcggcgcggatgcgatcatcgtctcgaaccacggcgggcgccagctcgacggggcgctctcctcgatccgcatgctgccgccgatcgtgcgggcggtgggcgatcaggtcgagatccacatggatggcggcatccgctcggggcaggatgtgctgaaggcgctggcgatgggcgcgaagggcaccttcatcggccgctcctacatctacgggctgggcgcgatgggagaggcgggcgtgcggcgcgcgctcgaggtgatctggaaggagctcgacatctcgatggcgctctgcggcgagaaggacgtgaaggcgctggggcctcacaacctgctggtgcccgatgatttcgagggccgctgggcctga

SEQ ID NO: 23520 - protein, 387 aa, Rhodobacter sphaeroides
MPVITCIEDLKRMHRRRAPRMFFDYCESGSYTEQTFRDNCSDFQKIRLRQKVAVDMLGRSTRSEMIGEPVAMPVALAPVGMTGMQCADGEIKAARAAEAFGVPYTLSTMSICSVEDVAAATTKPFWFQLYVMKDEEFVDGMLERVKKAGCSALVLTLDLQILGQRHKDLRNGLSAPPKMTLPVMLDLATKWGWGLEMLKTHRRSFGNIVGHAKGVGDTSSLASWTAEQFDPQLDWGKIARLRDKWGGKLILKGILDEEDARRAADFGADAIIVSNHGGRQLDGALSSIRMLPPIVRAVGDQVEIHMDGGIRSGQDVLKALAMGAKGTFIGRSYIYGLGAMGEAGVRRALEVIWKELDISMALCGEKDVKALGPHNLLVPDDFEGRWA

SEQ ID NO: 23521 - DNA, 1179 bp, Rhodococcus erythropolis
  CDS (1)..(1179)
atggctaagaatgctttcttcgagacggtggcagaagcacagcgccgtgcgaagaagaggttgcccaagtccgtgtacgcggcgttggtggcgggatccgagaaagggctgacggtcgacgacaacgtcgcggcattcagtgaactgggtttcgctcctcacgctgcgggactgtcggacaagcgcgagatgtccaccaccattatgggccaggacatttcgttgcctgtcatgatttcaccgaccggtgtgcaggcagtgcaccccgacggtgaggtagcggtagctcgtgcggctgcagcacggggaacagccatcggactgagttctttcgccagcaagtccatcgaagaagttgccgcggccaacccgcaggtcttcttccagatgtattgggtcggcagccgcgacgtgctcctgcagcgtatggagcgcgctcgcgctgccggtgccaagggcctgatcatcaccaccgactggtccttctcgtacggtcgcgactggggcagcccgtcaatccccgaaaagatggacctcaaggcgatgttccagttcgcccccgagggcatcatgcgcccgaagtggttgctggagttcgccaagaccggcaagatccccgatctgacaacacccaacctcgcggctcccggccagccggcaccgacgttcttcggcgcgtacggcgagtggatgcagaccccgcttccgacgtgggaagacatcgcctggcttcgtgagcagtggggtggaccgttcatgctcaagggcatcatgcgcatcgacgacgccaagcgagctgtcgacgccggtgtctccgctatctcggtctccaaccacggtggtaacaacctcgacggcaccccggcgccgatccgcgtgctcccgggcattgccgaggccgtgggcgatcaggtggaagttgttctcgacggcggcattcgacgcggcggcgacgtcgtcaaggcgctagcactcggagccaaggccgtcatgctcgggcgcgcctacctgtggggtctctcggcaaacggccaggccggtgtcgagaacgtgctcgacctgatgcggatgggcatcgactcggggctgatgggccttggccactcgtccatcaccgaactgagcccggcagacctggtgatcccggaaggcttcacacgctcactgggcgccagctga

SEQ ID NO: 23522 - protein, 392 aa, Rhodococcus erythropolis
MAKNAFFETVAEAQRRAKKRLPKSVYAALVAGSEKGLTVDDNVAAFSELGFAPHAAGLSDKREMSTTIMGQDISLPVMISPTGVQAVHPDGEVAVARAAAARGTAIGLSSFASKSIEEVAAANPQVFFQMYWVGSRDVLLQRMERARAAGAKGLIITTDWSFSYGRDWGSPSIPEKMDLKAMFQFAPEGIMRPKWLLEFAKTGKIPDLTTPNLAAPGQPAPTFFGAYGEWMQTPLPTWEDIAWLREQWGGPFMLKGIMRIDDAKRAVDAGVSAISVSNHGGNNLDGTPAPIRVLPGIAEAVGDQVEVVLDGGIRRGGDVVKALALGAKAVMLGRAYLWGLSANGQAGVENVLDLMRMGIDSGLMGLGHSSITELSPADLVIPEGFTRSLGAS

SEQ ID NO: 23523 - DNA, 1241 bp, Arabidopsis thaliana
  CDS (1)..(1104)
atggagatcactaacgttaccgagtatgatgcaatcgcaaaggcgaagttgcctaagatggtatatgactactatgcatctggtgcagaagatcaatggactcttcaagagaacagaaacgcttttgcaagaatcctcttccggcctcggattttgattgatgtgaacaaaattgatatggcgactaccgtcttggggttcaagatctcgatgccgatcatggttgctcctactgcctttcaaaagatggctcaccctgatggggaatatgctacggctagagctgcgtctgctgctggaaccatcatgacactatcttcatgggctacttcaagtgttgaagaagttgcttccacagggccaggaatccgattcttccagctctatgtatacaagaacaggaaggtggttgagcagctcgtgagaagagccgagaaagctgggttcaaagccattgctctcactgtagacaccccaaggctaggtcgcagagagtctgatatcaagaacagattcactttgcctccaaacctgacattgaagaactttgaaggtcttgaccttggaaagatggacgaggccaatgactctggcttggcttcgtatgttgctggtcaaattgaccgtaccttgagctggaaggatatccagtggctccaaacaatcaccaacatgccaattcttgtcaagggtgttcttacaggagaggatgcaaggatagcgattcaagctggagcagcagggatcattgtgtcaaatcatggagctcgccagcttgattatgtcccagcaacaatctcagcccttgaagaggttgtcaaagcaacacaaggacgagttcctgtcttcttggatggtggtgttcgacgtggcactgatgtcttcaaggcacttgcacttggagcctctggaatatttattggaagaccagtggtttttgcactagctgctgaaggagaagccggagtcaaaaaggtgcttcaaatgttgcgtgatgagttcgagctaaccatggcactaagtgggtgccggtcactcagtgaaatcacccgtaaccacattgtcacggaatgggacactccacgccatttgcccaggttatagagaagaaaaaaaaaacagagaacagaaacaacacggcaccaaaacgtattcatattctgattgatcactttgcttctactctgctatatttatatctcgaaaaacttgtttctccctatatcggatcacaaaaacgt

SEQ ID NO: 23524 - protein, 367 aa, Arabidopsis thaliana
MEITNVTEYDAIAKAKLPKMVYDYYASGAEDQWTLQENRNAFARILFRPRILIDVNKIDMATTVLGFKISMPIMVAPTAFQKMAHPDGEYATARAASAAGTIMTLSSWATSSVEEVASTGPGIRFFQLYVYKNRKVVEQLVRRAEKAGFKAIALTVDTPRLGRRESDIKNRFTLPPNLTLKNFEGLDLGKMDEANDSGLASYVAGQIDRTLSWKDIQWLQTITNMPILVKGVLTGEDARIAIQAGAAGIIVSNHGARQLDYVPATISALEEVVKATQGRVPVFLDGGVRRGTDVFKALALGASGIFIGRPVVFALAAEGEAGVKKVLQMLRDEFELTMALSGCRSLSEITRNHIVTEWDTPRHLPRL

SEQ ID NO: 23525 - DNA, 1427 bp, Arabidopsis thaliana
  CDS (52)..(1155)
acttcatctctccccagagctctattcccatcaagaaacacacttcggaagatggagatcactaacgttaccgagtatgatgcaatcgcaaagcagaagctgcctaagatggtgtacgactactatgcatctggtgcagaagaccaatggactcttcaagagaacagaaacgcttttgcaaggatcctctttcggcctcggattctgattgatgtgagcaagattgacatgacaaccaccgtcttggggttcaagatctcgatgcccatcatggttgctccaactgccatgcaaaagatggctcaccctgatggggaatatgctactgctagagctgcatctgcagctggaactatcatgacactatcttcatgggctacttccagcgttgaagaagttgcgtctacagggccagggatccgattcttccagctctatgtatacaagaacaggaatgtggttgagcagctcgtgagaagagctgagagggctgggttcaaagccattgctctcactgtagacaccccaaggctaggccgcagagagtctgatatcaagaacagattcactttgcctccaaacctgacattgaagaactttgaaggacttgacctcggaaagatggacgaggccaatgactctggcttggcttcatatgttgctggtcaaattgaccgtaccttaagctggaaggatgtccagtggctccagacaatcaccaagttgcccattcttgtcaaaggtgttcttacaggagaggatgcaaggatagcgattcaagctggtgcagccggaatcattgtatcaaaccatggagctcgccagcttgactatgtcccagcaaccatctcggcccttgaagaggttgtcaaagcgacacaaggacgaattcctgtcttcttggatggtggtgttcgacgtggcactgatgtcttcaaagcacttgcacttggagcctccgggatatttattggaagaccagtggtattctcattggcagctgaaggagaggctggagttagaaaggtgcttcaaatgctacgtgatgagttcgagctgaccatggcactgagtgggtgtcggtccctaaaggaaatctcccgtaaccacattaccaccgaatgggacactccacgtccttcagccaggttatagagaggaaaataaccaacaagcagagaacagcagcaacacagaaccaaaatattggctaaacttattcatactctgattgtacttggcttctactctgctaaatatctcaagacttgtttctccctctatcagatcacaaaccaagcctagtgattctgtaatactatttggctacttctttcttaaggccattcttatttctaaattccatgtacttacattcccacagatcaatttcttgtgattcccagataatacgatgaacatatgct

SEQ ID NO: 23526 - protein, 367 aa, Arabidopsis thaliana
MEITNVTEYDAIAKQKLPKMVYDYYASGAEDQWTLQENRNAFARILFRPRILIDVSKIDMTTTVLGFKISMPIMVAPTAMQKMAHPDGEYATARAASAAGTIMTLSSWATSSVEEVASTGPGIRFFQLYVYKNRNVVEQLVRRAERAGFKAIALTVDTPRLGRRESDIKNRFTLPPNLTLKNFEGLDLGKMDEANDSGLASYVAGQIDRTLSWKDVQWLQTITKLPILVKGVLTGEDARIAIQAGAAGIIVSNHGARQLDYVPATISALEEVVKATQGRIPVFLDGGVRRGTDVFKALALGASGIFIGRPVVFSLAAEGEAGVRKVLQMLRDEFELTMALSGCRSLKEISRNHITTEWDTPRPSARL

SEQ ID NO: 23527 - DNA, 1136 bp, Homo sapiens
  CDS (24)..(1136)
tgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctga

SEQ ID NO: 23528 - protein, 370 aa, Homo sapiens
MLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 23529 - DNA, 2029 bp, Mus musculus
  CDS (21)..(1133)
ggttgccctaccctgccacaatgttgcctcgactggtctgcatcagtgattatgaacagcatgtccgatcagtgcttcagaagtcagtgtatgactattacaggtctggggcaaatgatcaggagacgttagctgataacatccaagcattttctagatggaagctctatccacggatgcttcgcaacgttgctgatatcgatctgtcaacttctgttttaggacagagagtcagcatgccaatatgtgttggggctactgccatgcagtgcatggctcacgtggacggggagctggccactgtgcgagcctgtcagaccatgggaactggcatgatgctgagttcttgggctacctcctcaatagaagaagtggcagaagctggcccagaggcacttcgctggatgcaactgtacatctacaaagaccgtgagatcagcagacagatagtgaagcgagctgagaagcagggttacaaggccatatttgtgactgtggacaccccttacctgggcaaccgcattgatgacgtgcggaacaggttcaagctgccaccacaactcaggatgaaaaactttgaaaccaatgatttggcattttctcctaagggaaattttggagacaacagtggacttgctgaatatgtggcacaagctatagacccatctctcagctgggatgatattacatggctcagacgattgacatcactgcctattgttgtaaagggcattttgagaggtgatgatgccaaggaagctgttaaacatggtgtggatgggatcttggtgtcgaatcatggggcgcgacaactggatggggtgccagctactattgatgtcctgccagagattgttgaggctgtggaagggaaggtagaagtcttcctggatgggggagtaaggaaaggtactgatgttctcaaagctctggccctaggagccaaggccgtttttgtgggaagacccatcatctggggcttggctttccagggggagaaaggtgttcaagatgtcctcgagatattgaaggaagaattccgactggccatggctctgagtgggtgccagaatgtgaaagtcatcgacaagacattggtgaggaaaaatcctttggctgtttccaagatctgacagtgcacaatattttcccatctgtattattttttttccagcgtggattacttgacaaagagacactgtgcagagggtgaccacagactgtaactccccacttctatacaaagggtgtcgttcttttccaacaaaatagccaccccttttccttcattgcttttgacttttcaatgggtgtcctaggaaccttctagaaagaaatggacttgcatcctggaaatatattaactgttaaaaagaaaacattgaaaatgtgtttgggcaacgtcatcccctggcaggctaaagtgctggggaacaaaagatatcctctggtgagattgcagggtagcatgctgaagtgaaagatactgacctcactgttcattaacctgtcttctgtttagatttccttaagacagtggctcttacagtttgcacttggctttgaaatgctggaaatgcccagagaaacatgaggtttggatttgccatgttgagaaaatagcaccaggtagaattgaaatggatggtggtaatttgtgattttttttctagaaacttttcattttttaacaccctatttttttgaaggtagatttttagctatatatcacacgtctgaatatgtctggatgtttgtggcactcattgcatttgacagggatgtgtctagtccagttgggaccacatggagcttttactttttgaacctttggtctcctcattctcattttaaaataagtgttgacttcctaattcctcttgaatcttttttgattttctcacttttcctcatttatagtcacattcagtgtaaagtacatattttgtggggtccgtgatgaataaagatttgaaattcttgttcagaaggaaggcaaaaaaaaaaaaaagtctttccttttatcaca

SEQ ID NO: 23530 - protein, 370 aa, Mus musculus
MLPRLVCISDYEQHVRSVLQKSVYDYYRSGANDQETLADNIQAFSRWKLYPRMLRNVADIDLSTSVLGQRVSMPICVGATAMQCMAHVDGELATVRACQTMGTGMMLSSWATSSIEEVAEAGPEALRWMQLYIYKDREISRQIVKRAEKQGYKAIFVTVDTPYLGNRIDDVRNRFKLPPQLRMKNFETNDLAFSPKGNFGDNSGLAEYVAQAIDPSLSWDDITWLRRLTSLPIVVKGILRGDDAKEAVKHGVDGILVSNHGARQLDGVPATIDVLPEIVEAVEGKVEVFLDGGVRKGTDVLKALALGAKAVFVGRPIIWGLAFQGEKGVQDVLEILKEEFRLAMALSGCQNVKVIDKTLVRKNPLAVSKI

SEQ ID NO: 23531 - DNA, 22 bp, Primer
atgattatttccgcagccagcg

SEQ ID NO: 23532 - DNA, 23 bp, Primer
ttatgccgcattccctttcgcca

SEQ ID NO: 23533 - DNA, 2063 bp, Saccharomyces cerevisiae; identical to SEQ ID NO: 16128
  CDS (301)..(1872)

SEQ ID NO: 23534 - protein, 523 aa, Saccharomyces cerevisiae; identical to SEQ ID NO: 16129

SEQ ID NO: 23535 - DNA, 27 bp, Primer
atgtaccaaaataatgtattgaatgct

SEQ ID NO: 23536 - DNA, 25 bp, Primer
tcaatagtgcattaactctcccatt

SEQ ID NO: 23537 - DNA, 432 bp, Saccharomyces cerevisiae; identical to SEQ ID NO: 6880
  CDS (1)..(432)

SEQ ID NO: 23538 - protein, 143 aa, Saccharomyces cerevisiae; identical to SEQ ID NO: 6881

SEQ ID NO: 23539 - DNA, 309 bp, Arabidopsis thaliana (mouse-ear cress); identical to SEQ ID NO: 6882
  CDS (1)..(309)

SEQ ID NO: 23540 - protein, 102 aa, Arabidopsis thaliana (mouse-ear cress); identical to SEQ ID NO: 6883

SEQ ID NO: 23541 - DNA, 501 bp, Brucella melitensis; identical to SEQ ID NO: 6884
  CDS (28)..(306)

SEQ ID NO: 23542 - protein, 92 aa, Brucella melitensis; identical to SEQ ID NO: 6885

SEQ ID NO: 23543 - DNA, 324 bp, Nostoc sp. PCC 7120; identical to SEQ ID NO: 6886
  CDS (1)..(324)

SEQ ID NO: 23544 - protein, 107 aa, Nostoc sp. PCC 7120; identical to SEQ ID NO: 6887

SEQ ID NO: 23545 - DNA, 309 bp, Arabidopsis thaliana (mouse-ear cress); identical to SEQ ID NO: 6888
  CDS (1)..(309)

SEQ ID NO: 23546 - protein, 102 aa, Arabidopsis thaliana (mouse-ear cress); identical to SEQ ID NO: 6889

SEQ ID NO: 23547 - DNA, 540 bp, Arabidopsis thaliana (mouse-ear cress); identical to SEQ ID NO: 6890
  CDS (1)..(540)

SEQ ID NO: 23548 - protein, 179 aa, Arabidopsis thaliana (mouse-ear cress); identical to SEQ ID NO: 6891

SEQ ID NO: 23549 - DNA, 327 bp, vaccinia virus; identical to SEQ ID NO: 6892
  CDS (1)..(327)

SEQ ID NO: 23550 - protein, 108 aa, vaccinia virus; identical to SEQ ID NO: 6893

SEQ ID NO: 23551 - DNA, 312 bp, Arabidopsis thaliana (mouse-ear cress); identical to SEQ ID NO: 6894
  CDS (1)..(312)

SEQ ID NO: 23552 - protein, 103 aa, Arabidopsis thaliana (mouse-ear cress); identical to SEQ ID NO: 6895

SEQ ID NO: 23553 - DNA, 309 bp, Arabidopsis thaliana (mouse-ear cress); identical to SEQ ID NO: 6896
  CDS (1)..(309)

SEQ ID NO: 23554 - protein, 102 aa, Arabidopsis thaliana (mouse-ear cress); identical to SEQ ID NO: 6897

SEQ ID NO: 23555 - DNA, 309 bp, Arabidopsis thaliana (mouse-ear cress); identical to SEQ ID NO: 6898
  CDS (1)..(309)

SEQ ID NO: 23556 - protein, 102 aa, Arabidopsis thaliana (mouse-ear cress); identical to SEQ ID NO: 6899

SEQ ID NO: 23557 - DNA, 393 bp, Arabidopsis thaliana (mouse-ear cress); identical to SEQ ID NO: 6900
  CDS (1)..(393)

SEQ ID NO: 23558 - protein, 130 aa, Arabidopsis thaliana (mouse-ear cress); identical to SEQ ID NO: 6901

SEQ ID NO: 23559 - DNA, 589 bp, Bos primigenius taurus (cattle); identical to SEQ ID NO: 6902
  CDS (36)..(356)

SEQ ID NO: 23560 - protein, 106 aa, Bos primigenius taurus (cattle); identical to SEQ ID NO: 6903

SEQ ID NO: 23561 - DNA, 309 bp, Arabidopsis thaliana (mouse-ear cress); identical to SEQ ID NO: 6904
  CDS (1)..(309)

SEQ ID NO: 23562 - protein, 102 aa, Arabidopsis thaliana (mouse-ear cress); identical to SEQ ID NO: 6905

SEQ ID NO: 23563 - DNA, 309 bp, Arabidopsis thaliana (mouse-ear cress); identical to SEQ ID NO: 6906
  CDS (1)..(309)

SEQ ID NO: 23564 - protein, 102 aa, Arabidopsis thaliana (mouse-ear cress); identical to SEQ ID NO: 6907

SEQ ID NO: 23565 - DNA, 575 bp, Oryza sativa (rice); identical to SEQ ID NO: 6908
  CDS (45)..(383)

SEQ ID NO: 23566 - protein, 112 aa, Oryza sativa (rice); identical to SEQ ID NO: 6909

SEQ ID NO: 23567 - DNA, 333 bp, Saccharomyces cerevisiae; identical to SEQ ID NO: 6910
  CDS (1)..(333)

SEQ ID NO: 23568 - protein, 110 aa, Saccharomyces cerevisiae; identical to SEQ ID NO: 6911

SEQ ID NO: 23569 - DNA, 612 bp, Saccharomyces cerevisiae; identical to SEQ ID NO: 6912
  CDS (1)..(612)

SEQ ID NO: 23570 - protein, 203 aa, Saccharomyces cerevisiae; identical to SEQ ID NO: 6913

SEQ ID NO: 23571 - DNA, 321 bp, Homo sapiens (man); identical to SEQ ID NO: 6914
  CDS (1)..(321)

SEQ ID NO: 23572 - protein, 106 aa, Homo sapiens (man); identical to SEQ ID NO: 6915

SEQ ID NO: 23573 - DNA, 583 bp, Ricinus communis (castor bean); identical to SEQ ID NO: 6916
  CDS (44)..(352)

SEQ ID NO: 23574 - protein, 102 aa, Ricinus communis (castor bean); identical to SEQ ID NO: 6917

SEQ ID NO: 23575 - DNA, 531 bp, Arabidopsis thaliana (mouse-ear cress); identical to SEQ ID NO: 6918
  CDS (1)..(531)

SEQ ID NO: 23576 - protein, 176 aa, Arabidopsis thaliana (mouse-ear cress); identical to SEQ ID NO: 6919

SEQ ID NO: 23577 - DNA, 698 bp, Mesembryanthemum crystallinum (common ice plant); identical to SEQ ID NO: 6920
  CDS (60)..(464)

SEQ ID NO: 23578 - protein, 134 aa, Mesembryanthemum crystallinum (common ice plant); identical to SEQ ID NO: 6921

SEQ ID NO: 23579 - DNA, 441 bp, Caenorhabditis elegans; identical to SEQ ID NO: 6922
  CDS (1)..(441)

SEQ ID NO: 23580 - protein, 146 aa, Caenorhabditis elegans; identical to SEQ ID NO: 6923

SEQ ID NO: 23581 - DNA, 361 bp, Schizosaccharomyces pombe; identical to SEQ ID NO: 6924
  CDS (24)..(329)

SEQ ID NO: 23582 - protein, 101 aa, Schizosaccharomyces pombe; identical to SEQ ID NO: 6925

SEQ ID NO: 23583 - DNA, 501 bp, Schizosaccharomyces pombe; identical to SEQ ID NO: 6926
  CDS (1)..(501)

SEQ ID NO: 23584 - protein, 166 aa, Schizosaccharomyces pombe; identical to SEQ ID NO: 6927

SEQ ID NO: 23585 - DNA, 309 bp, Arabidopsis thaliana (mouse-ear cress); identical to SEQ ID NO: 6928
  CDS (1)..(309)

SEQ ID NO: 23586 - protein, 102 aa, Arabidopsis thaliana (mouse-ear cress); identical to SEQ ID NO: 6929

SEQ ID NO: 23587 - DNA, 312 bp, Arabidopsis thaliana (mouse-ear cress); identical to SEQ ID NO: 6930
  CDS (1)..(312)

SEQ ID NO: 23588 - protein, 103 aa, Arabidopsis thaliana (mouse-ear cress); identical to SEQ ID NO: 6931

SEQ ID NO: 23589 - DNA, 391 bp, Arabidopsis thaliana (mouse-ear cress); identical to SEQ ID NO: 6932
  CDS (33)..(341)

SEQ ID NO: 23590 - protein, 102 aa, Arabidopsis thaliana (mouse-ear cress); identical to SEQ ID NO: 6933

SEQ ID NO: 23591 - DNA, 330 bp, Neurospora crassa; identical to SEQ ID NO: 6934
  CDS (1)..(330)

SEQ ID NO: 23592 - protein, 109 aa, Neurospora crassa; identical to SEQ ID NO: 6935

SEQ ID NO: 23593 - DNA, 533 bp, Fritillaria agrestis; identical to SEQ ID NO: 6936
  CDS (39)..(353)

SEQ ID NO: 23594 - protein, 104 aa, Fritillaria agrestis; identical to SEQ ID NO: 6937

SEQ ID NO: 23595 - DNA, 330 bp, Plasmodium yoelii yoelii; identical to SEQ ID NO: 6938
  CDS (1)..(330): m means a or c

SEQ ID NO: 23596 - protein, 109 aa, Plasmodium yoelii yoelii; identical to SEQ ID NO: 6939
  misc_feature (54)..(54): Xaa can be Asn or His

SEQ ID NO: 23597 - DNA, 294 bp, Bordetella bronchiseptica; identical to SEQ ID NO: 6940
  CDS (1)..(294)

SEQ ID NO: 23598 - protein, 97 aa, Bordetella bronchiseptica; identical to SEQ ID NO: 6941

SEQ ID NO: 23599 - DNA, 342 bp, Triticum aestivum; identical to SEQ ID NO: 6942
  CDS (1)..(342)

SEQ ID NO: 23600 - protein, 113 aa, Triticum aestivum; identical to SEQ ID NO: 6943

SEQ ID NO: 23601 - DNA, 324 bp, Aphelenchus avenae; identical to SEQ ID NO: 6944
  CDS (1)..(324)

SEQ ID NO: 23602 - protein, 107 aa, Aphelenchus avenae; identical to SEQ ID NO: 6945

SEQ ID NO: 23603 - DNA, 327 bp, Cowpox virus; identical to SEQ ID NO: 6946
  CDS (1)..(327)

SEQ ID NO: 23604 - protein, 108 aa, Cowpox virus; identical to SEQ ID NO: 6947

SEQ ID NO: 23605 - DNA, 495 bp, Oryza sativa; identical to SEQ ID NO: 6948
  CDS (1)..(495)

SEQ ID NO: 23606 - protein, 164 aa, Oryza sativa; identical to SEQ ID NO: 6949

SEQ ID NO: 23607 - DNA, 270 bp, Vibrio vulnificus; identical to SEQ ID NO: 6950
  CDS (1)..(270)

SEQ ID NO: 23608 - protein, 89 aa, Vibrio vulnificus; identical to SEQ ID NO: 6951

SEQ ID NO: 23609 - DNA, 525 bp, Arabidopsis thaliana; identical to SEQ ID NO: 6952
  CDS (1)..(525)

SEQ ID NO: 23610 - protein, 174 aa, Arabidopsis thaliana; identical to SEQ ID NO: 6953

SEQ ID NO: 23611 - DNA, 608 bp, Arabidopsis thaliana; identical to SEQ ID NO: 6954
  CDS (68)..(445)

SEQ ID NO: 23612 - protein, 125 aa, Arabidopsis thaliana; identical to SEQ ID NO: 6955

SEQ ID NO: 23613 - DNA, 340 bp, Arabidopsis thaliana; identical to SEQ ID NO: 6956
  CDS (1)..(309)

SEQ ID NO: 23614 - protein, 102 aa, Arabidopsis thaliana; identical to SEQ ID NO: 6957

SEQ ID NO: 23615 - DNA, 618 bp, Arabidopsis thaliana; identical to SEQ ID NO: 6958
  CDS (54)..(461)

SEQ ID NO: 23616 - protein, 135 aa, Arabidopsis thaliana; identical to SEQ ID NO: 6959

SEQ ID NO: 23617 - DNA, 420 bp, Populus tremula x Populus tremuloides; identical to SEQ ID NO: 6960
  CDS (1)..(420)

SEQ ID NO: 23618 - protein, 139 aa, Populus tremula x Populus tremuloides; identical to SEQ ID NO: 6961

SEQ ID NO: 23619 - DNA, 664 bp, Mus musculus; identical to SEQ ID NO: 6962
  CDS (37)..(507)

SEQ ID NO: 23620 - protein, 156 aa, Mus musculus; identical to SEQ ID NO: 6963

SEQ ID NO: 23621 - DNA, 508 bp, Tilia platyphyllos; identical to SEQ ID NO: 6964
  CDS (28)..(375)

SEQ ID NO: 23622 - protein, 115 aa, Tilia platyphyllos; identical to SEQ ID NO: 6965

SEQ ID NO: 23623 - DNA, 604 bp, Deschampsia antarctica; identical to SEQ ID NO: 6966
  CDS (85)..(426)

SEQ ID NO: 23624 - protein, 113 aa, Deschampsia antarctica; identical to SEQ ID NO: 6967

SEQ ID NO: 23625 - DNA, 327 bp, Plasmodium berghei; identical to SEQ ID NO: 6968
  CDS (1)..(327)

SEQ ID NO: 23626 - protein, 108 aa, Plasmodium berghei; identical to SEQ ID NO: 6969

SEQ ID NO: 23627 - DNA, 498 bp, Homo sapiens; identical to SEQ ID NO: 6970
  CDS (1)..(498)

SEQ ID NO: 23628 - protein, 165 aa, Homo sapiens; identical to SEQ ID NO: 6971

SEQ ID NO: 23629 - DNA, 456 bp, Theileria parva; identical to SEQ ID NO: 6972
  CDS (1)..(456)

SEQ ID NO: 23630 - protein, 151 aa, Theileria parva; identical to SEQ ID NO: 6973

SEQ ID NO: 23631 - DNA, 336 bp, Arabidopsis thaliana; identical to SEQ ID NO: 6974
  CDS (1)..(336)

SEQ ID NO: 23632 - protein, 111 aa, Arabidopsis thaliana; identical to SEQ ID NO: 6975

SEQ ID NO: 23633 - DNA, 383 bp, Mus musculus; identical to SEQ ID NO: 6976
  CDS (15)..(383)

SEQ ID NO: 23634 - protein, 122 aa, Mus musculus; identical to SEQ ID NO: 6977

SEQ ID NO: 23635 - DNA, 318 bp, Caenorhabditis elegans; identical to SEQ ID NO: 6978
  CDS (1)..(318)

SEQ ID NO: 23636 - protein, 105 aa, Caenorhabditis elegans; identical to SEQ ID NO: 6979

SEQ ID NO: 23637 - DNA, 324 bp, Trypanosoma brucei; identical to SEQ ID NO: 6980
  CDS (1)..(324)

SEQ ID NO: 23638 - protein, 107 aa, Trypanosoma brucei; identical to SEQ ID NO: 6981

SEQ ID NO: 23639 - DNA, 336 bp, Plasmodium falciparum; identical to SEQ ID NO: 6982
  CDS (1)..(336)

SEQ ID NO: 23640 - protein, 111 aa, Plasmodium falciparum; identical to SEQ ID NO: 6983

SEQ ID NO: 23641 - DNA, 654 bp, Homo sapiens; identical to SEQ ID NO: 6984
  CDS (11)..(505)

SEQ ID NO: 23642 - protein, 164 aa, Homo sapiens; identical to SEQ ID NO: 6985

SEQ ID NO: 23643 - DNA, 478 bp, Drosophila melanogaster; identical to SEQ ID NO: 6986
  CDS (48)..(392)

SEQ ID NO: 23644 - protein, 114 aa, Drosophila melanogaster; identical to SEQ ID NO: 6987

SEQ ID NO: 23645 - DNA, 351 bp, Drosophila melanogaster; identical to SEQ ID NO: 6988
  CDS (1)..(351)

SEQ ID NO: 23646 - protein, 116 aa, Drosophila melanogaster; identical to SEQ ID NO: 6989

SEQ ID NO: 23647 - DNA, 644 bp, Homo sapiens; identical to SEQ ID NO: 6990
  CDS (26)..(481)

SEQ ID NO: 23648 - protein, 151 aa, Homo sapiens; identical to SEQ ID NO: 6991

SEQ ID NO: 23649 - DNA, 572 bp, Gallus gallus; identical to SEQ ID NO: 6992
  CDS (47)..(352)

SEQ ID NO: 23650 - protein, 101 aa, Gallus gallus; identical to SEQ ID NO: 6993

SEQ ID NO: 23651 - DNA, 321 bp, Homo sapiens; identical to SEQ ID NO: 6994
  CDS (1)..(321)

SEQ ID NO: 23652 - protein, 106 aa, Homo sapiens; identical to SEQ ID NO: 6915

SEQ ID NO: 23653 - DNA, 531 bp, Lycopersicon esculentum; identical to SEQ ID NO: 6996
  CDS (45)..(371)

SEQ ID NO: 23654 - protein, 108 aa, Lycopersicon esculentum; identical to SEQ ID NO: 6997

SEQ ID NO: 23655 - DNA, 473 bp, Mus musculus; identical to SEQ ID NO: 6998
  CDS (9)..(332)

SEQ ID NO: 23656 - protein, 107 aa, Mus musculus; identical to SEQ ID NO: 6999

SEQ ID NO: 23657 - DNA, 575 bp, Sus scrofa; identical to SEQ ID NO: 7000
  CDS (24)..(344)

SEQ ID NO: 23658 - protein, 106 aa, Sus scrofa; identical to SEQ ID NO: 7001

SEQ ID NO: 23659 - DNA, 432 bp, Saccharomyces cerevisiae; identical to SEQ ID NO: 6880
  CDS (1)..(432)

SEQ ID NO: 23660 - protein, 143 aa, Saccharomyces cerevisiae; identical to SEQ ID NO: 6881

SEQ ID NO: 23661 - DNA, 441 bp, Caenorhabditis elegans; identical to SEQ ID NO: 6922
  CDS (1)..(441)

SEQ ID NO: 23662 - protein, 146 aa, Caenorhabditis elegans; identical to SEQ ID NO: 6923

SEQ ID NO: 23663 - DNA, 324 bp, Rattus norvegicus; identical to SEQ ID NO: 7006
  CDS (1)..(324)

SEQ ID NO: 23664 - protein, 107 aa, Rattus norvegicus; identical to SEQ ID NO: 7007

SEQ ID NO: 23665 - DNA, 378 bp, Arabidopsis thaliana; identical to SEQ ID NO: 7008
  CDS (1)..(378)

SEQ ID NO: 23666 - protein, 125 aa, Arabidopsis thaliana; identical to SEQ ID NO: 7009

SEQ ID NO: 23667 - DNA, 651 bp, Ashbya gossypii; identical to SEQ ID NO: 7010
  CDS (1)..(651)

SEQ ID NO: 23668 - protein, 216 aa, Ashbya gossypii; identical to SEQ ID NO: 7011

SEQ ID NO: 23669 - DNA, 336 bp, Ashbya gossypii; identical to SEQ ID NO: 7012
  CDS (1)..(336)

SEQ ID NO: 23670 - protein, 111 aa, Ashbya gossypii; identical to SEQ ID NO: 7013

SEQ ID NO: 23671 - DNA, 25 bp, Primer
atggagaccaatttttccttcgact

SEQ ID NO: 23672 - DNA, 26 bp, Primer
ctattgaaataccggcttcaatattt

SEQ ID NO: 23673 - DNA, 1017 bp, Saccharomyces cerevisiae; identical to SEQ ID NO: 13239
  CDS (1)..(1017)

SEQ ID NO: 23674 - protein, 338 aa, Saccharomyces cerevisiae; identical to SEQ ID NO: 13240

SEQ ID NO: 23675 - DNA, 903 bp, Chlamydophila pneumoniae, Chlamydia pneumoniae; identical to SEQ ID NO: 13241
  CDS (1)..(903)

SEQ ID NO: 23676 - protein, 300 aa, Chlamydophila pneumoniae, Chlamydia pneumoniae; identical to SEQ ID NO: 13242

SEQ ID NO: 23677 - DNA, 948 bp, Agrobacterium tumefaciens; identical to SEQ ID NO: 13243
  CDS (1)..(948)

SEQ ID NO: 23678 - protein, 315 aa, Agrobacterium tumefaciens; identical to SEQ ID NO: 13244

SEQ ID NO: 23679 - DNA, 876 bp, Chlamydia muridarum, Chlamydia trachomatis MoPn; identical to SEQ ID NO: 13245
  CDS (1)..(876)

SEQ ID NO: 23680 - protein, 291 aa, Chlamydia muridarum, Chlamydia trachomatis MoPn; identical to SEQ ID NO: 13246

SEQ ID NO: 23681 - DNA, 876 bp, Chlamydia trachomatis; identical to SEQ ID NO: 13247
  CDS (1)..(876)

SEQ ID NO: 23682 - protein, 291 aa, Chlamydia trachomatis; identical to SEQ ID NO: 13248

SEQ ID NO: 23683 - DNA, 1023 bp, Caenorhabditis elegans; identical to SEQ ID NO: 13249
  CDS (1)..(1023)

SEQ ID NO: 23684 - protein, 340 aa, Caenorhabditis elegans; identical to SEQ ID NO: 13250

SEQ ID NO: 23685 - DNA, 1228 bp, Arabidopsis thaliana (mouse-ear cress); identical to SEQ ID NO: 13251
  CDS (30)..(1094)

SEQ ID NO: 23686 - protein, 354 aa, Arabidopsis thaliana (mouse-ear cress); identical to SEQ ID NO: 13252

SEQ ID NO: 23687 - DNA, 975 bp, Schizosaccharomyces pombe; identical to SEQ ID NO: 13253
  CDS (1)..(975)

SEQ ID NO: 23688 - protein, 324 aa, Schizosaccharomyces pombe; identical to SEQ ID NO: 13254

SEQ ID NO: 23689 - DNA, 1086 bp, Giardia lamblia ATCC 50803; identical to SEQ ID NO: 13255
  CDS (1)..(1086)

SEQ ID NO: 23690 - protein, 361 aa, Giardia lamblia ATCC 50803; identical to SEQ ID NO: 13256

SEQ ID NO: 23691 - DNA, 1107 bp, Plasmodium yoelii yoelii; identical to SEQ ID NO: 13257
  CDS (1)..(1107)

SEQ ID NO: 23692 - protein, 368 aa, Plasmodium yoelii yoelii; identical to SEQ ID NO: 13258

SEQ ID NO: 23693 - DNA, 1068 bp, Neurospora crassa; identical to SEQ ID NO: 13259
  CDS (1)..(1068)

SEQ ID NO: 23694 - protein, 355 aa, Neurospora crassa; identical to SEQ ID NO: 13260

SEQ ID NO: 23695 - DNA, 879 bp, Chlamydophila caviae; identical to SEQ ID NO: 13261
  CDS (1)..(879)

SEQ ID NO: 23696 - protein, 292 aa, Chlamydophila caviae; identical to SEQ ID NO: 13262

SEQ ID NO: 23697 - DNA, 936 bp, Encephalitozoon cuniculi; identical to SEQ ID NO: 13263
  CDS (1)..(936)

SEQ ID NO: 23698 - protein, 311 aa, Encephalitozoon cuniculi; identical to SEQ ID NO: 13264

SEQ ID NO: 23699 - DNA, 918 bp, Encephalitozoon cuniculi; identical to SEQ ID NO: 13265
  CDS (1)..(918)

SEQ ID NO: 23700 - protein, 305 aa, Encephalitozoon cuniculi; identical to SEQ ID NO: 13266

SEQ ID NO: 23701 - DNA, 1317 bp, Arabidopsis thaliana; identical to SEQ ID NO: 13267
  CDS (44)..(1084)

SEQ ID NO: 23702 - protein, 346 aa, Arabidopsis thaliana; identical to SEQ ID NO: 13268

SEQ ID NO: 23703 - DNA, 1179 bp, Drosophila melanogaster; identical to SEQ ID NO: 13269
  CDS (151)..(1098)

SEQ ID NO: 23704 - protein, 315 aa, Drosophila melanogaster; identical to SEQ ID NO: 13270

SEQ ID NO: 23705 - DNA, 1552 bp, Mus musculus; identical to SEQ ID NO: 13271
  CDS (380)..(1522)

SEQ ID NO: 23706 - protein, 380 aa, Mus musculus; identical to SEQ ID NO: 13272

SEQ ID NO: 23707 - DNA, 1233 bp, Ashbya gossypii; identical to SEQ ID NO: 13273
  CDS (1)..(1233)

SEQ ID NO: 23708 - protein, 410 aa, Ashbya gossypii; identical to SEQ ID NO: 13274

SEQ ID NO: 23709 - DNA, 1368 bp, Oryza sativa; identical to SEQ ID NO: 13275
  CDS (60)..(1118)

SEQ ID NO: 23710 - protein, 352 aa, Oryza sativa; identical to SEQ ID NO: 13276

SEQ ID NO: 23711 - DNA, 873 bp, Parachlamydia sp; identical to SEQ ID NO: 13277
  CDS (1)..(873)

SEQ ID NO: 23712 - protein, 290 aa, Parachlamydia sp; identical to SEQ ID NO: 13278

SEQ ID NO: 23713 - DNA, 26 bp, Primer
atgaatagcgtaaaaagagtaaagct

SEQ ID NO: 23714 - DNA, 23 bp, Primer
ctaggccaaagacatcttagcca

SEQ ID NO: 23715 - DNA, 735 bp, Saccharomyces cerevisiae
  CDS (1)..(735)
atgactgtggttgaaataaaaagccaggaccaatttacgcaactaaccactacaaacgctgctaataaactcattgtcttatattttaaagctcaatgggctgatccttgcaaaactatgagccaggtgctagaagctgttagtgaaaaagttaggcaagaggatgtccggtttttatcaatagatgcagacgaacatccagaaatatcagacctttttgagattgcagccgtaccatacttcgtcttcattcaaaatggtactattgtaaaagaaatatcagccgcagatcctaaggagtttgtgaaaagcttagaaattctttcgaatgcttctgcctcactagcgaacaatgccaagggtcctaaatctacgtctgatgaggaaagcagcgggtcttccgatgatgaagaggacgaaactgaagaagaaataaatgctaggctggtgaagctagtacaagctgcacctgtgatgctattcatgaaaggaagcccatcagaacctaaatgcggattttctagacagttagttggtatcctcagagaacaccaaataaggttcggattttttgatatattaagagacgaaaacgttagacaaagcttgaagaagttttctgattggcctacttttcctcagttatatatcaatggggagttccagggaggtttggatattatcaaggaatctatagaagaagatcctgaatatttccaacatgctctacagtaa

SEQ ID NO: 23716 - protein, 244 aa, Saccharomyces cerevisiae
MTVVEIKSQDQFTQLTTTNAANKLIVLYFKAQWADPCKTMSQVLEAVSEKVRQEDVRFLSIDADEHPEISDLFEIAAVPYFVFIQNGTIVKEISAADPKEFVKSLEILSNASASLANNAKGPKSTSDEESSGSSDDEEDETEEEINARLVKLVQAAPVMLFMKGSPSEPKCGFSRQLVGILREHQIRFGFFDILRDENVRQSLKKFSDWPTFPQLYINGEFQGGLDIIKESIEEDPEYFQHALQ

SEQ ID NO: 23717 - DNA, 1467 bp, Arabidopsis thaliana (mouse-ear cress)
  CDS (1)..(1467)
atgagcggtacggtgaaggatatcgtttcaaaggcggagcttgataacttgcgccagagcggcgcaccagtcgtgcttcacttctgggcttcttggtgtgatgcttcgaagcagatggatcaagttttctctcatctcgctactgatttccctcgtgctcacttctttagggttgaagctgaggaacatcctgagatatctgaggcttactctgttgctgctgtgccttatttcgtcttcttcaaggatggtaaaactgtggatacacttgagggtgcagatccatcaagtttagctaataaggttggcaaagttgctggttctagtacttctgcggagcctgctgctcctgcaagcttagggttggctgctgggccaacgattcttgaaactgtgaaggagaatgcgaaagcttctttacaagaccgagctcagcctgtatctaccgccgatgctctcaagagccgtttggaaaagctcactaattctcaccctgtcatgttattcatgaaaggtattcctgaagagcctaggtgtgggtttagcaggaaagtagttgacattttgaaagaggttaacgttgattttggaagttttgacatactatcggataacgaagtgcgagagggtttgaagaaattctctaactggccaacgtttcctcagctgtactgcaacggagagcttcttggtggagctgatatcgcaatagcgatgcacgagagcggtgaactaaaagatgctttcaaagatcttgggatcacgacagttggttcaaaagaaagtcaggatgaagctggaaaaggaggaggggttagttcaggaaacacaggcttaagtgagaccctccgagctcggctcgaaggtctggtcaattccaaaccagttatgctgttcatgaaaggaagaccagaagaaccaaagtgtgggttcagtgggaaagtggttgaaatcctcaaccaagaaaaaatcgagtttgggagtttcgatatcctcttagatgacgaagttcgccaaggccttaaagtgtattcaaactggtcaagctatcctcagctttacgtgaaaggcgagcttatgggtggatcagacattgtcttggagatgcaaaagagcggtgagctgaaaaaggtcttgaccgagaaagggatcactggagaacagagtcttgaagatagattgaaggcactgatcaattcctcggaagtaatgctattcatgaaaggttcaccagatgaaccgaaatgcggatttagctccaaagttgtgaaagcattgagaggagaaaacgtgagtttcggatcgtttgatatcttgactgatgaagaagtaaggcaagggattaagaatttctcaaactggccaacttttcctcagctatactacaaaggtgagttaattggaggatgtgatatcattatggagctaagtgagagtggtgatctcaaagcaactctatccgagtaa

SEQ ID NO: 23718 - protein, 488 aa, Arabidopsis thaliana (mouse-ear cress)
MSGTVKDIVSKAELDNLRQSGAPVVLHFWASWCDASKQMDQVFSHLATDFPRAHFFRVEAEEHPEISEAYSVAAVPYFVFFKDGKTVDTLEGADPSSLANKVGKVAGSSTSAEPAAPASLGLAAGPTILETVKENAKASLQDRAQPVSTADALKSRLEKLTNSHPVMLFMKGIPEEPRCGFSRKVVDILKEVNVDFGSFDILSDNEVREGLKKFSNWPTFPQLYCNGELLGGADIAIAMHESGELKDAFKDLGITTVGSKESQDEAGKGGGVSSGNTGLSETLRARLEGLVNSKPVMLFMKGRPEEPKCGFSGKVVEILNQEKIEFGSFDILLDDEVRQGLKVYSNWSSYPQLYVKGELMGGSDIVLEMQKSGELKKVLTEKGITGEQSLEDRLKALINSSEVMLFMKGSPDEPKCGFSSKVVKALRGENVSFGSFDILTDEEVRQGIKNFSNWPTFPQLYYKGELIGGCDIIMELSESGDLKATLSE

SEQ ID NO: 23719 - DNA, 858 bp, Saccharomyces cerevisiae
  CDS (1)..(858)
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 23720 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 23721 - DNA, 735 bp, Schizosaccharomyces pombe
  CDS (1)..(735)
atgagcgtcgaaattacttttgttgaacaatttcaagagatattgcaaaatggaaaagagcaaataattttactcaatttttatgcaccatgggctgctccatgcaagcaaatgaaccaagtctttgatcaatttgcaaaggacacgaaaaatgccgttttcttaaaaattgaagctgaaaaattttccgatatagcagagtcgtttgatgtaaacgctgttcctctatttgttttaatccacggagcaaaagttttggctagaatttcgggggcaaatcctcaaaaattgaaggctgctattgacgagtatattcaaccccttatctcccaaatatcctctaccaacgcgtccgtggaaactcaagtaaattccgttcagactaccaacactacttccaatacctctaaagctccaaatgggttggattctgaactaaatgaaaggttgagcacgctaacaaatgctcacaatgttatgctctttttaaagggtactccttcagaacctgcatgtggttttagtcgtaagctcgttggattacttcgtgagcaaaacgttcagtatggattttttaacatattggctgatgattctgtacgccaaggtcttaaagtgttttccgattggccaactttccctcaattgtacattaaaggtgaattcgtcggtggtttagatattgtttcggagatgattgaaaatggtgaattgcaagagatgcttcccaattaa

SEQ ID NO: 23722 - protein, 244 aa, Schizosaccharomyces pombe
MSVEITFVEQFQEILQNGKEQIILLNFYAPWAAPCKQMNQVFDQFAKDTKNAVFLKIEAEKFSDIAESFDVNAVPLFVLIHGAKVLARISGANPQKLKAAIDEYIQPLISQISSTNASVETQVNSVQTTNTTSNTSKAPNGLDSELNERLSTLTNAHNVMLFLKGTPSEPACGFSRKLVGLLREQNVQYGFFNILADDSVRQGLKVFSDWPTFPQLYIKGEFVGGLDIVSEMIENGELQEMLPN

SEQ ID NO: 23723 - DNA, 717 bp, Debaryomyces hansenii CBS767
  CDS (1)..(717)
atgtcagtgatagaaatagagtctgagtcgcagttcacagagttaactaaatcggacgctaataagttgattgcattgtatttccatacaccatgggcaggaccatgccaaacgatgaactcagtgtttaagacgttagcagaggccaacaagtcggttttgttcatatcgatcaacgcagacgaccacccggacataagcgagcttttcgaggtgtcggcggtgccatattttatattgattcgtaactcgactattttgaaggagttgtcgggtgcagaccctagggaattcataagtgcgttgaaccagttcacagagaagaaggacacggctgctccagcagcagccgctgctgctgctccggcggcaccggcacaatccccaatcgaggagtcgccggaagcgttgaacgagaggttgaagaagttgacgggtgcagcaccagtgatgcttttcatgaaggggtcgccatcggctccgcaatgtgggttttcgagacaactcgtggcgattttgagagaacaccaggtcagatttgggttctttgacatcttgaaggacgattctgtcagacagggtctcaagaacttttcggactggccaacgttcccccaattatacatcagcggagaattccaagggggacttgatatcgttaaggaatcgatcgaggaagattcgagcttcttcgagaatgcggttaaaagtgcttag

SEQ ID NO: 23724 - protein, 238 aa, Debaryomyces hansenii CBS767
MSVIEIESESQFTELTKSDANKLIALYFHTPWAGPCQTMNSVFKTLAEANKSVLFISINADDHPDISELFEVSAVPYFILIRNSTILKELSGADPREFISALNQFTEKKDTAAPAAAAAAAPAAPAQSPIEESPEALNERLKKLTGAAPVMLFMKGSPSAPQCGFSRQLVAILREHQVRFGFFDILKDDSVRQGLKNFSDWPTFPQLYISGEFQGGLDIVKESIEEDSSFFENAVKSA

SEQ ID NO: 23725 - DNA, 753 bp, Yarrowia lipolytica CLIB99
  CDS (1)..(753)
atgtcagtcgtggaaatcaccagcgactcgcacttctccgagctcaccagctcgctagctcccaccactctggtggccgtctacttccacactccttgggccgctccctgtgcccagatgaacagcgttttcaagtcgctgtcgaccctccattcgtcggtgctttttctgtccgtcaacgccgatgagctgccagagatttccgaatctttcgacatctcggccgtaccctactttgtcatgctcagggacggcaccattctcaaggagttgagtggagccgaccccaaggagctggccgccactatcagcgctctgagcgagagcgacgccaagcctgccgagtctgagtcggccgccgccgctgcccccacttcttctactgctgacgcccctgccagctcatccacagacgctcccgaacccgcagaggagaccgaagaagaactcaacgcccgtctggccaaactcgtgaaggccgcaccagtcatgctcttcatgaagggcacgccggcagctccacagtgcggcttctcacgacaattggtcgccattctcagagaacatcacgtgcggttcggctttttcgacattctcaaagatgacgccgtgcgacagggcctgaaaaagttttccgactggcccaccttcccccagctgtacattggaggcgagctgcagggcggtctggatatcgtcaaggagagcattcaggaggaccccgagtttttcgagaaggctgttgctgaatga

SEQ ID NO: 23726 - protein, 250 aa, Yarrowia lipolytica CLIB99
MSVVEITSDSHFSELTSSLAPTTLVAVYFHTPWAAPCAQMNSVFKSLSTLHSSVLFLSVNADELPEISESFDISAVPYFVMLRDGTILKELSGADPKELAATISALSESDAKPAESESAAAAAPTSSTADAPASSSTDAPEPAEETEEELNARLAKLVKAAPVMLFMKGTPAAPQCGFSRQLVAILREHHVRFGFFDILKDDAVRQGLKKFSDWPTFPQLYIGGELQGGLDIVKESIQEDPEFFEKAVAE

SEQ ID NO: 23727 - DNA, 795 bp, Kluyveromyces lactis NRRL Y
  CDS (1)..(795)
atgggtgttattgatattacttctcaggatcaatttactgagttgactactactaaggcgggtgacaagctattggtattgtatttctataccagttgggccgagccatgtgttgccgttggaaaagttgtggaagctctaagtgaagaacgttgcaataaggatgttgtattcttgagtatttctgctgaggaacaagttgaaatctctgagcttttcgaagtttcatctgtgccttatttcatcttcattaaaagcggaacgatattgagagaaatgtcgggtgctgatccaaaggaatttgttgctattttgaaccaattgaacgcttctggtactgacgataacgaatctggtgcggctaattcttctgctgataatggagctggttccaatgtcgcttcttctagaacggaaaacgtttctaatgttggcccagggtcaccattgggtgaagataacgaagagcaagaagaaacagaagaacagttgggcgaaaggctaaaaaaacttacacaagctgcacctgttatgctgtttatgaagggtacaccatccgagccaaagtgtggcttttctagacagatggttggaatattgagagaacatcaaatcagatttgggttcttcgatattttgaaggatgagaacgttagacaaggtttgaagaaattttctgactggccaactttcccacagctatatatcaatggtgaattccaaggaggtttggatatcatcaaggagtcattagaggaagatccagagttttttcaacacactctgtcagcataa

SEQ ID NO: 23728 - protein, 264 aa, Kluyveromyces lactis NRRL Y
MGVIDITSQDQFTELTTTKAGDKLLVLYFYTSWAEPCVAVGKVVEALSEERCNKDVVFLSISAEEQVEISELFEVSSVPYFIFIKSGTILREMSGADPKEFVAILNQLNASGTDDNESGAANSSADNGAGSNVASSRTENVSNVGPGSPLGEDNEEQEETEEQLGERLKKLTQAAPVMLFMKGTPSEPKCGFSRQMVGILREHQIRFGFFDILKDENVRQGLKKFSDWPTFPQLYINGEFQGGLDIIKESLEEDPEFFQHTLSA

SEQ ID NO: 23729 - DNA, 729 bp, Candida glabrata CBS138
  CDS (1)..(729)
atgtctgttgttgatatagataatgtggagcagtttctggatttggccaggacgaaagctggtaataagctagtggtgttgtttttttacatgccttggatgaagtcatgtagagtcttgaaggaagtggtgctggcgttgagcagatcagtaggtaagaaacattccacatttttacagattaatatagaaggtaatagagacattgtgtctcttctgggtatcacacaggttccagctttcttcctggtgagaaaaggtgttgtgataaaagcactaagcggtgttgatcccagagagtttttagcagcataccatgaatgtgtagataattccaactgctatgaccatgaccttgacgaagactcccaagatatcaaatcggatgatacattacaggagcccgaagatttctactctgaagataccgaaagtttagataaactggtaaacgctgcaccagtgatggtgttcataaaaggaagcccctctgatccaaaatgtggtttctctagacaaatggtaaatatactgagatcccaccagatacggtttggtttttttgatatactaaaggataagattacaagacaacagctaaaggattactcagactggcccacattcccacaattatatattaatggcgaatttgagggaggcctggatatagtaaaggaatcgttattggaagaccccgatttctttaacaagaagttatcactgtaa

SEQ ID NO: 23730 - protein, 242 aa, Candida glabrata CBS138
MSVVDIDNVEQFLDLARTKAGNKLVVLFFYMPWMKSCRVLKEVVLALSRSVGKKHSTFLQINIEGNRDIVSLLGITQVPAFFLVRKGVVIKALSGVDPREFLAAYHECVDNSNCYDHDLDEDSQDIKSDDTLQEPEDFYSEDTESLDKLVNAAPVMVFIKGSPSDPKCGFSRQMVNILRSHQIRFGFFDILKDKITRQQLKDYSDWPTFPQLYINGEFEGGLDIVKESLLEDPDFFNKKLSL

SEQ ID NO: 23731 - DNA, 783 bp, Candida glabrata CBS138
  CDS (1)..(783)
atggaggggggaaggagggaaatcgaaggcaggagacactttttgaagaggaatatggttgctgagattacgaaccaggaccagtttacggagctgactacgcagaatgtgcaggacaagctgattgctatatatttccacacctcgtgggcggagccctgcaaggccatcagcgagttgtaccgggctataagcgaagacgagtcgaacaaggacgtgtcgttcttggcggtggatgcggacgagcaggctgagatagctgagctgtttgagataagcgcggtgccatacttcgtgctgatcaggaacgggaccatcctgaaggagctctccggtgccaaccccaaggagttccttgctgcgctggaggagtgcaggagagcgggcacagagtcgaagtcgaaggaaagcaacggcgcggtagaggacgacgaagacagcgaggacagcgaggaagagaccgaggaagagatgaatatgaggctgacaaagctggtgaacgcagcacccgtgatgctgttcatgaagggtaacccatccgagcctaagtgcgggttctccagacaaatcgtgggaattctaagggaacaccagatcagattcgggttcttcgacatattaagagacgacaccgtcagaaccaacttgaagaagttctcagactggcctacgttccctcaattatatatcaacggtgagttccaaggtggcctagatatcataaaggaatccctagaggaagaccctgacttcttccaacacaccatacgagtaaataactag

SEQ ID NO: 23732 - protein, 260 aa, Candida glabrata CBS138
MEGGRREIEGRRHFLKRNMVAEITNQDQFTELTTQNVQDKLIAIYFHTSWAEPCKAISELYRAISEDESNKDVSFLAVDADEQAEIAELFEISAVPYFVLIRNGTILKELSGANPKEFLAALEECRRAGTESKSKESNGAVEDDEDSEDSEEETEEEMNMRLTKLVNAAPVMLFMKGNPSEPKCGFSRQIVGILREHQIRFGFFDILRDDTVRTNLKKFSDWPTFPQLYINGEFQGGLDIIKESLEEDPDFFQHTIRVNN

SEQ ID NO: 23733 - DNA, 714 bp, Ashbya gossypii
  CDS (1)..(714)
atgacagtcatcgatatcacatccaaggaccagttcacgcaacagactacggtggctgccggctctaagcttgtggcgctgtacttccacacagcctgggccgagccatgcaaggccatgagcgccgtgttttctgctgtgagtgaggaaccggcgcacaaagatgtcctattccttgcgattgatgcagacgagcatgcggaaatctctgagctgtttgaggtggcggcggttccgtacttcgtcttgatcaaggagggggccatcgtaaaagagatttctgggtcggaccccaaagacttcgtcagcgcattaaatgaatacaccgccggtagcaactccacaggcgctgccgccactgcatctgcacctgctgaagagtatggtgaggaggaaacagaggaacaactacaggaacggctcaagaagctgaccagcgctgctcctgtaatgttattcatgaaaggaacaccatctgaaccgaaatgtggtttctccaggcagatggttggtatcttacgtgagcaccaagtgaggtttggcttttttgacattcttaaggacgagagtgtgagacaggggctgaagacgttttcagattggcccacgttcccgcaattgtacatcaatggtgagttccaaggtggcctagatatcatcaaggagtccttggaggaagaccctgagtttttccaaaacactctaagctcctga

SEQ ID NO: 23734 - protein, 237 aa, Ashbya gossypii
MTVIDITSKDQFTQQTTVAAGSKLVALYFHTAWAEPCKAMSAVFSAVSEEPAHKDVLFLAIDADEHAEISELFEVAAVPYFVLIKEGAIVKEISGSDPKDFVSALNEYTAGSNSTGAAATASAPAEEYGEEETEEQLQERLKKLTSAAPVMLFMKGTPSEPKCGFSRQMVGILREHQVRFGFFDILKDESVRQGLKTFSDWPTFPQLYINGEFQGGLDIIKESLEEDPEFFQNTLSS

SEQ ID NO: 23735 - DNA, 801 bp, Neurospora crassa
  CDS (1)..(801)
atgtcgaccatcaaggacattaccagtatcgaggcttggaacaatcatgtgtcgtcattgccggcgtccaccctcctgatcgtctccttccacgcgccctgggctgcgccctgcgcccagatggcgacagtgctcaagacattggcgagcgaatatcccgttactgaaccgctttccacgtcctgggtctcgatcgacgccgaagaactgtcggaaatcagcgaaacgtacaacgtgacggccgttccctttctcgtgctcgcccggaataaccaggttttggagacggttagcggaagcagtgccgtcaaggttcgaaacgcgattgagacccacgccaaaaaatcggcccagttcggcactgaagctagtgagaagacaccggcgatcgcaaatggcgccgcaactgctgagggccaggccggcgacgttgtacctcaggaccccaagaagcaaaaggaggagttgttcagacgtctgggtgacctggtcaaggccgccccggtcatgctgttcatgaagggtactcccagtgagcccaagtgcggcttctcgcgacagctggttgctattctccgagaaaatgccgttaaatacggtttctttaacattctagcggacgacgaagtacgacagggccttaaggagtttgctgattggcctacttatccacaactttgggtcgacggtgagctagtggggggactcgatatcgtcaaggaggagttggcgaacgacgccgacttcttcaaaccatatagtgtcaaggcgaacggcgatgcgtccgccgggcaatcatag

SEQ ID NO: 23736 - protein, 266 aa, Neurospora crassa
MSTIKDITSIEAWNNHVSSLPASTLLIVSFHAPWAAPCAQMATVLKTLASEYPVTEPLSTSWVSIDAEELSEISETYNVTAVPFLVLARNNQVLETVSGSSAVKVRNAIETHAKKSAQFGTEASEKTPAIANGAATAEGQAGDVVPQDPKKQKEELFRRLGDLVKAAPVMLFMKGTPSEPKCGFSRQLVAILRENAVKYGFFNILADDEVRQGLKEFADWPTYPQLWVDGELVGGLDIVKEELANDADFFKPYSVKANGDASAGQS

SEQ ID NO: 23737 - DNA, 723 bp, Dictyostelium discoideum
  CDS (1)..(723)
atggcaaatacaattaatacaaatgaagaatttgaaaatattttaaaagataataaatttttagttgttatgttttgggcagattggtcaaaaccatcaactcaaatgagagatgtttttgatcaattagctaaacaagctacaaatcaagcaaacaataaacttttattcttaaaagttgaagcagagaaagttcatcaaatttctggtagatataatgttaaatctgtaccaacttgtatatttttaaatcaaggtaaattagttcaatcagtcgttggtgctaatccatcagaattagcattacaaacaaataatttctcaaaaacttgtgatacattaccattggaagagcaacaacaacaacaacaaagtgaagaaatcataaataaaattaaattagatcaagaacaagagaaaaaattattaaatgaaagattagaaaaacttgtaaatcaatcaccagttatgttatttatgaaaggtaatccagagaaaccacaatgtggtttctcaaataaaactgttacaatcttaaaagagaatggttttgaatttggttcattcgatatcttacaagatcaagcagttcgtaatggtttaaaggaatattcgaattggccaacttatcctcaattatatatcaatggtaaattagttggtggttatgatattattaaagatttaaatgaagaaggtgaattaattgatcttaagccatag

SEQ ID NO: 23738 - protein, 240 aa, Dictyostelium discoideum
MANTINTNEEFENILKDNKFLVVMFWADWSKPSTQMRDVFDQLAKQATNQANNKLLFLKVEAEKVHQISGRYNVKSVPTCIFLNQGKLVQSVVGANPSELALQTNNFSKTCDTLPLEEQQQQQQSEEIINKIKLDQEQEKKLLNERLEKLVNQSPVMLFMKGNPEKPQCGFSNKTVTILKENGFEFGSFDILQDQAVRNGLKEYSNWPTYPQLYINGKLVGGYDIIKDLNEEGELIDLKP

SEQ ID NO: 23739 - DNA, 1815 bp, Oryza sativa
  CDS (141)..(1616)
aaaaggaaagcagaggaaaaccccaagccgcaagcccccccgccgcgagtcgtcttctcatctctcctccgccgccgccgcctgctgctgcatctctcgtcgtcgccggtgagggaagggaggggaggggggagggcgtgatggcggcggtgagggaggtggggtcgaaggcggagctggaggcggcggcgggaggggcgcgggccgccgcggtgcacttctgggcggcgtggtgcgaggcgtccaagcagatggacgaggtcttcgcgcacctcgccgtcgacttctcccacgccgtcttcctccgggttgaagctgaggaacaacccgaaatttcagaggcatatggagttacagcagtgccatattttgttttcttgaaggaaggtaaaactgttgatactctggagggtgcaaatccagccagcttggccaataaggttgcaaagttagctgggcctgccagcgttgctgagtctgctgtgcctgctagcctgggtgtggctgctgggcctgctgtacttgaaaaggttcaagagatggcacagcaaaatggagcttctgccactagtagtgcagaagatgcattgaacaagagattggagcagcttgtcaattcccatcccgtcttcttatttatgaagggaacccctgagcaaccaaggtgtggtttcagtcgaaaagtagttgacgttttgaagcaggaaggagttgaatttgggagctttgacatcctaacagataacgatgtacgtgaaggaatgaaaaagttctcaaactggccgacttttcctcagctctactgcaaaggtgagctgcttggtggatgtgatattgtgattgctatgcatgaaagcggtgaactgaaggatgtttttaaggagcacaacattccgctgcagccacagggaagcaaaaacgaggaggcagtgaaagccaagcctgatactgagaagagtggtgcagtttctgaaccagctttgcttactgcagctcagaaggaacgcttggaaagccttgttaatttcagcacagtgatggcatttataaaaggtacacctgaggagcccaagtgtggattcagtggaaaactagtgcatattcttaagcaagagaagatccctttctcaagttttgacattcttacggatgatgaggttaggcagggtctaaaacttctctcaaactggcctagttaccctcaactgtacataaacggtgaactggttggcggatcagacattgttatggagatgcataagagtggggagcttaagaaggttctatctgagaaagggatcgttgcgaaagaaagtctagaagaccgcctgaaggccctgatttcctctgccccagtgatgctcttcatgaagggcaccccagatgccccccgctgcggcttcagttcgaaggttgtgaatgcactgaagcaagcaggagtcagcttcggagcgttcgacatcctatccgacgaggaggttaggcaaggcttgaagacgtactccaactggcccacgttccctcagctgtactacaaatcagaactgattggaggctgtgacatcgttcttgagctggagaagagtggagagctgaagtccacgctttcggagtgaggaaaatttaccgtcgtatccgcatcttcctcttcctggtgtttctaccatccgtcgaccatcgagtttgctctattgatggcattttcttgtattcatagatccgtatttcaaacttagatatatgcctgtgccacatcgcttttaactgtgacatctgcagaagaataactaagacgacctgttcagtacggctaat

SEQ ID NO: 23740 - protein, 491 aa, Oryza sativa
MAAVREVGSKAELEAAAGGARAAAVHFWAAWCEASKQMDEVFAHLAVDFSHAVFLRVEAEEQPEISEAYGVTAVPYFVFLKEGKTVDTLEGANPASLANKVAKLAGPASVAESAVPASLGVAAGPAVLEKVQEMAQQNGASATSSAEDALNKRLEQLVNSHPVFLFMKGTPEQPRCGFSRKVVDVLKQEGVEFGSFDILTDNDVREGMKKFSNWPTFPQLYCKGELLGGCDIVIAMHESGELKDVFKEHNIPLQPQGSKNEEAVKAKPDTEKSGAVSEPALLTAAQKERLESLVNFSTVMAFIKGTPEEPKCGFSGKLVHILKQEKIPFSSFDILTDDEVRQGLKLLSNWPSYPQLYINGELVGGSDIVMEMHKSGELKKVLSEKGIVAKESLEDRLKALISSAPVMLFMKGTPDAPRCGFSSKVVNALKQAGVSFGAFDILSDEEVRQGLKTYSNWPTFPQLYYKSELIGGCDIVLELEKSGELKSTLSE

SEQ ID NO: 23741 - DNA, 1038 bp, Caenorhabditis elegans
  CDS (1)..(1038)
atgccaattcaagaaatcaagtcaggagaggaggttgctgcgttcattaaggaaccatctccagctgttcttcatttctacgcatcgtgggctccaagctgtgagcaagttaatcagctactggatgatttgctcgctgaaattgctctgccgcttcgtgccgccttcattgacgctgaagctttgcccggaatttcgttgaatttcaagattactgctgcgccgacgcttgtattttttagtaatggcaaagaagtcgacagaatcgatggcttcgtgccaaaagagatccaatcaaaagttgttcttgttgccagccgatccctttcccagagctcatcggatgcttcatctacaacctcttccacaccttcactgactccacaacaagaaaaggaagctctaaatgccagattgggtgcgctggtcaattctcaaaaagtcatggttttcatgaaaggagatccatcggcgccacgttgtggtttctcgagaactattgtcgaacttttaaattcacataaaatcaaattcggatccttcgacattttctcggatgaagcagttcgccaaggattaaaggaatactcgaattggccaacttatcctcaactctatttcgatggagaattgattggagggcttgatgtcgtcaaggaggagttttcagatccacaatttatcaagcaacttccgaaagttggagaaaatagtgaggggggatcacttgaagatcgactcaaaaagcttgtctcatcgcaaagattgatgctatttatgaaaggagatcgggagacaccaaagtgcggattttcacgaactatcgttgatttgttgaacaaggctcgtgctgattatcatacttttgatatcttggaggatgaggaagtcaggcaagggcttaagaaattctccaattggccaacttatccacagctctatctcgacggagagctcgtcggagggcttgatgtcgtcaaggaagagctcttggatacgcatttccttcgtcagattccaagaattagaaatgattaa

SEQ ID NO: 23742 - protein, 345 aa, Caenorhabditis elegans
MPIQEIKSGEEVAAFIKEPSPAVLHFYASWAPSCEQVNQLLDDLLAEIALPLRAAFIDAEALPGISLNFKITAAPTLVFFSNGKEVDRIDGFVPKEIQSKVVLVASRSLSQSSSDASSTTSSTPSLTPQQEKEALNARLGALVNSQKVMVFMKGDPSAPRCGFSRTIVELLNSHKIKFGSFDIFSDEAVRQGLKEYSNWPTYPQLYFDGELIGGLDVVKEEFSDPQFIKQLPKVGENSEGGSLEDRLKKLVSSQRLMLFMKGDRETPKCGFSRTIVDLLNKARADYHTFDILEDEEVRQGLKKFSNWPTYPQLYLDGELVGGLDVVKEELLDTHFLRQIPRIRND

SEQ ID NO: 23743 - DNA, 828 bp, Mortierella alpina
  CDS (1)..(828)
atggtctccaacaactatatagacatcaccagcgaagacgactttgcgcaagtcttccagccctcctcatccactgtctatgctctgaacttttgggcggcatgggcacctccttgcgtccaaatgaatgaggtctttgaagaactggccgccaagaacgctaatgtgaactttctcaagattgaggcagaaaagtttcccgacatttccgaagactatgagatcgctgctgttccaagcttcgttatcgtgaaggagggtactgtcgtcgatcgcgtggagggagctaacgcacccgagctggccaaagtcatcgccaagtactcaaagtcaacgtcatcgcctttaccaacacagagttcgaccatggcggccgcaggacacgcagcgccttctgttgcccctccaacaatgtctcccgaagagatgaacgctcggctcaaggagctgaccagcagttcgagtgtcatggcttttatcaaaggaacacctacagctcccagatgccagttctctcgccagctcctggaaatcttgactgctcaaaacatccgattcagctccttcaacattcttgctgacgatgaggtccgacaggccatgaagaccttttcggactggccaacattccctcaggtgtatgtgaagggtgagtttgtcggaggactggatgttgtcaaggagctggttgcatctggcgagttccaggccctggtgcctgctgaaaaggatctgaagactcgcatggatgagctgattcgcaaggcacctgtgatgatctttatcaaaggcagccccgagacgcctcgttgcggcttttcgaagtaa

SEQ ID NO: 23744 - protein, 275 aa, Mortierella alpina
MVSNNYIDITSEDDFAQVFQPSSSTVYALNFWAAWAPPCVQMNEVFEELAAKNANVNFLKIEAEKFPDISEDYEIAAVPSFVIVKEGTVVDRVEGANAPELAKVIAKYSKSTSSPLPTQSSTMAAAGHAAPSVAPPTMSPEEMNARLKELTSSSSVMAFIKGTPTAPRCQFSRQLLEILTAQNIRFSSFNILADDEVRQAMKTFSDWPTFPQVYVKGEFVGGLDVVKELVASGEFQALVPAEKDLKTRMDELIRKAPVMIFIKGSPETPRCGFSK

SEQ ID NO: 23745 - DNA, 651 bp, Drosophila melanogaster
  CDS (1)..(651)
atgcccgtggtgaacgtgtcggctgccgaggagtaccagaagtacattaatgcggataagacgaccgtagctctattcgccgccgaatgggcagagcaatgcggtcaggtgaaagacgcgctggaggagctggccaagattactggcgaaaaactgcagttcatcagcctaaacgctgaacaatttcccgagatttccatgaaacatcagatcgaggccgtgcccacagtcatattcttcgccaagggctccgccgttgaccgtgtcgatggtgtagacatcgccgccataagcgccaaatccaaaaagttggccgaaaacgcaagcagcgcggcggcaacaggacaaacgttggaggaacgcctaaaggccctaatcaatacagctccgctgatgatattcatgaagggcgaccgaaatggaccgcgttgcggattctccaagcagctcatcggcattgtgaacgaaaccaacttgccgtacgagacatttgacatcctcggcgacgaagaagtgcgtcaaggcctgaaaacctactccgactggcccacatatccccaggtttacgtcaagggtgaacttatcggcggactcgatattattaaggaactgctggcgaacaatgagctcgagtccacgctaaagggctaa

SEQ ID NO: 23746 - protein, 216 aa, Drosophila melanogaster
MPVVNVSAAEEYQKYINADKTTVALFAAEWAEQCGQVKDALEELAKITGEKLQFISLNAEQFPEISMKHQIEAVPTVIFFAKGSAVDRVDGVDIAAISAKSKKLAENASSAAATGQTLEERLKALINTAPLMIFMKGDRNGPRCGFSKQLIGIVNETNLPYETFDILGDEEVRQGLKTYSDWPTYPQVYVKGELIGGLDIIKELLANNELESTLKG

SEQ ID NO: 23747 - DNA, 1260 bp, Mus musculus
  CDS (12)..(1025)
gcggagacagcatggcggcgggggcggccgaggcaggcgaggcagccgtggcagtggtggaagtcggctctgcccagcagtttgaagagctactgcgcctcaaaaccaagtcactccttgtggttcatttctgggcaccatgggctccacagtgtgtacagatgaacgatgtcatggcagagttagctaaagaacaccctcatgtttcatttgtgaagctggaagccgaagctgttcctgaagtatctgaaaaatatgaaattagctctgtccccaccttcctgttcttcaagaattctcagaaagtcgaccggttagatggtgcacatgccccagagttgaccaaaaaagtccagcgacacgtgtctagcggagcctttcctcctagtactaatgaacatcttaaagaagacctcagccttcgcctgaaaaagctgactcacgctgccccctgcatgctgttcatgaagggaacacctcaagaaccgcgctgtggtttcagcaagcagatggtggaaatccttcacaaacacaatattcagttcagcagctttgatatcttctcagatgaagaagttcgacaggggctcaaaacgtactctaattggcccacctatcctcagctctatgtttctggagagctaataggaggacttgacataattaaggagctggaagcatcagaagagctggacacgatctgtcccaaagcacccaagttagaggaaaggctcaaagtgctgaccaataaagcttccgtgatgctctttatgaaaggaaacaaacaggaagcaaaatgtggattcagcaaacaaattctggaaatactgaatagtactggggttgaatatgaaacttttgatatactggaagatgaagaagtgcgtcagggattaaaaacgttctcaaattggccaacctaccctcagctgtatgtgagaggggatcttgttggaggattggatattgtcaaggaactgaaagacaacggtgaattgctgcctatactgaaaggagaaaattagtgaacataagcatggtgtccaaggactgcaagaagtaactaattaccttggaacagttgatgatttggtcctgagaagtggactaacagtagagatacaacacactcagccatgctcgatgcgcttcaaaaggtgtgctgaagaaacatgctacgttctccatgaagcagagaaggcaataaactcttcagactcagctaaaaaaaaaaaaaaaaaaaaaaaaaaaaaaaaaaaa

SEQ ID NO: 23748 - protein, 337 aa, Mus musculus
MAAGAAEAGEAAVAVVEVGSAQQFEELLRLKTKSLLVVHFWAPWAPQCVQMNDVMAELAKEHPHVSFVKLEAEAVPEVSEKYEISSVPTFLFFKNSQKVDRLDGAHAPELTKKVQRHVSSGAFPPSTNEHLKEDLSLRLKKLTHAAPCMLFMKGTPQEPRCGFSKQMVEILHKHNIQFSSFDIFSDEEVRQGLKTYSNWPTYPQLYVSGELIGGLDIIKELEASEELDTICPKAPKLEERLKVLTNKASVMLFMKGNKQEAKCGFSKQILEILNSTGVEYETFDILEDEEVRQGLKTFSNWPTYPQLYVRGDLVGGLDIVKELKDNGELLPILKGEN

SEQ ID NO: 23749 - DNA, 25 bp, Primer
atgactgtggttgaaataaaaagcc

SEQ ID NO: 23750 - DNA, 26 bp, Primer
ttactgtagagcatgttggaaatatt

SEQ ID NO: 23751 - DNA, 1470 bp, Saccharomyces cerevisiae; identical to SEQ ID NO: 3866
  CDS (1)..(1470)

SEQ ID NO: 23752 - protein, 489 aa, Saccharomyces cerevisiae; identical to SEQ ID NO: 3867

SEQ ID NO: 23753 - DNA, 1215 bp, Bacillus subtilis; identical to SEQ ID NO: 3868
  CDS (1)..(1215)

SEQ ID NO: 23754 - protein, 404 aa, Bacillus subtilis; identical to SEQ ID NO: 3869

SEQ ID NO: 23755 - DNA, 1224 bp, Methanobacterium thermoautotrophicum; identical to SEQ ID NO: 3870
  CDS (1)..(1224)

SEQ ID NO: 23756 - protein, 407 aa, Methanobacterium thermoautotrophicum; identical to SEQ ID NO: 3871

SEQ ID NO: 23757 - DNA, 1176 bp, Archaeoglobus fulgidus; identical to SEQ ID NO: 3872
  CDS (1)..(1176)

SEQ ID NO: 23758 - protein, 391 aa, Archaeoglobus fulgidus; identical to SEQ ID NO: 3873

SEQ ID NO: 23759 - DNA, 1479 bp, Xylella fastidiosa; identical to SEQ ID NO: 3874
  CDS (1)..(1479)

SEQ ID NO: 23760 - protein, 492 aa, Xylella fastidiosa; identical to SEQ ID NO: 3875

SEQ ID NO: 23761 - DNA, 1545 bp, Arabidopsis thaliana (mouse-ear cress); identical to SEQ ID NO: 3876
  CDS (1)..(1545)

SEQ ID NO: 23762 - protein, 514 aa, Arabidopsis thaliana (mouse-ear cress); identical to SEQ ID NO: 3877

SEQ ID NO: 23763 - DNA, 1287 bp, Salmonella enterica subsp. enterica serovar Typhi; identical to SEQ ID NO: 3878
  CDS (1)..(1287)

SEQ ID NO: 23764 - protein, 428 aa, Salmonella enterica subsp. enterica serovar Typhi; identical to SEQ ID NO: 3879

SEQ ID NO: 23765 - DNA, 1206 bp, Listeria monocytogenes; identical to SEQ ID NO: 3880
  CDS (1)..(1206)

SEQ ID NO: 23766 - protein, 401 aa, Listeria monocytogenes; identical to SEQ ID NO: 3881

SEQ ID NO: 23767 - DNA, 1413 bp, Nostoc sp. PCC 7120; identical to SEQ ID NO: 3882
  CDS (1)..(1413)

SEQ ID NO: 23768 - protein, 470 aa, Nostoc sp. PCC 7120; identical to SEQ ID NO: 3883

SEQ ID NO: 23769 - DNA, 1296 bp, Yersinia pestis; identical to SEQ ID NO: 3884
  CDS (1)..(1296)

SEQ ID NO: 23770 - protein, 431 aa, Yersinia pestis; identical to SEQ ID NO: 3885

SEQ ID NO: 23771 - DNA, 1206 bp, Listeria innocua; identical to SEQ ID NO: 3886
  CDS (1)..(1206)

SEQ ID NO: 23772 - protein, 401 aa, Listeria innocua; identical to SEQ ID NO: 3887

SEQ ID NO: 23773 - DNA, 1320 bp, Deinococcus radiodurans; identical to SEQ ID NO: 3888
  CDS (1)..(1320)

SEQ ID NO: 23774 - protein, 439 aa, Deinococcus radiodurans; identical to SEQ ID NO: 3889

SEQ ID NO: 23775 - DNA, 1266 bp, Bacillus halodurans; identical to SEQ ID NO: 3890
  CDS (1)..(1266)

SEQ ID NO: 23776 - protein, 421 aa, Bacillus halodurans; identical to SEQ ID NO: 3891

SEQ ID NO: 23777 - DNA, 1239 bp, Methanobacterium thermoautotrophicum; identical to SEQ ID NO: 3892
  CDS (1)..(1239)

SEQ ID NO: 23778 - protein, 412 aa, Methanobacterium thermoautotrophicum; identical to SEQ ID NO: 3893

SEQ ID NO: 23779 - DNA, 1305 bp, Neisseria meningitidis; identical to SEQ ID NO: 3894
  CDS (1)..(1305)

SEQ ID NO: 23780 - protein, 434 aa, Neisseria meningitidis; identical to SEQ ID NO: 3895

SEQ ID NO: 23781 - DNA, 1329 bp, Pseudomonas aeruginosa; identical to SEQ ID NO: 3896
  CDS (1)..(1329)

SEQ ID NO: 23782 - protein, 442 aa, Pseudomonas aeruginosa; identical to SEQ ID NO: 3897

SEQ ID NO: 23783 - DNA, 1533 bp, Caulobacter crescentus; identical to SEQ ID NO: 3898
  CDS (1)..(1533)

SEQ ID NO: 23784 - protein, 510 aa, Caulobacter crescentus; identical to SEQ ID NO: 3899

SEQ ID NO: 23785 - DNA, 1167 bp, Archaeoglobus fulgidus; identical to SEQ ID NO: 3900
  CDS (1)..(1167)

SEQ ID NO: 23786 - protein, 388 aa, Archaeoglobus fulgidus; identical to SEQ ID NO: 3901

SEQ ID NO: 23787 - DNA, 1533 bp, Ureaplasma urealyticum; identical to SEQ ID NO: 3902
  CDS (1)..(1533)

SEQ ID NO: 23788 - protein, 510 aa, Ureaplasma urealyticum; identical to SEQ ID NO: 3903

SEQ ID NO: 23789 - DNA, 1566 bp, Ureaplasma urealyticum; identical to SEQ ID NO: 3904
  CDS (1)..(1566)

SEQ ID NO: 23790 - protein, 521 aa, Ureaplasma urealyticum; identical to SEQ ID NO: 3905

SEQ ID NO: 23791 - DNA, 1530 bp, Sulfolobus solfataricus; identical to SEQ ID NO: 3906
  CDS (1)..(1530)

SEQ ID NO: 23792 - protein, 509 aa, Sulfolobus solfataricus; identical to SEQ ID NO: 3907

SEQ ID NO: 23793 - DNA, 1272 bp, Aquifex aeolicus; identical to SEQ ID NO: 3908
  CDS (1)..(1272)

SEQ ID NO: 23794 - protein, 423 aa, Aquifex aeolicus; identical to SEQ ID NO: 3909

SEQ ID NO: 23795 - DNA, 1434 bp, Mycobacterium tuberculosis; identical to SEQ ID NO: 3910
  CDS (1)..(1434)

SEQ ID NO: 23796 - protein, 477 aa, Mycobacterium tuberculosis; identical to SEQ ID NO: 3911

SEQ ID NO: 23797 - DNA, 1308 bp, Thermotoga maritima; identical to SEQ ID NO: 3912
  CDS (1)..(1308)

SEQ ID NO: 23798 - protein, 435 aa, Thermotoga maritima; identical to SEQ ID NO: 3913

SEQ ID NO: 23799 - DNA, 1242 bp, Lactococcus lactis subsp. lactis; identical to SEQ ID NO: 3914
  CDS (1)..(1242)

SEQ ID NO: 23800 - protein, 413 aa, Lactococcus lactis subsp. lactis; identical to SEQ ID NO: 3915

SEQ ID NO: 23801 - DNA, 1218 bp, Clostridium acetobutylicum; identical to SEQ ID NO: 3916
  CDS (1)..(1218)

SEQ ID NO: 23802 - protein, 405 aa, Clostridium acetobutylicum; identical to SEQ ID NO: 3917

SEQ ID NO: 23803 - DNA, 1350 bp, Agrobacterium tumefaciens; identical to SEQ ID NO: 3918
  CDS (1)..(1350)

SEQ ID NO: 23804 - protein, 449 aa, Agrobacterium tumefaciens; identical to SEQ ID NO: 3919

SEQ ID NO: 23805 - DNA, 1479 bp, Saccharomyces cerevisiae; identical to SEQ ID NO: 3920
  CDS (1)..(1479)

SEQ ID NO: 23806 - protein, 492 aa, Saccharomyces cerevisiae; identical to SEQ ID NO: 3921

SEQ ID NO: 23807 - DNA, 1500 bp, Saccharomyces cerevisiae; identical to SEQ ID NO: 3922
  CDS (1)..(1500)

SEQ ID NO: 23808 - protein, 499 aa, Saccharomyces cerevisiae; identical to SEQ ID NO: 3923

SEQ ID NO: 23809 - DNA, 1524 bp, Synechocystis sp.; identical to SEQ ID NO: 3924
  CDS (1)..(1524)

SEQ ID NO: 23810 - protein, 507 aa, Synechocystis sp.; identical to SEQ ID NO: 3925

SEQ ID NO: 23811 - DNA, 1602 bp, Oryza sativa (rice); identical to SEQ ID NO: 3926
  CDS (1)..(1602)

SEQ ID NO: 23812 - protein, 533 aa, Oryza sativa (rice); identical to SEQ ID NO: 3927

SEQ ID NO: 23813 - DNA, 1515 bp, Arabidopsis thaliana (mouse-ear cress); identical to SEQ ID NO: 3928
  CDS (1)..(1515)

SEQ ID NO: 23814 - protein, 504 aa, Arabidopsis thaliana (mouse-ear cress); identical to SEQ ID NO: 3929

SEQ ID NO: 23815 - DNA, 1545 bp, Lycopersicon esculentum (tomato); identical to SEQ ID NO: 3930
  CDS (1)..(1545)

SEQ ID NO: 23816 - protein, 514 aa, Lycopersicon esculentum (tomato); identical to SEQ ID NO: 3931

SEQ ID NO: 23817 - DNA, 1506 bp, Arabidopsis thaliana (mouse-ear cress); identical to SEQ ID NO: 3932
  CDS (1)..(1506)

SEQ ID NO: 23818 - protein, 501 aa, Arabidopsis thaliana (mouse-ear cress); identical to SEQ ID NO: 3933

SEQ ID NO: 23819 - DNA, 1605 bp, Caenorhabditis elegans; identical to SEQ ID NO: 3934
  CDS (1)..(1605)

SEQ ID NO: 23820 - protein, 534 aa, Caenorhabditis elegans; identical to SEQ ID NO: 3935

SEQ ID NO: 23821 - DNA, 1347 bp, Streptomyces coelicolor; identical to SEQ ID NO: 3936
  CDS (1)..(1347)

SEQ ID NO: 23822 - protein, 448 aa, Streptomyces coelicolor; identical to SEQ ID NO: 3937

SEQ ID NO: 23823 - DNA, 1539 bp, Schizosaccharomyces pombe; identical to SEQ ID NO: 3938
  CDS (1)..(1539)

SEQ ID NO: 23824 - protein, 512 aa, Schizosaccharomyces pombe; identical to SEQ ID NO: 3939

SEQ ID NO: 23825 - DNA, 1425 bp, Rhizobium etli; identical to SEQ ID NO: 3940
  CDS (1)..(1425)

SEQ ID NO: 23826 - protein, 474 aa, Rhizobium etli; identical to SEQ ID NO: 3941

SEQ ID NO: 23827 - DNA, 1311 bp, Azotobacter vinelandii; identical to SEQ ID NO: 3942
  CDS (1)..(1311)

SEQ ID NO: 23828 - protein, 436 aa, Azotobacter vinelandii; identical to SEQ ID NO: 3943

SEQ ID NO: 23829 - DNA, 1482 bp, Azorhizobium caulinodans; identical to SEQ ID NO: 3944
  CDS (1)..(1482)

SEQ ID NO: 23830 - protein, 493 aa, Azorhizobium caulinodans; identical to SEQ ID NO: 3945

SEQ ID NO: 23831 - DNA, 1317 bp, Azospirillum brasilense; identical to SEQ ID NO: 3946
  CDS (1)..(1317)

SEQ ID NO: 23832 - protein, 438 aa, Azospirillum brasilense; identical to SEQ ID NO: 3947

SEQ ID NO: 23833 - DNA, 1314 bp, Wolinella succinogenes; identical to SEQ ID NO: 3948
  CDS (1)..(1314)

SEQ ID NO: 23834 - protein, 437 aa, Wolinella succinogenes; identical to SEQ ID NO: 3949

SEQ ID NO: 23835 - DNA, 1320 bp, Photorhabdus luminescens (subsp. laumondii); identical to SEQ ID NO: 3950
  CDS (1)..(1320)

SEQ ID NO: 23836 - protein, 439 aa, Photorhabdus luminescens (subsp. laumondii); identical to SEQ ID NO: 3951

SEQ ID NO: 23837 - DNA, 1437 bp, Gloeobacter violaceus; identical to SEQ ID NO: 3952
  CDS (1)..(1437)

SEQ ID NO: 23838 - protein, 478 aa, Gloeobacter violaceus; identical to SEQ ID NO: 3953

SEQ ID NO: 23839 - DNA, 1311 bp, Chromobacterium violaceum; identical to SEQ ID NO: 3954
  CDS (1)..(1311)

SEQ ID NO: 23840 - protein, 436 aa, Chromobacterium violaceum; identical to SEQ ID NO: 3955

SEQ ID NO: 23841 - DNA, 1479 bp, Neurospora crassa; identical to SEQ ID NO: 3956
  CDS (1)..(1479)

SEQ ID NO: 23842 - protein, 492 aa, Neurospora crassa; identical to SEQ ID NO: 3957

SEQ ID NO: 23843 - DNA, 1365 bp, Neurospora crassa; identical to SEQ ID NO: 3958
  CDS (1)..(1365)

SEQ ID NO: 23844 - protein, 454 aa, Neurospora crassa; identical to SEQ ID NO: 3959

SEQ ID NO: 23845 - DNA, 1533 bp, Neurospora crassa; identical to SEQ ID NO: 3960
  CDS (1)..(1533)

SEQ ID NO: 23846 - protein, 510 aa, Neurospora crassa; identical to SEQ ID NO: 3961

SEQ ID NO: 23847 - DNA, 1473 bp, Synechococcus sp. (strain WH8102); identical to SEQ ID NO: 3962
  CDS (1)..(1473)

SEQ ID NO: 23848 - protein, 490 aa, Synechococcus sp. (strain WH8102); identical to SEQ ID NO: 3963

SEQ ID NO: 23849 - DNA, 1590 bp, Rhodopirellula baltica; identical to SEQ ID NO: 3964
  CDS (1)..(1590)

SEQ ID NO: 23850 - protein, 529 aa, Rhodopirellula baltica; identical to SEQ ID NO: 3965

SEQ ID NO: 23851 - DNA, 1479 bp, Prochlorococcus marinus (strain MIT 9313); identical to SEQ ID NO: 3966
  CDS (1)..(1479)

SEQ ID NO: 23852 - protein, 492 aa, Prochlorococcus marinus (strain MIT 9313); identical to SEQ ID NO: 3967

SEQ ID NO: 23853 - DNA, 1509 bp, Prochlorococcus marinus; identical to SEQ ID NO: 3968
  CDS (1)..(1509)

SEQ ID NO: 23854 - protein, 502 aa, Prochlorococcus marinus; identical to SEQ ID NO: 3969

SEQ ID NO: 23855 - DNA, 1497 bp, Oryza sativa (Rice); identical to SEQ ID NO: 3970
  CDS (1)..(1497)

SEQ ID NO: 23856 - protein, 498 aa, Oryza sativa (Rice); identical to SEQ ID NO: 3971

SEQ ID NO: 23857 - DNA, 1557 bp, Lotus japonicus; identical to SEQ ID NO: 3972
  CDS (1)..(1557)

SEQ ID NO: 23858 - protein, 518 aa, Lotus japonicus; identical to SEQ ID NO: 3973

SEQ ID NO: 23859 - DNA, 1233 bp, Bacillus cereus (strain ATCC 14579 / DSM 31); identical to SEQ ID NO: 3974
  CDS (1)..(1233)

SEQ ID NO: 23860 - protein, 410 aa, Bacillus cereus (strain ATCC 14579 / DSM 31); identical to SEQ ID NO: 3975

SEQ ID NO: 23861 - DNA, 1311 bp, Streptomyces avermitilis; identical to SEQ ID NO: 3976
  CDS (1)..(1311)

SEQ ID NO: 23862 - protein, 436 aa, Streptomyces avermitilis; identical to SEQ ID NO: 3977

SEQ ID NO: 23863 - DNA, 1341 bp, Streptomyces avermitilis; identical to SEQ ID NO: 3978
  CDS (1)..(1341)

SEQ ID NO: 23864 - protein, 446 aa, Streptomyces avermitilis; identical to SEQ ID NO: 3979

SEQ ID NO: 23865 - DNA, 1461 bp, Oryza sativa (japonica cultivar-group); identical to SEQ ID NO: 3980
  CDS (1)..(1461)

SEQ ID NO: 23866 - protein, 486 aa, Oryza sativa (japonica cultivar-group); identical to SEQ ID NO: 3981

SEQ ID NO: 23867 - DNA, 1440 bp, Oryza sativa (japonica cultivar-group); identical to SEQ ID NO: 3982
  CDS (1)..(1440)

SEQ ID NO: 23868 - protein, 479 aa, Oryza sativa (japonica cultivar-group); identical to SEQ ID NO: 3983

SEQ ID NO: 23869 - DNA, 1455 bp, Xylella fastidiosa (strain Temecula1 / ATCC 700964); identical to SEQ ID NO: 3984
  CDS (1)..(1455)

SEQ ID NO: 23870 - protein, 484 aa, Xylella fastidiosa (strain Temecula1 / ATCC 700964); identical to SEQ ID NO: 3985

SEQ ID NO: 23871 - DNA, 1326 bp, Pseudomonas syringae (pv. tomato); identical to SEQ ID NO: 3986
  CDS (1)..(1326)

SEQ ID NO: 23872 - protein, 441 aa, Pseudomonas syringae (pv. tomato); identical to SEQ ID NO: 3987

SEQ ID NO: 23873 - DNA, 1338 bp, Pseudomonas syringae (pv. tomato); identical to SEQ ID NO: 3988
  CDS (1)..(1338)

SEQ ID NO: 23874 - protein, 445 aa, Pseudomonas syringae (pv. tomato); identical to SEQ ID NO: 3989

SEQ ID NO: 23875 - DNA, 1332 bp, Pseudomonas putida (strain KT2440); identical to SEQ ID NO: 3990
  CDS (1)..(1332)

SEQ ID NO: 23876 - protein, 443 aa, Pseudomonas putida (strain KT2440); identical to SEQ ID NO: 3991

SEQ ID NO: 23877 - DNA, 1317 bp, Lactobacillus plantarum; identical to SEQ ID NO: 3992
  CDS (1)..(1317)

SEQ ID NO: 23878 - protein, 438 aa, Lactobacillus plantarum; identical to SEQ ID NO: 3993

SEQ ID NO: 23879 - DNA, 1533 bp, Bradyrhizobium japonicum; identical to SEQ ID NO: 3994
  CDS (1)..(1533)

SEQ ID NO: 23880 - protein, 510 aa, Bradyrhizobium japonicum; identical to SEQ ID NO: 3995

SEQ ID NO: 23881 - DNA, 1251 bp, Staphylococcus epidermidis; identical to SEQ ID NO: 3996
  CDS (1)..(1251)

SEQ ID NO: 23882 - protein, 416 aa, Staphylococcus epidermidis; identical to SEQ ID NO: 3997

SEQ ID NO: 23883 - DNA, 1236 bp, Streptococcus mutans; identical to SEQ ID NO: 3998
  CDS (1)..(1236)

SEQ ID NO: 23884 - protein, 411 aa, Streptococcus mutans; identical to SEQ ID NO: 3999

SEQ ID NO: 23885 - DNA, 1371 bp, Oceanobacillus iheyensis; identical to SEQ ID NO: 4000
  CDS (1)..(1371)

SEQ ID NO: 23886 - protein, 456 aa, Oceanobacillus iheyensis; identical to SEQ ID NO: 4001

SEQ ID NO: 23887 - DNA, 1293 bp, Leptospira interrogans; identical to SEQ ID NO: 4002
  CDS (1)..(1293)

SEQ ID NO: 23888 - protein, 430 aa, Leptospira interrogans; identical to SEQ ID NO: 4003

SEQ ID NO: 23889 - DNA, 1287 bp, Escherichia coli O6; identical to SEQ ID NO: 4004
  CDS (1)..(1287)

SEQ ID NO: 23890 - protein, 428 aa, Escherichia coli O6; identical to SEQ ID NO: 4005

SEQ ID NO: 23891 - DNA, 1326 bp, Corynebacterium efficiens; identical to SEQ ID NO: 4006
  CDS (1)..(1326)

SEQ ID NO: 23892 - protein, 441 aa, Corynebacterium efficiens; identical to SEQ ID NO: 4007

SEQ ID NO: 23893 - DNA, 1320 bp, Corynebacterium efficiens; identical to SEQ ID NO: 4008
  CDS (1)..(1320)

SEQ ID NO: 23894 - protein, 439 aa, Corynebacterium efficiens; identical to SEQ ID NO: 4009

SEQ ID NO: 23895 - DNA, 1302 bp, Brucella suis; identical to SEQ ID NO: 4010
  CDS (1)..(1302)

SEQ ID NO: 23896 - protein, 433 aa, Brucella suis; identical to SEQ ID NO: 4011

SEQ ID NO: 23897 - DNA, 1296 bp, Bifidobacterium longum; identical to SEQ ID NO: 4012
  CDS (1)..(1296)

SEQ ID NO: 23898 - protein, 431 aa, Bifidobacterium longum; identical to SEQ ID NO: 4013

SEQ ID NO: 23899 - DNA, 1392 bp, Acetobacter diazotrophicus (Gluconacetobacter diazotrophicus); identical to SEQ ID NO: 4014
  CDS (1)..(1392)

SEQ ID NO: 23900 - protein, 463 aa, Acetobacter diazotrophicus (Gluconacetobacter diazotrophicus); identical to SEQ ID NO: 4015

SEQ ID NO: 23901 - DNA, 1818 bp, Medicago truncatula (Barrel medic); identical to SEQ ID NO: 4016
  CDS (47)..(1531)

SEQ ID NO: 23902 - protein, 494 aa, Medicago truncatula (Barrel medic); identical to SEQ ID NO: 4017

SEQ ID NO: 23903 - DNA, 1654 bp, Phytophthora infestans (Potato late blight fungus); identical to SEQ ID NO: 4018
  CDS (16)..(1572)

SEQ ID NO: 23904 - protein, 518 aa, Phytophthora infestans (Potato late blight fungus); identical to SEQ ID NO: 4019

SEQ ID NO: 23905 - DNA, 1332 bp, Chlorobium tepidum; identical to SEQ ID NO: 4020
  CDS (1)..(1332)

SEQ ID NO: 23906 - protein, 443 aa, Chlorobium tepidum; identical to SEQ ID NO: 4021

SEQ ID NO: 23907 - DNA, 2716 bp, Chlamydomonas reinhardtii; identical to SEQ ID NO: 4022
  CDS (26)..(1654)

SEQ ID NO: 23908 - protein, 542 aa, Chlamydomonas reinhardtii; identical to SEQ ID NO: 4023

SEQ ID NO: 23909 - DNA, 2568 bp, Chlamydomonas reinhardtii; identical to SEQ ID NO: 4024
  CDS (106)..(1845)

SEQ ID NO: 23910 - protein, 579 aa, Chlamydomonas reinhardtii; identical to SEQ ID NO: 4025

SEQ ID NO: 23911 - DNA, 1296 bp, Dictyostelium discoideum (Slime mold); identical to SEQ ID NO: 4026
  CDS (1)..(1296)

SEQ ID NO: 23912 - protein, 431 aa, Dictyostelium discoideum (Slime mold); identical to SEQ ID NO: 4027

SEQ ID NO: 23913 - DNA, 1434 bp, Hebeloma cylindrosporum; identical to SEQ ID NO: 4028
  CDS (1)..(1434)

SEQ ID NO: 23914 - protein, 477 aa, Hebeloma cylindrosporum; identical to SEQ ID NO: 4029

SEQ ID NO: 23915 - DNA, 1251 bp, Staphylococcus aureus (strain MW2); identical to SEQ ID NO: 4030
  CDS (1)..(1251)

SEQ ID NO: 23916 - protein, 416 aa, Staphylococcus aureus (strain MW2); identical to SEQ ID NO: 4031

SEQ ID NO: 23917 - DNA, 1476 bp, Xanthomonas campestris (pv. campestris); identical to SEQ ID NO: 4032
  CDS (1)..(1476)

SEQ ID NO: 23918 - protein, 491 aa, Xanthomonas campestris (pv. campestris); identical to SEQ ID NO: 4033

SEQ ID NO: 23919 - DNA, 1365 bp, Azoarcus sp. BH72; identical to SEQ ID NO: 4034
  CDS (1)..(1365)

SEQ ID NO: 23920 - protein, 454 aa, Azoarcus sp. BH72; identical to SEQ ID NO: 4035

SEQ ID NO: 23921 - DNA, 1430 bp, Azoarcus sp. BH72; identical to SEQ ID NO: 4036
  CDS (24)..(1430)

SEQ ID NO: 23922 - protein, 468 aa, Azoarcus sp. BH72; identical to SEQ ID NO: 4037

SEQ ID NO: 23923 - DNA, 1317 bp, Pseudomonas stutzeri (Pseudomonas perfectomarina); identical to SEQ ID NO: 4038
  CDS (1)..(1317)

SEQ ID NO: 23924 - protein, 438 aa, Pseudomonas stutzeri (Pseudomonas perfectomarina); identical to SEQ ID NO: 4039

SEQ ID NO: 23925 - DNA, 2195 bp, Chlamydomonas reinhardtii; identical to SEQ ID NO: 4040
  CDS (28)..(1647)

SEQ ID NO: 23926 - protein, 539 aa, Chlamydomonas reinhardtii; identical to SEQ ID NO: 4041

SEQ ID NO: 23927 - DNA, 1494 bp, Oryza sativa (japonica cultivar-group); identical to SEQ ID NO: 4042
  CDS (1)..(1494)

SEQ ID NO: 23928 - protein, 497 aa, Oryza sativa (japonica cultivar-group); identical to SEQ ID NO: 4043

SEQ ID NO: 23929 - DNA, 1883 bp, Oryza sativa (japonica cultivar-group); identical to SEQ ID NO: 4044
  CDS (87)..(1580)

SEQ ID NO: 23930 - protein, 497 aa, Oryza sativa (japonica cultivar-group); identical to SEQ ID NO: 4045

SEQ ID NO: 23931 - DNA, 1437 bp, Emericella nidulans (Aspergillus nidulans); identical to SEQ ID NO: 4046
  CDS (1)..(1437)

SEQ ID NO: 23932 - protein, 478 aa, Emericella nidulans (Aspergillus nidulans); identical to SEQ ID NO: 4047

SEQ ID NO: 23933 - DNA, 1635 bp, Emericella nidulans (Aspergillus nidulans); identical to SEQ ID NO: 4048
  CDS (1)..(1635)

SEQ ID NO: 23934 - protein, 544 aa, Emericella nidulans (Aspergillus nidulans); identical to SEQ ID NO: 4049

SEQ ID NO: 23935 - DNA, 1215 bp, Methanosarcina acetivorans; identical to SEQ ID NO: 4050
  CDS (1)..(1215)

SEQ ID NO: 23936 - protein, 404 aa, Methanosarcina acetivorans; identical to SEQ ID NO: 4051

SEQ ID NO: 23937 - DNA, 1209 bp, Methanosarcina acetivorans; identical to SEQ ID NO: 4052
  CDS (1)..(1209)

SEQ ID NO: 23938 - protein, 402 aa, Methanosarcina acetivorans; identical to SEQ ID NO: 4053

SEQ ID NO: 23939 - DNA, 2239 bp, Methanosarcina mazei (Methanosarcina frisia); identical to SEQ ID NO: 4054
  CDS (537)..(1730)

SEQ ID NO: 23940 - protein, 397 aa, Methanosarcina mazei (Methanosarcina frisia); identical to SEQ ID NO: 4055

SEQ ID NO: 23941 - DNA, 1446 bp, Neurospora crassa; identical to SEQ ID NO: 4056
  CDS (1)..(1446)

SEQ ID NO: 23942 - protein, 481 aa, Neurospora crassa; identical to SEQ ID NO: 4057

SEQ ID NO: 23943 - DNA, 2689 bp, Tuber borchii (White truffle); identical to SEQ ID NO: 4058
  CDS (386)..(1837)

SEQ ID NO: 23944 - protein, 483 aa, Tuber borchii (White truffle); identical to SEQ ID NO: 4059

SEQ ID NO: 23945 - DNA, 1311 bp, Ralstonia solanacearum (Pseudomonas solanacearum); identical to SEQ ID NO: 4060
  CDS (1)..(1311)

SEQ ID NO: 23946 - protein, 436 aa, Ralstonia solanacearum (Pseudomonas solanacearum); identical to SEQ ID NO: 4061

SEQ ID NO: 23947 - DNA, 1356 bp, Rhizobium meliloti (Sinorhizobium meliloti); identical to SEQ ID NO: 4062
  CDS (1)..(1356)

SEQ ID NO: 23948 - protein, 451 aa, Rhizobium meliloti (Sinorhizobium meliloti); identical to SEQ ID NO: 4063

SEQ ID NO: 23949 - DNA, 1655 bp, Lotus japonicus; identical to SEQ ID NO: 4064
  CDS (37)..(1497)

SEQ ID NO: 23950 - protein, 486 aa, Lotus japonicus; identical to SEQ ID NO: 4065

SEQ ID NO: 23951 - DNA, 1497 bp, Oryza sativa (Rice); identical to SEQ ID NO: 4066
  CDS (1)..(1497)

SEQ ID NO: 23952 - protein, 498 aa, Oryza sativa (Rice); identical to SEQ ID NO: 4067

SEQ ID NO: 23953 - DNA, 1479 bp, Hebeloma cylindrosporum; identical to SEQ ID NO: 4068
  CDS (1)..(1479)

SEQ ID NO: 23954 - protein, 492 aa, Hebeloma cylindrosporum; identical to SEQ ID NO: 4069

SEQ ID NO: 23955 - DNA, 1416 bp, Hebeloma cylindrosporum; identical to SEQ ID NO: 4070
  CDS (1)..(1416)

SEQ ID NO: 23956 - protein, 471 aa, Hebeloma cylindrosporum; identical to SEQ ID NO: 4071

SEQ ID NO: 23957 - DNA, 1771 bp, Ustilago maydis (Smut fungus); identical to SEQ ID NO: 4072
  CDS (149)..(1735)

SEQ ID NO: 23958 - protein, 528 aa, Ustilago maydis (Smut fungus); identical to SEQ ID NO: 4073

SEQ ID NO: 23959 - DNA, 1557 bp, Sulfolobus tokodaii; identical to SEQ ID NO: 4074
  CDS (1)..(1557)

SEQ ID NO: 23960 - protein, 518 aa, Sulfolobus tokodaii; identical to SEQ ID NO: 4075

SEQ ID NO: 23961 - DNA, 1356 bp, Rhizobium loti (Mesorhizobium loti); identical to SEQ ID NO: 4076
  CDS (1)..(1356)

SEQ ID NO: 23962 - protein, 451 aa, Rhizobium loti (Mesorhizobium loti); identical to SEQ ID NO: 4077

SEQ ID NO: 23963 - DNA, 1296 bp, Rhodospirillum rubrum; identical to SEQ ID NO: 4078
  CDS (1)..(1296)

SEQ ID NO: 23964 - protein, 431 aa, Rhodospirillum rubrum; identical to SEQ ID NO: 4079

SEQ ID NO: 23965 - DNA, 1473 bp, Dictyostelium discoideum (Slime mold); identical to SEQ ID NO: 4080
  CDS (37)..(1428)

SEQ ID NO: 23966 - protein, 463 aa, Dictyostelium discoideum (Slime mold); identical to SEQ ID NO: 4081

SEQ ID NO: 23967 - DNA, 1494 bp, Schizosaccharomyces pombe (Fission yeast); identical to SEQ ID NO: 4082
  CDS (1)..(1494)

SEQ ID NO: 23968 - protein, 497 aa, Schizosaccharomyces pombe (Fission yeast); identical to SEQ ID NO: 4083

SEQ ID NO: 23969 - DNA, 1797 bp, Lotus japonicus; identical to SEQ ID NO: 4084
  CDS (76)..(1581)

SEQ ID NO: 23970 - protein, 501 aa, Lotus japonicus; identical to SEQ ID NO: 4085

SEQ ID NO: 23971 - DNA, 1491 bp, Arabidopsis thaliana (Mouse-ear cress); identical to SEQ ID NO: 4086
  CDS (1)..(1491)

SEQ ID NO: 23972 - protein, 496 aa, Arabidopsis thaliana (Mouse-ear cress); identical to SEQ ID NO: 4087

SEQ ID NO: 23973 - DNA, 1554 bp, Schizosaccharomyces pombe (Fission yeast); identical to SEQ ID NO: 4088
  CDS (1)..(1554)

SEQ ID NO: 23974 - protein, 517 aa, Schizosaccharomyces pombe (Fission yeast); identical to SEQ ID NO: 4089

SEQ ID NO: 23975 - DNA, 1476 bp, Xanthomonas axonopodis (pv. citri), and; identical to SEQ ID NO: 4090
  CDS (1)..(1476)

SEQ ID NO: 23976 - protein, 491 aa, Xanthomonas axonopodis (pv. citri), and; identical to SEQ ID NO: 4091

SEQ ID NO: 23977 - DNA, 1482 bp, Prochlorococcus sp. (strain PCC 9511); identical to SEQ ID NO: 4092
  CDS (1)..(1482)

SEQ ID NO: 23978 - protein, 493 aa, Prochlorococcus sp. (strain PCC 9511); identical to SEQ ID NO: 4093

SEQ ID NO: 23979 - DNA, 1317 bp, Corynebacterium glutamicum (Brevibacterium flavum); identical to SEQ ID NO: 4094
  CDS (1)..(1317)

SEQ ID NO: 23980 - protein, 438 aa, Corynebacterium glutamicum (Brevibacterium flavum); identical to SEQ ID NO: 4095

SEQ ID NO: 23981 - DNA, 1690 bp, Ustilago violacea (Smut fungus) (Microbotryum violaceum); identical to SEQ ID NO: 4096
  CDS (19)..(1500)

SEQ ID NO: 23982 - protein, 493 aa, Ustilago violacea (Smut fungus) (Microbotryum violaceum); identical to SEQ ID NO: 4097

SEQ ID NO: 23983 - DNA, 1658 bp, Arabidopsis thaliana (Mouse-ear cress); identical to SEQ ID NO: 4098
  CDS (63)..(1490): n means a or g or c or t/u

SEQ ID NO: 23984 - protein, 475 aa, Arabidopsis thaliana (Mouse-ear cress); identical to SEQ ID NO: 4099

SEQ ID NO: 23985 - DNA, 1359 bp, Corynebacterium glutamicum (Brevibacterium flavum); identical to SEQ ID NO: 4100
  CDS (1)..(1359)

SEQ ID NO: 23986 - protein, 452 aa, Corynebacterium glutamicum (Brevibacterium flavum); identical to SEQ ID NO: 4101

SEQ ID NO: 23987 - DNA, 1751 bp, Lycopersicon esculentum (Tomato); identical to SEQ ID NO: 4102
  CDS (56)..(1522)

SEQ ID NO: 23988 - protein, 488 aa, Lycopersicon esculentum (Tomato); identical to SEQ ID NO: 4103

SEQ ID NO: 23989 - DNA, 1671 bp, Arabidopsis thaliana (Mouse-ear cress); identical to SEQ ID NO: 4104
  CDS (10)..(1569)

SEQ ID NO: 23990 - protein, 519 aa, Arabidopsis thaliana (Mouse-ear cress); identical to SEQ ID NO: 4105

SEQ ID NO: 23991 - DNA, 1659 bp, Lycopersicon esculentum (Tomato); identical to SEQ ID NO: 4106
  CDS (179)..(1561)

SEQ ID NO: 23992 - protein, 460 aa, Lycopersicon esculentum (Tomato); identical to SEQ ID NO: 4107

SEQ ID NO: 23993 - DNA, 1603 bp, Ustilago maydis (Smut fungus); identical to SEQ ID NO: 4108
  CDS (91)..(1554)

SEQ ID NO: 23994 - protein, 487 aa, Ustilago maydis (Smut fungus); identical to SEQ ID NO: 4109

SEQ ID NO: 23995 - DNA, 1470 bp, Geobacter sulfurreducens; identical to SEQ ID NO: 4110
  CDS (1)..(1470)

SEQ ID NO: 23996 - protein, 489 aa, Geobacter sulfurreducens; identical to SEQ ID NO: 4111

SEQ ID NO: 23997 - DNA, 1221 bp, Geobacter sulfurreducens; identical to SEQ ID NO: 4112
  CDS (1)..(1221)

SEQ ID NO: 23998 - protein, 406 aa, Geobacter sulfurreducens; identical to SEQ ID NO: 4113

SEQ ID NO: 23999 - DNA, 1656 bp, Triticum aestivum (Wheat); identical to SEQ ID NO: 4114
  CDS (93)..(1505)

SEQ ID NO: 24000 - protein, 470 aa, Triticum aestivum (Wheat); identical to SEQ ID NO: 4115

SEQ ID NO: 24001 - DNA, 1278 bp, Mycobacterium paratuberculosis; identical to SEQ ID NO: 4116
  CDS (1)..(1278)

SEQ ID NO: 24002 - protein, 425 aa, Mycobacterium paratuberculosis; identical to SEQ ID NO: 4117

SEQ ID NO: 24003 - DNA, 1440 bp, Mycobacterium paratuberculosis; identical to SEQ ID NO: 4118
  CDS (1)..(1440)

SEQ ID NO: 24004 - protein, 479 aa, Mycobacterium paratuberculosis; identical to SEQ ID NO: 4119

SEQ ID NO: 24005 - DNA, 1236 bp, Bacillus cereus ATCC 10987; identical to SEQ ID NO: 4120
  CDS (1)..(1236)

SEQ ID NO: 24006 - protein, 411 aa, Bacillus cereus ATCC 10987; identical to SEQ ID NO: 4121

SEQ ID NO: 24007 - DNA, 1332 bp, Rhodopseudomonas palustris; identical to SEQ ID NO: 4122
  CDS (1)..(1332)

SEQ ID NO: 24008 - protein, 443 aa, Rhodopseudomonas palustris; identical to SEQ ID NO: 4123

SEQ ID NO: 24009 - DNA, 1443 bp, Rhodopseudomonas palustris; identical to SEQ ID NO: 4124
  CDS (1)..(1443)

SEQ ID NO: 24010 - protein, 480 aa, Rhodopseudomonas palustris; identical to SEQ ID NO: 4125

SEQ ID NO: 24011 - DNA, 21 bp, Primer
atggctcggggtgacggacat

SEQ ID NO: 24012 - DNA, 25 bp, Primer
tcatgcttcttttgcgtgatgcaat

SEQ ID NO: 24013 - DNA, 603 bp, Saccharomyces cerevisiae; identical to SEQ ID NO: 13285
  CDS (1)..(603)

SEQ ID NO: 24014 - protein, 200 aa, Saccharomyces cerevisiae; identical to SEQ ID NO: 13286

SEQ ID NO: 24015 - DNA, 615 bp, Saccharomyces cerevisiae; identical to SEQ ID NO: 13287
  CDS (1)..(615)

SEQ ID NO: 24016 - protein, 204 aa, Saccharomyces cerevisiae; identical to SEQ ID NO: 13288

SEQ ID NO: 24017 - DNA, 573 bp, Schizosaccharomyces pombe; identical to SEQ ID NO: 13289
  CDS (1)..(573)

SEQ ID NO: 24018 - protein, 190 aa, Schizosaccharomyces pombe; identical to SEQ ID NO: 13290

SEQ ID NO: 24019 - DNA, 669 bp, Cochliobolus heterostrophus; identical to SEQ ID NO: 13291
  CDS (1)..(669)

SEQ ID NO: 24020 - protein, 222 aa, Cochliobolus heterostrophus; identical to SEQ ID NO: 13292

SEQ ID NO: 24021 - DNA, 789 bp, Neurospora crassa; identical to SEQ ID NO: 13293
  CDS (1)..(789)

SEQ ID NO: 24022 - protein, 262 aa, Neurospora crassa; identical to SEQ ID NO: 13294

SEQ ID NO: 24023 - DNA, 621 bp, Leptosphaeria maculans; identical to SEQ ID NO: 13295
  CDS (1)..(621)

SEQ ID NO: 24024 - protein, 206 aa, Leptosphaeria maculans; identical to SEQ ID NO: 13296

SEQ ID NO: 24025 - DNA, 612 bp, Phaeosphaeria nodorum; identical to SEQ ID NO: 13297
  CDS (1)..(612)

SEQ ID NO: 24026 - protein, 203 aa, Phaeosphaeria nodorum; identical to SEQ ID NO: 13298

SEQ ID NO: 24027 - DNA, 576 bp, Ashbya gossypii; identical to SEQ ID NO: 13299
  CDS (1)..(576)

SEQ ID NO: 24028 - protein, 191 aa, Ashbya gossypii; identical to SEQ ID NO: 13300

SEQ ID NO: 24029 - DNA, 24 bp, Primer
atggcttggactagtacattacca

SEQ ID NO: 24030 - DNA, 26 bp, Primer
ttaactcttccctttacttagaaaca

SEQ ID NO: 24031 - protein, 136 aa, consensus; identical to SEQ ID NO: 10195
  MISC_FEATURE (1)..(136): Xaa in all positions is any amino acid.

SEQ ID NO: 24032 - protein, 46 aa, consensus; identical to SEQ ID NO: 546
  MISC_FEATURE (1)..(46): xaa in  all positions is any amino acid.

SEQ ID NO: 24033 - protein, 289 aa, consensus; identical to SEQ ID NO: 10197
  MISC_FEATURE (1)..(289): Xaa in all positions is any amino acid.

SEQ ID NO: 24034 - protein, 23 aa, consensus
  MISC_FEATURE (1)..(23): consensus for the disclosure of xaa see table XV
SXXTXXXXXXXLXXXXXXXXXXG

SEQ ID NO: 24035 - protein, 222 aa, consensus; identical to SEQ ID NO: 5291
  MISC_FEATURE (1)..(222): Xaa in all positions is any amino acid.

SEQ ID NO: 24036 - protein, 33 aa, consensus; identical to SEQ ID NO: 4356
  MISC_FEATURE (1)..(33): consensus for the disclosure of xaa see table XV

SEQ ID NO: 24037 - protein, 36 aa, consensus; identical to SEQ ID NO: 4357
  MISC_FEATURE (1)..(36): consensus for the disclosure of xaa see table XV

SEQ ID NO: 24038 - protein, 39 aa, consensus; identical to SEQ ID NO: 4358
  MISC_FEATURE (1)..(39): consensus for the disclosure of xaa see table XV

SEQ ID NO: 24039 - protein, 323 aa, consensus; identical to SEQ ID NO: 5813
  MISC_FEATURE (1)..(323): Xaa in all positions is any amino acid.

SEQ ID NO: 24040 - protein, 26 aa, consensus
  MISC_FEATURE (1)..(26): consensus for the disclosure of xaa see table XV
XXXGXXXXXXXXXXXXXXXXXXXXXX

SEQ ID NO: 24041 - protein, 16 aa, consensus
  MISC_FEATURE (1)..(16): consensus for the disclosure of xaa see table XV
XXXXXXXXXXXXXXXX

SEQ ID NO: 24042 - protein, 22 aa, consensus
  MISC_FEATURE (1)..(22): consensus for the disclosure of xaa see table XV
XXXXXXXXXHXXXGXXXXXXXX

SEQ ID NO: 24043 - protein, 547 aa, consensus; identical to SEQ ID NO: 18717
  MISC_FEATURE (1)..(547): Xaa in all positions is any amino acid.

SEQ ID NO: 24044 - protein, 11 aa, consensus
  MISC_FEATURE (1)..(11): consensus for the disclosure of xaa see table XV
XXXXXXXXXXX

SEQ ID NO: 24045 - protein, 14 aa, consensus
  MISC_FEATURE (1)..(14): consensus for the disclosure of xaa see table XV
XXPXXXXXXXXXGX

SEQ ID NO: 24046 - protein, 80 aa, consensus; identical to SEQ ID NO: 7429
  MISC_FEATURE (1)..(80): Xaa in all positions is any amino acid.

SEQ ID NO: 24047 - protein, 37 aa, consensus; identical to SEQ ID NO: 10208
  MISC_FEATURE (1)..(37): consensus for the disclosure of xaa see table XV

SEQ ID NO: 24048 - protein, 32 aa, consensus; identical to SEQ ID NO: 10209
  MISC_FEATURE (1)..(32): consensus for the disclosure of xaa see table XV

SEQ ID NO: 24049 - protein, 337 aa, consensus; identical to SEQ ID NO: 10210
  MISC_FEATURE (1)..(337): Xaa in all postions is any amino acid.

SEQ ID NO: 24050 - protein, 35 aa, consensus; identical to SEQ ID NO: 13778
  MISC_FEATURE (1)..(35): consensus for the disclosure of xaa see table XV

SEQ ID NO: 24051 - protein, 20 aa, consensus
  MISC_FEATURE (1)..(20): consensus for the disclosure of xaa see table XV
DVXXXXXXXDXXXDHHXXXX

SEQ ID NO: 24052 - protein, 9 aa, consensus
  MISC_FEATURE (1)..(9): consensus for the disclosure of xaa see table XV
SSXGXXXXX

SEQ ID NO: 24053 - protein, 15 aa, consensus
  MISC_FEATURE (1)..(15): consensus for the disclosure of xaa see table XV
XXXXXXXXXDXXDNG

SEQ ID NO: 24054 - protein, 42 aa, consensus; identical to SEQ ID NO: 13782
  MISC_FEATURE (1)..(42): consensus for the disclosure of xaa see table XV

SEQ ID NO: 24055 - protein, 344 aa, consensus; identical to SEQ ID NO: 13783
  MISC_FEATURE (1)..(344): Xaa in all positions is any amino acid.

SEQ ID NO: 24056 - protein, 54 aa, consensus; identical to SEQ ID NO: 13784
  MISC_FEATURE (1)..(54): consensus for the disclosure of xaa see table XV

SEQ ID NO: 24057 - protein, 41 aa, consensus; identical to SEQ ID NO: 13785
  MISC_FEATURE (1)..(41): consensus for the disclosure of xaa see table XV

SEQ ID NO: 24058 - protein, 196 aa, consensus; identical to SEQ ID NO: 13786
  MISC_FEATURE (1)..(196): Xaa in all positions is any amino acid.

SEQ ID NO: 24059 - protein, 42 aa, consensus
  MISC_FEATURE (1)..(42): consensus for the disclosure of xaa see table XV
PXXXXXXXXXXXXXXXXXXXXXXXXXXXXXXXXXXXXXXXXX

SEQ ID NO: 24060 - protein, 41 aa, consensus
  MISC_FEATURE (1)..(41): consensus for the disclosure of xaa see table XV
QXYXXXXXXXXXXXXXXXXXXXXXXXXXXXXTXDXXXXXXR

SEQ ID NO: 24061 - protein, 35 aa, consensus
  MISC_FEATURE (1)..(35): consensus for the disclosure of xaa see table XV
XXXKGXXXXXXXXXXXXXXXXXXXXXXXHGXXXXX

SEQ ID NO: 24062 - protein, 61 aa, consensus
  MISC_FEATURE (1)..(61): consensus for the disclosure of xaa see table XV
XXXDXGXXXXXXXXXXXXXGAXXXXXXXXXXXXXXXXGXXGXXXXXXXXXXXXXXXXXXXX

SEQ ID NO: 24063 - protein, 434 aa, consensus
  MISC_FEATURE (1)..(434): Xaa in all positions is any amino acid
AXXXXXXXXXXXXXXXXXXXXXXXYXXXXXXXXXTXXXNXXXXXXXXXXXXXLXXXXXXXXXXXXXXXXXXXXXPXXXXPXXXXXXXXXXXXGEXXXAXAAXXXXXXXXXXXXXXXXXXXEXXXXXXXXXXXXXXXXXXXXXXXXXXXXXXXXXXXXXXXXXXXXQLYXXXDXXXXXXXXXXXRAXXXXGXXXXXXTXDXXXXGXRXXDXXXXXXXXXXXXXXXXXXXXXXXXXXXXXXXXXXXXXXXXXXXXXXXXXXXXXXXXXXXXXXXXXXXXXXXXXXXXXXXXXXWXDXXXXXXXXXXXXXXXXXXXXXKGXXXXXDAXXAXXXGXXXXXXXSNHGGRQLDXXXXXXXXLXXXXXXXXXXXXXXXXXXXXDXGXRXGXDXXXAXALGAXXXXXGRXXXXXLXXXGXXGVXXXXXXXXXEXXXXMXLXG

SEQ ID NO: 24064 - protein, 72 aa, consensus
  MISC_FEATURE (1)..(72): consensus for the disclosure of xaa see table XV
XXFXXXWXXXXXXXXXXXXXXXXXXXXXXXXXXXXXXXXXXXXXXXXXXXXXXXXPXXXXXXXXXXXXXXXX

SEQ ID NO: 24065 - protein, 86 aa, consensus
  MISC_FEATURE (1)..(86): consensus for the disclosure of xaa see table XV
XXXXLXXLXXXXXXXXFXKGXXXXPXCXFSXXXXXXXXXXXXXXXXFXIXXDXXXRXXXKXXXXWPTXPQXXXXGXXXGGXDXXXX

SEQ ID NO: 24066 - protein, 227 aa, consensus
  MISC_FEATURE (1)..(227): Xaa in all positions is any amino acid
FXXXWXXXCXXXXXVXXXXXXXXXXXXXXXXXFXXXXAXXXXXISXXXXXXXVPXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXRLXXLXXXXPVMXFMKGXPXXPXCGFSRXXVXILXXXXXXFGXFDILXDXXVRXXLKXXSXWPTXPQLYXXGEXXGGLDIXKE

SEQ ID NO: 24067 - protein, 33 aa, consensus
  MISC_FEATURE (1)..(33): consensus for the disclosure of xaa see table XV
XXXXXXXXXXXXXXKGXXXXPXCGFSXXXXXXX

SEQ ID NO: 24068 - protein, 44 aa, consensus
  MISC_FEATURE (1)..(44): consensus for the disclosure of xaa see table XV
XXXXXXXRXXXXXXXXWPTXPQXXXXGXXXGGXXXXXXXXXXXX

SEQ ID NO: 24069 - protein, 77 aa, consensus
  MISC_FEATURE (1)..(77): Xaa in all positions is any amino acid
MKGXXXXPXCGFSXXXXXXLXXXXXXXXXXXXXXXLXXXXXRXXXXXXXXWPTXPQXXXXGEXXGGXDIXXXXXXXG

SEQ ID NO: 24070 - protein, 19 aa, consensus
  MISC_FEATURE (1)..(19): consensus for the disclosure of xaa see table XV
KXEXXXXXXSXKXRXXXXX

SEQ ID NO: 24071 - DNA, 405 bp, Escherichia coli K12
  CDS (1)..(405)
atgcgtgctttaccgatctgtttagtagcactcatgctaagcggctgttccatgttaagcagatcccctgtcgaacccgttcaaagcactgcaccccagccgaaagcggagcctgcaaaaccgaaagcgccgcgcgccacgccggtccgaatttataccaatgcagaagaattagtcggcaaaccgttccgcgatctcggtgaagtcagtggcgactcttgccaggcctctaatcaggactctccgccgagcattccaaccgcacgtaagcggatgcaaatcaacgcctctaaaatgaaagccaatgctgtattactgcatagctgcgaagtcaccagcggtacgccaggctgctatcgtcaggctgtatgtatcggttctgcgcttaacattacggcgaaatga

SEQ ID NO: 24072 - protein, 134 aa, Escherichia coli K12
MRALPICLVALMLSGCSMLSRSPVEPVQSTAPQPKAEPAKPKAPRATPVRIYTNAEELVGKPFRDLGEVSGDSCQASNQDSPPSIPTARKRMQINASKMKANAVLLHSCEVTSGTPGCYRQAVCIGSALNITAK

SEQ ID NO: 24073 - DNA, 408 bp, Yersinia pestis
  CDS (1)..(408)
atgcgtgcgttacctctgtgtctgttagctctatcgctaactggatgtaccctgcttccatcaaagccatccaccacagataatccgattaagcaaccacctccggttatcgaacgcagccccacggcagccccacggcctgcaccggtaaagctttataaaagtgccgaagaacttgttggtaagccttttcgcgatctaggtgaagtgtctggtgaatcttgccaatcaaccgttcaggattctccacccagtatttcaaccgctcgtaagagaatgcaaattcgtgcatcttatatgaaagcaaatgccgtcttactgcatgaatgtgaaatacaaagtggtgtccctggctgctatcaacaagcggtgtgtcagggttcagcactgaacgtttcatctaaatga

SEQ ID NO: 24074 - protein, 135 aa, Yersinia pestis
MRALPLCLLALSLTGCTLLPSKPSTTDNPIKQPPPVIERSPTAAPRPAPVKLYKSAEELVGKPFRDLGEVSGESCQSTVQDSPPSISTARKRMQIRASYMKANAVLLHECEIQSGVPGCYQQAVCQGSALNVSSK

SEQ ID NO: 24075 - DNA, 405 bp, Salmonella enterica subsp. enterica serovar Typhi
  CDS (1)..(405)
atgcgtgctttaccgatctgtttattggcactcatgctgggcggttgttccatgctaagcagatcccctgttgaacccgttcaaagcaccgcaaccccgccaaaagcggagccggagaaacctaaagcgccgcgtgccgctcccgtcaggatttacaccaatgctgaagacttagtcggcaaacctttccgagatcttggcgaggttagcggcgaatcctgccaggcgacaaatcaagactctccgcctaacattccaactgcgcgcaagcgtatgcagattaatgcatctaaaatgaaagccaacgccgtcctgctgcacagctgtgaaattaccagcggcacgccaggctgctatcgtcaggcggtttgtatcgggtccgccctgaatatttcggcgaaatga

SEQ ID NO: 24076 - protein, 134 aa, Salmonella enterica subsp. enterica serovar Typhi
MRALPICLLALMLGGCSMLSRSPVEPVQSTATPPKAEPEKPKAPRAAPVRIYTNAEDLVGKPFRDLGEVSGESCQATNQDSPPNIPTARKRMQINASKMKANAVLLHSCEITSGTPGCYRQAVCIGSALNISAK

SEQ ID NO: 24077 - DNA, 411 bp, Erwinia carotovora
  CDS (1)..(411)
atgcgtgctgttccctttatattgttggcaatgtcgctgacaggctgttctttatttcagaagccaccggcacctgctcctcaacctgttattgaaaccaaaaccgcagaaccggctccaaaaccgaagccaccggctcgcccaacgccagccgtgttgtataaaagtgcagaagagttagtcggtaaaccgttccgtgatatgggcgaagtttcaggttcctcatgtcaggtcagcgctcaggatgctccccccaacgcagcaaatgcgcgtaaaagaatgcaaaaccgcgcaaccgtaatgaaagccaatgcggttttactgcatgaatgccaaaccgtcagtggcgtagcgggttgctacagccaagtcgtttgccagggcactgcgctgaaagtctctgcacaatga

SEQ ID NO: 24078 - protein, 136 aa, Erwinia carotovora
MRAVPFILLAMSLTGCSLFQKPPAPAPQPVIETKTAEPAPKPKPPARPTPAVLYKSAEELVGKPFRDMGEVSGSSCQVSAQDAPPNAANARKRMQNRATVMKANAVLLHECQTVSGVAGCYSQVVCQGTALKVSAQ

SEQ ID NO: 24079 - DNA, 399 bp, Photorhabdus luminescens
  CDS (1)..(399)
atgcgtaggctacttgcctctttattagcactgtccataacaggatgttcagtacaacaagcaacatttcctgacgcttcccagttatcagatatgaagtacacaaaactatcaaccggagaaaaaaaacatttctcttcatccgtaaagttatataccaaaagtgaagaattattaggtgtctcatttaaagatttagggattgtttctggtcaatcgtgtcgtagttccttacaggatccacccgcaaatatcatcgtggctcgcaaccagatgatgaccaaagcagcttatttgaatgctaacgctgttttattgcatcaatgcgaaatattatcaggccaaggatgctaccagatagcaatatgtgaaggttcagccttgcttatcacccaatga

SEQ ID NO: 24080 - protein, 132 aa, Photorhabdus luminescens
MRRLLASLLALSITGCSVQQATFPDASQLSDMKYTKLSTGEKKHFSSSVKLYTKSEELLGVSFKDLGIVSGQSCRSSLQDPPANIIVARNQMMTKAAYLNANAVLLHQCEILSGQGCYQIAICEGSALLITQ

SEQ ID NO: 24081 - DNA, 24 bp, Primer
atgcgtgctttaccgatctgttta

SEQ ID NO: 24082 - DNA, 26 bp, Primer
ttatttcgccgtaatgttaagcgcag

SEQ ID NO: 24083 - DNA, 723 bp, Escherichia coli; identical to SEQ ID NO: 417
  CDS (1)..(723)

SEQ ID NO: 24084 - protein, 240 aa, Escherichia coli; identical to SEQ ID NO: 418

SEQ ID NO: 24085 - DNA, 723 bp, Listeria innocua; identical to SEQ ID NO: 453
  CDS (1)..(723)

SEQ ID NO: 24086 - protein, 240 aa, Listeria innocua; identical to SEQ ID NO: 454

SEQ ID NO: 24087 - DNA, 798 bp, Yersinia pestis; identical to SEQ ID NO: 2052
  CDS (1)..(798)

SEQ ID NO: 24088 - protein, 265 aa, Yersinia pestis; identical to SEQ ID NO: 452

SEQ ID NO: 24089 - DNA, 744 bp, Salmonella enterica subsp. enterica serovar Typhi; identical to SEQ ID NO: 2054
  CDS (1)..(744)

SEQ ID NO: 24090 - protein, 247 aa, Salmonella enterica subsp. enterica serovar Typhi; identical to SEQ ID NO: 460

SEQ ID NO: 24091 - DNA, 714 bp, Listeria innocua; identical to SEQ ID NO: 455
  CDS (1)..(714)

SEQ ID NO: 24092 - protein, 237 aa, Listeria innocua; identical to SEQ ID NO: 456

SEQ ID NO: 24093 - DNA, 723 bp, Listeria monocytogenes; identical to SEQ ID NO: 457
  CDS (1)..(723)

SEQ ID NO: 24094 - protein, 240 aa, Listeria monocytogenes; identical to SEQ ID NO: 458

SEQ ID NO: 24095 - DNA, 729 bp, Listeria monocytogenes; identical to SEQ ID NO: 429
  CDS (1)..(729)

SEQ ID NO: 24096 - protein, 242 aa, Listeria monocytogenes; identical to SEQ ID NO: 430

SEQ ID NO: 24097 - DNA, 729 bp, Listeria innocua; identical to SEQ ID NO: 2062
  CDS (1)..(729)

SEQ ID NO: 24098 - protein, 242 aa, Listeria innocua; identical to SEQ ID NO: 432

SEQ ID NO: 24099 - DNA, 729 bp, Bacillus subtilis; identical to SEQ ID NO: 421
  CDS (1)..(729)

SEQ ID NO: 24100 - protein, 242 aa, Bacillus subtilis; identical to SEQ ID NO: 422

SEQ ID NO: 24101 - DNA, 747 bp, Bacillus halodurans; identical to SEQ ID NO: 445
  CDS (1)..(747)

SEQ ID NO: 24102 - protein, 248 aa, Bacillus halodurans; identical to SEQ ID NO: 446

SEQ ID NO: 24103 - DNA, 723 bp, Bacillus halodurans; identical to SEQ ID NO: 433
  CDS (1)..(723)

SEQ ID NO: 24104 - protein, 240 aa, Bacillus halodurans; identical to SEQ ID NO: 434

SEQ ID NO: 24105 - DNA, 714 bp, Bacillus halodurans; identical to SEQ ID NO: 427
  CDS (1)..(714)

SEQ ID NO: 24106 - protein, 237 aa, Bacillus halodurans; identical to SEQ ID NO: 428

SEQ ID NO: 24107 - DNA, 811 bp, Corynebacterium glutamicum; identical to SEQ ID NO: 2072

SEQ ID NO: 24108 - protein, 269 aa, Corynebacterium glutamicum; identical to SEQ ID NO: 462

SEQ ID NO: 24109 - DNA, 732 bp, Bacillus subtilis; identical to SEQ ID NO: 425
  CDS (1)..(732)

SEQ ID NO: 24110 - protein, 243 aa, Bacillus subtilis; identical to SEQ ID NO: 426

SEQ ID NO: 24111 - DNA, 744 bp, Caulobacter crescentus; identical to SEQ ID NO: 2076
  CDS (1)..(744)

SEQ ID NO: 24112 - protein, 247 aa, Caulobacter crescentus; identical to SEQ ID NO: 442

SEQ ID NO: 24113 - DNA, 711 bp, Streptococcus pneumoniae; identical to SEQ ID NO: 2078
  CDS (1)..(711)

SEQ ID NO: 24114 - protein, 236 aa, Streptococcus pneumoniae; identical to SEQ ID NO: 436

SEQ ID NO: 24115 - DNA, 729 bp, Streptococcus pneumoniae; identical to SEQ ID NO: 2080
  CDS (1)..(729)

SEQ ID NO: 24116 - protein, 242 aa, Streptococcus pneumoniae; identical to SEQ ID NO: 438

SEQ ID NO: 24117 - DNA, 708 bp, Streptococcus pneumoniae; identical to SEQ ID NO: 2082
  CDS (1)..(708)

SEQ ID NO: 24118 - protein, 235 aa, Streptococcus pneumoniae; identical to SEQ ID NO: 450

SEQ ID NO: 24119 - DNA, 717 bp, Escherichia coli; identical to SEQ ID NO: 423
  CDS (1)..(717)

SEQ ID NO: 24120 - protein, 238 aa, Escherichia coli [sequence omitted]

SEQ ID NO: 24121 - DNA, 708 bp, Lactococcus lactis subsp. lactis; identical to SEQ ID NO: 443
  CDS (1)..(708)

SEQ ID NO: 24122 - protein, 235 aa, Lactococcus lactis subsp. lactis; identical to SEQ ID NO: 444

SEQ ID NO: 24123 - DNA, 756 bp, Escherichia coli; identical to SEQ ID NO: 439
  CDS (1)..(756)

SEQ ID NO: 24124 - protein, 251 aa, Escherichia coli; identical to SEQ ID NO: 440

SEQ ID NO: 24125 - DNA, 732 bp, Clostridium acetobutylicum; identical to SEQ ID NO: 2090
  CDS (1)..(732)

SEQ ID NO: 24126 - protein, 243 aa, Clostridium acetobutylicum; identical to SEQ ID NO: 448

SEQ ID NO: 24127 - DNA, 747 bp, Bordetella parapertussis; identical to SEQ ID NO: 2092
  CDS (1)..(747)

SEQ ID NO: 24128 - protein, 248 aa, Bordetella parapertussis; identical to SEQ ID NO: 510

SEQ ID NO: 24129 - DNA, 747 bp, Bordetella bronchiseptica; identical to SEQ ID NO: 2094
  CDS (1)..(747)

SEQ ID NO: 24130 - protein, 248 aa, Bordetella bronchiseptica; identical to SEQ ID NO: 508

SEQ ID NO: 24131 - DNA, 738 bp, Bacillus cereus; identical to SEQ ID NO: 503
  CDS (1)..(738)

SEQ ID NO: 24132 - protein, 245 aa, Bacillus cereus; identical to SEQ ID NO: 504

SEQ ID NO: 24133 - DNA, 732 bp, Bacillus anthracis; identical to SEQ ID NO: 2098
  CDS (1)..(732)

SEQ ID NO: 24134 - protein, 243 aa, Bacillus anthracis; identical to SEQ ID NO: 502

SEQ ID NO: 24135 - DNA, 738 bp, Bacillus anthracis; identical to SEQ ID NO: 499
  CDS (1)..(738)

SEQ ID NO: 24136 - protein, 245 aa, Bacillus anthracis; identical to SEQ ID NO: 500

SEQ ID NO: 24137 - DNA, 765 bp, Streptomyces avermitilis; identical to SEQ ID NO: 2102
  CDS (1)..(765)

SEQ ID NO: 24138 - protein, 254 aa, Streptomyces avermitilis; identical to SEQ ID NO: 498

SEQ ID NO: 24139 - DNA, 756 bp, Enterococcus faecalis; identical to SEQ ID NO: 2104
  CDS (25)..(756)

SEQ ID NO: 24140 - protein, 243 aa, Enterococcus faecalis; identical to SEQ ID NO: 496

SEQ ID NO: 24141 - DNA, 708 bp, Enterococcus faecalis; identical to SEQ ID NO: 2106
  CDS (1)..(708)

SEQ ID NO: 24142 - protein, 235 aa, Enterococcus faecalis; identical to SEQ ID NO: 494

SEQ ID NO: 24143 - DNA, 675 bp, Shigella flexneri; identical to SEQ ID NO: 2108
  CDS (1)..(675)

SEQ ID NO: 24144 - protein, 224 aa, Shigella flexneri; identical to SEQ ID NO: 506

SEQ ID NO: 24145 - DNA, 723 bp, Shigella flexneri; identical to SEQ ID NO: 491
  CDS (1)..(723)

SEQ ID NO: 24146 - protein, 240 aa, Shigella flexneri; identical to SEQ ID NO: 492

SEQ ID NO: 24147 - DNA, 927 bp, Pseudomonas putida; identical to SEQ ID NO: 2112
  CDS (1)..(927)

SEQ ID NO: 24148 - protein, 308 aa, Pseudomonas putida; identical to SEQ ID NO: 490

SEQ ID NO: 24149 - DNA, 711 bp, Lactobacillus plantarum; identical to SEQ ID NO: 487
  CDS (1)..(711)

SEQ ID NO: 24150 - protein, 236 aa, Lactobacillus plantarum; identical to SEQ ID NO: 488

SEQ ID NO: 24151 - DNA, 699 bp, Streptococcus mutans; identical to SEQ ID NO: 485
  CDS (1)..(699)

SEQ ID NO: 24152 - protein, 232 aa, Streptococcus mutans; identical to SEQ ID NO: 486

SEQ ID NO: 24153 - DNA, 699 bp, Streptococcus agalactiae; identical to SEQ ID NO: 2118
  CDS (1)..(699)

SEQ ID NO: 24154 - protein, 232 aa, Streptococcus agalactiae; identical to SEQ ID NO: 484

SEQ ID NO: 24155 - DNA, 747 bp, Oceanobacillus iheyensis; identical to SEQ ID NO: 481
  CDS (1)..(747)

SEQ ID NO: 24156 - protein, 248 aa, Oceanobacillus iheyensis; identical to SEQ ID NO: 482

SEQ ID NO: 24157 - DNA, 756 bp, Escherichia coli O6; identical to SEQ ID NO: 479
  CDS (1)..(756)

SEQ ID NO: 24158 - protein, 251 aa, Escherichia coli O6; identical to SEQ ID NO: 480

SEQ ID NO: 24159 - DNA, 699 bp, Escherichia coli O6; identical to SEQ ID NO: 477
  CDS (1)..(699)

SEQ ID NO: 24160 - protein, 232 aa, Escherichia coli O6; identical to SEQ ID NO: 478

SEQ ID NO: 24161 - DNA, 765 bp, Streptomyces sp; identical to SEQ ID NO: 2126
  CDS (1)..(765)

SEQ ID NO: 24162 - protein, 254 aa, Streptomyces sp; identical to SEQ ID NO: 468

SEQ ID NO: 24163 - DNA, 714 bp, Streptococcus mutans; identical to SEQ ID NO: 2128
  CDS (1)..(714)

SEQ ID NO: 24164 - protein, 237 aa, Streptococcus mutans; identical to SEQ ID NO: 476

SEQ ID NO: 24165 - DNA, 762 bp, Streptomyces griseus; identical to SEQ ID NO: 2130
  CDS (1)..(762)

SEQ ID NO: 24166 - protein, 253 aa, Streptomyces griseus; identical to SEQ ID NO: 466

SEQ ID NO: 24167 - DNA, 726 bp, Clostridium perfringens; identical to SEQ ID NO: 471
  CDS (1)..(726)

SEQ ID NO: 24168 - protein, 241 aa, Clostridium perfringens; identical to SEQ ID NO: 472

SEQ ID NO: 24169 - DNA, 726 bp, Streptococcus pyogenes; identical to SEQ ID NO: 469
  CDS (1)..(726)

SEQ ID NO: 24170 - protein, 241 aa, Streptococcus pyogenes; identical to SEQ ID NO: 470

SEQ ID NO: 24171 - DNA, 705 bp, Pseudomonas fluorescens; identical to SEQ ID NO: 463
  CDS (1)..(705)

SEQ ID NO: 24172 - protein, 234 aa, Pseudomonas fluorescens; identical to SEQ ID NO: 464

SEQ ID NO: 24173 - DNA, 765 bp, Streptomyces coelicolor; identical to SEQ ID NO: 2138
  CDS (1)..(765)

SEQ ID NO: 24174 - protein, 254 aa, Streptomyces coelicolor; identical to SEQ ID NO: 474

SEQ ID NO: 24175 - DNA, 23 bp, Primer
atgggacacaagcccttataccg

SEQ ID NO: 24176 - DNA, 23 bp, Primer
ttatcgcgatgattttcgctgcg

SEQ ID NO: 24177 - DNA, 2200 bp, Escherichia coli K12; identical to SEQ ID NO: 17198
  CDS (776)..(2200)

SEQ ID NO: 24178 - protein, 474 aa, Escherichia coli K12; identical to SEQ ID NO: 17199

SEQ ID NO: 24179 - DNA, 3053 bp, Arabidopsis thaliana (mouse-ear cress); identical to SEQ ID NO: 17200
  CDS (1)..(2556)

SEQ ID NO: 24180 - protein, 851 aa, Arabidopsis thaliana (mouse-ear cress); identical to SEQ ID NO: 17201

SEQ ID NO: 24181 - DNA, 1422 bp, Salmonella enterica subsp. enterica serovar Typhi; identical to SEQ ID NO: 17202
  CDS (1)..(1422)

SEQ ID NO: 24182 - protein, 473 aa, Salmonella enterica subsp. enterica serovar Typhi; identical to SEQ ID NO: 17203

SEQ ID NO: 24183 - DNA, 1497 bp, Mycobacterium leprae; identical to SEQ ID NO: 17204
  CDS (1)..(1497)

SEQ ID NO: 24184 - protein, 498 aa, Mycobacterium leprae; identical to SEQ ID NO: 17205

SEQ ID NO: 24185 - DNA, 2829 bp, Arabidopsis thaliana (mouse-ear cress); identical to SEQ ID NO: 17206
  CDS (1)..(2829)

SEQ ID NO: 24186 - protein, 942 aa, Arabidopsis thaliana (mouse-ear cress); identical to SEQ ID NO: 17207

SEQ ID NO: 24187 - DNA, 1491 bp, Methanobacterium thermoautotrophicum; identical to SEQ ID NO: 17208
  CDS (1)..(1491)

SEQ ID NO: 24188 - protein, 496 aa, Methanobacterium thermoautotrophicum; identical to SEQ ID NO: 17209

SEQ ID NO: 24189 - DNA, 1392 bp, Sinorhizobium meliloti; identical to SEQ ID NO: 17210
  CDS (1)..(1392)

SEQ ID NO: 24190 - protein, 463 aa, Sinorhizobium meliloti; identical to SEQ ID NO: 17211

SEQ ID NO: 24191 - DNA, 1503 bp, Mycobacterium tuberculosis; identical to SEQ ID NO: 17212
  CDS (1)..(1503)

SEQ ID NO: 24192 - protein, 500 aa, Mycobacterium tuberculosis; identical to SEQ ID NO: 17213

SEQ ID NO: 24193 - DNA, 2091 bp, Saccharomyces cerevisiae; identical to SEQ ID NO: 17214
  CDS (233)..(1720)

SEQ ID NO: 24194 - protein, 495 aa, Saccharomyces cerevisiae; identical to SEQ ID NO: 17215

SEQ ID NO: 24195 - DNA, 5981 bp, Saccharomyces cerevisiae; identical to SEQ ID NO: 17216
  CDS (2282)..(5578)

SEQ ID NO: 24196 - protein, 1098 aa, Saccharomyces cerevisiae; identical to SEQ ID NO: 17217

SEQ ID NO: 24197 - DNA, 2358 bp, Kluyveromyces marxianus var. lactis, Candida sphaerica; identical to SEQ ID NO: 17218
  CDS (722)..(2188)

SEQ ID NO: 24198 - protein, 488 aa, Kluyveromyces marxianus var. lactis, Candida sphaerica; identical to SEQ ID NO: 17219

SEQ ID NO: 24199 - DNA, 3170 bp, Saccharomyces cerevisiae; identical to SEQ ID NO: 17220
  CDS (147)..(2837)

SEQ ID NO: 24200 - protein, 896 aa, Saccharomyces cerevisiae; identical to SEQ ID NO: 17221

SEQ ID NO: 24201 - DNA, 1500 bp, Synechocystis sp; identical to SEQ ID NO: 17222
  CDS (1)..(1500)

SEQ ID NO: 24202 - protein, 499 aa, Synechocystis sp; identical to SEQ ID NO: 17223

SEQ ID NO: 24203 - DNA, 2586 bp, Arabidopsis thaliana (mouse-ear cress); identical to SEQ ID NO: 17224
  CDS (1)..(2586)

SEQ ID NO: 24204 - protein, 861 aa, Arabidopsis thaliana (mouse-ear cress); identical to SEQ ID NO: 17225

SEQ ID NO: 24205 - DNA, 2388 bp, Arabidopsis thaliana (mouse-ear cress); identical to SEQ ID NO: 17226
  CDS (1)..(2388)

SEQ ID NO: 24206 - protein, 795 aa, Arabidopsis thaliana (mouse-ear cress); identical to SEQ ID NO: 17227

SEQ ID NO: 24207 - DNA, 2676 bp, Schizosaccharomyces pombe; identical to SEQ ID NO: 17228
  CDS (1)..(2676)

SEQ ID NO: 24208 - protein, 891 aa, Schizosaccharomyces pombe; identical to SEQ ID NO: 17229

SEQ ID NO: 24209 - DNA, 2550 bp, Schizosaccharomyces pombe; identical to SEQ ID NO: 17230
  CDS (1)..(2550)

SEQ ID NO: 24210 - protein, 849 aa, Schizosaccharomyces pombe; identical to SEQ ID NO: 17231

SEQ ID NO: 24211 - DNA, 2835 bp, Schizosaccharomyces pombe; identical to SEQ ID NO: 17232
  CDS (1)..(2835)

SEQ ID NO: 24212 - protein, 944 aa, Schizosaccharomyces pombe; identical to SEQ ID NO: 17233

SEQ ID NO: 24213 - DNA, 2580 bp, Schizosaccharomyces pombe; identical to SEQ ID NO: 17234
  CDS (52)..(2505)

SEQ ID NO: 24214 - protein, 817 aa, Schizosaccharomyces pombe; identical to SEQ ID NO: 17235

SEQ ID NO: 24215 - DNA, 1993 bp, Schizosaccharomyces pombe; identical to SEQ ID NO: 17236
  CDS (266)..(1705)

SEQ ID NO: 24216 - protein, 479 aa, Schizosaccharomyces pombe; identical to SEQ ID NO: 17237

SEQ ID NO: 24217 - DNA, 2621 bp, unidentified; identical to SEQ ID NO: 17238
  CDS (25)..(2487)

SEQ ID NO: 24218 - protein, 820 aa, unidentified; identical to SEQ ID NO: 17239

SEQ ID NO: 24219 - DNA, 2640 bp, Helianthus annuus; identical to SEQ ID NO: 17240
  CDS (171)..(2510)

SEQ ID NO: 24220 - protein, 779 aa, Helianthus annuus; identical to SEQ ID NO: 17241

SEQ ID NO: 24221 - DNA, 1913 bp, Selaginella lepidophylla; identical to SEQ ID NO: 17242
  CDS (111)..(1913)

SEQ ID NO: 24222 - protein, 600 aa, Selaginella lepidophylla; identical to SEQ ID NO: 17243

SEQ ID NO: 24223 - DNA, 4351 bp, Caenorhabditis elegans; identical to SEQ ID NO: 17244
  CDS (112)..(3996)

SEQ ID NO: 24224 - protein, 1294 aa, Caenorhabditis elegans; identical to SEQ ID NO: 17245

SEQ ID NO: 24225 - DNA, 2637 bp, Debaryomyces hansenii; identical to SEQ ID NO: 17246
  CDS (1)..(2637)

SEQ ID NO: 24226 - protein, 878 aa, Debaryomyces hansenii; identical to SEQ ID NO: 17247

SEQ ID NO: 24227 - DNA, 1443 bp, Debaryomyces hansenii; identical to SEQ ID NO: 17248
  CDS (1)..(1443)

SEQ ID NO: 24228 - protein, 480 aa, Debaryomyces hansenii; identical to SEQ ID NO: 17249

SEQ ID NO: 24229 - DNA, 2403 bp, Yarrowia lipolytica; identical to SEQ ID NO: 17250
  CDS (1)..(2403)

SEQ ID NO: 24230 - protein, 800 aa, Yarrowia lipolytica; identical to SEQ ID NO: 17251

SEQ ID NO: 24231 - DNA, 3447 bp, Kluyveromyces lactis; identical to SEQ ID NO: 17252
  CDS (1)..(3447)

SEQ ID NO: 24232 - protein, 1148 aa, Kluyveromyces lactis; identical to SEQ ID NO: 17253

SEQ ID NO: 24233 - DNA, 2631 bp, Kluyveromyces lactis; identical to SEQ ID NO: 17254
  CDS (1)..(2631)

SEQ ID NO: 24234 - protein, 876 aa, Kluyveromyces lactis; identical to SEQ ID NO: 17255

SEQ ID NO: 24235 - DNA, 1437 bp, Acinetobacter sp; identical to SEQ ID NO: 17256
  CDS (1)..(1437)

SEQ ID NO: 24236 - protein, 478 aa, Acinetobacter sp; identical to SEQ ID NO: 17257

SEQ ID NO: 24237 - DNA, 1476 bp, Candida glabrata; identical to SEQ ID NO: 17258
  CDS (1)..(1476)

SEQ ID NO: 24238 - protein, 491 aa, Candida glabrata; identical to SEQ ID NO: 17259

SEQ ID NO: 24239 - DNA, 3198 bp, Candida glabrata; identical to SEQ ID NO: 17260
  CDS (1)..(3198)

SEQ ID NO: 24240 - protein, 1065 aa, Candida glabrata; identical to SEQ ID NO: 17261

SEQ ID NO: 24241 - DNA, 3345 bp, Candida glabrata; identical to SEQ ID NO: 17262
  CDS (1)..(3345)

SEQ ID NO: 24242 - protein, 1114 aa, Candida glabrata; identical to SEQ ID NO: 17263

SEQ ID NO: 24243 - DNA, 2673 bp, Candida glabrata; identical to SEQ ID NO: 17264
  CDS (1)..(2673)

SEQ ID NO: 24244 - protein, 890 aa, Candida glabrata; identical to SEQ ID NO: 17265

SEQ ID NO: 24245 - DNA, 2013 bp, Cryptococcus neoformans var; identical to SEQ ID NO: 17266
  CDS (1)..(2013)

SEQ ID NO: 24246 - protein, 670 aa, Cryptococcus neoformans var; identical to SEQ ID NO: 17267

SEQ ID NO: 24247 - DNA, 1302 bp, Picrophilus torridus; identical to SEQ ID NO: 17268
  CDS (1)..(1302)

SEQ ID NO: 24248 - protein, 433 aa, Picrophilus torridus; identical to SEQ ID NO: 17269

SEQ ID NO: 24249 - DNA, 1482 bp, Rhodopseudomonas palustris; identical to SEQ ID NO: 17270
  CDS (1)..(1482)

SEQ ID NO: 24250 - protein, 493 aa, Rhodopseudomonas palustris; identical to SEQ ID NO: 17271

SEQ ID NO: 24251 - DNA, 1440 bp, Corynebacterium diphtheriae; identical to SEQ ID NO: 17272
  CDS (1)..(1440)

SEQ ID NO: 24252 - protein, 479 aa, Corynebacterium diphtheriae; identical to SEQ ID NO: 17273

SEQ ID NO: 24253 - DNA, 2589 bp, Oryza sativa; identical to SEQ ID NO: 17274
  CDS (1)..(2589)

SEQ ID NO: 24254 - protein, 862 aa, Oryza sativa; identical to SEQ ID NO: 17275

SEQ ID NO: 24255 - DNA, 2812 bp, Oryza sativa; identical to SEQ ID NO: 17276
  CDS (53)..(2527)

SEQ ID NO: 24256 - protein, 824 aa, Oryza sativa; identical to SEQ ID NO: 17277

SEQ ID NO: 24257 - DNA, 2208 bp, Thermoproteus tenax; identical to SEQ ID NO: 17278
  CDS (1)..(2208)

SEQ ID NO: 24258 - protein, 735 aa, Thermoproteus tenax; identical to SEQ ID NO: 17279

SEQ ID NO: 24259 - DNA, 1479 bp, Mycobacterium paratuberculosis; identical to SEQ ID NO: 17280
  CDS (1)..(1479)

SEQ ID NO: 24260 - protein, 492 aa, Mycobacterium paratuberculosis; identical to SEQ ID NO: 17281

SEQ ID NO: 24261 - DNA, 1461 bp, Geobacter sulfurreducens; identical to SEQ ID NO: 17282
  CDS (1)..(1461)

SEQ ID NO: 24262 - protein, 486 aa, Geobacter sulfurreducens; identical to SEQ ID NO: 17283

SEQ ID NO: 24263 - DNA, 3333 bp, Ashbya gossypii; identical to SEQ ID NO: 17284
  CDS (1)..(3333)

SEQ ID NO: 24264 - protein, 1110 aa, Ashbya gossypii; identical to SEQ ID NO: 17285

SEQ ID NO: 24265 - DNA, 1485 bp, Ashbya gossypii; identical to SEQ ID NO: 17286
  CDS (1)..(1485)

SEQ ID NO: 24266 - protein, 494 aa, Ashbya gossypii; identical to SEQ ID NO: 17287

SEQ ID NO: 24267 - DNA, 3498 bp, Oryza sativa; identical to SEQ ID NO: 17288
  CDS (176)..(2875)

SEQ ID NO: 24268 - protein, 899 aa, Oryza sativa; identical to SEQ ID NO: 17289

SEQ ID NO: 24269 - DNA, 3048 bp, Neurospora crassa; identical to SEQ ID NO: 17290
  CDS (1)..(3048)

SEQ ID NO: 24270 - protein, 1015 aa, Neurospora crassa; identical to SEQ ID NO: 17291

SEQ ID NO: 24271 - DNA, 1572 bp, Neurospora crassa; identical to SEQ ID NO: 17292
  CDS (1)..(1572)

SEQ ID NO: 24272 - protein, 523 aa, Neurospora crassa; identical to SEQ ID NO: 17293

SEQ ID NO: 24273 - DNA, 2730 bp, Neurospora crassa; identical to SEQ ID NO: 17294
  CDS (1)..(2730)

SEQ ID NO: 24274 - protein, 909 aa, Neurospora crassa; identical to SEQ ID NO: 17295

SEQ ID NO: 24275 - DNA, 1488 bp, Synechococcus sp; identical to SEQ ID NO: 17296
  CDS (1)..(1488)

SEQ ID NO: 24276 - protein, 495 aa, Synechococcus sp; identical to SEQ ID NO: 17297

SEQ ID NO: 24277 - DNA, 1350 bp, Thermus thermophilus; identical to SEQ ID NO: 17298
  CDS (1)..(1350)

SEQ ID NO: 24278 - protein, 449 aa, Thermus thermophilus; identical to SEQ ID NO: 17299

SEQ ID NO: 24279 - DNA, 3862 bp, Caenorhabditis elegans; identical to SEQ ID NO: 17300
  CDS (30)..(3722)

SEQ ID NO: 24280 - protein, 1230 aa, Caenorhabditis elegans; identical to SEQ ID NO: 17301

SEQ ID NO: 24281 - DNA, 1590 bp, Magnaporthe grisea; identical to SEQ ID NO: 17302
  CDS (1)..(1590)

SEQ ID NO: 24282 - protein, 529 aa, Magnaporthe grisea; identical to SEQ ID NO: 17303

SEQ ID NO: 24283 - DNA, 1485 bp, Bradyrhizobium japonicum; identical to SEQ ID NO: 17304
  CDS (1)..(1485)

SEQ ID NO: 24284 - protein, 494 aa, Bradyrhizobium japonicum; identical to SEQ ID NO: 17305

SEQ ID NO: 24285 - DNA, 1449 bp, Corynebacterium efficiens; identical to SEQ ID NO: 17306
  CDS (1)..(1449)

SEQ ID NO: 24286 - protein, 482 aa, Corynebacterium efficiens; identical to SEQ ID NO: 17307

SEQ ID NO: 24287 - DNA, 2774 bp, Arabidopsis thaliana; identical to SEQ ID NO: 17308
  CDS (102)..(2690)

SEQ ID NO: 24288 - protein, 862 aa, Arabidopsis thaliana; identical to SEQ ID NO: 17309

SEQ ID NO: 24289 - DNA, 2583 bp, Oryza sativa; identical to SEQ ID NO: 17310
  CDS (1)..(2583)

SEQ ID NO: 24290 - protein, 860 aa, Oryza sativa; identical to SEQ ID NO: 17311

SEQ ID NO: 24291 - DNA, 1458 bp, Corynebacterium glutamicum; identical to SEQ ID NO: 17312
  CDS (1)..(1458)

SEQ ID NO: 24292 - protein, 485 aa, Corynebacterium glutamicum; identical to SEQ ID NO: 17313

SEQ ID NO: 24293 - DNA, 2358 bp, Xanthomonas campestris; identical to SEQ ID NO: 17314
  CDS (1)..(2358)

SEQ ID NO: 24294 - protein, 785 aa, Xanthomonas campestris; identical to SEQ ID NO: 17315

SEQ ID NO: 24295 - DNA, 1368 bp, Xanthomonas axonopodis; identical to SEQ ID NO: 17316
  CDS (1)..(1368)

SEQ ID NO: 24296 - protein, 455 aa, Xanthomonas axonopodis; identical to SEQ ID NO: 17317

SEQ ID NO: 24297 - DNA, 2574 bp, Solanum tuberosum; identical to SEQ ID NO: 17318
  CDS (1)..(2574)

SEQ ID NO: 24298 - protein, 857 aa, Solanum tuberosum; identical to SEQ ID NO: 17319

SEQ ID NO: 24299 - DNA, 1380 bp, Encephalitozoon cuniculi; identical to SEQ ID NO: 17320
  CDS (1)..(1380)

SEQ ID NO: 24300 - protein, 459 aa, Encephalitozoon cuniculi; identical to SEQ ID NO: 17321

SEQ ID NO: 24301 - DNA, 1398 bp, Ralstonia solanacearum; identical to SEQ ID NO: 17322
  CDS (1)..(1398)

SEQ ID NO: 24302 - protein, 465 aa, Ralstonia solanacearum; identical to SEQ ID NO: 17323

SEQ ID NO: 24303 - DNA, 1674 bp, Ralstonia solanacearum; identical to SEQ ID NO: 17324
  CDS (1)..(1674)

SEQ ID NO: 24304 - protein, 557 aa, Ralstonia solanacearum; identical to SEQ ID NO: 17325

SEQ ID NO: 24305 - DNA, 2214 bp, Pyrobaculum aerophilum; identical to SEQ ID NO: 17326
  CDS (1)..(2214)

SEQ ID NO: 24306 - protein, 737 aa, Pyrobaculum aerophilum; identical to SEQ ID NO: 17327

SEQ ID NO: 24307 - DNA, 3001 bp, Arabidopsis thaliana; identical to SEQ ID NO: 17328
  CDS (204)..(2306)

SEQ ID NO: 24308 - protein, 700 aa, Arabidopsis thaliana; identical to SEQ ID NO: 17329

SEQ ID NO: 24309 - DNA, 3272 bp, Oryza sativa; identical to SEQ ID NO: 17330
  CDS (247)..(2985)

SEQ ID NO: 24310 - protein, 912 aa, Oryza sativa; identical to SEQ ID NO: 17331

SEQ ID NO: 24311 - DNA, 1681 bp, Amanita muscaria; identical to SEQ ID NO: 17332
  CDS (101)..(1552)

SEQ ID NO: 24312 - protein, 483 aa, Amanita muscaria; identical to SEQ ID NO: 17333

SEQ ID NO: 24313 - DNA, 1344 bp, Thermoplasma volcanium; identical to SEQ ID NO: 17334
  CDS (1)..(1344)

SEQ ID NO: 24314 - protein, 447 aa, Thermoplasma volcanium; identical to SEQ ID NO: 17335

SEQ ID NO: 24315 - DNA, 1563 bp, Rhizobium loti; identical to SEQ ID NO: 17336
  CDS (1)..(1563)

SEQ ID NO: 24316 - protein, 520 aa, Rhizobium loti; identical to SEQ ID NO: 17337

SEQ ID NO: 24317 - DNA, 2637 bp, Oryza sativa; identical to SEQ ID NO: 17338
  CDS (1)..(2637)

SEQ ID NO: 24318 - protein, 878 aa, Oryza sativa; identical to SEQ ID NO: 17339

SEQ ID NO: 24319 - DNA, 1326 bp, Thermoplasma acidophilum; identical to SEQ ID NO: 17340
  CDS (1)..(1326)

SEQ ID NO: 24320 - protein, 441 aa, Thermoplasma acidophilum; identical to SEQ ID NO: 17341

SEQ ID NO: 24321 - DNA, 1389 bp, Streptomyces coelicolor; identical to SEQ ID NO: 17342
  CDS (1)..(1389)

SEQ ID NO: 24322 - protein, 462 aa, Streptomyces coelicolor; identical to SEQ ID NO: 17343

SEQ ID NO: 24323 - DNA, 2635 bp, Arabidopsis thaliana; identical to SEQ ID NO: 17344
  CDS (1)..(2604)

SEQ ID NO: 24324 - protein, 867 aa, Arabidopsis thaliana; identical to SEQ ID NO: 17345

SEQ ID NO: 24325 - DNA, 2843 bp, Zygosaccharomyces rouxii; identical to SEQ ID NO: 17346
  CDS (24)..(2726)

SEQ ID NO: 24326 - protein, 900 aa, Zygosaccharomyces rouxii; identical to SEQ ID NO: 17347

SEQ ID NO: 24327 - DNA, 3197 bp, Drosophila melanogaster; identical to SEQ ID NO: 17348
  CDS (662)..(3091)

SEQ ID NO: 24328 - protein, 809 aa, Drosophila melanogaster; identical to SEQ ID NO: 17349

SEQ ID NO: 24329 - DNA, 1503 bp, Pseudomonas anguilliseptica; identical to SEQ ID NO: 17350
  CDS (1)..(1503)

SEQ ID NO: 24330 - protein, 500 aa, Pseudomonas anguilliseptica; identical to SEQ ID NO: 17351

SEQ ID NO: 24331 - DNA, 1503 bp, Synechococcus sp; identical to SEQ ID NO: 17352
  CDS (1)..(1503)

SEQ ID NO: 24332 - protein, 500 aa, Synechococcus sp; identical to SEQ ID NO: 17353

SEQ ID NO: 24333 - DNA, 1395 bp, Rhizobium sp; identical to SEQ ID NO: 17354
  CDS (1)..(1395)

SEQ ID NO: 24334 - protein, 464 aa, Rhizobium sp; identical to SEQ ID NO: 17355

SEQ ID NO: 24335 - DNA, 1437 bp, Candida albicans; identical to SEQ ID NO: 17356
  CDS (1)..(1437)

SEQ ID NO: 24336 - protein, 478 aa, Candida albicans; identical to SEQ ID NO: 17357

SEQ ID NO: 24337 - DNA, 1515 bp, Emericella nidulans; identical to SEQ ID NO: 17358
  CDS (1)..(1515)

SEQ ID NO: 24338 - protein, 504 aa, Emericella nidulans; identical to SEQ ID NO: 17359

SEQ ID NO: 24339 - DNA, 2695 bp, Pichia angusta; identical to SEQ ID NO: 17360
  CDS (793)..(2220)

SEQ ID NO: 24340 - protein, 475 aa, Pichia angusta; identical to SEQ ID NO: 17361

SEQ ID NO: 24341 - DNA, 1542 bp, Schizosaccharomyces pombe; identical to SEQ ID NO: 17362
  CDS (1)..(1542)

SEQ ID NO: 24342 - protein, 513 aa, Schizosaccharomyces pombe; identical to SEQ ID NO: 17363

SEQ ID NO: 24343 - DNA, 1520 bp, Yarrowia lipolytica; identical to SEQ ID NO: 17364
  CDS (27)..(1436)

SEQ ID NO: 24344 - protein, 469 aa, Yarrowia lipolytica; identical to SEQ ID NO: 17365

SEQ ID NO: 24345 - DNA, 1645 bp, Zygosaccharomyces rouxii; identical to SEQ ID NO: 17366
  CDS (77)..(1534)

SEQ ID NO: 24346 - protein, 485 aa, Zygosaccharomyces rouxii; identical to SEQ ID NO: 17367

SEQ ID NO: 24347 - DNA, 3069 bp, Saccharomyces cerevisiae; identical to SEQ ID NO: 17368
  CDS (1)..(3069)

SEQ ID NO: 24348 - protein, 1022 aa, Saccharomyces cerevisiae; identical to SEQ ID NO: 17369

SEQ ID NO: 24349 - DNA, 1554 bp, Aspergillus niger; identical to SEQ ID NO: 17370
  CDS (1)..(1554)

SEQ ID NO: 24350 - protein, 517 aa, Aspergillus niger; identical to SEQ ID NO: 17371

SEQ ID NO: 24351 - DNA, 25 bp, Primer
atgagtcgtttagtcgtagtatcta

SEQ ID NO: 24352 - DNA, 24 bp, Primer
ttacgcaagctttggaaaggtagc

SEQ ID NO: 24353 - DNA, 1923 bp, Escherichia coli K12
  CDS (777)..(1748)
gatcccgactctcatgagttacgttccggactggctacaatggctgagttatctgttgtggcctctggctgtcatctctgtgctgttagtgtttggctatttcttctccacgattgctaactggattgccgctccgtttaacggtttattggctgaacaactggaagcacgattgactggcgctacaccgccagataccgggattttcggtatcatgaaagatgtgccgcgaatcatgaaacgcgaatggcaaaaatttgcctggtatctgccgcgcgcaattgtattactaattctttacttcatccctggtattgggcaaaccgtcgcgccggtactgtggttcctgtttagcgcctggatgttagccatccagtattgcgattaccccttcgataaccacaaagtgccgtttaaagagatgcgcaccgccctgcgcacacgcaaaatcaccaatatgcagtttggtgctttaaccagcctgtttacgatgatcccgctgcttaatctgttcatcatgcccgttgccgtttgtggcgcgacggcgatgtgggtcgattgctatcgcgataaacacgcgatgtggcggtaacaatctaccggttattttgtaaaccgtttgtgtgaaacaggggtggcttatgccgccccttattccatcttgcatgtcattatttcccttctgtatatagatatgctaaatccttacttccgcatattctctgagcgggtatgctacctgttgtatcccaatttcatacagttaaggacaggccatgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccgaccagcggtaataccgggattgcactggcctatgtagctgccgctcgcggttacaaactcaccctgaccatgccagaaaccatgagtattgaacgccgcaagctgctgaaagcgttaggtgcaaacctggtgctgacggaaggtgctaaaggcatgaaaggcgcaatccaaaaagcagaagaaattgtcgccagcaatccagagaaatacctgctgctgcaacaattcagcaatccggcaaaccctgaaattcacgaaaagaccaccggtccggagatatgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggcccgcataaaattcagggtattggcgctggttttatcccggctaacctcgatctcaagctggtcgataaagtcattggcatcaccaatgaagaagcgatttctaccgcgcgtcgtctgatggaagaagaaggtattcttgcaggtatctcttctggagcagctgttgccgcggcgttgaaactacaagaagatgaaagctttaccaacaagaatattgtggttattctaccatcatcgggtgagcgttatttaagcaccgcattgtttgccgatctcttcactgagaaagaattgcaacagtaatgccagcttgttaaaaatgcgtaaaaaagcacctttttaggtgcttttttgtggcctgcttcaaactttcgcccctcctggcattgattcagcctgtcggaactggtatttaaccagactaattattttgatgcgcgaaattaatcgttacaggaaaagccaaagctgaatcgat

SEQ ID NO: 24354 - protein, 323 aa, Escherichia coli K12
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 24355 - DNA, 1313 bp, Capsicum annuum (pepper)
  CDS (2)..(1126)
aatggcatctatcatcaacaatcccttcacttctctctgctgcaacaccaacaaatgtgaacctaatagaatttgctctttaaggtctcagcagtcattggtgtttgacaacgtcaacagaaaagttggtttcccttctgttgtttgcaaagcagtgtctgtgcaaacgaaatcacctacagaaattgaaggccttaacattgctgaagatgttacacagcttattgggaacacaccaatggtttaccttaacaccattgttaagggttgtgttgcaaatattgctgctaaacttgagattatggagccatgttgcagtgttaaggacaggatagggttcagtatgatatctgatgctgaggagaagggacttatatctccagggaagactgttctagttgagcctacgagtggaaacacaggcattggtcttgccttcattgctgcttccagaggatataagctcatcttaacgatgcctgcctcaatgagtcttgaaagaagggttattctaaaagcttttggagctgaacttgttttaactgacccagccaaagggatgaaaggagctgtttcaaaggctgaagaaatattgaataacacaccagatgcctatatccttcaacaatttgacaatcccgccaaccccaagatacactatgaaacaacgggtccagaaatctgggaagacacaaaaggcaaaatcgacatacttgttgctggcattggaactggcggaaccatttctggaacgggccgataccttaaagagaaaaatccaaacattaagattattggtgtggagcccacagaaagtaacgttctatcagggggcaagcctggttttattccaggaaacttggatcaagatgtcatggatgaagtgatagagatatcaagtgacgaagctgttgaaactgcaaagcaattagccctacaagaagggttgttggttgggatttcttcgggggcagctgctcttgctgccattcaggttgcgaagaggcctgagaatgcagggaaacttattgcggttgtatttccaagttttggggaacggtacctctcctctatacttttccagtcaatacgagaggaatgcgagaaaatgaagccagaattgtgaagatcttcctttgtcgagctatcttctgattcctaataatgttatttgccttttctagctgccacacttttgtttgttatttagttggctgctggtgtatacaatagatcaggtattaagatgattctcataacaaagcttaaacaacctcattgatttggtttgacggttttttgtttgtgaattg

SEQ ID NO: 24356 - protein, 374 aa, Capsicum annuum (pepper)
MASIINNPFTSLCCNTNKCEPNRICSLRSQQSLVFDNVNRKVGFPSVVCKAVSVQTKSPTEIEGLNIAEDVTQLIGNTPMVYLNTIVKGCVANIAAKLEIMEPCCSVKDRIGFSMISDAEEKGLISPGKTVLVEPTSGNTGIGLAFIAASRGYKLILTMPASMSLERRVILKAFGAELVLTDPAKGMKGAVSKAEEILNNTPDAYILQQFDNPANPKIHYETTGPEIWEDTKGKIDILVAGIGTGGTISGTGRYLKEKNPNIKIIGVEPTESNVLSGGKPGFIPGNLDQDVMDEVIEISSDEAVETAKQLALQEGLLVGISSGAAALAAIQVAKRPENAGKLIAVVFPSFGERYLSSILFQSIREECEKMKPEL

SEQ ID NO: 24357 - DNA, 1468 bp, Spinacia oleracea (spinach)
  CDS (167)..(1273)
cggatcctcgccctggccttcaaaaccttcactttccacccaccaaccatatatatacttctatataacaaacattaacagactcatataaaacacattgttattgctatttgttctgctcaaaattgtagatttgtagatttgtagttggtaaactgaagaaatcatggcaactgtgtcaagctgtttgctgaggagatcaagaacagcctcacggatctttaaaacatcactcagatgtttctccaccacttcttcttctgcacaaactgtttctggttcatctccctttccttttactgggactaatattaaaaccaatgtttcccaacttattgggagaactcccctagtttatctaagcaaaattagtgaaggatctggagcttacatagccgtcaagcaagagatgatgcagcctactgctagtgttaaagatagacctgcattggctatgattgaagatgcagagaaaaagggattaatttctccaggaaagacggtgttgatcgagccaacatcaggaaacatgggaataagcatggcgttcatggcggctatgaagggatacaaaatggtattgacaatgccatcatacacaagcatggaaagaagggtagtaatgagggcttttggtgctgatcttattctcactgaccctgacaaaggaatggggggaactgtcaaaaaggctaaccagcttttagactccacccctgatggtttcatgcttcaacaatttaataatcctgctaatactcaggttcattttgagacgacaggtcctgaaatatgggaggatactcaagggaaagtggacatctttgtcatgggaatcggaagtggaggcactgtttctggtgttggacgctatctcaaatctcaaaatcctaatgtgaagatctatggagttgaaccagctgaaagcaacatactcaatggaggcaaaccaggtcctcaccttataactggaaacggggttgggtttaaaccagagattttagacatggatgtaatggatgcagttctcgaggttaaaagtgacgatgctgttaagatggccaggcagttggcattacaggaaggacttttggttgggatatcatcaggggctaatacaattgctgcccttgatcttgctaagaggccagaaaacaagggcaaactaattgtgacgattcacccgagttttggagagcgatatctgtcgtctgccttgttcaaggagctgagggaagaggctgaaaacatgcaaccagtccctgttgaatgattccagcatcttatagctccagatatgctaaataaaggatctgttactgttttgtcactactactagtatatgacagtaactacatgatatctctttgagaaaaattgtaaaattgcaagtcaattgtgtattaattttcaatgaaattgttagggatgaaaattatttatcaatgaagtaattgtaattctttt

SEQ ID NO: 24358 - protein, 368 aa, Spinacia oleracea (spinach)
MATVSSCLLRRSRTASRIFKTSLRCFSTTSSSAQTVSGSSPFPFTGTNIKTNVSQLIGRTPLVYLSKISEGSGAYIAVKQEMMQPTASVKDRPALAMIEDAEKKGLISPGKTVLIEPTSGNMGISMAFMAAMKGYKMVLTMPSYTSMERRVVMRAFGADLILTDPDKGMGGTVKKANQLLDSTPDGFMLQQFNNPANTQVHFETTGPEIWEDTQGKVDIFVMGIGSGGTVSGVGRYLKSQNPNVKIYGVEPAESNILNGGKPGPHLITGNGVGFKPEILDMDVMDAVLEVKSDDAVKMARQLALQEGLLVGISSGANTIAALDLAKRPENKGKLIVTIHPSFGERYLSSALFKELREEAENMQPVPVE

SEQ ID NO: 24359 - DNA, 1656 bp, Homo sapiens (man)
  CDS (1)..(1656)
atgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtga

SEQ ID NO: 24360 - protein, 551 aa, Homo sapiens (man)
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 24361 - DNA, 984 bp, Aquifex aeolicus
  CDS (1)..(984)
atgtcgttaaaatcatgtttaatgtgggttttgggtgaacacgacgagccttacagaaaagcgcgtgaaacaatactaaaactcgtaggaaacacacccctcgtaagagtaaaaaagtgtcttccagaagatatacccgaggacgtagaaatctgggcaaagttagagagtttcaatcccggcggttcggtaaaggacagacctgctctcagtatgtttctggacgccttaaaaagggggcttattaaagagggaaaagttgtaatagacgcaacttccggaaatacgggaatagccctcgccatggttggtgcagctctcggcgttcccgtggaacttgccatgccagcaaacgtaagtgaagagaggaagaagataataaaagccttcggagcgaaactttaccttaccgatccccttgagggtaccgatggagctatcctctttgtaagggaacttgttcagaagtaccctgaaaagtacgtgtacctcgaccaatacaacaatccagcaaactggaaagctcacttttactctaccggtatagagatatggaatcaaactaaggggaggataactcacttcgtcgcagggataggaacaggcggaacgataatgggaacgggaaggagactaaagatttacaacccgaatattcaagtaataggagtccagcctgcgtatccttttcacggaatagaaggtttaaaacacatagagagttcaataaagccgggaatatttgacgagacctttctggacaggactatcttcgtagagacggaagacgcctactactgggcaagggagcttgcaaaaaaggacgctatattcgtaggacagtcatcgggagcggctctctgggcatgcattcaactcgcaagggaacttgcgaaaaaaggtgaaaagggcgtaatagttaccgtttttccggacggaggggagaagtacctcaccacggctcttttctctgacaaggattaa

SEQ ID NO: 24362 - protein, 327 aa, Aquifex aeolicus
MSLKSCLMWVLGEHDEPYRKARETILKLVGNTPLVRVKKCLPEDIPEDVEIWAKLESFNPGGSVKDRPALSMFLDALKRGLIKEGKVVIDATSGNTGIALAMVGAALGVPVELAMPANVSEERKKIIKAFGAKLYLTDPLEGTDGAILFVRELVQKYPEKYVYLDQYNNPANWKAHFYSTGIEIWNQTKGRITHFVAGIGTGGTIMGTGRRLKIYNPNIQVIGVQPAYPFHGIEGLKHIESSIKPGIFDETFLDRTIFVETEDAYYWARELAKKDAIFVGQSSGAALWACIQLARELAKKGEKGVIVTVFPDGGEKYLTTALFSDKD

SEQ ID NO: 24363 - DNA, 954 bp, Deinococcus radiodurans
  CDS (1)..(954)
atgatcgagtctttcatcggccacacgcccctggtgcagttgcggcgggtggtcacgcctgacatggccgacgtgtttatcaaactggagggtcagaaccccggcggcagcatcaaggaccgcaccgcgctgggactggtgcaagacgccgagcgccggggcgtcctcaaacccggcgggaccatcgtggagcccaccagcggcaacaccggcatcgggctggcgcaggtggcggcggcgaagggctacaaactcatcctgtgcatgcccgcccagatgagcgaggagcgcaagcgcacgctgagggcctacggcgccgagctgattctcaccgaccccgagcgccggatgctcgccgccatcgaggaagccgagaagattgccgccgaaacgggcgcggtgatgatgaaccagttcgccaaccccgccaaccccgccacccacgaggcgagcaccggccccgagctgtgggagcagatggaaggacgcgtggacgctttcgtgtacggcaccggcaccggcggaaccatcacaggcaccgggcgttacctcaagcggcaggacccgaacattcaggtcatcgcctgcgagcccgcccgctccaacgtcctttcgggcggcgagcgtggcaaccacgggtttcaggggatggggccgggcttcattcccgacaacctcgaccgcagcctgctcgacgacgtgattcaggtctgggaggaagacgcctacccccttgcccgccgactggcgcaggaagaaggcatcttcatcggcatgagcagcggcgcgatggtctggaccgcactcgaagtcgcccggcgcctcggccccggcaagcgcgtggtcaccatcgcctgcgacaccggggcgcgctacttgaccacggcgctcttttccggcgagggcgacaccccggcgggttatctgccgtattcgcgtgagcgggtggagtga

SEQ ID NO: 24364 - protein, 317 aa, Deinococcus radiodurans
MIESFIGHTPLVQLRRVVTPDMADVFIKLEGQNPGGSIKDRTALGLVQDAERRGVLKPGGTIVEPTSGNTGIGLAQVAAAKGYKLILCMPAQMSEERKRTLRAYGAELILTDPERRMLAAIEEAEKIAAETGAVMMNQFANPANPATHEASTGPELWEQMEGRVDAFVYGTGTGGTITGTGRYLKRQDPNIQVIACEPARSNVLSGGERGNHGFQGMGPGFIPDNLDRSLLDDVIQVWEEDAYPLARRLAQEEGIFIGMSSGAMVWTALEVARRLGPGKRVVTIACDTGARYLTTALFSGEGDTPAGYLPYSRERVE

SEQ ID NO: 24365 - DNA, 1149 bp, Pseudomonas aeruginosa
  CDS (250)..(1149)
tcgccgcggccaacgtgctttcaccggcaggcgcaacgcctgtcggacctttctttggcgttggtcaggcatcggctgtccaacgccaggttttctcttcggacgcctctggtcatcgcatcgcatgccgtttcgggcggtctttcggctgaatcggcatgcatgaccggatattgcggtgctagggtccggccccagtttcccggtatcatgctcagcctttaccgtcagtgccgaacgagtgcctccatgaccgtgcagtacccgactatcgccgactgcgttggcaatacccctctggtgcgtctgcagcgccttcccggggaaacctccaataccctgctggtgaagctcgaaggcaacaacccggcgggatcggtgaaggaccgcccggccctgtcgatgatcacccgtgccgaactgcgcggcgacatccgccccggcgatacgctgatcgaggctacttccggcaacaccggcatcgccctggccatggcggcggcgatcaagggttacaagatgatcctgatcatgccggacaactccacggccgaacgcaaggcggcgatgaccgcctatggcgccgagctcattctggtcagcaaggaagagggcatggagggcgcgcgcgatctggccgacaagctgcagcgcgaaggccgcggcaaggtcctcgaccagttcgccaatggcgacaacccggaagcccattaccacagcaccggcccggaaatctggcagcagaccggcggcagcatcacccatttcgtcagctccatgggcaccaccgggaccatcatgggcgtctcgcgctacctcaaggagcagaacccggcggtgcagatcgtcggcctgcaacccatggagggctcggccatcccgggaatccgacgctggccgcaggaatacctgccgaagatctatgacgccagtcgcgtcgaccgggtcgtcgacatgcaccaggacgaagccgaggacatcatgcgccggctggcccgcgaggaaggcatcttctgcggcgtgtcctccggtggggcggtggcggcgatgctgcgcctgtcccgcgaactggagaatgccgtgctggtggcgatcatctgcgaccgcggcgaccgctacctgtcttccggcgtctatgacccgcgctga

SEQ ID NO: 24366 - protein, 299 aa, Pseudomonas aeruginosa
MTVQYPTIADCVGNTPLVRLQRLPGETSNTLLVKLEGNNPAGSVKDRPALSMITRAELRGDIRPGDTLIEATSGNTGIALAMAAAIKGYKMILIMPDNSTAERKAAMTAYGAELILVSKEEGMEGARDLADKLQREGRGKVLDQFANGDNPEAHYHSTGPEIWQQTGGSITHFVSSMGTTGTIMGVSRYLKEQNPAVQIVGLQPMEGSAIPGIRRWPQEYLPKIYDASRVDRVVDMHQDEAEDIMRRLAREEGIFCGVSSGGAVAAMLRLSRELENAVLVAIICDRGDRYLSSGVYDPR

SEQ ID NO: 24367 - DNA, 1210 bp, Arabidopsis thaliana (mouse-ear cress)
  CDS (1)..(1179)
atggcggcgacatcttcctctgcttttctccttaatccgttgacttctcgccaccgtcctttcaaatactcgccagagctctcttctctctccttatcctctcgaaaggctgctgctttcgatgtttcctcagctgctttcacgctcaagagacagagccggagtgatgttgtgtgcaaggctgtatctatcaagccagaagctggtgttgaagggctcaatatcgccgataacgccgctcagcttattgggaaaactccgatggtgtacttgaacaatgtagtcaagggctgtgttgcaagtgttgctgctaagcttgagatcatggaaccatgttgcagtgtcaaggataggattgggtacagtatgattactgatgctgaagagaaaggacttataacacctggaaagagtgttcttgtggaatctacgagtgggaacacagggattggccttgcattcattgctgcttcaaaaggctataaacttatcttgacgatgcctgcgtccatgagtttggaaaggcgggttcttttgagggcatttggagctgagcttgtgttaactgaacctgcaaaaggtatgactggagcaattcagaaggctgaagaaatcttgaaaaaaactcccaattcctacatgctccaacagtttgacaaccctgccaatcccaagattcattatgagacgactggtcctgagatttgggaagatacaagaggcaaaatcgatatattggttgcggggattggaactggtggaactatcactggtgttggtcgattcattaaagaaagaaaacctgaattgaaggttattggtgtcgaacccacggaaagtgctatactttctggtggaaaacccggacctcacaagattcaaggaattggagctggatttgtacccaagaatttggatctggctattgtagatgaatacatagcgatttccagtgaggaagctattgaaacctcgaagcaactagctctccaggaaggcttgttggttggtatatcttctggagctgctgctgctgctgcaatccaggttgcaaagagacctgaaaatgccgggaaactcatagccgttgtgttcccgagcttcggggaacgttacctctcgacccagcttttccagtcgattcgagaagagtgcgagcaaatgcagcccgagctttgattttcttctgtaatttcgtgaccaacaagga

SEQ ID NO: 24368 - protein, 392 aa, Arabidopsis thaliana (mouse-ear cress)
MAATSSSAFLLNPLTSRHRPFKYSPELSSLSLSSRKAAAFDVSSAAFTLKRQSRSDVVCKAVSIKPEAGVEGLNIADNAAQLIGKTPMVYLNNVVKGCVASVAAKLEIMEPCCSVKDRIGYSMITDAEEKGLITPGKSVLVESTSGNTGIGLAFIAASKGYKLILTMPASMSLERRVLLRAFGAELVLTEPAKGMTGAIQKAEEILKKTPNSYMLQQFDNPANPKIHYETTGPEIWEDTRGKIDILVAGIGTGGTITGVGRFIKERKPELKVIGVEPTESAILSGGKPGPHKIQGIGAGFVPKNLDLAIVDEYIAISSEEAIETSKQLALQEGLLVGISSGAAAAAAIQVAKRPENAGKLIAVVFPSFGERYLSTQLFQSIREECEQMQPEL

SEQ ID NO: 24369 - DNA, 960 bp, Nostoc sp. PCC 7120
  CDS (1)..(960)
atgcgaattgctaatgatgtaacagaacttattggaggtacacctttagttaagcttaataagattccgcaagcggaaggagtagttgccagaatagttgtcaaactagaaggaatgaatccagcctcttccgtaaaagaccggattggggtgagtatgattaacgcagcagaagcggaaggtttaatcataccgggaaaaactattttagtagaaccaacttccggtaacacaggaattgccctggcgatggtagccgccgcccgtggctatcggttaattttgactatgccagagactatgagccaagaaagacgggctatgttgcgggcttatggtgcaactctagagttgactccaggtacagaaggtatgcggggagccattcgcaaagccgaagaaattgtggctagtacccctgatactcatatgctgcaacagtttcgcaacccagctaaccccaaaatccaccgtgaaactaccgccgaagaaatttggaatgataccgatggtgaagttgatattgtgattgctggggtgggtactggaggaacaattactgggattgcagaggtattgaaacaacgcaaacctagctttcaggcgatcgcagttgaacctagcaatagtcctatcctttccggtggacaagccgggccacacaaaatccaaggtatcggtgcaggctttgttcccgatgtcctccgtctagaattggtggatgaagtcatcagagttagcgatgatcaagcgatgagctacgggcggcgtttagccagagaagaaggtttgctatctggtatttcctctggtgcggctttgtgtgcagctttacaggtggggaaacgtccagaaaatgccggcaagttaattgtgatgattcaaccttccttcggcgaacgctacctcagcacccctttgtttcaggatttgacgaatgaaactgctggtgtcagttag

SEQ ID NO: 24370 - protein, 319 aa, Nostoc sp. PCC 7120
MRIANDVTELIGGTPLVKLNKIPQAEGVVARIVVKLEGMNPASSVKDRIGVSMINAAEAEGLIIPGKTILVEPTSGNTGIALAMVAAARGYRLILTMPETMSQERRAMLRAYGATLELTPGTEGMRGAIRKAEEIVASTPDTHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMIQPSFGERYLSTPLFQDLTNETAGVS

SEQ ID NO: 24371 - DNA, 972 bp, Salmonella enterica subsp. enterica serovar Typhi
  CDS (1)..(972)
atgagtaagatttatgaagataactcgctgactatcggtcatacgccgctggttcgactgaaccgtatcggtaatggacgcattctggcaaaggtggagtcgcgcaacccgagcttcagcgtcaagtgccgtatcggcgccaacatgatttgggatgccgaaaagcgtggcgtactgaaacctggcgtggaactggtggagccgaccagcggcaacaccggtattgcgctggcgtatgtcgccgccgcgcgcggttacaaactcaccctgaccatgccggaaaccatgagcattgaacgccgcaagctactcaaagcattaggcgcgaatctggtgctgaccgaaggggcgaaagggatgaaaggcgctattcagaaagccgaagaaattgtcgccagcgatccgcaaaaatatctcctgctccagcagttcagcaaccctgccaacccggaaatccatgaaaaaaccaccggcccggaaatctgggaagacaccgatggtcaggtggatgtgtttatctccggcgtcggcactggcggtacgttaaccggcgtcacgcgttatatcaaagggacgaagggtaaaaccgatcttatcaccgttgcggtagaacccactgactccccggttattgcccaggcgctggctggtgaagagatcaaaccaggcccgcataaaattcagggtatcggcgcaggcttcatcccgggcaacctggatctgaaactgattgataaagtggttggcatcaccaatgaagaagctatttctaccgcgcgccgtctgatggaagaggaaggtattctggcaggaatttcttccggcgccgcggttgctgcagcgcttaagctgcaggaagatgaaagctttaccaataagaatattgtggttatcctaccttcatcaggtgagcgttatctgagcaccgcgttgttcgccgatctctttactgagaaagaactgcaacagtga

SEQ ID NO: 24372 - protein, 323 aa, Salmonella enterica subsp. enterica serovar Typhi
MSKIYEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 24373 - DNA, 1029 bp, Brucella melitensis
  CDS (1)..(1029)
atgttcaattcggtactcgacacaatcggcaacacgccgttgatccgcctcagcaaggcttccgagctcacaggatgcgatatttacgggaaagcagagtttctcaatccgggccagtcggtcaaggaccgtgcggcgctctacattatccgcgatgcggaaaaacgcgggcttttgcggcccggaggcgtgattgtggaaggaaccgcgggcaataccggcattggcctcacgatggtcgccaaggcattgggctaccgcacggcgatcgtgattcctgaaacgcagagccaggaaaaaaaggaagtcttgcgcctgctcggtgcagagctgatcgaggttcccgccgccccctatcgcaacccgaacaattatgtgcgcctttcagggcgtcttgccgagcaactggccaaaaccgagccgaatggcgcaatatgggccaatcagttcgacaatacggtcaaccggcaagcccatatcgagaccacggcgcaggaaatctggcgcgatacaagcgaccagatcgatggttttgtggccgctgtgggatctggcggtacgcttgccggaacggcgattggcctgaaggaacggaaccacaatatcaaaattgctctggcggacccgcatggcgcggcgcttcacgccttctatacgaccggcgaattgaaggcagaaggcgattcgatcaccgaaggcatcgggcaggggcgcatcaccgccaatcttgaaggcttcacccctgatttttcctaccagattcccgatgcggaggcgctcgatatcctgtttgccctcgtggaagaggaggggctttgcctcggcggctcgtccggcatcaacattgccggtgcaatccggcttgcaaaagatctcgggccgggccacacaattgtgaccgtgctttgtgactacggtaatcgttaccagtcaaagctgttcaatcccgccttcctccgcggcaagagcctgcccgtgccgcgctggctggagaagaaaaccgaaatagacataccgttcgaggggtaa

SEQ ID NO: 24374 - protein, 342 aa, Brucella melitensis
MFNSVLDTIGNTPLIRLSKASELTGCDIYGKAEFLNPGQSVKDRAALYIIRDAEKRGLLRPGGVIVEGTAGNTGIGLTMVAKALGYRTAIVIPETQSQEKKEVLRLLGAELIEVPAAPYRNPNNYVRLSGRLAEQLAKTEPNGAIWANQFDNTVNRQAHIETTAQEIWRDTSDQIDGFVAAVGSGGTLAGTAIGLKERNHNIKIALADPHGAALHAFYTTGELKAEGDSITEGIGQGRITANLEGFTPDFSYQIPDAEALDILFALVEEEGLCLGGSSGINIAGAIRLAKDLGPGHTIVTVLCDYGNRYQSKLFNPAFLRGKSLPVPRWLEKKTEIDIPFEG

SEQ ID NO: 24375 - DNA, 927 bp, Listeria innocua
  CDS (1)..(927)
atgacaattgtaaattcgatcactgatttaattggaaagacacctattgtgaaacttaatcgtttaccagaagcaggtagcgccgacgtatatgtgaaattagaattccaaaatccgggtggtagcgtaaaagatcgtattgctaatgcgatgatcgaaagcgctgaaaaatcaggtgcattaaaaccaggagatacaattatcgaaccaactagtggtaacactggtatcggactagcaatggtagcagcggcaaaaggttaccaagcaatcttcgtaatgccagaaacaatgagtatagaacgtcgtaaattacttcaagcttatggtgcgaaattagtgttaactccagggccagatggcatgaaaggcgcaattgctaaagcagaagagcttgcaaaagaaaataattatttcgttcctcaacaattccacaatccagcaaacccagctgtccatgaagaaacaactggaccagaaatcgttgaagctttcggtaaagacggcttagatgctttcattgcaggagtaggaacaggcggaacagtaactggtgtaggacacgtacttaaaaagaactacccagatgttaaaatctatgctcttgaaccagaagaatccccagtacttagcggtggttctccatcgcctcataaaatccaaggtatcggagctggttttgtaccagatacattagatacaaaagtttatgatggcattttgaaagtttcgagtgaagatgcgcttgaaacagcacgcgaagtagcgaaaaaagaaggtatcttagtaggtatttcttccggagcaactattaaagccgctctagaccttgcaaaagaacttggtgctggtaaaaaagtgctcgcaatcgttgcaagtaacggcgaacgctacttaagtacaccgctttataattttgaagattag

SEQ ID NO: 24376 - protein, 308 aa, Listeria innocua
MTIVNSITDLIGKTPIVKLNRLPEAGSADVYVKLEFQNPGGSVKDRIANAMIESAEKSGALKPGDTIIEPTSGNTGIGLAMVAAAKGYQAIFVMPETMSIERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 24377 - DNA, 975 bp, Nostoc sp. PCC 7120
  CDS (1)..(975)
atggatatcaaaaatggctttataggaactgttggcaacacaccactaattcgtttaaacagttttagtgaagaaacaggatgtgaaattctcgctaaagcagaatttctcaatcctggtggttcagtcaaagaccgcgccgcactttacatcatccaagatgcagaagaaaaaggactcctcaaagcaggcggaactgttgtagaaggaactgctggtaatactggcattggattagcgcatatttgcaatgccaaaggctacaaatgcctgataattattcctaacacccaatcacaggaaaagattgatgcactcacagctttgggtgcagaagtccgtcccgttcctgctgtaccttacaaagacccaaacaattacgtcaaactatctgggagaattgctgcggagttagacaacgcaatttgggcaaatcagtttgataatttagctaaccgccgcgctcattacgagactaccggcccagaaatctggacacaaaccgatggtaaagttgatgcttgggtagcttccactggtactggtggcacatttgccggtgtagccatgtatctgaaaaaccaaaatcccgccattaaatgcgtagtagctgacccactaggtagcggactatatagttacatcaaaactggtgacatcaagatagaaggaaattctatcaccgaaggtattggtaacagccgcgtcacagctaatatggaaggcgcaccaactgatgatgccatccaaatagatgaccatgaagctttgcgggtagtttaccaactgttgcggaaagatggtttattcatgggtggttcgacaggtattaatgttgccggtgctgtagctttggcgaagcaattggggcctggtcacaggattgtcaccatattatgtgatagtggttcccgctaccaatcgcgtatattcaaccgtgattggcttgcatccaaaggactaacggtagattag

SEQ ID NO: 24378 - protein, 324 aa, Nostoc sp. PCC 7120
MDIKNGFIGTVGNTPLIRLNSFSEETGCEILAKAEFLNPGGSVKDRAALYIIQDAEEKGLLKAGGTVVEGTAGNTGIGLAHICNAKGYKCLIIIPNTQSQEKIDALTALGAEVRPVPAVPYKDPNNYVKLSGRIAAELDNAIWANQFDNLANRRAHYETTGPEIWTQTDGKVDAWVASTGTGGTFAGVAMYLKNQNPAIKCVVADPLGSGLYSYIKTGDIKIEGNSITEGIGNSRVTANMEGAPTDDAIQIDDHEALRVVYQLLRKDGLFMGGSTGINVAGAVALAKQLGPGHRIVTILCDSGSRYQSRIFNRDWLASKGLTVD

SEQ ID NO: 24379 - DNA, 963 bp, Nostoc sp. PCC 7120
  CDS (1)..(963)
atgcgggttgctcgtaacattacagaacttgttggtcgtacacctttagtacagctaaatcgtattccccaagaggaaggatgtgtagctcagattcttgtgaagatggaaagtatgaacccatcatcatcagtgaaagaccgaattggggtgagtatgattaatgcagctgaacaggaggggttgattgctcctgggaagactgtattagtagaacccacatcgggaaatacagggattgctttagcaatggcagcagcagccaagggttatcgcttaattttaacgatgccagaaaccatgagtggtgagcgtcgggctatgttgcgggcttatggagcggagttagaattgacaccgggaatggagggaatgagtggagcgattcgccgggcgcaggagatagtgaatactacccctcatgcttatatgttgcagcagttccgcaacccagcgaacgtgaaaatacatcgagagactaccgccgaggaaatctgggaagataccgatggtcaggtagatatgattgtcgcaggggtaggtacaggtggtacgatcacaggtgtagcggaagtgctgaaagcccgtaaaccaagttttcaggcgatcgcagttgagcctgccaatagtccagttttatctggaggtaaaccaggcccccataaaattcagggaattggtgcgggattcgttccccaagttctaaaaacacaattgattgatgaagtgattacggtcacagatgaagaagcgatcgcttacggtcggcgtttagctagagaagaagggctactatctgggatttccagtggtgctgctttgtttgctgccattcgcgtagctcaacgtccagaaaacgccggacgcttaattgtattgattcagcctagttttggagaaaggtatcttagtacaccattgttccaagacctagaaacaaaggcaacagctagcattagctaa

SEQ ID NO: 24380 - protein, 320 aa, Nostoc sp. PCC 7120
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALFAAIRVAQRPENAGRLIVLIQPSFGERYLSTPLFQDLETKATASIS

SEQ ID NO: 24381 - DNA, 1011 bp, Brucella melitensis
  CDS (1)..(1011)
atgcgcgacagcaacggagaatatgccatgaacaagccccttggctccaaagacgccgaagccgcaggtcgcggacgcatttatgattccattctcgatacgatcggcaatacgccgcttgtgcgtatcgacaagtttgccagggaaaacggtgtgaaggccaatcttctggtaaagcttgaattcttcaatccgctggcaagcgtgaaggatcgtatcgggcttgccatgatcgaggctttggaaaagcagggcaaggctgtccccggcaagaccgttttcgtggagccgacctccggcaataccggcatcgcgctggcctttgccgcagccgccaaaggctatcgcctcattctcaccatgccggaaaccatgtccatggagcgccgcaagctcctgaggctgcttggcgcggaactggtgctgaccgaaggcgcgaaaggcatgaaaggtgcgattgcggaagccgaagccattgccgaaggcaaccccaatgccatcatcccgcaacagtttgaaaaccccgccaacccggaaatccatcgcctcacgacggccgaggaaatctggaacgataccaatggcgaagctgatatcctgatctccggtatcggcaccggcggcacgatcacaggcgtcggtcaggtcatcaaggcgcgcaagccatccttcaaggtcgtcgctgtcgaaccgaaggactcacctgttctttccggcggcgcgcccggcccgcacaagattcaagggcttggtgcgggctttgcaccaaagacgcttgataccggcatttatgacgaaatcgtgcagatttccaacgaagatgctttcaccaatgcccgtctggttgcacggcttgagggcattcccgttggcatctcgtcgggcgctgctcttgcggctgcgatcgaagtcggcaagcgctcggaaaatgcaggcaagaatatcgtggtggtgatcccgtcctttgccgaacggtacctctcgaccgcgctgttcgaggggctggaataa

SEQ ID NO: 24382 - protein, 336 aa, Brucella melitensis
MRDSNGEYAMNKPLGSKDAEAAGRGRIYDSILDTIGNTPLVRIDKFARENGVKANLLVKLEFFNPLASVKDRIGLAMIEALEKQGKAVPGKTVFVEPTSGNTGIALAFAAAAKGYRLILTMPETMSMERRKLLRLLGAELVLTEGAKGMKGAIAEAEAIAEGNPNAIIPQQFENPANPEIHRLTTAEEIWNDTNGEADILISGIGTGGTITGVGQVIKARKPSFKVVAVEPKDSPVLSGGAPGPHKIQGLGAGFAPKTLDTGIYDEIVQISNEDAFTNARLVARLEGIPVGISSGAALAAAIEVGKRSENAGKNIVVVIPSFAERYLSTALFEGLE

SEQ ID NO: 24383 - DNA, 969 bp, Yersinia pestis
  CDS (1)..(969)
atgagcaagatatatgaagacaactctttaacaatcggccatacgccgctggttcgtctgaaccgtatcggcaacggacgtattttggcgaaagttgaatcgcgtaacccaagtttcagtgtgaagtgccgtatcggcgccaacatgatttgggatgctgaaaaacggggtattctgaccgcaggcaaagagctggttgaaccaaccagcgggaatacaggtgttgccctggcatttgtcgccgctgcacgtggctataaattaacccttaccatgcctgaaactatgagcattgagcgccgcaagttgctgaaagcactgggggcaaatttggtgcttaccgaaggtgccaaagggatgaaaggcgcgattgccaaagcggaagaaattcaagcaaccgatccagaacgctaccttatcttgcaacaattcagtaacccggctaaccctgaaattcatgaaaaaaccaccggccctgaaatttgggaagataccgatggtgatgtagatgtctttgtctccggggtaggtaccggtggtaccctaaccggtgtcagccgctatattaaaaacacccaaggcaaagccatcacgactgtggccgtcgaacccactgactcccccgtgattacccaagcgctggccggtcaagagatcaaacctggtccgcataaaattcaaggtattggtgcgggttttatccccggtaacctcgacttgagtctggttgatcgtgtagcgctggtcaccaatgaagaagctatttcgatggcccgccgtttgatggatgaagaaggcattctggcgggtatttcttcaggtgcagccgttgctgccgccgttaagctttcagaagaggaaggctttactgacaaaacaattgtggttatccttccctcctcgggtgaacggtatttaagtacagcattgttcgcagatttgttcacagagcaagagctgcaacagtag

SEQ ID NO: 24384 - protein, 322 aa, Yersinia pestis
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTQGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 24385 - DNA, 942 bp, Staphylococcus aureus
  CDS (10)..(942)
gtgttcttaatggcacaaaaaccagtagataatattactcaaattattggcggtacaccggtagtcaaattgagaaatgtagtagatgacaatgcagcagatgtttatgtaaaattggaatatcaaaatccaggtggttctgtaaaggatagaattgctttagcaatgattgaaaaagcagagcgagaaggcaaaattaaacctggcgatacaattgtagaaccaacaagtggtaatacaggtatcggtttagcatttgtatgtgctgctaaaggatataaagcagtatttactatgcccgaaacaatgagccaagagcgtcgtaatttattaaaagcatacggtgcggaattagttttaacgcctggatcagaagcgatgaaaggtgcaattaaaaaagctaaagaattgaaagaagaacatggttacttcgagccacaacaatttgaaaaccctgcgaaccctgaagttcatgagttaactacaggtcctgagttattacaacaatttgaagggaaaactatcgatgcgttcctagctggtgttggtactggtggtacgttatctggtgtaggtaaagttctgaaaaaagaatatcctaacatcgaaattgttgctatagagcctgaggcttctccagtattgagcggtggtgagccaggtccacataaattacaaggtttaggtgctggatttattccaggcactttgaatacagaaatctatgacagtattattaaagtaggaaatgatacagcgatggaaatgtctcgtcgagttgctaaagaggaaggtattttagcaggtatttcatcaggtgctgcgatttatgctgccattcaaaaagcaaaagaattaggaaaaggtaaaacagtagtaacagtattgccgagtaatggtgaacgctacttatcaacacctttatattcattcgatgactag

SEQ ID NO: 24386 - protein, 310 aa, Staphylococcus aureus
MAQKPVDNITQIIGGTPVVKLRNVVDDNAADVYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEVHELTTGPELLQQFEGKTIDAFLAGVGTGGTLSGVGKVLKKEYPNIEIVAIEPEASPVLSGGEPGPHKLQGLGAGFIPGTLNTEIYDSIIKVGNDTAMEMSRRVAKEEGILAGISSGAAIYAAIQKAKELGKGKTVVTVLPSNGERYLSTPLYSFDD

SEQ ID NO: 24387 - DNA, 1038 bp, Agrobacterium tumefaciens
  CDS (1)..(1038)
atgaccattcattcctctgcgctcagtgcaatcggcaacacgccgctcatccgtctgaaggctgcctctgaagcgacggggtgtgaaatcctcggcaaggcggaattcctcaatcccggccagtcggtgaaggatcgtgcagcgctctacatcatccgcgacgccgaacggcgcggccaattgcgcccgggcggcaccatcgtggaaggcacggccggaaataccggcatcggcctgtcgctggtcgccaatgcgctcggctacaagacggtgatcgtcattcccgagacgcagagccaggagaagaaggacgcgctgaagcttctcggcgccaagctggtcgaagtaccggccgcgccttattccaatccgaacaattacgtaaaggtctccggccggcttgcaaaacagctcgccgccacggatgaaaacggcgcgatctgggccaaccagttcgacaatatcgccaaccgtcaggcgcatatcgagacgaccgcgcctgagatctgggaccagacggacggcaaggtcgatggcttcatatgctcggtcggttccggcggaacactggccggcgtcgccgacggcctgcgcgatttcaatcccgacatcaagatcggtcttgccgaccctgaaggtgccgccctttatgaattttacaaacacggcgtcctgaagtccgaaggctcctccattaccgaaggcatcggacaggggcgcatcaccgccaatctggaagggttcgcaccggatttctcctatcgtatttcggacgcggaagcgctgccggtgctgttcgatctggtcacgaaagaaggcctgtgcctcggcggttcttccggcatcaacattgccggcgcaatccgccttgcccgtgagctcggtccggggcatacaatcgtgacgatactgtgcgactacggtaatcgttatcagtcgaagctcttcaatccggatttcctgcgctccaaggggcttcccgtgccgcagtggctggcgaccaagagcgagattccggttccctacgaaaccgtttga

SEQ ID NO: 24388 - protein, 345 aa, Agrobacterium tumefaciens
MTIHSSALSAIGNTPLIRLKAASEATGCEILGKAEFLNPGQSVKDRAALYIIRDAERRGQLRPGGTIVEGTAGNTGIGLSLVANALGYKTVIVIPETQSQEKKDALKLLGAKLVEVPAAPYSNPNNYVKVSGRLAKQLAATDENGAIWANQFDNIANRQAHIETTAPEIWDQTDGKVDGFICSVGSGGTLAGVADGLRDFNPDIKIGLADPEGAALYEFYKHGVLKSEGSSITEGIGQGRITANLEGFAPDFSYRISDAEALPVLFDLVTKEGLCLGGSSGINIAGAIRLARELGPGHTIVTILCDYGNRYQSKLFNPDFLRSKGLPVPQWLATKSEIPVPYETV

SEQ ID NO: 24389 - DNA, 921 bp, Helicobacter pylori
  CDS (1)..(921)
atgatgattatcaccacaatgcaagacgccataggccgcactcccgtttttaaattcactaacaaggattaccccattccgttaaattccgccatttacgccaaactggagcatctaaacccaggggggagcgttaaagatcgcttaggccaataccttataggagaagggtttaaaacgggcaaaatcacttctaaaacaaccatcattgagcctaccgcaggcaataccggcatcgctctagctttagtggcaatcaagcaccatctcaaaaccatctttgttgtcccggaaaaattcagcacagaaaaacaacaaatcatgagggctttgggggctttagtaatcaacacgcctactagcgaggggatttctggcgccattaaaaaaagtaaagagttagccgaaagtatccctgatagctatttgcccttacaatttgaaaaccctgataatcccgccgcttactaccacaccctagcccctgagattgtccaagaattaggcacaaaccttacgagctttgtagccgggatagggagtggtggcacttttgcgggcacggctaggtatttgaaagaacgcatccctgcgattcgcttgattggggtggagccggagggttctattttgaatgggggtgagcctgggcctcatgagattgagggcattggcgtggagttcatccctcctttttttgaaaacttggatattgatggctttgaaacgatctcagatgaagagggttttagctacactaggaagttagccaagaaaaacggcttattagtggggagctctagcggggcagcttttgtggcagcattgaaagaagcgcaacgcctccccgaaggcagccaggttttaaccattttcccggatgttgccgatcgttatctctcaaaaggtatttatttataa

SEQ ID NO: 24390 - protein, 306 aa, Helicobacter pylori
MMIITTMQDAIGRTPVFKFTNKDYPIPLNSAIYAKLEHLNPGGSVKDRLGQYLIGEGFKTGKITSKTTIIEPTAGNTGIALALVAIKHHLKTIFVVPEKFSTEKQQIMRALGALVINTPTSEGISGAIKKSKELAESIPDSYLPLQFENPDNPAAYYHTLAPEIVQELGTNLTSFVAGIGSGGTFAGTARYLKERIPAIRLIGVEPEGSILNGGEPGPHEIEGIGVEFIPPFFENLDIDGFETISDEEGFSYTRKLAKKNGLLVGSSSGAAFVAALKEAQRLPEGSQVLTIFPDVADRYLSKGIYL

SEQ ID NO: 24391 - DNA, 1395 bp, Mycobacterium tuberculosis
  CDS (1)..(1395)
atgcggatcgcgcaacatatcagtgaactcattggtggtaccccactggttcggctgaactccgtggtacccgacggcgccggaaccgtggccgcaaaggtcgagtatctcaaccctggcggcagctccaaggatcggatcgcggtgaagatgatcgaagccgccgaggccagcggtcagctgaagccgggtggcaccatcgtcgaacccacgtccggcaataccggcgttggtctggcgttggtcgctcagcgccgcggctacaagtgcgtgttcgtctgcccggacaaggtcagtgaggataaacgcaatgtgttgatcgcctacggcgccgaggtcgtggtgtgcccgacggcggtcccgccgcacgatccggccagctactacagtgtgtcggaccggttggtccgtgatatcgacggtgcctggaagcccgaccagtacgccaacccggagggaccggcaagccattatgtgaccaccggcccggaaatctgggccgataccgagggcaaggtcacccatttcgtggctggcatcggcaccggcggtaccatcaccggcgctggccggtacctcaaagaggtgtccgggggccgagtacgcatcgtcggcgccgacccggagggatcggtctattcgggcggtgccggccgaccgtatctggtcgagggggtcggcgaggatttctggccggcggcctatgacccgagcgtgcccgacgagatcatcgcggtgtccgactccgactcgttcgacatgaccaggcggctggcccgcgaagaggcgatgttggtcggcgggtcgtgcgggatggcggtggttgccgcgctcaaggtcgccgaggaagccgggcccgacgcgttgatcgtcgtcctgttgcccgacggcggccggggctacatgtcgaaaatcttcaacgacgcgtggatgtcgtcctatgggttcctgcgcagccgccttgacgggtcgaccgagcaatccaccgtcggtgatgtgttgcgccgcaagtccggcgcgctgcccgccctggtgcacacccatccgtcggagaccgtgcgcgacgccatcgggattcttcgcgagtacggggtgtcgcagatgccggtggtcggcgccgagccgccggtgatggccggcgaggtcgccggtagcgtctcggaacgcgagctgctctcggccgtgttcgagggccgcgccaagttggccgacgccgtgtcggcacacatgagcccgccgctgcggatgataggcgccggtgaattggtcagtgcggccggcaaggcgttgcgtgattgggatgcgttgatggtggtggaggaaggcaagccggttggggtcattacccggtacgacttgttgggcttcttgtcggagggggcgggacggcggtag

SEQ ID NO: 24392 - protein, 464 aa, Mycobacterium tuberculosis
MRIAQHISELIGGTPLVRLNSVVPDGAGTVAAKVEYLNPGGSSKDRIAVKMIEAAEASGQLKPGGTIVEPTSGNTGVGLALVAQRRGYKCVFVCPDKVSEDKRNVLIAYGAEVVVCPTAVPPHDPASYYSVSDRLVRDIDGAWKPDQYANPEGPASHYVTTGPEIWADTEGKVTHFVAGIGTGGTITGAGRYLKEVSGGRVRIVGADPEGSVYSGGAGRPYLVEGVGEDFWPAAYDPSVPDEIIAVSDSDSFDMTRRLAREEAMLVGGSCGMAVVAALKVAEEAGPDALIVVLLPDGGRGYMSKIFNDAWMSSYGFLRSRLDGSTEQSTVGDVLRRKSGALPALVHTHPSETVRDAIGILREYGVSQMPVVGAEPPVMAGEVAGSVSERELLSAVFEGRAKLADAVSAHMSPPLRMIGAGELVSAAGKALRDWDALMVVEEGKPVGVITRYDLLGFLSEGAGRR

SEQ ID NO: 24393 - DNA, 969 bp, Vibrio cholerae
  CDS (1)..(969)
atgagcaaaatctacgaagacaattcactgactattggtaacactccactagtgcgcttaaacaaagtctctaacggcaaagtgctggctaagattgaagcacgcaacccaagcttcagcgtaaaatgccgaatcggagccaatatgatttgggaagctgaaaagcaaggcaaactcaagcctggcgttgaattagtagagccaacaagtggtaatactggtgttgccctagcgtttgttgctgcagctcgtggatacaagttaactctgaccatgcctgaatcgatgagtttagagcgtcgtaagctactcaaagcacttggcgccaatttagaactgactgaagcagcaaaaggcatgaaaggcgcgattgcgaaagcagaagagattgttgccagcaacccagaaaaatatttgctcctccagcaattcaataacccagctaacccgcagatccatgaaaagaccacaggcccagagatttgggatgcaacagatggtcaaattgatgtgtttgttgctggtgtgggtactggcggtacattaacgggtaccagtcgctacatcaaaggcactcaaggtaaagctattctttctgttgcggttgaaccggctgaatcaccggtcattacacaagcgctggcgggagaagaaatcaaacctgctccacataaaattcaaggtatcggtgccggttttatccctggtaacttagatttaagcttgattgatcgtgttgagcgtgtcacctcagatgaagcgattgaaatggcgcgtcgcctaatggaagaagaaggcattctcgcggggatctcttctggtgctgcggttgttgccgctaaccgaatcgcacaattgcctgaatttgaaggaaaaactatagttactgtgttaccaagttcaggtgaacgttacttgagcacagctctattcgcaggcattttcactgataaagaaaaccagcagtaa

SEQ ID NO: 24394 - protein, 322 aa, Vibrio cholerae
MSKIYEDNSLTIGNTPLVRLNKVSNGKVLAKIEARNPSFSVKCRIGANMIWEAEKQGKLKPGVELVEPTSGNTGVALAFVAAARGYKLTLTMPESMSLERRKLLKALGANLELTEAAKGMKGAIAKAEEIVASNPEKYLLLQQFNNPANPQIHEKTTGPEIWDATDGQIDVFVAGVGTGGTLTGTSRYIKGTQGKAILSVAVEPAESPVITQALAGEEIKPAPHKIQGIGAGFIPGNLDLSLIDRVERVTSDEAIEMARRLMEEEGILAGISSGAAVVAANRIAQLPEFEGKTIVTVLPSSGERYLSTALFAGIFTDKENQQ

SEQ ID NO: 24395 - DNA, 984 bp, Halobacterium sp. NRC-1
  CDS (1)..(984)
atgaaagacagcatcctggacgccatcgggacgccactcgttcggctcacggcacccgagggtgcgaccatcgcggcgaagctggaggggttcaaccccgccggctcggcgaaagaccggccggccagggagatggtgttggccgccgagcgcgcgggcgagatccagcccggcgaccagttggtcgaggcgaccagcgggaacacggggatcgggctggcgctgaccgccgccgcccgcggctacgacctcacgatcgtgatgccggcgtcgatgtccacggagcgcaagcaactgctgcgcgcgtacggcgcggacctggagctggtggacgccggcatggagaccgcgaaccaggtggccgaccgggtcgccgccgacaccggcgcgttccgggtgggacagttcgagaaccccgcgaacccgcgcgcccactaccggacgaccgccgaggagatcctcgaccaggtcgagggccgcgagatcgacgcgctcgttgcgggcgtcgggaccggcggcacgatcaccgggaccgcaaccaggctccgggaggcccatcccgagatgtccgtggtcgcggtcgagccggaggcgaacgcggtgctgtcgacgggcgaatcgggcgacgacgacttccaggggatggggccggggttcgtcagcgacaacctcgaccgggagctgatcgacaccgtcgaaaccgtggcggtggacgcggcggaagccgagacgcggcggctcgcccgcgaggagggcgtgctcgtgggccagtccagcggcgcggcggcgctggcggccacccggaccgccgagcgcatcgccgacccctcgcttgactgcccggacgtcagcttcgacgccgacgccgtcggcgatccggacgccatcgcggacggtggtgacggacccgacgactgcccgctggtcgtcacgatcctgcccgacaccggcgagcgatacctctcggcgggcgtgttcgactga

SEQ ID NO: 24396 - protein, 327 aa, Halobacterium sp. NRC-1
MKDSILDAIGTPLVRLTAPEGATIAAKLEGFNPAGSAKDRPAREMVLAAERAGEIQPGDQLVEATSGNTGIGLALTAAARGYDLTIVMPASMSTERKQLLRAYGADLELVDAGMETANQVADRVAADTGAFRVGQFENPANPRAHYRTTAEEILDQVEGREIDALVAGVGTGGTITGTATRLREAHPEMSVVAVEPEANAVLSTGESGDDDFQGMGPGFVSDNLDRELIDTVETVAVDAAEAETRRLAREEGVLVGQSSGAAALAATRTAERIADPSLDCPDVSFDADAVGDPDAIADGGDGPDDCPLVVTILPDTGERYLSAGVFD

SEQ ID NO: 24397 - DNA, 999 bp, Caulobacter crescentus
  CDS (1)..(999)
atgtccgctctgcccagcgtccttgacgcgatcggaaacacgcccctgatccgcctggcccgcgccagcgaagccacgggctgcgagatcctaggcaaggccgagttcatgaacccgggccaatcggtcaaggaccgcgccgcgctggccatcattcgcgacgccgaggccaagggtttgctgcgccccggcggtcggatcgtcgaaggcacggcgggcaacaccggcatcggcctggccatggtcgcctcggcgctgggctacaagacgaccatcgtcatcccgcgcacccagagccaggaaaagaaggacgccatccgcctgctgggcgccgaactggtcgaggtggacgccgtcccctattccaaccccgacaattacgtccgctattccgggcgcttggctgaggaacttgccaggacggaaccccacggcgtgatctgggccaaccagttcgacaacaccgccaaccgcgacgcgcactatcacacgacggggccggaaatcttcgatcagacaagtggtaaggtcgacggcttcatctgcgccgtcggctcgggcggcaccctggccggcgtggccgcagcgctgcgcgaacgcaagccgggcgtgaggatcggtctggccgatccctacggcgcggcgctttacgcctggtacaaggacggcgaactcaaatcggaaggctcctcgatcagcgagggcatcggccagggtcggatcacggccaatctcgagggcctggcgatcgacgatccgttccgggtgtccgaccaagagatgctggaagtgctctatgacctggtgcagcacgaaggcctttgcctgggcggatcggccgggatcaatgtcgccggcgcgatcaagctggcgacggcgatgggccctggccacaccatcgtgacggtgctgtgcgaccacggctcgcgctaccagtccaagctcttcaatcccgtcttccttaaggaaaagggcctgccgacgccgccctggatgtag

SEQ ID NO: 24398 - protein, 332 aa, Caulobacter crescentus
MSALPSVLDAIGNTPLIRLARASEATGCEILGKAEFMNPGQSVKDRAALAIIRDAEAKGLLRPGGRIVEGTAGNTGIGLAMVASALGYKTTIVIPRTQSQEKKDAIRLLGAELVEVDAVPYSNPDNYVRYSGRLAEELARTEPHGVIWANQFDNTANRDAHYHTTGPEIFDQTSGKVDGFICAVGSGGTLAGVAAALRERKPGVRIGLADPYGAALYAWYKDGELKSEGSSISEGIGQGRITANLEGLAIDDPFRVSDQEMLEVLYDLVQHEGLCLGGSAGINVAGAIKLATAMGPGHTIVTVLCDHGSRYQSKLFNPVFLKEKGLPTPPWM

SEQ ID NO: 24399 - DNA, 1014 bp, Caenorhabditis elegans
  CDS (1)..(1014)
atgtctcgtgaattgatggttcaggatagtggggacactatcggaaatactccattggtgcttctccgaaatatttccaaaggcttggatgccagaatcgctgtcaaagtggaatatctgaatccatcgtgctctgtcaaggatcgaattgccaagtcaatggtggacgaagccgagaaagctggaacaattgtgcccggaaaaacggttctcgttgagggaaccagtggaaatttgggcatcgctttggctcatattggaaagattcgaggatacaaggtgattctcgtgatgccagccaccatgagcgttgagcgtcgtgccatgctccgagcctacggagccgaggtgatcctgtccgatccagctgaaggacatccgggagttattaagaaagtggagatgcttgtcgataagcttccaaatgctcattgccttgatcaattctcgaatcccgccaatccagccgctcattatcgtaccactgggccagaaatttggaggcaaaccgaaggaaaagttgatattgtgtgctttggtgtaggatcgagtggaactgtgacaggagtcggaagatacctccgcgagcagaatccgaatattgagatctacccggttgagccatacgagagttcagtcttgagtgggctgccaagagggccacacaaaattcaaggaatcggtgccggcattgtgccaggaaacgtcgatcgctcgttgttcacggaaattttgcgcatcaagtctgacgatgcgatgcaaatggcgcggcgactcgccgacgaggaggcaattctcggtggaatctcgtccggagccaacgtcgtcgctgccgtggagctggctagtcgccccgagaacaagggaaaattgattgtgaccactgtgaacagctttgcagagagatacttcaccacggagctgtactcggatgtgctcaatgaagtttcacaattgactttttcaagtgacgatgaggcgatgggaattgcgaagaaatatttgggtctctaa

SEQ ID NO: 24400 - protein, 337 aa, Caenorhabditis elegans
MSRELMVQDSGDTIGNTPLVLLRNISKGLDARIAVKVEYLNPSCSVKDRIAKSMVDEAEKAGTIVPGKTVLVEGTSGNLGIALAHIGKIRGYKVILVMPATMSVERRAMLRAYGAEVILSDPAEGHPGVIKKVEMLVDKLPNAHCLDQFSNPANPAAHYRTTGPEIWRQTEGKVDIVCFGVGSSGTVTGVGRYLREQNPNIEIYPVEPYESSVLSGLPRGPHKIQGIGAGIVPGNVDRSLFTEILRIKSDDAMQMARRLADEEAILGGISSGANVVAAVELASRPENKGKLIVTTVNSFAERYFTTELYSDVLNEVSQLTFSSDDEAMGIAKKYLGL

SEQ ID NO: 24401 - DNA, 972 bp, Mycobacterium tuberculosis
  CDS (1)..(972)
atgacacgatacgactcgctgttgcaggccttgggcaacacgccgctggttggcctgcagcgattgtcgccacgctgggatgacgggcgagacggaccgcacgtgcggctgtgggccaagctcgaggaccgcaatccgaccgggtcgatcaaggaccgcccggctgtgcggatgatcgagcaggccgaggccgacgggttgttgcggccgggcgccaccatcctggagcccaccagcggaaacaccggcatttcgctggcgatggcggcccggttgaaggggtaccgattgatctgcgtgatgccggagaacacatcggttgaacggcggcagctgctcgagctctacggcgcgcagattatcttctcggcggccgaaggcgggtccaacactgcggtggccaccgccaaagagctggccgcgaccaacccgtcatgggtgatgctgtaccagtacggcaatcccgccaacaccgactcgcactactgcggcaccggccccgagctgctggccgacctgcccgaaatcacgcacttcgtcgccggcctaggcaccacgggcacgctgatgggcactggccgtttcctgcgcgagcacgttgccaacgtcaagatcgtggcggccgaaccccgctacggtgagggggtatacgccctgcgcaacatggacgaaggctttgtgcccgagctgtatgacccggaaatactgaccgcgcgatattctgtcggcgcggtggacgcagtgcgccgcacccgcgagttggtgcacaccgaaggcatctttgcgggcatctcaaccggcgcggtgctacacgccgcactcggagtcggggccggcgccctggcggccggcgagcgggccgacattgcgttggtggtcgccgacgccgggtggaagtatctgtccaccggcgcctacgccggtagcctggatgacgccgagaccgctctggaagggcaactatgggcatga

SEQ ID NO: 24402 - protein, 323 aa, Mycobacterium tuberculosis
MTRYDSLLQALGNTPLVGLQRLSPRWDDGRDGPHVRLWAKLEDRNPTGSIKDRPAVRMIEQAEADGLLRPGATILEPTSGNTGISLAMAARLKGYRLICVMPENTSVERRQLLELYGAQIIFSAAEGGSNTAVATAKELAATNPSWVMLYQYGNPANTDSHYCGTGPELLADLPEITHFVAGLGTTGTLMGTGRFLREHVANVKIVAAEPRYGEGVYALRNMDEGFVPELYDPEILTARYSVGAVDAVRRTRELVHTEGIFAGISTGAVLHAALGVGAGALAAGERADIALVVADAGWKYLSTGAYAGSLDDAETALEGQLWA

SEQ ID NO: 24403 - DNA, 888 bp, Vibrio cholerae
  CDS (1)..(888)
atgtctgatttccccactcttgaagattatgtaggtcaaacgcccttggtgcgtttacagcgcctcaatgcaggccgctctacagtattggtgaagctcgaaggcaataatccagcgggttccgtgaaagatagaccagcgcttaatatgattgtgcaagccgaagcgcgcggcagtttgcagcccggcgataccattattgaagccaccagtggtaatactggcatagcgttggctatggctgccgccatcaaaggctacaagatgattctgatcatgcccgataacgccactcaagagcgcaaagattcgatgcgcgcctatggcgctgagctgattttggttagcaaagaacaagggatggaaggcgcacgcgatttagccttacagatgcagcaagaaggcaaaggtaaggtattggatcaattcaataacttggataaccctgacgcgcattatcgctcaaccgggccggaaatctggcagcaaagccaaggcaaaatcactcattttgtttcaagcatgggcaccacaggcaccataatgggcgtctctcgttatctgaagcaacaaaatccgcagattcagatcatcggcttacaaccctcggaaggcagcgcgattccgggtattcgccgttggccgcaagcctacctccccggcatttttgatgctgcacgagtcgatcaggtgctggacgtaactcaaactgacgccgaacagaccgctcgcgcccttgcgcgtgaagaaggaatttgcgccggcgtcagctctggcggagccgtgtttgccgctttgcagattgcccaacaaaatccgggatccgtagtggtagcgattgtgtgcgatcgtggcgaccgttatttatcctcaggattattttcctaa

SEQ ID NO: 24404 - protein, 295 aa, Vibrio cholerae
MSDFPTLEDYVGQTPLVRLQRLNAGRSTVLVKLEGNNPAGSVKDRPALNMIVQAEARGSLQPGDTIIEATSGNTGIALAMAAAIKGYKMILIMPDNATQERKDSMRAYGAELILVSKEQGMEGARDLALQMQQEGKGKVLDQFNNLDNPDAHYRSTGPEIWQQSQGKITHFVSSMGTTGTIMGVSRYLKQQNPQIQIIGLQPSEGSAIPGIRRWPQAYLPGIFDAARVDQVLDVTQTDAEQTARALAREEGICAGVSSGGAVFAALQIAQQNPGSVVVAIVCDRGDRYLSSGLFS

SEQ ID NO: 24405 - DNA, 999 bp, Xylella fastidiosa
  CDS (1)..(999)
atgtgtacatcctccctgattacttccacagagaccttcatgactatctacaacactatcctggacacgattggccacacacccgtggttaaactgaaccgtattgctccggcacacgtggatctgtacatcaaggttgaatcattcaatccaagcggctcggtcaaagaccgtctggcactggccattattctcgacgccgaacaacaggggttattgaaacccggcgacaccatcgttgaagccacttcgggaaatactggcgtcgccctggccatgatcgccgctgcccgcggctacacgtttgtcgccaccatggtcgaaaccttttcgatcgagcggcgcaaactgatgcgcgcttacggtgccaaagtcatcctcaccccagccgccgaacgcggtagcggcatggtacgcaaagccaaagaactcgccgaacagcacggctggttcctcgccagtcaattttccaacccagccaacccggcctatcaccgcaacaccaccgccgcggaaatcctacgagactttgccggacgccgcctcgaccacttcgtcagcggatggggcaccggcggcacgcttactggtgttggtgaagtgctgaaaatcgcgcgaccagacatcacgatcaccgccagcgaacccgccagcgcagcactgctccaagggaaggaatggcaaccccacaagattcaaggatggacacccgatttcgtaccggaggtactgaatcgttccgttccacaccacatcctcagtgttaccgacgacgatgcaatcacggtggcccgtcgcctggccgcggaggaaggtgttttctcggggatctccggcggtgccaccgtcgcaacagcactgcagatcgcccaacaggcccaaccgggtgccgtgatcctcgccatgctgccagataccggcgaacgttacttctccaccccactgttcgctgacatcaatgagcattcagacgacgcgtggttagccagtctcggctga

SEQ ID NO: 24406 - protein, 332 aa, Xylella fastidiosa
MCTSSLITSTETFMTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDITITASEPASAALLQGKEWQPHKIQGWTPDFVPEVLNRSVPHHILSVTDDDAITVARRLAAEEGVFSGISGGATVATALQIAQQAQPGAVILAMLPDTGERYFSTPLFADINEHSDDAWLASLG

SEQ ID NO: 24407 - DNA, 933 bp, Lactococcus lactis subsp. lactis
  CDS (1)..(933)
atgactaaaatttatgataacattactgaattaatcggacaaactccaattgttaaacttcaacatgttccagcagagagtgctgatgtctatgtcaaacttgaagctttcaatcctggtggttctgtgaaagatcggattgcccttgcaatgattcgggcggctgaggccgatggacatttaaaacctggtggaacaatcgttgaaccgacttctggaaatacaggaattggactcgccttcgttggctctgctttgggttacaaagttgtcattgtcatgccagagtcattctcacttgaacgtcgcaaattgattcaagcttacggggctcaattagttttaacacccgctagtggtggaatgaaagcagcaattgctaaggcaaaagaactctcagaaacagaaggttattttcttgccatgcaatttgaaaatcccgcaaatcctgaaattcatgaaaaaacaacaggagctgagattattgatgcttttgggccaactggacttgatgcctttgtggcaggtgcagggactggtggaacgataacaggagtttcgcatgccctcaaaaaagcaaatccaactatcaaaacttatgttgtcgaagctgatgaatctgctattctctcgggtgaggctgctggcccacataaaatccaaggtatttctgctggttttattcctgggaatcttgacactaaatcttatgatgaaatcattcgggtcaaaggagatgatgccattttaacggctcgtcatcttggaggaaaagaaggatttttagttggaatttcttcgggcgcagccatttatgctgcccttgaagtagctaaaaaattaggtaagggtaaaaaagtgttagcgattgctcctgataatggagaacgctacttatcaacggctctttatgattttgagtctgaaaaataa

SEQ ID NO: 24408 - protein, 310 aa, Lactococcus lactis subsp. lactis
MTKIYDNITELIGQTPIVKLQHVPAESADVYVKLEAFNPGGSVKDRIALAMIRAAEADGHLKPGGTIVEPTSGNTGIGLAFVGSALGYKVVIVMPESFSLERRKLIQAYGAQLVLTPASGGMKAAIAKAKELSETEGYFLAMQFENPANPEIHEKTTGAEIIDAFGPTGLDAFVAGAGTGGTITGVSHALKKANPTIKTYVVEADESAILSGEAAGPHKIQGISAGFIPGNLDTKSYDEIIRVKGDDAILTARHLGGKEGFLVGISSGAAIYAALEVAKKLGKGKKVLAIAPDNGERYLSTALYDFESEK

SEQ ID NO: 24409 - DNA, 921 bp, Streptococcus pneumoniae
  CDS (1)..(921)
atgtctatttataacaacattactgaattaatcggtcaaacaccgattgttaaacttaacaacatcgtgccagaaggtgctgcagacgtctatataaagcttgaagcatttaatcctggttcatctgtaaaagaccgtattgcccttagcatgattgaaaaagctgaacaagatggtattctgaaacctggttctactattgttgaagcaacaagtggaaacaccggtattggactttcatgggtaggtgctgctaaagggtataaagtcgtcatcgttatgcctgaaactatgagtgtagaacgacgtaaaattatccaagcttatggtgctgaactcgtcctaactcctggtagcgagggaatgaaaggtgctattgctaaggctcaagaaatcgctgctgaacgtgatggtttccttcctcttcaatttgacaatccagctaatccagaagtacacgaaagaacaacaggagctgagatactagctgctttcggtaaagatggattagatgcctttgttgctggagtaggtactggtggaacgatttctggtgtttctcatgcactcaaatcagaaaattctaacattcaagtttttgcagtagaagcagatgaatctgctattctatctggtgaaaaacctggtcctcacaaaattcaaggtatctcagctggatttattcctgatacacttgatactaaagcctatgatggtatcgttcgtgtaacatcagatgacgctcttgcactcggacgtgaaattggtggaaaagaaggcttccttgtagggatttcctcagctgcagctatctacggagccatcgaggttgccaaaaaattaggtacaggtaaaaaagtccttgccctagcaccagataacggtgaacgttatctctctacagcactttatgaattgtag

SEQ ID NO: 24410 - protein, 306 aa, Streptococcus pneumoniae
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 24411 - DNA, 975 bp, Pseudomonas aeruginosa
  CDS (1)..(975)
atgagccgcatcttcgcagacaacgcgcagtccatcggcaacacgccgctggtccagatcaaccgcatcgccccgcgcggcgtcaccatcctggccaagatcgaagggcgcaaccccggctattcggtgaagtgccggatcggcgcgaacatgatctgggatgccgaagccagcggcagactgaagtccggcatgaccctggtcgagccgacctccggcaacaccggcatcggcctcgccttcgtcgccgccgcacgcggctacaaactgatcctgaccatgccggcgtcgatgagcctggagcgacgcaaggtgctcaaggcgctgggcgcggagctggtcctgaccgaaccggcgaagggcatgaagggtgcgatccagaaggccgaggaactggtcgcgggggatcccgggaagtacttcatgccgcagcagttcgacaacccggccaacccggcgatccatgagaagaccaccggcccggagatctggaacgataccgagggcgcggtggacgtgctggtctccggggtcggcaccggcggcaccctcaccggcgtctcgcgctacatcaagaacacccggggcaagccgatcctcgccgtggcggtggagccggtgacctcgccggtgatcagccagaccctcgccggcgaggaggtcaagcccgccccgcacaagatccagggcatcggcgccggcttcgtgccgaagaacctcgacctgtcgctggtcgaccgggtcgagaagatcggcgacgacgaagcgaagaacatggcgctgcgcctgatgcaggaagaaggcatcctctgcggcatctcctccggcgcggcgatggccgccgcggtgcgcctggccgaggagccgaacatgcagggcaagaccatcgtggtgatcctccccgattccggcgagcgctatctttcgagcatgctcttcgacggcctgttcagcgaacaggaactgacccagtaa

SEQ ID NO: 24412 - protein, 324 aa, Pseudomonas aeruginosa
MSRIFADNAQSIGNTPLVQINRIAPRGVTILAKIEGRNPGYSVKCRIGANMIWDAEASGRLKSGMTLVEPTSGNTGIGLAFVAAARGYKLILTMPASMSLERRKVLKALGAELVLTEPAKGMKGAIQKAEELVAGDPGKYFMPQQFDNPANPAIHEKTTGPEIWNDTEGAVDVLVSGVGTGGTLTGVSRYIKNTRGKPILAVAVEPVTSPVISQTLAGEEVKPAPHKIQGIGAGFVPKNLDLSLVDRVEKIGDDEAKNMALRLMQEEGILCGISSGAAMAAAVRLAEEPNMQGKTIVVILPDSGERYLSSMLFDGLFSEQELTQ

SEQ ID NO: 24413 - DNA, 1374 bp, Pseudomonas aeruginosa
  CDS (1)..(1374)
atgacttccgactcacgtcccgccgtgctcgacctgatcggcaacaccccgctggttcgcgtgacgcgcttcgataccggcccctgcaccctgtacctcaagctcgaatcgcagaaccccggcggctccatcaaggatcgcatcggtgtcgccatgatcgaggccgccgagcgtgacggccgcctgcggcccggtggcaccatcgtcgaggccaccgccggcaacaccggtctcggcctggccctggtcggccgcgcgaagggctaccgggtggtgctggtggtgccggacaagatgtccaccgagaaggtcctgcacctgcgcgccatgggcgccgaggtgcacatcacccgatcggacgtcggcaagggccatccggagtactaccaggacgttgccgcgcgcctggcgcaggatattcccggcgccttcttcgccgaccagttcaacaacccggccaacccgctggcccacgagtgcggcaccggcccggagctctgggcgcagaccggccacgatctcgacgccatcgtcgtcggcgtcggctcctccggtaccctgaccggccttacccggttcttccagaaggtccagccggagctggagatggtgctcgccgatcccgagggctcgatcatggccgagtactcccgctccggcaccctgggtacgccgggttcctgggcggtggagggcatcggcgaggacttcgtaccggccatcgccgacctctccagcgtgcgccatgcctattccatcagcgacgaggaaagcttcgccatggcccgcgaactgttgcgcgtcgagggcattcccggcggctcctccaccggcaccctgctggccgcggcgctgcgcttctgtcgcgagcagaaggagccgaagcgggtggtcagcttcgtctgcgacaccggcacccgctacctgtcgaagatctacaacgaccagtggatgaccgaccagggcctgctgcaacgcaagcactacggcgacctgcgcgacatcatcgcgcggcgcttcgaggagggccgggtgatcagcgtcggtccggacgacaccctgctcaccgccttccagcgcatgcgcctggccgacgtttcgcaattgccggtgctggacgatggaaaactggtcggtgtgatcgacgagtcggatatcctgctcggtgtccacgccgacgcgccacgcttccgcgatgcggtaagcagcgcgatgaacgccgcgccggagaccctcgcgcccggcgccagcctggcccagttgcaggcggtcctggaccgcggcctggtggcgatcgttgccgatgccagcggcttccacggcctgatcacccgtttcgacctgttgaaccatttgcggagaaagctcgcatga

SEQ ID NO: 24414 - protein, 457 aa, Pseudomonas aeruginosa
MTSDSRPAVLDLIGNTPLVRVTRFDTGPCTLYLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKVQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLA

SEQ ID NO: 24415 - DNA, 948 bp, Buchnera sp
  CDS (1)..(948)
atgagtaaaatatatcaagataattctttaactattggtaatacacctctagttcgtttaaatagaattggaaatggaaatattttagtaaaaatagaatctagaaatccaagttttagtgttaaatgtagaattggtgctaatatgatatggcacgccgaaaaaaataataatataaataaaaatgtaaaactaatcgaggcgactagtggtaatacaggaatagcattagcttatgttgcagcttctagaaattatcgattaactctaactatgcctgaaaccatgtctattgagcggaaaaaaatattaaaatctttaggtgcagaattgattttaaccgatggaagatatggcatgaagggagctatttctaaggcaaatgatattatatctcgcaatccaagtaaatattttttattaaaacaatttgagaatccagctaatcctgaaattcatcaaattactactggaccagaaatatggaacgatactaatggcaatttagatattttaatttctgctgtaggaacgggtggcacaattactggtatcacaagatatatcaaaaaaataaaaagaaaaaaaaatttaatcagtatagctgttgaaccttctgaatcacctgtaatcacacaatttttagcaggaaaagcaatcgagcctggaccacataaaattcaaggaattgggcctggttttatacccaaaaacttagatttaacaataatcgatcaagttattactgtttctagtgaagaagcaatattaacggctaaagaattaatgaaaaaagaaggtatactagcaggaatctcttctggtgctgcgttatatgcagcaataaaaatccaacagcaaaaaaaattttcagacaaaaaaatagttgttattttaccttcttcaggagaacgttatttaagtacagaattattttctgaactataa

SEQ ID NO: 24416 - protein, 315 aa, Buchnera sp
MSKIYQDNSLTIGNTPLVRLNRIGNGNILVKIESRNPSFSVKCRIGANMIWHAEKNNNINKNVKLIEATSGNTGIALAYVAASRNYRLTLTMPETMSIERKKILKSLGAELILTDGRYGMKGAISKANDIISRNPSKYFLLKQFENPANPEIHQITTGPEIWNDTNGNLDILISAVGTGGTITGITRYIKKIKRKKNLISIAVEPSESPVITQFLAGKAIEPGPHKIQGIGPGFIPKNLDLTIIDQVITVSSEEAILTAKELMKKEGILAGISSGAALYAAIKIQQQKKFSDKKIVVILPSSGERYLSTELFSEL

SEQ ID NO: 24417 - DNA, 906 bp, Staphylococcus aureus
  CDS (1)..(906)
atgattacttatgatttaattggcaatacaccattagtactgttagaacattatagtgatgataaagttaaaatttatgccaagcttgaacaatggaatcctggaggcagtgttaaagacagactcgggaaatatttagtagagaaggcaattcaagaagggcgtgtgcgtgcaggtcaaactattgttgaagcgactgctggtaatacaggcatagggttagctattgcagcgaatagacatcatttgaaatgtaagatctttgcgccgtatggtttttcagaagaaaagattaatattatgatagcgcttggtgcagatgtttcaaggacgagtcagtctgaaggtatgcatggggcacaattagctgcacgttcctatgctgaaaaatatggtgccgtttatatgaatcaatttgaatccgaacataatccggatacatattttcatacattgggacccgaattgacttcagcattacagcaaattgattattttgtggctggtattggctctggcggtacatttacaggtaccgcacgttatttaaagcaacatcacgtgcaatgttatgccgttgagccagaagggtccgtgttaaatggagggccagctcatgcacatgacactgaaggtatcggttctgagaaatggccgatatttttagagagacgtcttgtagatgggatatttacgattaaagatcaagatgcctttcgaaatgtcaaaagtttggctataaatgaagggttgttagtaggcagttcttcaggtgcagcattacaaggtgcattgaatttaaaagcgcaattatctgaaggtacgattgttgtcgtatttccagatggtagcgatcgatatatgtctaagcaaatatttaattatgaggagaatgattatgaataa

SEQ ID NO: 24418 - protein, 301 aa, Staphylococcus aureus
MITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGADVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENDYE

SEQ ID NO: 24419 - DNA, 930 bp, Clostridium acetobutylicum
  CDS (1)..(930)
atgggtaaaatctataagaacttaattgaaactattggaagaactccattagtagaactttcaaattacaaagaaaaaaataaaattgagggaaatattctaggaaaggtagagtactttaatccatcaggaagcataaaagatagaattgcatattcaatgataaaaaatgcagaagaacaggggttaataaataaggatacagttataatagaaccaacaagcggaaatactggagttggtcttgcatttatagcagcagcaaagggatataagcttatattaacaatgcctgaaactatgagtgttgaaagaagaaagcttttgacagcatatggagctgaaatagttcttacttcaggagttgaaggaatgacgggagctattaaaaaggcaaatgagcttgcaagtgaaaatcctaattcttttataccacagcagttcaaaaatccatcaaatccagctatacatgaagttacaactggaatagaaatatgggaggatactgatggaaaagttgatgcagtagttgcaggagtaggaacaggtggtactataacaggtattgctaaaactcttagagaaaaaaataaagatataaaaattatagcagtagaaccagcaacttcaccagtactttctggaggaaaagcaggtcctcacaagattcagggaataggagccggatttgttcctgatgtatatgaagcagaattaatagatgagataattcaagttaaaaatgaagatgcatttgcttctgccaaagagcttgctagagaagagggaatacttgcaggaatatcatcaggtgcagcactatttgcggctaaagaggttgcatcaagaccagaattcaagggtaagaatgttgttgtgattcttcctgatagcggtcaaagatatttatcaatgtctgtatttgattaa

SEQ ID NO: 24420 - protein, 309 aa, Clostridium acetobutylicum
MGKIYKNLIETIGRTPLVELSNYKEKNKIEGNILGKVEYFNPSGSIKDRIAYSMIKNAEEQGLINKDTVIIEPTSGNTGVGLAFIAAAKGYKLILTMPETMSVERRKLLTAYGAEIVLTSGVEGMTGAIKKANELASENPNSFIPQQFKNPSNPAIHEVTTGIEIWEDTDGKVDAVVAGVGTGGTITGIAKTLREKNKDIKIIAVEPATSPVLSGGKAGPHKIQGIGAGFVPDVYEAELIDEIIQVKNEDAFASAKELAREEGILAGISSGAALFAAKEVASRPEFKGKNVVVILPDSGQRYLSMSVFD

SEQ ID NO: 24421 - DNA, 951 bp, Haemophilus influenzae
  CDS (1)..(951)
atggcaatttatgcagacaattcttattctatcggaaatacgccgcttgtgcgtttaaaacactttggccataacggtaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggcgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggcatttctcgcgcgattaaattagattttggtaaacaaatcacttctgttgccgttgagccagtggaatctccggtcattagtcaaactttagcgggtgaagaagtaaaaccaggcccacacaaaattcaaggtatcggtgcgggtttcattcccaaaaatttagatttatctattattgatcgcgtagaaactgttgatagtgataccgcacttgccacagctcgtcgcttaatggcggaagaaggaattcttgcaggtatttcatctggtgcagctgtcgcggctgcagatcgcttagctaaattaccagaatttgctgataaactcattgttgttattttgccttcagcgtctgaacgctacttaagcacagcactgtttgaagggattgagggataa

SEQ ID NO: 24422 - protein, 316 aa, Haemophilus influenzae
MAIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 24423 - DNA, 876 bp, Thermotoga maritima
  CDS (1)..(876)
atgatggaaagactgatagggagcactcctatagtgagactcgattcgatagactcgagaatcttcttgaaactggaaaagaataatcccggtggtagtgtaaaagacagacccgccctcttcatgattctcgacgcagagaaaagaggactcctcaagaacggtatcgtggaaccaacgagcggcaacatgggaatcgccatagcgatgatcggagcaaagagaggacacagggtgatcctcacgatgcccgaaaccatgagcgttgagagaagaaaggtcctgaaaatgctcggagcagaactcgttctcacaccaggggaactgggaatgaaaggtgcggtggaaaaggcgctcgagatatccagagaaaccggcgcgcacatgctcaaccagttcgaaaacccctacaacgtctactctcaccagttcactacaggtccggagatcctcaaacagatggactatcagatagacgccttcgtcgcgggagtgggaacgggaggcacgatcagcggagtgggaagggttttgaaaggcttctttggaaacggagtgaagatagtagcggtagagcccgcaaaatctcccgttctctctggaggccagccgggaaaacacgccatccagggtataggagcgggctttgttccgaagatcctggacagatccgtgatagacgaagtgatcaccgtggaggacgaagaggcctacgagatggcgaggtacctcgcaaaaaaagagggacttctcgtagggatctcttccggtgccaacgtcgcagccgctttgaaagtagcccagaaactcgggccagacgcgagggttgtgaccgttgcaccggaccacgcggaaagatacctgagtatcctatga

SEQ ID NO: 24424 - protein, 291 aa, Thermotoga maritima
MMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 24425 - DNA, 1182 bp, Aeropyrum pernix
  CDS (1)..(1182)
atggtgggccgcgtgcggaagggtcttggatccggtgtttacgggagtatcctggaccttgtaggcggcaccccccttctcaggctgggcagggtggagcgtttcttccggctagagggtgtggagctctacggcaagctcgagatgttcaaccctgggggtagcgtgaaggacaggatagggctttacatgctgatggacgctaggagcagggggcttgttgaggagggcgcggttataatcgagcctacagccggcaacacgggggtaggcctggcgctcgccgcaatacactacggcttcaggcttgtcgctgttatgccgtcgaagatgagcgtggagaaggagctaatactcagggcttacggcgcctacgtcatcagaacccccacagcagtccccccggagagccccctctcctactatagggtggcggaggcggtgaggaacctgctatggatgataggcggcaggcccggtgggggggaggtgaggaaggttgtggagaaggtgcagacgcttgtgagggaggagagggttgaggacctcaggtctatactggaggccagcgtcgagcccaccccctacgcctacataccaaaccagtacagcaacccggcgaacccacgggcccacgaggagacgacggggagggagatatggatgcagactggcggcagggttgacgtggtctacgccggcatggggaccagggggactataaccggggtggcccgctatctgaagagggccaagccctctgtgaggattgtgggcgtggaccctgaggggagcatatacagcctcgtcaagaagggcatgagcccccacgaggcagcgaagcacgccagaccctacaaggtggaggggataggggaggacttcataccctcaaccatagacctgagcctcgtggacgaggtggttgtggtcacggaccagcaggccttctccatggccaggatgctggcccggctcgagggtgtgctggcggggggctcctcgggcgccgccctctacgcggccgtgaagcacataaagaccaggagggtcaggggtgttgccgtggttatactccccgacacgggcaggaactacatcaacaagctctacaacgacaggtggatgggggagaacggtttctccactagggacgaggaggtcctgggggagctgctgtga

SEQ ID NO: 24426 - protein, 393 aa, Aeropyrum pernix
MVGRVRKGLGSGVYGSILDLVGGTPLLRLGRVERFFRLEGVELYGKLEMFNPGGSVKDRIGLYMLMDARSRGLVEEGAVIIEPTAGNTGVGLALAAIHYGFRLVAVMPSKMSVEKELILRAYGAYVIRTPTAVPPESPLSYYRVAEAVRNLLWMIGGRPGGGEVRKVVEKVQTLVREERVEDLRSILEASVEPTPYAYIPNQYSNPANPRAHEETTGREIWMQTGGRVDVVYAGMGTRGTITGVARYLKRAKPSVRIVGVDPEGSIYSLVKKGMSPHEAAKHARPYKVEGIGEDFIPSTIDLSLVDEVVVVTDQQAFSMARMLARLEGVLAGGSSGAALYAAVKHIKTRRVRGVAVVILPDTGRNYINKLYNDRWMGENGFSTRDEEVLGELL

SEQ ID NO: 24427 - DNA, 921 bp, Lactococcus lactis subsp. lactis
  CDS (1)..(921)
atggtaaaaattgttgaaaatattactgaattagttggaaatagtccaattatcaaactaaaaaatggtccagaaaatggagcagaaatttatctaaaacttgaatattttaatcctggaggttcagttaaagaccggattgctttacaaatgattcggcaagccgaagcagatggtcgcttaaaaaagggaggaacgattgttgaacctacctctgggaacacaggaattggacttgccatggctggtgcagctttaggctataatgtggttattatcatgcctgatagttactcaaaagagcgtcgtcagattattcaagcttatggagcagaattgattttgactccagcagctgatggcatcaaagctgccattgatttaggtcaaaaattagttgaagaaaatggttggtttatgccaatgcaatttgaaaatccagctaatttaaaagcccatgaattaacgactggtccagaaataattgaagcatttggtgaaaatggcctggacgcatttgttgcttgtgcaggcactgggggtacaatttctggtgtttctcactatcttaaaagtcaaaattctaaaatcaaaacttttgttgtcgaaccggcagaatcaccaattttaacaggaggtgagagtggtccacaccgcattcaaggaattggtattccatttatgtcaccaaatttagatacgaaagcttatgatggtgtaattgatgtaacaagtgatgaggctttagagaccgcaagaaaaattggcaaaagcgaaggatttttagtaggtatatcttctggcgcagcaatttgggcagcttatgaattggcaaaaaaacttggcaaaggtcaaaaagttctcgcactttgtgctgacaatggtgagcgctatctttcaacagaactctatgattattaa

SEQ ID NO: 24428 - protein, 306 aa, Lactococcus lactis subsp. lactis
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQIIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTKAYDGVIDVTSDEALETARKIGKSEGFLVGISSGAAIWAAYELAKKLGKGQKVLALCADNGERYLSTELYDY

SEQ ID NO: 24429 - DNA, 933 bp, Mycobacterium tuberculosis
  CDS (1)..(933)
atgagcatcgccgaggacatcacccaactcatcgggcgcacaccgctggtccgactgcgccgagtcaccgacggcgccgttgccgacatcgtcgccaagctggaattcttcaacccggccaacagcgtaaaagaccgtatcggggttgccatgctccaagcggccgagcaggcaggtttgatcaagccggacacgatcattctcgaacccacgagcggtaacaccggcatcgccctggccatggtttgcgcggcacgcggctaccggtgcgtgctgaccatgcccgagacgatgagtctggagcgccggatgttgctgcgcgcatacggtgctgaactcatcctcactccgggtgcggacggcatgtcaggtgccatcgccaaggctgaggagctggccaagaccgatcaacgctacttcgtgccccagcaattcgagaacccggcgaacccggccatccatcgcgtcacgaccgccgaggaggtctggcgtgacaccgacggcaaggtcgacatcgtcgtcgcgggagtcggcaccggtggcaccatcaccggcgtcgcgcaggtcatcaaggaacgcaagccgtcggcccggttcgtggccgtagagccggccgcgtcgccggtcctttctggtggccagaagggaccgcacccgatccagggcatcggcgccgggttcgtcccgccggtactcgaccaggacctagtcgacgagatcattaccgtcggtaacgaagacgcgctcaacgtggcgcgccggctggcccgggaagagggcttgctggtcggcatctcctcgggcgccgccacagtggccgctcttcaggtggcccgccggccagagaacgccgggaagctaatcgtcgtagtgctccccgacttcggcgaacgatatctgagcacaccgttgttcgccgacgtggctgactag

SEQ ID NO: 24430 - protein, 310 aa, Mycobacterium tuberculosis
MSIAEDITQLIGRTPLVRLRRVTDGAVADIVAKLEFFNPANSVKDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 24431 - DNA, 900 bp, Campylobacter jejuni
  CDS (1)..(900)
atgaaagtacatgaaaaagtaagtgagcttataggaaatactcctattatacatttgaaaaaatttggtatcaatgtttttgctaaatgtgaatttttaaatcctagtcattctataaaagatagagcagcttttgaaatgattaaagatgctttagatagtaaaaaaattaatcaagatactacaatagttgaagcaactagtggaaatactggaatttctttggctatgatttgtgcagatttgggacttaaatttattgctgtaatgcccgaatctatgagtttagaaagaagaaaaatgataacactctttggcgctaggttagaattaactcctgcaaatttaggaatgaaaggagcggttgataaagcaaatgaaatattattaaatactccaaattcttttatggtttctcaatttgaaaatatttcaaataaaaatgcgcatcgtaagaatacggctttagaaattttaagagatttggataatgaacttgatatttttgtagctggttttggaactggcggtactattagtggagttggggaaatactaaaagaaaaattagaaaaagtgcatattgttggagtcgagcctctaaattctccattgcttagcaaaggtgaagcgggaagccataaaatacaaggaataggggcgaattttatacctgctattttaaataaagaagttatagatgaagtgatcacagtaagtaatgaagatgctataaatacagccaaagaacttgccaaaagtggtttaatggtaggtatatcaagtggagcaaatgtatttgccgcaagtatgctagcaaagaaatttccagataaaagaattttaactatgctaaacgatacggctgaaagatacctctcaaccgatctttttgcttaa

SEQ ID NO: 24432 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 24433 - DNA, 1371 bp, Xylella fastidiosa
  CDS (1)..(1371)
atggtcattcattcttccgtacttgaattgattggtaatacgccgattgtcaaggcgcagcgccttgacactggtctctgtgatttatttttgaagcttgaaagcgctaatcctggtggttcaatcaaggatcgtgtgggcttgtcgatgattgaggcggctgagtgccgtggtcatatcaagccgggtgctacgttggttgatggggctgccagcagtaccagtatgggcttggcttttgtagctcggcagaaggggtatcgcctgatccttgttgtaccggacaacatggcttgggaaaagatttctaatcttaaggcgatgggggcggaagtgatattgacccgctcagatgtcagcaagggtcatccagagcactaccaagatttggctgaaaaactggcagccgagacaccaggagcctacttcattaatcagtttggaaatgcggacaatccagctgcgcatgagttcggtactggtccggagattctgaagcagatgggcgatcatgtggatgcggttgtattaggttgcgatagtgctggcaccatcacaggcttgtcgcgggcattcgactcagttgcttctgatgtcgaattgattttggccgatccggttggttcgattcttacccagtacatcaatgagggaacatgcagtgataagtctggtacttggttggtggaagggattggaagtgattgtttgcctccgatttccgacttcaggcggatcaaaaaaacgtatgccatcagtgatgcggagagctttcacactgcacgtgagttgttgagtaaagaggggattctgggaggttcttcaacaggtactctgttggctgcggcattgaaatactgccgtgagcagattgagcgcaagcgtgtattggtgtttgtttgcgacacgggaaacaagtatttgttaaatatgtataacgacgattggatgttggataacggttttttgaaaaggccacattatggtgatttgcgtgatctgatcctgcatccttacagtcagcgtcatactgttgtggttgatcccaatgatttgctgactgtggcttaccagcgtatgaagcgatacggtgtttcacagttgccagtgattgaggacggacagctggtcggtatccttgatgaaagcgatgtgctgttacatgtctatggtgatgagactcggttttgtgaccctgtttctaccgcgatggtcagtaagcttcaccgattggatgtgaagtcgccgattgaggggttactccctgtgtttgagcgaggccaagtggctatagtgatggaagatgctcagtttttgggcctgattacacgcattgatttattgaattacctgcgtcgtcgtatgcaatga

SEQ ID NO: 24434 - protein, 456 aa, Xylella fastidiosa
MVIHSSVLELIGNTPIVKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGDHVDAVVLGCDSAGTITGLSRAFDSVASDVELILADPVGSILTQYINEGTCSDKSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYSQRHTVVVDPNDLLTVAYQRMKRYGVSQLPVIEDGQLVGILDESDVLLHVYGDETRFCDPVSTAMVSKLHRLDVKSPIEGLLPVFERGQVAIVMEDAQFLGLITRIDLLNYLRRRMQ

SEQ ID NO: 24435 - DNA, 918 bp, Pseudomonas aeruginosa
  CDS (1)..(918)
atgatctacgattcgctactcgatttaattggcgggacgccggtgatacggctgagcaaattgtctgctcgcctgggggtgagcgtattcgccaagctggaatccttcaatccaggaggaagtcataaggcgcgtatcgcgctctggatgattctggatgccgaacgcaaaggaatcctggtgcgcgggaaagggcagaccattctcgagccgagcgggggaaatacggggattggactggcaatggcggggaacatcctggggtaccgcgtgtccctggtggttcccgacaactacagccctgacaagagacaattgctcgagctgtatggcgctcacgtcgtgctgtcggatagcagaaaagggaacaactcgcatggcgagctggcaatccagatactgctggaacatccggagttcgtcatgctcaaccagcagcgcaatccagccaacccgcaagcccatcgcgaagctacagccctggaaatcctgagggactttgcaggccagccacccccggacttcttcttcgctggcattggaactggtggacatatcacgggtgttggagaggtgctgaggaaccactggccggatatggccatctatggcgtgcagccagagcagtgcgacttgctcgacgataggcacgcatcgcatgagattcagggactttccattggtatcgtgccggaagtctgcaacctcggcattgttactggcatggtcggggtgtcgaaatctgcctgcttgtcgatgatccgggaagtcctgcaaaacgactctgtgagcatggggttgtcctccgcagccaacctggtcgcggtgctgaacatggcatctgccatgccgtcaggcgctcgtgtactgacgatgatctacgatggcgtcgagtcatacatggacgcttttcgatga

SEQ ID NO: 24436 - protein, 305 aa, Pseudomonas aeruginosa
MIYDSLLDLIGGTPVIRLSKLSARLGVSVFAKLESFNPGGSHKARIALWMILDAERKGILVRGKGQTILEPSGGNTGIGLAMAGNILGYRVSLVVPDNYSPDKRQLLELYGAHVVLSDSRKGNNSHGELAIQILLEHPEFVMLNQQRNPANPQAHREATALEILRDFAGQPPPDFFFAGIGTGGHITGVGEVLRNHWPDMAIYGVQPEQCDLLDDRHASHEIQGLSIGIVPEVCNLGIVTGMVGVSKSACLSMIREVLQNDSVSMGLSSAANLVAVLNMASAMPSGARVLTMIYDGVESYMDAFR

SEQ ID NO: 24437 - DNA, 939 bp, Bacillus halodurans
  CDS (1)..(939)
atgaagatcgtaaataatattgccgagctcatcggtgacacacctttggttcggcttaatcgcttgccgaacccaaagggagctgccgtttatttgaaaatggagatgtttaacccaagtgggagcgtaaaagatcgagcagcctatcaaatgattgtccaagcggaaaaggacggctatcttaagccaggttccacgatcattgaaccaacaagtggaaacacaggcattggtcttgcaatgaatgctgcggcgagaggctatcgggccattcttaccatgcctgatacaatgtcagaggagcgaatcaacctattaaaggcctacggggcagaggttgtactgaccgaaggagaaaagaaaatgccgggggctatcgaaaaagcccatgaattagtaagagaaatcccgaatagttttatgccgatgcaatttgagaattcggcaaaccctgatgctcaccgtttcacgaccgctgtggaaatcaagaaagcccttgattccatcggtaaaaagttaagcgcctttgttgctgcctctggtacgggtggtacgattacgggaacaggagaagagttgaaaaagttttatccaaacgtagagatccatgtcgttgagccgttcggatcccccgttctctcaggaggaaagccaggtccacataaactagttgggaccagccccggctttgtacctccgattttaaaccaagacgtttatgatgtgattgataaaatcaaggatgaagatgcatatgaagctgcgcgaaatcttgctcgcctggaaggaatcttagtcggtccttcatcaggtgcggcttgctatgcggcgatgaaggtggccgagcgcttagctccagatgaggtcgttgtctgtatcgcgtgtgatactggggaacgttatttatctaccgacctgtttgattttgagagtcaataa

SEQ ID NO: 24438 - protein, 312 aa, Bacillus halodurans
MKIVNNIAELIGDTPLVRLNRLPNPKGAAVYLKMEMFNPSGSVKDRAAYQMIVQAEKDGYLKPGSTIIEPTSGNTGIGLAMNAAARGYRAILTMPDTMSEERINLLKAYGAEVVLTEGEKKMPGAIEKAHELVREIPNSFMPMQFENSANPDAHRFTTAVEIKKALDSIGKKLSAFVAASGTGGTITGTGEELKKFYPNVEIHVVEPFGSPVLSGGKPGPHKLVGTSPGFVPPILNQDVYDVIDKIKDEDAYEAARNLARLEGILVGPSSGAACYAAMKVAERLAPDEVVVCIACDTGERYLSTDLFDFESQ

SEQ ID NO: 24439 - DNA, 825 bp, Halobacterium sp. NRC-1
  CDS (1)..(825)
atgatcgaacagatgctcgcctccggcgagctccccgagggcggcaccatcatcgagccgaccgccggcaacaccggcgtcgggttcgcggtggccgccagccaactcggcatcgacgccgtcttcgtcgtgccggagcggttcagtctcgaaaaacaacagctgatgcgcgcgctcggcgcggacgtggtcaacacacccaccgacgacggcatgggtggcgcgatccagcgcgcccacgacctcgccgccgagcgcgaggacgccatcgtcccccagcagttctccaaccccctgaacgccgaagcccactacgagaccaccggccccgagatctaccacgcgctcgacggtgctgtcggcgcgttcgtcgccggctgtggcacggccggcaccctgatgggcaccagccggttcctccgcgaccagatctcggcgctacacgtcacggccgtcgaaccggaagggtcgatgtacgcctcggccgccggggccgacgtctccgaaggcgagtacaagaccgagggcatcggcacccacgacccgtcgaccagcgagctgttcgaccccgagttcgtcgacgacgtcacccagatccccgacgaggacacgcacgccgaaatgcagcgcctcgccgccgaggaagcccaactggtcgcgtccagcgccgccgcgaacagtctcgccgccatcgatgtcgccgagcgcgccgccgccggacacatcgacctcccacacgactgcgtggtcactgtgttcccggactcaagcgagcgctacctctcgaaggggctctacggcgactacgaggagtgggagggctga

SEQ ID NO: 24440 - protein, 274 aa, Halobacterium sp. NRC-1
MIEQMLASGELPEGGTIIEPTAGNTGVGFAVAASQLGIDAVFVVPERFSLEKQQLMRALGADVVNTPTDDGMGGAIQRAHDLAAEREDAIVPQQFSNPLNAEAHYETTGPEIYHALDGAVGAFVAGCGTAGTLMGTSRFLRDQISALHVTAVEPEGSMYASAAGADVSEGEYKTEGIGTHDPSTSELFDPEFVDDVTQIPDEDTHAEMQRLAAEEAQLVASSAAANSLAAIDVAERAAAGHIDLPHDCVVTVFPDSSERYLSKGLYGDYEEWEG

SEQ ID NO: 24441 - DNA, 987 bp, Caulobacter crescentus
  CDS (1)..(987)
atggacgacgcttcctccctctatgacgccgcccgcttcaagcgcgctggccgtggcaagatctatgactcgatcatcgacacgatcggtgacaccccgctggtgcgcctgccgcgtctgtccgccgagctgaaccccaaggccgaggtcctggccaagctggagttcttcaacccgatcgcctcggtgaaggaccggatcggcgtctcgatgatcgagtcgctggaggctcagggcgtcttgaagccgggcgcgacgattatcgagccgacctcgggcaacaccggcatcgccctggccttcgtcgcggcggccaagggctacaagctgaccctggtcatgcccgagagcatgtcgatcgagcgccgcaagatgctgctgctgctcggcgccaagctggaactgaccccggccgagaagggcatgcgcggcgcggtcacccgggcccaggagctgatcgaggcgaccccgggcgcggtgatgccgcaacagttcgaaaacagcgccaatccgctgatccatcgcgtctcgaccgccgaggagatctggaacgacaccgccggcgcggtcgacgcggtggtctcgggcgtcgggaccggcggcaccatcacgggcgttggccaggcgctgaaggcgcgcaagccctcgctgaagatggtggcggtggagcccgaggcctcgccggtgctgtcgggcggcgcgccgggtccgcacaagatccaggggatcggcgcgggcttcgtgcccggcgtgctggatcgcggcgtcatcgacgacatcgtccaggtcagcaatgacgacgccttcgccatggcccgccgcgcggcggccaccgaagggttgccggtcggcatcagctccggcgcggccctgacggccgcgttcgatctggccctgcgcgatgcgtacaagggcaagacgatcgtggtgatcatccccagcttcgccgagcgctacctgtcgacggctttgttcgacgggctctag

SEQ ID NO: 24442 - protein, 328 aa, Caulobacter crescentus
MDDASSLYDAARFKRAGRGKIYDSIIDTIGDTPLVRLPRLSAELNPKAEVLAKLEFFNPIASVKDRIGVSMIESLEAQGVLKPGATIIEPTSGNTGIALAFVAAAKGYKLTLVMPESMSIERRKMLLLLGAKLELTPAEKGMRGAVTRAQELIEATPGAVMPQQFENSANPLIHRVSTAEEIWNDTAGAVDAVVSGVGTGGTITGVGQALKARKPSLKMVAVEPEASPVLSGGAPGPHKIQGIGAGFVPGVLDRGVIDDIVQVSNDDAFAMARRAAATEGLPVGISSGAALTAAFDLALRDAYKGKTIVVIIPSFAERYLSTALFDGL

SEQ ID NO: 24443 - DNA, 969 bp, Agrobacterium tumefaciens
  CDS (1)..(969)
atgcccgaagccagaaagcccggacgcggacgcgtctattcctcaatcacggaaacaatcggcgacacgccgatcgtgaggctcgacaagctggcgaaggaaaagggcgtgaaggcaaacctgctcgccaagctggagttcttcaaccctatcggttccgtgaaggaccgtatcggcgttgccatgatcgaagcgctggaagcacagggtaagatcactcccggcaagacgacgctggtggagccgacttcaggtaataccggcatcgcgctcgcctttgccgccgccgccaagggttacaagctgatcctcaccatgccggaaaccatgtcggttgaacgcagaaagatgctggcgctgctgggtgccgagctggtgctgaccgaaggcccgaagggcatgaagggcgccattgccaaggctcaggaactggcagagaccctgcccgacgccgtcattccccaacaattcgaaaaccccgccaatccggatattcaccgcaggacaacggcggaagaaatctggaacgacaccgatggcacggtcgatatcctcgtttccgggatcggcaccggcggcacgatcaccggcacgggccaggttctgaaatcccgcaagcccgaagtgaaggtgattgcggtcgagcccgccgacagcccggttctttccggcggcaatcccggcccgcacaagattcagggcatcggcgccggctttgcacccgccattctcgacaccggcgtctatgatgaaatcgtcaccgtgaccaatgacgaggcatttgaaattgcgcgtctggcggcacggctcgaaggcgtgccggtcggcatctcctcgggtgcggcactggccgcggccatcaaggtcggcgcgcgtgaggaaaatgccggcaagaacatcgtcgtcatcattccttctttcgcagaacgttatctttcgaccgcgcttttcgaaggccttgggctttaa

SEQ ID NO: 24444 - protein, 322 aa, Agrobacterium tumefaciens
MPEARKPGRGRVYSSITETIGDTPIVRLDKLAKEKGVKANLLAKLEFFNPIGSVKDRIGVAMIEALEAQGKITPGKTTLVEPTSGNTGIALAFAAAAKGYKLILTMPETMSVERRKMLALLGAELVLTEGPKGMKGAIAKAQELAETLPDAVIPQQFENPANPDIHRRTTAEEIWNDTDGTVDILVSGIGTGGTITGTGQVLKSRKPEVKVIAVEPADSPVLSGGNPGPHKIQGIGAGFAPAILDTGVYDEIVTVTNDEAFEIARLAARLEGVPVGISSGAALAAAIKVGAREENAGKNIVVIIPSFAERYLSTALFEGLGL

SEQ ID NO: 24445 - DNA, 924 bp, Bacillus subtilis
  CDS (1)..(924)
atgacagtgattacggacattaccgagctgattgggaatacaccgcttctccgcttgaagaactttgatgttccagaaggagtcgcggtgtatgccaagcttgaaatgatgaatccagggggaagcatcaaagacagactgggagatatgctgattcgtgacgcgctcgattcaggcaaagtgaaacccggcggagtgattatagaagctacggcaggcaatacagggatcggccttgcgttaagtgccagaaaatatgggctgaaagcgattttctgtgtccctgaacatttcagcagagagaaacagcaaattatgcaagcgcttggcgcatcaatcattcatacaccgcgtcaagacggaatgcagggagccattcaaaaagccattcagctggagactgaaattgaaaattcttattgcgttttgcaatttaaaaaccgagtaaatccatcgacttactataagacgcttggacctgaaatgtgggaagcgcttgacgggaatattcatacatttgtcgcaggggcaggatcaggaggcacattcgcagggacagcttccttcttaaaagaaaaaaatccagcagtcaaaacggtgattgttgaaccggtgggctcgattttaaacggaggagagccccacgctcataaaacagagggcatcggcatggagtttatccccgattatatggataagagccattttgacgagatctacaccgtaacagatgagaatgcgtttagacttgtgaaagaagcggcagaaaaagaaggcctgctgatcggaagctcttcaggtgcagcgctttatgcggcattggaggaagcgaaaaaagcatccgctggaactaacattgtcacagtatttcctgacagcagcgatcgatatatcagcaaacaaatatacgaaggaggcatctga

SEQ ID NO: 24446 - protein, 307 aa, Bacillus subtilis
MTVITDITELIGNTPLLRLKNFDVPEGVAVYAKLEMMNPGGSIKDRLGDMLIRDALDSGKVKPGGVIIEATAGNTGIGLALSARKYGLKAIFCVPEHFSREKQQIMQALGASIIHTPRQDGMQGAIQKAIQLETEIENSYCVLQFKNRVNPSTYYKTLGPEMWEALDGNIHTFVAGAGSGGTFAGTASFLKEKNPAVKTVIVEPVGSILNGGEPHAHKTEGIGMEFIPDYMDKSHFDEIYTVTDENAFRLVKEAAEKEGLLIGSSSGAALYAALEEAKKASAGTNIVTVFPDSSDRYISKQIYEGGI

SEQ ID NO: 24447 - DNA, 936 bp, Bacillus subtilis
  CDS (1)..(936)
atgttgaaaatcgttgcaaacacagctgatctgataggagatacaccgctagtgagattgaatcggcttcagccggaaaatgcggcacaagtctatttaaagcttgaatttttcaatccgagcggcagtgtgaaagacagagccgcttatcaaatgatcatagaagctgaacaaaacggtttactcaagccgggatcagttattatagagccgacaagcggaaataccggcatcgggctcgccatgaatgcggcagcacgcggatataaagcaatcttagttatgcctgatacgatgacgaaggaacggatcaacctacttaaagcttacggtgcagaggttgtattaactcccggagaggaaagaatgccgggcagcatcaaaaaagcgaaggagcttgccgaacaaattccgaacagctatattccaatgcagttcgataacactgctaatcctgatgcgcaccgaaaaacaacagcgcctgaaatcgcccgggcaatagaggaaatcggaaaaccgctcggcgcttttgtagcctcctctggaacgggcggaaccattaccggaacaggtgaggcgctcaaagagctttttccggatatcacggttcatgttgttgagccagcgggttcgcctgtattatccggcggaaaacctggcgcgcataaacttgtaggaacgagcccaggctttataccgccgattttaaatgaagacgtttatgatgaaattatcaaaatctctgatgaagacgcgtatacgacgacaagacggcttgctgctgaagaaggaattcttgtcggtccttcatcaggcgctgcctgcttcgcggcaatcgaaacagcgaaacgcctctctcctgacaaagttgtggtctgcatgacagctgatacaggagaacggtacttatcaactgatttatggtcatttatttaa

SEQ ID NO: 24448 - protein, 311 aa, Bacillus subtilis
MLKIVANTADLIGDTPLVRLNRLQPENAAQVYLKLEFFNPSGSVKDRAAYQMIIEAEQNGLLKPGSVIIEPTSGNTGIGLAMNAAARGYKAILVMPDTMTKERINLLKAYGAEVVLTPGEERMPGSIKKAKELAEQIPNSYIPMQFDNTANPDAHRKTTAPEIARAIEEIGKPLGAFVASSGTGGTITGTGEALKELFPDITVHVVEPAGSPVLSGGKPGAHKLVGTSPGFIPPILNEDVYDEIIKISDEDAYTTTRRLAAEEGILVGPSSGAACFAAIETAKRLSPDKVVVCMTADTGERYLSTDLWSFI

SEQ ID NO: 24449 - DNA, 933 bp, Neisseria meningitidis
  CDS (1)..(933)
atgaaaattgcaaacagcatcaccgaactaatcggcaacacgcctttggtcaaactgaaccgtctgaccgaaggtttgaaggcggaggttgccgtgaaactggaatttttcaatccaggcagcagcgtcaaagaccgcattgccgaagcaatgatcgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaaggtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataa

SEQ ID NO: 24450 - protein, 310 aa, Neisseria meningitidis
MKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 24451 - DNA, 924 bp, Bacillus halodurans
  CDS (1)..(924)
atgagagtggcaaactccattaccgatttgatcggtcaaacgccgttagtaaaattaaatcgactcgtttctgacaaacatgccgatgtttacttaaagcttgaattttttaaccctggaagcagcgtaaaagatcgtattgcacttgcgatgattgaagctgcagaaaagtctggggctttaaagcctgatgatacaatcgttgagcctacttctggaaatactgggatcggccttgcgatggttgctgcggcaaaagggtataaaacaaaacttgtcatgcctgagacgatgagtttagagcgccggaacttgctgcgtgcatacggtgcagagcttgttctaactcctggccctgaaggaatgggaggagcgattcgtaaagcaacagagcttgcccaagaaaatgggtacttcatgccacaacaatttgaaaatgaagcgaacccagaaattcaccgtgaaacgacaggtcgtgagcttcttgagcaggtggacggtcagcttgatggcttcgtatctggaattggaacaggtggaacgattacaggtgcaggtggattgctaaaagaaaacttcccgaacttgcacattgcagctgttgagcctgcagattctccagtattatctggtggaaacccagggcctcataaaattcaaggaattggtgccggatttgtgccgaaaatccttgatacagacatctatgatgaagtcataaaagtttcaacagaacaagcatttgaatacgctcgtcgtgcagcgaaagaagaaggaatccttggaggaatttcttctggtgcagccatttatgcagcgttgcaagtggctgaaaagcttgggccaggtaaaaaagtagtagccgtcatcccatcaaatggagagcgctacttgagcacacctctttatcaatttgaggactaa

SEQ ID NO: 24452 - protein, 307 aa, Bacillus halodurans
MRVANSITDLIGQTPLVKLNRLVSDKHADVYLKLEFFNPGSSVKDRIALAMIEAAEKSGALKPDDTIVEPTSGNTGIGLAMVAAAKGYKTKLVMPETMSLERRNLLRAYGAELVLTPGPEGMGGAIRKATELAQENGYFMPQQFENEANPEIHRETTGRELLEQVDGQLDGFVSGIGTGGTITGAGGLLKENFPNLHIAAVEPADSPVLSGGNPGPHKIQGIGAGFVPKILDTDIYDEVIKVSTEQAFEYARRAAKEEGILGGISSGAAIYAALQVAEKLGPGKKVVAVIPSNGERYLSTPLYQFED

SEQ ID NO: 24453 - DNA, 1014 bp, Caenorhabditis elegans
  CDS (1)..(1014)
atgtcacgcgaattgatggttcatgatagtggagataccgttggaaacactccgctggtacttttgagaaatatcaccaagggattggatgccagaattgccgtcaaaatcgaatatctgaatccatcgtgctcagtgaaggaccgtatcgctaaaacgatggtggacgacgctgagaaagccgggaaaattgttccggggaagacggttctcgtggagggtaccagcggaaacttggggatcgcattggctcatattggaagaattcggggatacaaagtgattttggtgatgaccaccgccatgagcatcgagcgtcgggccatgctccgagcctacggagccgaagtgattctttcggatcctgccgaaggtcatccagggattgtgaagaaaatcgagatgctcgtcagcaaacttcccgatgcatattgcctcgatcagttctcaaacccctccaatccagccgctcactaccgtaccacgggtccagaaatttggaagcaaactcaagggaaagtggatatggtttgcttcggagtcggctcaggtgggacggttaccggagtcggaagatatcttcgtgctcaaaagcaaaatattggagtgtaccctgtggagccattcgagagctcggtgctgagtggattcccgagaggtccacataagattcatggaatcggcgccggattgattcccgggaacgtggatcgctccctcttcactgaagtctttcgtgtcaaatctgaagatgctatgaaaatggctcgccggctcgccgacgaggaagcgattctcggtggaatctcatctggagcgaatgtggtcgctgccgtcgaactggcacgtcgtccggaaaacattggaaaattgattgtgaccactgtgaatagttttgctgagagatatttctccaccgaactctactcaacactgctcagcgaggtgtccaaactgccaatatcgacagatgagcaagctgtggaaattgcgaaaaagtacttgggactgtaa

SEQ ID NO: 24454 - protein, 337 aa, Caenorhabditis elegans
MSRELMVHDSGDTVGNTPLVLLRNITKGLDARIAVKIEYLNPSCSVKDRIAKTMVDDAEKAGKIVPGKTVLVEGTSGNLGIALAHIGRIRGYKVILVMTTAMSIERRAMLRAYGAEVILSDPAEGHPGIVKKIEMLVSKLPDAYCLDQFSNPSNPAAHYRTTGPEIWKQTQGKVDMVCFGVGSGGTVTGVGRYLRAQKQNIGVYPVEPFESSVLSGFPRGPHKIHGIGAGLIPGNVDRSLFTEVFRVKSEDAMKMARRLADEEAILGGISSGANVVAAVELARRPENIGKLIVTTVNSFAERYFSTELYSTLLSEVSKLPISTDEQAVEIAKKYLGL

SEQ ID NO: 24455 - DNA, 912 bp, Clostridium acetobutylicum
  CDS (1)..(912)
atgaactatatagacgacattagacaaattataggaaacactcctataataaaaatcaataactttggattaaatagtggagtgaatatttttgctaagcttgaattattgaatccaggaggcagtgtaaaagatagagtaggcgtttatatgatagaggatgcagaaaagaagggaaaactaaaaaaaggttataccatagttgaaggcacagcgggtaatacaggtataggaatagcacttgcagctataaacaaagggtataatgtaatctttgttgtacctgagaagttttctatagaaaagcagacgcttatgaaagcatttggtgcaaaaattataaatacgcctagagaggaaggaatgcagggagcagttaagaaggcaaatgagcttttgagtaccatacctaattctataagtcttggtcaattcgtaaaccaagcaaatccattggcacactatgaaactacaggacctgagatttatagagatcttgaaggcaacattgattatgtagttgcaggtgctggtagtggaggaacctatgctggtgtattaaagtttttaaaagagaaaaaaccaaatataaagggtgtacttgctgatcctgaaggttctaccatgggtggaggagaggaagctagctatgatatcgaaggtataggaaatgattttattccagataccatggatatgaatcttgtagatgaagttattaaggttaatgatgctgaggcttttcatatggtaaggcaacttgcccttaaagaaggactgatagttggaagttcatctggtgcagctatggcagcagcaattaaattaagtaaaaagattaaaagtggtaatatagttactatctttccagatagaggtgacaggtattttagtaaaaatattttaggatag

SEQ ID NO: 24456 - protein, 303 aa, Clostridium acetobutylicum
MNYIDDIRQIIGNTPIIKINNFGLNSGVNIFAKLELLNPGGSVKDRVGVYMIEDAEKKGKLKKGYTIVEGTAGNTGIGIALAAINKGYNVIFVVPEKFSIEKQTLMKAFGAKIINTPREEGMQGAVKKANELLSTIPNSISLGQFVNQANPLAHYETTGPEIYRDLEGNIDYVVAGAGSGGTYAGVLKFLKEKKPNIKGVLADPEGSTMGGGEEASYDIEGIGNDFIPDTMDMNLVDEVIKVNDAEAFHMVRQLALKEGLIVGSSSGAAMAAAIKLSKKIKSGNIVTIFPDRGDRYFSKNILG

SEQ ID NO: 24457 - DNA, 1128 bp, Campylobacter jejuni
  CDS (105)..(1004)
gccttctttcttaattgatccagatattttgtaccttttatttactttatttttttaaacttttataaaactatcattattaaacaaaaaaggatattaaaattatgaaagtacatgaaaaagtaagtgagcttataggaaatactcctattatacatttgaaaaaatttggtatcaatgtttttgctaaatgtgaatttttaaatcctagtcattctataaaagatagagcagcttttgaaatgattaaagatgctttagatagtaaaaaaattaatcaagatactacaatagttgaagcaactagtggaaataccggaatttctttggctatgatttgtgcagatttgggacttaaatttgttgctgtaatgcctgaatctatgagtttagaaagaaaaaaaatgataacactctttggcgctaggttagaattaactcctgcaaatttaggaatgaaaggagcggttgataaagcaaatgaaatattattaaatactccaaattcttttatggtttctcaatttgaaaatatttcaaataaaaatgcgcatcgtaagaatacggctttagaaattttaagagatttggataatgaacttgatatttttgtagctggttttggaactggcggtactattagtggagttggggaaatactaaaagaaaaattagaaaaagtgcatattgttggagtcgagcctctaaattctccattgcttagcaaaggtgaagcgggaagccataaaatacaaggaataggggcgaattttatacctgctattttaaataaagaagttatagatcaagtgatcacagtaagtaatgaagatgctataaatacagccaaagaacttgccaaaattggtttaatggtaggtatatcaagtggagcaaatgtatttgccgcaagtatgctagcaaagaaatttccagataaaagaattttaactatgctaaacgatacggctgaaagatacctctcaactgatctttttgcttaagtataattattgagaatttagaaaaattctaagttctcttaaaatttcttgtggatttaaatcgctaatttctttataaaaatgacctttttcatcaataagataaagcatattgctatgtgct

SEQ ID NO: 24458 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFVAVMPESMSLERKKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDQVITVSNEDAINTAKELAKIGLMVGISSGANVFAASMLAKKFPDKRILTMLNDTAERYLSTDLFA

SEQ ID NO: 24459 - DNA, 1371 bp, Triticum aestivum (common wheat)
  CDS (72)..(1049)
gcggccgccacttcgtccagctccagctccgggaggatcacttggctgtcgaatcgctcgtcgacggcgggatgggggaggcgtcatctccggcgatcgccaaggatgtcaccgagctgatcgggaacacgccgttggtgtacctcaacaaggtgaccgacgggtgcgtggggcgcgtcgccgccaagctcgagtccatggagccctgctccagcgtcaaggacaggattggatacagcatgatcaccgacgcggaggagaaggggttcatcgtcccaggcaagagtgtgctgattgagccaaccagtggcaacacaggcattgggctggccttcatggctgctgcgaagggttacagacttgtactcacaatgcccgcctccatgagtatggagaggagaatcatcttgaaggcttttggtgctgagctgatcctcaccgacccactcttgggaatgaaaggagctgtccaaaaggcagaagagctggcagcaaagacacccaactcatacatccttcagcagtttgagaatgctgccaacccaaagattcattatgagacaactgggcctgaaatctggaaaggcacaggaggaaagatcgatggccttgtttctggcatcgggacaggtggtaccattactggaactggaaaatacctccaagagcaaaatcctaacatcaagctctacggtgtggagcctaccgagagtgctatcttaaatggtggaaagcctggaccacacaagatccaaggaattggagctggttttatccctggtgtcttggatgttgacatcattgatgaaaccatacaggtttcaagtgatgagtccattgagatggcaaagtctctggcattgaaagaaggattgctggttggaatctcttctggtgctgctgcagcagctgcaatcaaggttgctcagaggcctgaaaatgcagggaaactctttgttgttgtattcccaagcttcggagagcgctacctttcgtcggtgctcttccactccatcaagaaggaggccgagagcatggtggtcgagtgactctcgggactcctcaagcgcgcgaacgtgttctccaaagccaaatccctacattcgtaggagccctcctacagaaataaaagctttggcgtccctgctagtgttggtctgacatcaagtcctgtcaagttttaatcccactttgtttagcaatggggaatacttttgtgttggccttgtggtgtttagcgatttgaattacctcttgcatgccctgtatattgaactcctctgtggtccatatgtcagccagtgtgaaatgaaacatcatggtgccatgtaaataaatagatatacagataggtttccctcaaaaaaaaaa

SEQ ID NO: 24460 - protein, 325 aa, Triticum aestivum (common wheat)
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELILTDPLLGMKGAVQKAEELAAKTPNSYILQQFENAANPKIHYETTGPEIWKGTGGKIDGLVSGIGTGGTITGTGKYLQEQNPNIKLYGVEPTESAILNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAESMVVE

SEQ ID NO: 24461 - DNA, 1351 bp, Salmonella typhimurium
  CDS (423)..(1334)
ccgcggcgggcagtttcacgttggcgcgcatcgctggccgctgggttatacgcccgcgtaccaggggccggtcgatctgttcctgcgtccgtgggaggtggatattagccgccgcaccagcctggattctcctctaccagtacaggtcattagccagcccgaaagtcactatacacagttagtggtacagccgctggggtggtatcacgatccgctgacggtggtgatggcgggtgaggatgttccggttcgcggcgagcgtttgtttgttggactgcaaaaagcgcgtctgtataacggcgaccagcgtattgaaacgcgtgaagaggaacttgctctggcgcaatcggcctgataggttaatttgtatagttatcgctcggtggcgctacgcataccgggcttttttacgagctgaaaacatgaatacattagaacaaaccatcggcaatacgccgctggtcaaattacaacgtctggggccggataacggcagtgaaatctgggtcaagctggaaggcaataatccggcaggatcggtgaaagatcgcgcggcgctatcgatgattgtcgaggcggaaaagcgcggggaaattaaaccgggcgatgtcctgattgaagcgaccagcggcaacactggcattgcgctggcgatgatcgccgcgctgaaaggttatcgcatgaagctgttgatgccagacaacatgagtcaggagcgtcgggcggcaatgcgggcctatggcgcggaactgattctggtcactaaagagcagggaatggaaggggcgcgcgatttagcgctcgctatgtctgaacgaggcgagggcaaactgctcgatcagtttaataatcctgataatccctacgcccactacacgaccaccggcccggaaatctggcggcaaacgtcaggtcgcatcacccattttgtctccagcatgggcacgaccggcaccattaccggcgtgtcgcgttttctgcgcgagcaggaaaaaccggtcaccatcgttggcctacagccggaagagggcagcagtattccgggcattcgacgctggcctgcggaatatatgccgggcatttttaacgcctcgctggtagatgaggtgctggatattcatcagaatgatgccgaaaacaccatgcgtgaactggccgttcgtgaaggcattttctgcggcgtgagttccggcggcgcggtagcgggcgcgttacgggtcgcacgagccacgcccggcgcgatagtggtggcgatcatctgcgatcgcggcgaccgttacctttcgaccggcgtgtttggtgaagagcatttcagccagggggcagggatttaaactaatgagttcagctg

SEQ ID NO: 24462 - protein, 303 aa, Salmonella typhimurium
MNTLEQTIGNTPLVKLQRLGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 24463 - DNA, 1432 bp, Spinacia oleracea (spinach)
  CDS (54)..(1205)
atacattgcagattacacacatacaggtacagagaggagagagaaagttggctatggcttcattggtcaacaacgcatacgctgcgcttcgcacctccaaattggagctccgagaagttaagaatcttgccaatttccgagttggacctccatcatcgctcagctgcaacaatttcaagaaggtttcttcttctccaatcacctgcaaagctgtgtctctttcgcctccatccaccattgaaggccttaacattgctgaagatgtttctcagctaattggaaaaaccccaatggtgtatctcaacaatgtatcaaaaggatcagttgcaaacattgctgcgaagcttgagagcatggaaccttgctgcagtgtcaaggacaggattggctacagtatgattgatgatgctgagcagaaaggagttatcacacctggaaagactactctagtggagcctacgagtgggaatactggaataggacttgcctttatagctgctgccagaggatacaagattaccttgacaatgccagcttccatgagtatggaaaggagagttatcttgaaagcatttggagctgagttggtcctgactgatccagctaagggaatgaaaggagcagttgagaaggctgaagaaattttgaagaaaactcctgattcctacatgcttcagcagtttgacaatcctgcaaatcccaagatacattacgagacaacaggtcccgagatctgggaagacacaaaaggcaaagtggacatttttgttgcaggcattggaactggaggaacgatttctggagttggacggtacctcaaagaacgtaaccctggtgtgcaggtaattggtatagaacctacagaaagcaacatactttctggtggaaagcctggtccacacaagattcaaggacttggagctggttttgttcccagcaatttagatttgggtgtgatggatgaagttatagaggtatctagtgaagaagctgtagaaatggcaaagcaattggcaatgaaagaaggcttgttggttggcatttcatctggacgacgagcagctgctgcagtcaggattggtaaaagacctgaaaatgcaggaaaacttattgctgttgtgttcccaagctttggtgagagatacctgtcatccattttgttccagtctattcgagaagagtgtgaaaacatgaagccagaatagtgaggagtcatttcttggatattcttggcgggggcacattgttagatttttcaggttgtgcctcttgcttgcttgtcgcgttctttagagccaagaatggtttatgttttctcaatttatttgttgacatgaaatgagcaataaaattatgcatgtagatcagaacagcacatgatgatttttaacaaattttcctaatattactttggcttactcaaaaaaaaaaa

SEQ ID NO: 24464 - protein, 383 aa, Spinacia oleracea (spinach)
MASLVNNAYAALRTSKLELREVKNLANFRVGPPSSLSCNNFKKVSSSPITCKAVSLSPPSTIEGLNIAEDVSQLIGKTPMVYLNNVSKGSVANIAAKLESMEPCCSVKDRIGYSMIDDAEQKGVITPGKTTLVEPTSGNTGIGLAFIAAARGYKITLTMPASMSMERRVILKAFGAELVLTDPAKGMKGAVEKAEEILKKTPDSYMLQQFDNPANPKIHYETTGPEIWEDTKGKVDIFVAGIGTGGTISGVGRYLKERNPGVQVIGIEPTESNILSGGKPGPHKIQGLGAGFVPSNLDLGVMDEVIEVSSEEAVEMAKQLAMKEGLLVGISSGRRAAAAVRIGKRPENAGKLIAVVFPSFGERYLSSILFQSIREECENMKPE

SEQ ID NO: 24465 - DNA, 1281 bp, Spinacia oleracea (spinach)
  CDS (52)..(1029)
tcagtctcgattcttctcagatttctatctcttttaagtatataacccaaaatggttgaggagaaggccttcattgctaaagatgtgactgaattgattgggaaaacgccattggtatatctcaacactgtcgccgatggttgtgttgctcgtgttgctgcaaagctggaaggaatggaaccttgctctagtgttaaagacaggattgggttcagtatgattactgatgctgaaaaaagcgggcttattacacctggagagagtgtcctgattgagcccaccagtggaaatactggcattggattagccttcatcgcagcagctaaaggttacaagctcatcattacgatgccagcatcaatgagtcttgagcggaggactattctcagggcctttggtgctgagcttatccttactgatccagcaaaaggtatgaaaggggctgttcagaaggctgaggagatccgtgacaaaactcctaattcatatatactacaacagtttgaaaaccctgccaacccaaaggttcattatgaaacaactggaccagaaatttggaaaggcacaggtggaaaaattgatatattcgtctctggaatagggactggaggtacaataacaggtgcaggaaaatacctaaaggaacaaaacccggatgttaagctaattggcctggaaccagtggaaagtgctgtattgtctggaggaaaacctggcccacataagattcaaggacttggagctggattcatacctggtgttctggatgtgaatattatcgatgaagtggttcagatatccagtgaagaatctattgaaatggccaaattgctcgccctcaaggaaggtctactggttgggatttcatctggtgctgctgctgccgctgccattaaagtggcaaagaggcctgaaaatgctggaaaactcatcgtcgctgtctttcccagctttggcgaacgatatttatcctcggtgttgtttgattcagtgaggaaggaggcagagagcatggttattgagtcctaagttcgagttctcctttaatggtcttggatacttcacaggctttggtcttttcatgtggtctaaatcctagttttcttctgttttccttttcttttctcgtagacatgcaaatcgtggcccttctgtattagaacaatgtcagttgtgtccttgatgtttggtcatcatgcactggcaactatggtttgtgatgtataaaatactctttcatgttcttccattacatattgttgatgagggatttcatgtgat

SEQ ID NO: 24466 - protein, 325 aa, Spinacia oleracea (spinach) [sequence omitted]

SEQ ID NO: 24467 - DNA, 1855 bp, Citrullus lanatus (watermelon)
  CDS (564)..(1541)
tattctttttctctccttctctttccccgttcttcctctctcgccgatctctccctctttctcctttctccctctcctcttccgcctcacgcccgcacaatcctcccccaactacgatctgcttccgatcggccagccccactagcgacttggcttcggcagcgcctcccagacgagcggcggacccggcggtgcagcggcaagaaccgactagcgcgacttccggcgaaaatctgtagtgagcggcggcgtccggcacagatctgaagtagatcctcgaacttcgacgatccgcagcagccgccgacgacccagcagccaccagcgacgacgacgacaacggaaggtcggagcaggcgcaacctcgacgcgaaaccacgtgtttcgtcaagtttcagcagcgttttccctcatacagcgttcggacactaatcgacgaggttttgggacgtttgactaagttttagtggggagctattcgaacacgtggcagcaagggaaacagtctatttcggcattcggatcgaggttaaggtcgcttatctgcatagttgttgctcaaaatggctgatgcaaagtctacaatagctaaagatgttactgaactaattgggaatacaccacttgtatacctcaaccgtgttgttgatggctgcgtggctcgggtagctgccaagttggagatgatggagccttgctccagtgtcaaagataggattggctatagcatgatttcagatgcagaaaacaagggtcttatcactccgggggagagtgtcttgattgaacctaccagtggtaatactggtataggcttggccttcattgctgctgccaagggttatagacttataatttgcatgcctgcatcaatgagtcttgaaagaagaaccattcttcgagctttcggagctgaactggttctcacagatccagctcgggggatgaaaggagcagttcaaaaggctgaagagataaaggcaaaaacacctaattcttacatccttcagcaatttgaaaaccctgctaacccgaagatccactatgagaccactggtccagagatctggaggggctcaggtggaaagattgacgcacttgtctctggtatagggactggaggtacagtgacaggtgcagggaagtatctcaaagaacaaaatcctaatattaagttatatggcgttgaacctgttgaaagtgcaattctatctggaggaaagcctggcccacataaaatccaaggaattggggcaggcttcatccctggagttttggatgtcaatttgctagatgaagttattcaagtatcaagtgaagaatctattgaaactgcaaagctgcttgcattgaaagaaggtctactggttggtatatcatctggcgcggccgcggctgctgcaattaggattgcaaagagaccagaaaatgctggaaagcttattgttgcggtattcccgagttttggggaacgatacctctcaaccgtgctgttcgagtctgtgaaacgagagactgagaatatggttttcgagccatgagaggtttatgtaatattttcttgcttcaaatggagagccagccagttgaacctgcaaatttcccatgagtcaaagcaaagaaagaaagtgaacttcaagcggttctttttagctttcgatgcttttgcttatacctgtagtgatttgaataacttgtttccttaatagcttctttcgtttatggtttgctcagttttagtggataaacacagatgcagctgagaataaggatagtctttcatgtattcccttctgtcgaataatgtatggaatgagtagtttctctgtgaaatggttttgaagatgaaaaaaaa

SEQ ID NO: 24468 - protein, 325 aa, Citrullus lanatus (watermelon)
MADAKSTIAKDVTELIGNTPLVYLNRVVDGCVARVAAKLEMMEPCSSVKDRIGYSMISDAENKGLITPGESVLIEPTSGNTGIGLAFIAAAKGYRLIICMPASMSLERRTILRAFGAELVLTDPARGMKGAVQKAEEIKAKTPNSYILQQFENPANPKIHYETTGPEIWRGSGGKIDALVSGIGTGGTVTGAGKYLKEQNPNIKLYGVEPVESAILSGGKPGPHKIQGIGAGFIPGVLDVNLLDEVIQVSSEESIETAKLLALKEGLLVGISSGAAAAAAIRIAKRPENAGKLIVAVFPSFGERYLSTVLFESVKRETENMVFEP

SEQ ID NO: 24469 - DNA, 1278 bp, Arabidopsis thaliana (mouse-ear cress)
  CDS (87)..(1061)
gaattcgcacgagcgattttctccattttcttcaaaacgattcgggtcaaggttattgactttcctcattcagtgaagcttgaatcatggcctcgagaattgctaaagatgtgactgaattgattgggaacactccattggtgtatttgaacaatgttagcctgaagggatgtgttggtcgtgttgctgctaagcttgagatgatggaaccgtgctctagcgtcagcgtcaaagacaggattggttttagcatgatttctgatgcagaaaagaagggtcttatcaaacaaggagagagtgtgctgattgagccaacaagtggaaacactggagagttgctgttagcattcacggcagcctgcaaaggctacaagcttattattacaatgccagcttctatgagtactgagagaagaatcattctcttagcctttggagttgaagttgttttaactgacccagctaagggcatgaaaggaagctatcgcaaagcgcaagagattttggccaaaacacccaatggttacatgcttcagcagtttgagaacccggccaacccagaaatccactatgagccgacgggacctgagatatggaaaggcactggtgctaaaatcgatggctttgtttctgggattggtactggtggtaccattacaggtgctgggaagtatcttaaagaacagaacccaaacttcaagctgtatggagtggagccagttgaaagtgctattctatccggtgggaagccaggccctaccaagattcaagggataggagctggttttataccaagtgtattgaatgttgatcttattgacgaagttgttcaggtttcaagtgatgaatccattgacatggcaaggcagcttgctcttaaagaaggtcttcttgtgggaatatcatccggcgctgctgcagcaattaaacttgcacagaggccagaaaacgctgggaagctatttgtggccatattcccgagtttcgggagaaggtatctatcaacgtaccttttcgatgccgacaaggaaagaagtcggaacatgccttcaaggccttgaacattctccatttcttcttaagagacgcaaaataaaagagatgttcagtttctcctatagagactcttcatctttagttacattggcgtctttgcttccatctgtatcttctcttgtgtgccaataaaaggttcaaactagattttctctgtttcttttgtgaaccacttgcttgttaatgaagtttaaatttgctaaaaaaaaaaaaaaaaaaaaa

SEQ ID NO: 24470 - protein, 324 aa, Arabidopsis thaliana (mouse-ear cress)
MASRIAKDVTELIGNTPLVYLNNVSLKGCVGRVAAKLEMMEPCSSVSVKDRIGFSMISDAEKKGLIKQGESVLIEPTSGNTGELLLAFTAACKGYKLIITMPASMSTERRIILLAFGVEVVLTDPAKGMKGSYRKAQEILAKTPNGYMLQQFENPANPEIHYEPTGPEIWKGTGAKIDGFVSGIGTGGTITGAGKYLKEQNPNFKLYGVEPVESAILSGGKPGPTKIQGIGAGFIPSVLNVDLIDEVVQVSSDESIDMARQLALKEGLLVGISSGAAAAIKLAQRPENAGKLFVAIFPSFGRRYLSTYLFDADKERSRNMPSRP

SEQ ID NO: 24471 - DNA, 1319 bp, Zea mays (maize)
  CDS (73)..(1050)
gcacgaggagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcagtcgcgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcttgggaatgaaaggagctgtcaagaaagcggaagagatacaagcaaagacacccaactcgtacattcttcaacaatttgaaaatccagctaacccaaagattcactatgagactactgggcctgaaatctggaaagctacagcaggaaaaattgatggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgaaactctacaggtttcaagtgatgaagctatcgagactgccaaggctcttgctctgaaagaagggttgttggttggaatctcttctggtgcagctgcagctgcggcagttaggcttgctaagaggccagaaaacgccggaaagctatttgttgtcgtgttcccgagcttcggcgagcgctacctctcatcggtgctgttccagtccatcaagaaggaagcggagagcatggtggtcgagccctagagcacaaaattctggctctggcaaactatttcctgagacgttcaccatttccatcacagaaaaataaagctcgggtgccttctgttgatttcgacgtacatttccctgccgatggtgtccagcccactgttgtcgctggagaacacgtcgtttttagacttgtgatattttactactgttttgacactcgttgtatttctgtatatcgcgtcagactgtgaaataaaagcagtacagtgtgtttcttgcaaaaaaaaaaaaaaaaaaaa

SEQ ID NO: 24472 - protein, 325 aa, Zea mays (maize)
MGEASPSIAKDVTELIGNTPLVYLNKVTDGCVGRSRAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 24473 - DNA, 990 bp, Synechococcus sp
  CDS (1)..(990)
atgagtacttctggaaccttttttgctgataatagccaaaccatcggcaagacccctttggttcgccttaatcgaattgtgaaaggggctcctgcaacagttttggcgaaaattgaagggcgtaatcccgcctattccgttaaatgtcggattggtgcagccatgatttgggatgcagagcagcgaggcttgctcggccccggtaaggaattgattgaacccactagtggtaataccggcattgccttagcgtttgtggccgcagcgcgggggattccactcaccctgacgatgccagaaacgatgagcttggaacgtcgcaagttgctggcggcctatggggccaagttggtgctgaccgaaggcgtcaagggcatgaccggagccgtgcggcgagccgaagacattgcggcctcagatcctgatcgctatgtgttgctgcagcagttccgtaacccggccaatccagcgattcatgagcagacgacagggccagaaatttgggaggacactggcggcgcgatcgatattttggtttccggcgttggcacaggtggcacgattacgggcgtctcgcgctacatcaagcaaacccaaggcaagcccattctgtctgtagcagtggaacctgaagccagtccggtgattagccaacagcgatcggggttgccgctgaaaccagggccgcacaagattcaaggcattggggcagggttcatccctgaaaacctggatctgtcgctggtcgatcaggtagagcgagtttccaatgaagaagcgatcgcctatgcccggcgccttgctcaagaggaaggactgatttcggggatttcctgtggtgctgccgtggcagcggcagttcggctagcccagcaatcagaacatgcgggcaaaacgatcgtggtagtgttgcccgattccggtgagcgctatctcagtacggctttgttcgacggcattttcaatgagcaggggctggccgttgtatga

SEQ ID NO: 24474 - protein, 329 aa, Synechococcus sp
MSTSGTFFADNSQTIGKTPLVRLNRIVKGAPATVLAKIEGRNPAYSVKCRIGAAMIWDAEQRGLLGPGKELIEPTSGNTGIALAFVAAARGIPLTLTMPETMSLERRKLLAAYGAKLVLTEGVKGMTGAVRRAEDIAASDPDRYVLLQQFRNPANPAIHEQTTGPEIWEDTGGAIDILVSGVGTGGTITGVSRYIKQTQGKPILSVAVEPEASPVISQQRSGLPLKPGPHKIQGIGAGFIPENLDLSLVDQVERVSNEEAIAYARRLAQEEGLISGISCGAAVAAAVRLAQQSEHAGKTIVVVLPDSGERYLSTALFDGIFNEQGLAVV

SEQ ID NO: 24475 - DNA, 1775 bp, Flavobacterium sp
  CDS (509)..(1432)
caaactacgtggggatattttgcaacttatgtttacagaatttcccatcaactctggaaccaggaaattccggttttaccccgtgttatttcagaatatgcacacagcaaaactggaatagacattcatcccggcgcaataatcgggaatactttttcatcgatcatggaaccggaattgtcatcggagaaaccaccatcattggcgatcatgtcaaaatataccagggagtaacccttggtgccttgaatgtctccaaagaaaaagccaaccagaaaagacatcctaatattgaggaccatgtcattattattcgggagcaccattttagggtggaaaacaccataggcagggacagtattattaggtggaattgtgtgggattacacagggtgtaccacccaattcacttggtctataaccaaaagcgagataagaataaaggataacaaatccgttaccggaaccattaacctttgtaatataaaaacaaaaaaattgtattgatatgaaatttcagaacgcactagaaaccattggaaatacaccagtcgtaaagatcaataacttattcaattcagaccatgaaatctggattaaattggaaaaaagcaacccaggcggaagcatcaaggacagaattgccttagccatgattgaagatgcggaagctaaaggattattaaataaagacagtaccatcattgaacctaccagtggaaataccggaataggattggcattggtagctgcagtaaaaggatataagcttattctggtaatgccggaaagcatgagtatagaacgtcgtaaaatcatggaagcctatggtgctgaatttgtgcttacgccaagagaaaaaggaatgaaaggagctatcgaaaaagctaatgaattagcagaagaaactcccaattcatggattccaagacagtttgataatcctgctaacgtaaaaatacacgtagaaactacagcacaggaaattctacaagatttcccggaaggtttggattatgtgattaccggagtaggaaccggcggacatatcacaggaattgctaaagcattaaaggaaaaatatcctaaccttaaagtgattgcagtagagccggaattatctcctgtattaagcggcggaagtcctgcaccacatccattgcaaggtttaggagctggttttgttccttccatattagatattacccttttagatggagtgattacagtagggaaggatgaagcgtatgaatatgccatcaacgctgctaaaaaagaaggacttttttgtgggagtttccacaggagccgccttagccgctatcgcaaaacatttaccggaaatacagcctggagcaaaaattccttaccattaattacgacaccggagaaaggtatctttctcttgagggactcttctaaaatcctttaactaacaccgatttcaatgaatccaactataaaatcacctaaggtttaccttatcggtgcagggcccggcaaccctgatttgatcacagtaaaagccgtaaaagccatcgccaaagcagatgttgttctggcagaccgcctcgtaagtcctgagattttagaagcttacgtaaacaaaaacacagagcttatttatgtaggcaaagaatgcagcaaaaatgcatctacacctcagtctcttatcaatactttaatggttgattatgctttgcagaacaaaaccgttgtaagacttaaaggcggagatgtttctattttctctaatattctggatgaattacagg

SEQ ID NO: 24476 - protein, 307 aa, Flavobacterium sp
MKFQNALETIGNTPVVKINNLFNSDHEIWIKLEKSNPGGSIKDRIALAMIEDAEAKGLLNKDSTIIEPTSGNTGIGLALVAAVKGYKLILVMPESMSIERRKIMEAYGAEFVLTPREKGMKGAIEKANELAEETPNSWIPRQFDNPANVKIHVETTAQEILQDFPEGLDYVITGVGTGGHITGIAKALKEKYPNLKVIAVEPELSPVLSGGSPAPHPLQGLGAGFVPSILDITLLDGVITVGKDEAYEYAINAAKKEGLFCGSFHRSRLSRYRKTFTGNTAWSKNSLPLITTPEKGIFLLRDSSKIL

SEQ ID NO: 24477 - DNA, 927 bp, Bacillus subtilis
  CDS (1)..(927)
atggtacgtgtagcaaactccattactgaattaattgggaatacgccaatcgttaaattaaatcgccttgcagatgaaaacagtgcggatgtatatctaaaacttgaatacatgaaccctggaagcagtgtaaaagaccgtatcggtttagctatgattgaagcggctgaaaaagaaggaaaattaaaagccggtaatacaatcattgaaccgacaagcggaaatactggaatcgggcttgcaatggttgctgctgctaaaggattaaaagccattttggttatgcctgatacaatgagcatggagcgccgcaaccttcttcgcgcatatggtgctgagcttgtgctgactcctggtgcggaaggcatgaaaggtgctattaagaaagctgaagagcttgctgaaaagcacggatactttgtgccgcagcagtttaacaacccttctaaccccgaaattcaccgccaaacaacgggtaaagaaatcgttgagcaattcggtgatgatcagcttgacgcatttgtagccggaatcggaacgggcggaacgattacgggagcgggcgaagtgctgaaggaagcatacccttccatcaagatttatgctgttgaaccgtcagattccccagtgctttcaggaggaaaaccaggcccccacaaaattcagggaatcggagcaggattcgtgccggacatcttaaacactgaagtatatgatgaaatcttccctgtgaagaatgaagaagcattcgaatatgcccgcagagctgcacgtgaagaaggaattctcggaggcatctcatcaggtgcggcaatttatgctgctcttcaagtagcaaaaaaactcggaaaaggcaaaaaagtattggccatcattccaagtaacggcgaacgttatctaagcacgccgctgtaccaattcgattaa

SEQ ID NO: 24478 - protein, 308 aa, Bacillus subtilis
MVRVANSITELIGNTPIVKLNRLADENSADVYLKLEYMNPGSSVKDRIGLAMIEAAEKEGKLKAGNTIIEPTSGNTGIGLAMVAAAKGLKAILVMPDTMSMERRNLLRAYGAELVLTPGAEGMKGAIKKAEELAEKHGYFVPQQFNNPSNPEIHRQTTGKEIVEQFGDDQLDAFVAGIGTGGTITGAGEVLKEAYPSIKIYAVEPSDSPVLSGGKPGPHKIQGIGAGFVPDILNTEVYDEIFPVKNEEAFEYARRAAREEGILGGISSGAAIYAALQVAKKLGKGKKVLAIIPSNGERYLSTPLYQFD

SEQ ID NO: 24479 - DNA, 978 bp, Synechocystis sp
  CDS (1)..(978)
atggatattaagcacggctttgtggactccattggccacacccccttgattcgccttaacagtttcagtgacgaaaccggctgtgaaattttaggcaaagcagaatttatgaaccctggtggttctgtcaaagaccgggccgccctgggcatcatcgaaaccgccgaaaaggaagggaagctcaaacccggtggcactgtggtggaaggcacagcgggtaatacgggcattggtctcgcccacatttgcaacgccaagggttataaatgcttaattgtcattcccgacacccaatcccaggaaaaaattgatttgctccgcaccctgggggcagaagtcaggaccgtgcccgccgtgccctaccgggatcccaacaattacgtcaaactctccggacgcattgccgcagaattagataacgccatttgggccaatcaatttgataatttggccaaccgtgatgcccactaccacaccaccggccccgaaatttggcaacaaacggacggcaaagtagatgcttgggtggcagccactggcaccggaggaacctatgcaggggtagccctgtatcttaaagaacagtctgaggccgtgcaatgcgtggtggcggaccccatgggtagtgggctgtatagcttcatcaaaactggggagattaaccccagcggcaactccatcaccgaaggcattggcaacagtcgcatcaccgccaacatggaaaatgtgcccattgacgatgcggtgcaaattgacgatccagaagcgttgcgggtggtgtaccaacttctgcggcgggatggcctatttatgggcggttccgtgggcattaatgtgggagcggcttaccaattggccaaaaaacttgggccggggcataccattgttaccgtactttgtgacggaggagcccgttaccaatcccgtctttacaatcaggaatggttgaccagtaaaggtttaacaattcccgattaa

SEQ ID NO: 24480 - protein, 325 aa, Synechocystis sp
MDIKHGFVDSIGHTPLIRLNSFSDETGCEILGKAEFMNPGGSVKDRAALGIIETAEKEGKLKPGGTVVEGTAGNTGIGLAHICNAKGYKCLIVIPDTQSQEKIDLLRTLGAEVRTVPAVPYRDPNNYVKLSGRIAAELDNAIWANQFDNLANRDAHYHTTGPEIWQQTDGKVDAWVAATGTGGTYAGVALYLKEQSEAVQCVVADPMGSGLYSFIKTGEINPSGNSITEGIGNSRITANMENVPIDDAVQIDDPEALRVVYQLLRRDGLFMGGSVGINVGAAYQLAKKLGPGHTIVTVLCDGGARYQSRLYNQEWLTSKGLTIPD

SEQ ID NO: 24481 - DNA, 996 bp, Synechocystis sp
  CDS (1)..(996)
atggggtttttcgttgtaagatgcaggcagatttcccttcttggtgggcccttacctatgaaaattgccagtaatattacagagctaattggtcgtactcctctggttcgcctcaatcgcattcccctattggagggatgtggggccaagattgtagtcaagttggaggggatgaatccagcggcttcggtaaaggaccgcattggcattaatatgattaaccgggcagaacaagagggattaattgaaccagggaagactctgctgattgagcccacttctggtaatacgggcattgcccttgccatggtggccgcagccaagggttaccaattaattttgacgatgcctgaaaccatgagccaagaacggcgggcgatgttaaaagcctatggagcaaaactagaactgaccccggggagtgaagggatggggggatgtattagaagagcccaagaattggctgagagtttgccaaatgcctatatgttgcaacagtttgataatccggctaatcctcaaattcatcaacagactacggcattggaaatttggcaagataccgatggagccattgatttcctcgtggcgggggttggcactggtgggactattaccggggtggcttctgtgttaaaagaaaaaaaacctagctttcaggcgatcgccgtagaaccccaaaatagcccagtcttatcagggggtaagccggggccgcataaaattcaaggtattggggcgggctttattcccgaagtgttagatgtaaacctgattgacgaagtgattgccgtgaccgatgaagaggcgatcgcctacggtcgtagattagccagggaagaaggaatattatcggggatttccactggagcagctctggcggcggccatcaaagtggcaaaaagacctgccaataaagataaattgattgtcatgatccaacccagttttggggaaagatacctcagcacccccctatttcaggatttggagtaa

SEQ ID NO: 24482 - protein, 331 aa, Synechocystis sp
MGFFVVRCRQISLLGGPLPMKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 24483 - DNA, 912 bp, Escherichia coli
  CDS (1)..(912)
atgagtacattagaacaaacaataggcaatacgcctctggtgaagttgcagcgaatggggccggataacggcagtgaagtgtggttaaaactggaaggcaataacccggcaggttcggtgaaagatcgtgcggcactttcgatgatcgtcgaggcggaaaagcgcggggaaattaaaccgggtgatgtcttaatcgaagccaccagtggtaacaccggcattgcgctggcaatgattgccgcgctgaaaggctatcgcatgaaattgctgatgcccgacaacatgagccaggaacgccgtgcggcgatgcgtgcttatggtgcggaactgattcttgtcaccaaagagcagggcatggaaggtgcgcgcgatctggcgctggagatggcgaatcgtggcgaaggaaagctgctcgatcagttcaataatcccgataacccttatgcgcattacaccaccactgggccggaaatctggcagcaaaccggcgggcgcatcactcattttgtctccagcatggggacgaccggcactatcaccggcgtctcacgctttatgcgcgaacaatccaaaccggtgaccattgtcggcctgcaaccggaagagggcagcagcattcccggcattcgccgctggcctacggaatatctgccggggattttcaacgcttctctggtggatgaggtgctggatattcatcagcgcgatgcggaaaacaccatgcgcgaactggcggtgcgggaaggaatattctgtggcgtcagctccggcggcgcggttgccggagcactgcgggtggcaaaagctaaccctgacgcggtggtggtggcgatcatctgcgatcgtggcgatcgctacctttctaccggggtgtttggggaagagcattttagccagggggcggggatttaa

SEQ ID NO: 24484 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 24485 - DNA, 1308 bp, Solanum tuberosum (potato)
  CDS (35)..(1012)
gggccgcttcaaatcctagaattaacctgataatatggcgggggaaaagattggaattgccaaggatgtaactgaattgattggtaacactcctttggtatacctgaataatgttgtggatgggtgtgttgcacgtgttgctgccaagctggaaagcatggagccatgctctagtgttaaggataggatcggttatagtatgattacagatgctgaggagaagggtctcatcaaacccggcgagagtgtcctcatcgaacctacgagtggaaacaccggtgtaggattggcattcatggctgctgctaaaggctacaaactcatcattacgatgccttcttcaatgagtcttgagagaagaattattctgcgtggctttcggtctgagttagtgcttaccgatccagcaaaagggatgaagggtgctatttcaaaggctgaagagataaaggccaaaacacccaactcctatattcttcagcaatttgaaaaccctgctaacccaaagatacactatgagaccactggtcctgagatctggaaaggctcaaacgggaaagtggatgctctagcctctggaattggaacaggaggcacgataactggttcaggcaagtatttgagagagcagaaccccaacgttaagctgtatggcgtggaaccagttgaaagtgctatcctttctggtggaaagcctggtccacataagattcaggggattggtgctggtttcattcctggtgttttggaagttaaccttattgatgatgtagttcaggtttcaagtgaagaatccatagaaatggctaagcttctggcattgaaggaaggattgctagtgggaatttcatctggtgctgctgcggcggcggcaattaaagttgctaagcgccctgaaaatgctgggaagctcattgttgttattttcccaagcttcggagagcgatatctttcctctgtactcttcgaaactgtcagacgagaagcagagaacatgactgtggagccttgaactttttacccttcgatgaccacatcatagtcgcaagtgggcttcgatgaaagcagaatgttcttgtctgaaccttcccttttctattttgctgaaactgctagaaaataagccttttctttctttattggctatgttctttaaagtaaagaaaccattcaagtatattttagtgcttttgtaattgtactgtaagaacaacttaatgatatttagtgctttgtaactctatgtttctacaacatttgaaatttaaagaggtgttgcttcttgttaaaaaaaaaaaaaaaaaaaaa

SEQ ID NO: 24486 - protein, 325 aa, Solanum tuberosum (potato)
MAGEKIGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRGFRSELVLTDPAKGMKGAISKAEEIKAKTPNSYILQQFENPANPKIHYETTGPEIWKGSNGKVDALASGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 24487 - DNA, 1404 bp, Solanum tuberosum (potato)
  CDS (21)..(1181)
gaattcgccacgaggcaacaatggcatctttcatcaacaatcccttaacttctctctgtaacactaagtctgaacgtaataatctcttcaaaatttccctttacgaagctcaatcactgggtttttccaagcttaatggcagcagaaaagttgctttcccttctgttgtttgcaaagcagtgtctgtaccaacgaaatcgagtacagaaattgaagggcttaacatcgctgaagatgttacacagcttattgggaacacaccaatggtttaccttaacaccatcgctaagggttgtgtagcaaacattgctgctaaacttgagattatggaaccttgttgcagtgttaaggacaggatagggttcagtatgatagttgatgccgaggagaagggacttatatctccggggaagactgttctagttgagcctacaagtggaaacacaggcattgggcttgccttcattgctgcttccagaggatataagctcatcttaacgatgcctgcatcaatgagtcttgaaagaagggtcattctaaaagcttttggagctgaacttgttttaactgatccagccaaagggatgaaaggagctgtttcaaaggctgaagaaatattgaataacacaccagatgcctatatccttcaacaatttgacaatcccgccaaccccaagatacactatgaaacaacgggtccagagatctgggaagacacaaaaggcaagattgacatacttgttgctggcattggaactggcggaaccattacaggaacaggccgattccttaaagagcaaaatccaaacattaagattattggtgtggagcccacagaaagtaacgttctatcagggggcaaacctggccctcacaaaattcaagggattggagcaggttttattccaggaaacttggatcaagatgtcatggatgaagtgatagagatatcgagtgacgaagctgttgaaactgcgagaaccttagcgctacaagaagggttgttggttgggatttcttccggagcagctgctcttgctgccattcaggttgggaagagacctgagaatgcaggaaagcttattggggttgtatttccaagctatggggaacgatacctctcctctattcttttccagtcaatacgagaggaatgcgagaaaatgaagccagaattgtgaagatcttcctttctttgagctatcttctgattcttaataatcgtatctggcttttctagctcgcaaacttttgtttgttatatttagttggctggtgtatacaatagatcaggtattaagatggttctcataacaaagattaaacaatctcatcgattcggtttgaggattttttatttgaattgatcatgaaatttactcgcaaaaaaaaaaaaaaaaaaaa

SEQ ID NO: 24488 - protein, 386 aa, Solanum tuberosum (potato)
MASFINNPLTSLCNTKSERNNLFKISLYEAQSLGFSKLNGSRKVAFPSVVCKAVSVPTKSSTEIEGLNIAEDVTQLIGNTPMVYLNTIAKGCVANIAAKLEIMEPCCSVKDRIGFSMIVDAEEKGLISPGKTVLVEPTSGNTGIGLAFIAASRGYKLILTMPASMSLERRVILKAFGAELVLTDPAKGMKGAVSKAEEILNNTPDAYILQQFDNPANPKIHYETTGPEIWEDTKGKIDILVAGIGTGGTITGTGRFLKEQNPNIKIIGVEPTESNVLSGGKPGPHKIQGIGAGFIPGNLDQDVMDEVIEISSDEAVETARTLALQEGLLVGISSGAAALAAIQVGKRPENAGKLIGVVFPSYGERYLSSILFQSIREECEKMKPEL

SEQ ID NO: 24489 - DNA, 1492 bp, Chlamydomonas reinhardtii
  CDS (73)..(1131)
ttgagttgcagtttagcgcaatcgcgttaggcaggggcttagagccacgaaggaccaactgccaaagatttcatgctttgcggttgcgggggcgcgaaacaggtttctcgagttgccctggtccccaaggccgtcgctgctcccgagaaggctgctgttaagatgaacatcgccaccgatgtcaccgagctgattggcaagacccctatggtctacctgaacaaggtggccacgggcacgcacgccaagatcgccgccaagctggagatcatggagccctgctgctccgttaaggacaggatcggctacagcatgatctcgagcgcggagaaggagggcctcatcaccccgggcaagactgtcctggtggagcccacctcgggtaacaccggcatcggtctggccttcatcgccgccgcccgcggctacaagctcatcctgaccatgcccgcctccatgtccctggagcgccgcatcctgctgcgtgccttcggcgccgagctggtgctgactgaccccgccaagggcatgaagggcgccgtggccaaggccgaggagatcctggcctccacgccggacgccttcatgctgcagcagttccagaaccccaacaaccccaaggtgcactacgagaccaccggccccgagatctggagcgccaccgacggcaaggtcgacatcctggtgtcgggcgtgggcaccggcggcaccatcaccggcaccggccgctacctgcgcgagaagaagtcggacgtgcagctggtggctgtggagccggccgagagccccgtgctcagcggcggcaagcccggcccccacaagatccagggcatcggcgccggctttgtgcccgcggtgctggacaccgcgctgatcagcgaggtggtgcaggtgtccagtgacgacgccatcgacatggctcgccgcctggcgctggaggagggcctcatggtgggcatcagctcgggcgccgcggtgcaagccgccatcaaggtggccagccgccccgagaacgagggcaagctggtggtggtggtgctgcccccgttcggcgagcgctacctgtcgtcggtgctgttccagcagctgcgcgacgaggcgtccaagatgaccttcgagccctccgcctgaagcgggacgcggacgcaactggacgacagcagcacggcaccgcggcgcgcggattggccgcgcaggatgcgggcacgaggtgcttcatttatgcccaggccctcctggaagctgatcagcgctaataagcaggatgctgtgatagcgctttaacaacctatggctggctgcaagcaaacacgcggtgcatcatgagtcggaatgacggcatgcgtgttggaagccgatgcagggggactactaatgggtggggttggggggaggctgtgggtcgcgctcctcaattgagaggctatactcgcggtgtagaccaaactgtaataaccccggtttcaaaaaaaaaaaaaaaaaaaaaaaaaaa

SEQ ID NO: 24490 - protein, 352 aa, Chlamydomonas reinhardtii
MLCGCGGAKQVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPPFGERYLSSVLFQQLRDEASKMTFEPSA

SEQ ID NO: 24491 - DNA, 1446 bp, chloroplast Spinacia oleracea (spinach)
  CDS (43)..(1215)
attacacacatacaggtacagagaggagagagaaagttggctatggcttcattggtcaacaacgcatacgctgcgcttcgcacctccaaattggagctccgagaagttaagaatcttgccaatttccgagttggacctccatcatcgctcagctgcaacaatttcaagaaggtttcttcttctccaatcacctgcaaagctgtgtctctttcgcctccatccaccattgaaggccttaacattgctgaagatgtttctcagctaattggaaaaaccccaatggtgtatctcaacaatgtatcaaaaggatcagttgcaaacattgctgcgaagcttgagagcatggaaccttgctgcagtgtcaaggacaggattggctacagtatgattgatgatgctgagcagaaaggagttatcacacctggaaagactactctagtggagcctacgagcgggaatactggaataggacttgcctttatagctgctgccagaggatacaagattaccttgacaatgccagcttccatgagtatggaaaaggagagttatcttgaaaggagagttatcttgaaagcatttggagctgagttggtcctgactgatccagctaagggaatgaaaggagcagttgagaaggctgaagaaattttgaagaaaactcctgattcctacatgcttcagcagtttgacaatcctgcaaatcccaagatacattacgagacaacaggtcccgagatctgggaagacacaaaaggcaaagtggacatttttgttgcaggcattggaactggaggaacgatttctggagttgacggtacctcaaagaacgctaaccctggtgtgcaggtaattggtatagaacctacagaaagcaactactttctggtggaaagcgctggtccacacaagattcaaggacttggagctggttttgttcccagcaatttagatttgggtgtgatggatgaagttatagaggtatctagtgaagaagctgtagaaatggcaaagcaattggcaatgaaagaaggcttgttggttggcatttcatctggacgaggagcagctgctgcagtcaggattggtaaaagacctgaaaatgcaggaaaacttattgctgttgtgttcccaagctttggtgagagatacctgtcatccattttgttccagtctattcgagaagagtgtgaaaaactgaagccagaaatatgaggagtcatttcttggatattcttggcgggggcacattgttagatttttcaggttgtgcctcttgcttgcttgtcgcgtcttagagccaagaatggtttatgttttctcaatttatttgttgacatgaaatgagcaataaaattatgcatgtagatcagaacagcagatgatgatttttaacaaattttcctaatattactttggcttactcaaaaaaaaaaaaaaaaaaaa

SEQ ID NO: 24492 - protein, 390 aa, chloroplast Spinacia oleracea (spinach)
MASLVNNAYAALRTSKLELREVKNLANFRVGPPSSLSCNNFKKVSSSPITCKAVSLSPPSTIEGLNIAEDVSQLIGKTPMVYLNNVSKGSVANIAAKLESMEPCCSVKDRIGYSMIDDAEQKGVITPGKTTLVEPTSGNTGIGLAFIAAARGYKITLTMPASMSMEKESYLERRVILKAFGAELVLTDPAKGMKGAVEKAEEILKKTPDSYMLQQFDNPANPKIHYETTGPEIWEDTKGKVDIFVAGIGTGGTISGVDGTSKNANPGVQVIGIEPTESNYFLVESAGPHKIQGLGAGFVPSNLDLGVMDEVIEVSSEEAVEMAKQLAMKEGLLVGISSGRGAAAAVRIGKRPENAGKLIAVVFPSFGERYLSSILFQSIREECEKLKPEI

SEQ ID NO: 24493 - DNA, 1035 bp, Caenorhabditis elegans
  CDS (1)..(1035)
atgtttcagatggctgatcgcaactctattggcgaaaatgctgccgcgcttattggcaacacacccatggtgtacatcaataaattgacaaaaggacttccagggacagttgctgtaaaaatcgaatacatgaatccagcgggatcggtcaaagatcgtattggagcggcaatgcttgcagcggccgaaaaagatggaacggtgatcccgggagtgaccacgctcattgagccaacatcaggaaacactggaatcgcattggcttttgttgctgccgccaaggggtatagatgtattgtcacaatgccagcatctatgagtggagaacgcagaactcttctcaaagcatatggatccgaggtggtcttgacagacccagcgaaaggaatgaaaggagcgattgacatggctaaccagctgaaggaaaacattccagggtctatcattcttgctcaatttgacaacccaaataatccacttgttcactatcaaacaactggaccagaaatttggagacaaaccaaagggacagtagacgctgttgtttttggggttggaactggtggaacaattaccggagttggcagatacttgcaagagcagaatccaggtgtccgcgtgtttgctgtggagccagaagaatccgctatactcagcggcagaccagccggtccacacaaaattcaaggcattggagcagggtttgctccagctgttttggacacaaagatctatgaagacgtaattcgaattcattccgatgaggctattgtcatggctcaaagactttcctatgaagaaggtcttcttggcggaatttcctccggagctaatgttgcagctgcacttcagttggctgctcgcccagaaatggctggaaagctcattgtgacttgtttgccaagctgtggagaacgatacatgacctctcctttgtacaccgacatccgcgaaagcgctatggctctggcagtcgaaagcttggaggcaaacttgaagaagttatgtcttcacaactatgatattatggagtga

SEQ ID NO: 24494 - protein, 344 aa, Caenorhabditis elegans
MFQMADRNSIGENAAALIGNTPMVYINKLTKGLPGTVAVKIEYMNPAGSVKDRIGAAMLAAAEKDGTVIPGVTTLIEPTSGNTGIALAFVAAAKGYRCIVTMPASMSGERRTLLKAYGSEVVLTDPAKGMKGAIDMANQLKENIPGSIILAQFDNPNNPLVHYQTTGPEIWRQTKGTVDAVVFGVGTGGTITGVGRYLQEQNPGVRVFAVEPEESAILSGRPAGPHKIQGIGAGFAPAVLDTKIYEDVIRIHSDEAIVMAQRLSYEEGLLGGISSGANVAAALQLAARPEMAGKLIVTCLPSCGERYMTSPLYTDIRESAMALAVESLEANLKKLCLHNYDIME

SEQ ID NO: 24495 - DNA, 1014 bp, Caenorhabditis elegans
  CDS (1)..(1014)
atgtcccgcgaacttatggtcgaaaccggtggtgagctcatcggaaacaccccactcctgaagctcaacaagatcggaaaggatctcggtgcatcgattgccgtcaaggtagagtacatgaaccctgcctgctcggtcaaggatcgtatcgcgttcaacatgatcgacacagctgagaaggccgggctcatcacccccggcaaaactgtgctcattgagccaaccagtggaaacatgggaattgcgttggcctactgcggaaaacttcgtgggtacaaagttattcttacgatgccagcgtcgatgagtattgagagaaggtgtctgttaaaggcctacggtgctgaggtgattcttaccgatccagcgaccgcggtcaaaggagctgtccaaagagccgaagagcttcgcgatgtgattccaaatgcgtatatcttgaaccaattcggaaatccagcaaatccagaagcccattataagactacaggaccagaaatttggaggcagacacagggcaaggttgatatcgtatgcttcggagttggatcaggtggaacttgcactggagtcggacgattcttgaaggagaagaacccaagtgttcaagtgttcccagttgagccatttgagagttctgtgatcaatggacttccacatagcccacacaaaattcaaggcatgggaaccggaatgattcctgacatcctcgacttgacccttttctccgaggctctgcgagttcattccgatgatgctattgcaatggccaagaagcttgccgacgaggagtcgattttgggtggaatctcgtctggagccaacgtgtgcgctgcagttcagttggccaagcgaccggagaataaggggaaactaattgtcaccacagttaacagttttggagaacgctatctttcaaccgccctctacgccgagctccgtgataacgccgccaacatgaaacagttgaacctcgacgattccatcaagattgccaaagaatacctaggaatttaa

SEQ ID NO: 24496 - protein, 337 aa, Caenorhabditis elegans
MSRELMVETGGELIGNTPLLKLNKIGKDLGASIAVKVEYMNPACSVKDRIAFNMIDTAEKAGLITPGKTVLIEPTSGNMGIALAYCGKLRGYKVILTMPASMSIERRCLLKAYGAEVILTDPATAVKGAVQRAEELRDVIPNAYILNQFGNPANPEAHYKTTGPEIWRQTQGKVDIVCFGVGSGGTCTGVGRFLKEKNPSVQVFPVEPFESSVINGLPHSPHKIQGMGTGMIPDILDLTLFSEALRVHSDDAIAMAKKLADEESILGGISSGANVCAAVQLAKRPENKGKLIVTTVNSFGERYLSTALYAELRDNAANMKQLNLDDSIKIAKEYLGI

SEQ ID NO: 24497 - DNA, 951 bp, Streptomyces coelicolor
  CDS (1)..(951)
atgcgctacgactccccgctggccgcggtgggcaacacccccctggtgcgcctgccgcggctgtcgccgtccgacgacgtccgcatctgggccaagctggaggaccgcaacccgaccggctcgatcaaggatcgccccgcgctccacatgatcgagcaggccgagaaggacggccgcctcacccagggctgcaccatcctggagccgaccagcggaaacaccggcatctccctggccatggccgccaggctcaagggctaccgcatcgtctgcgtcatgcccgagaacacctcccaggaacgccgggacctgctcaccatgtggggcgcggagatcatctcctccccggccgcgggcggctccaacaccgccgtacgcgtcgccaaggaactctccgccgaacacccggactgggtgatgctctaccagtacggcaacccggacaacgcgggcgcccactacgccggcaccggccccgagatcctcgccgacctgccgtcggtcacgcacttcgtcgcgggcctgggaacgacggggacgctgatgggcgtcggccgctacctgcgcgagcacaagccggacgtgaagatcgtcgccgccgaaccgcgctacgacgacctggtctacggcctgcgcaacctcgacgagggcttcgtccccgagctgtacgacgcctccgtcctcaccacccgcttctcggtgggctccgccgacgcggtcacccgcacccgcgagctgctccagcaggagggcatcttcgcgggcgtctccaccggcgccgccctgcacgccgcgatcggcgtcgggaagaaggcggtcaaggcgggggagagcgcggacatcgtgttcgtcgtcgccgacggcggctggaagtacctgtcgaccggcgtctacaccgccgagacgaccgaggcggccatcgagaccctgcacggccagctctgggcctga

SEQ ID NO: 24498 - protein, 316 aa, Streptomyces coelicolor
MRYDSPLAAVGNTPLVRLPRLSPSDDVRIWAKLEDRNPTGSIKDRPALHMIEQAEKDGRLTQGCTILEPTSGNTGISLAMAARLKGYRIVCVMPENTSQERRDLLTMWGAEIISSPAAGGSNTAVRVAKELSAEHPDWVMLYQYGNPDNAGAHYAGTGPEILADLPSVTHFVAGLGTTGTLMGVGRYLREHKPDVKIVAAEPRYDDLVYGLRNLDEGFVPELYDASVLTTRFSVGSADAVTRTRELLQQEGIFAGVSTGAALHAAIGVGKKAVKAGESADIVFVVADGGWKYLSTGVYTAETTEAAIETLHGQLWA

SEQ ID NO: 24499 - DNA, 1056 bp, Schizosaccharomyces pombe
  CDS (1)..(1056)
atggctactagcggtattcaaacgaaggttccaggaatcgttagcggattcattggggcaattggtcgtactcctttaattagactgaatacgctgtcgaacgagacgggatgcaatatccttgccaaagctgaattccaaaatcccggaggaagcgtcaaggatagagctgcttactacgtggtacgcgatgccgagaaaaaaggaaaactctctagaggtggcacaattgtcgaggggactgccggtaacactggtattggtcttgctcacattgctagagcaagaggttataaatgcgtgatttacatgccaaatacccaatctcaagctaaaatcgatacccttaagtttttgggtgccgaggttcatcccgtacctgttgctcccttttccaaccctctcaattataaccatcaggcccgtcgtcacgctgagtctactccgaatgcttcttggactgatcagttcgataacgtcgctaacttactgtctcactacgaaaccactggtcctgaaatttgggatcaaaccaaaggtaccgttgacggctttacctgctctactggtactggtggtacttttgccggcgttaccaagtatttgaaggagaagtccgacggtcgtgttgcttctttcgtggctgatccccctggaagtgttttgtatagccatatcaaaacgaagggtaagcatcctgacaacaagggttcttcatttaccgaaggcattggtcaaggtcgtattactggaaatgtccaacctgtttacgatctcattgacgatgctatgaaaatccctgacgaaaaatctattaacatgttctttcgtttgttagaccaagaaggtcttttcttgggcggctcttcttgcttaaatgtggtcgctgctgttgaaatggctaaaatattaggtcctggcaagacggtggttacaattctttgtgattctggtcacaagtatgccactcgtttattcagtcgctcattccttgaaagtaaaaaattatttgatgtaattgagccacaatacaagaagtatattgtacttccttaa

SEQ ID NO: 24500 - protein, 351 aa, Schizosaccharomyces pombe
MATSGIQTKVPGIVSGFIGAIGRTPLIRLNTLSNETGCNILAKAEFQNPGGSVKDRAAYYVVRDAEKKGKLSRGGTIVEGTAGNTGIGLAHIARARGYKCVIYMPNTQSQAKIDTLKFLGAEVHPVPVAPFSNPLNYNHQARRHAESTPNASWTDQFDNVANLLSHYETTGPEIWDQTKGTVDGFTCSTGTGGTFAGVTKYLKEKSDGRVASFVADPPGSVLYSHIKTKGKHPDNKGSSFTEGIGQGRITGNVQPVYDLIDDAMKIPDEKSINMFFRLLDQEGLFLGGSSCLNVVAAVEMAKILGPGKTVVTILCDSGHKYATRLFSRSFLESKKLFDVIEPQYKKYIVLP

SEQ ID NO: 24501 - DNA, 909 bp, Clostridium perfringens
  CDS (1)..(909)
atgaaatattataatgatataagagatttaataggaaatactccaatattaaaactaaataatataagtacaaaagaaggagtaaatatttatgccaaaatagaaggtactagtccagggggaagttgtaaagatagagtcggaatatatatggtagaaaaagctgagaaagaaggaaaacttaaacctggaagcactattatagaggctactgccggaaatacaggtattggcatagctttagcagctattaataaaggttataaaataatatttatagttcctgataaattttctatagagaagcaaaagataatgaaagctttaggtgctgaaataataaatactcctaaagaagaggggatggaaggtgctataaatttagcaaattcattattaagtgagattcctaattcattatcattaaatcaattcaaaaatgaggcaaatccattagctcattacgagactactggtagagaattatatgatggattagatggagaaattgattattttgttgctggagcaggaagcggaggaacaatttctggtgtattaaaattcttaaaagaaaatatttcagaagtaaaaggaatattagctgatccagtaggttctattattggtggtggacaatgtggaacttataaaatagaaggaataggaaacaattttattccagaaactatggatatgagcttagtagatgatgttataaaagtaaatgatgaggaagcttttgatgcagtaaaattattagctaaaaaagaaggattaatagttggttcctcttcaggagcagcatttgcagcagtattaaaattagctgagaaaatagagaagggcaatatagtaacaatatttccagatagaggagataggtattttagtacagatcttttttaa

SEQ ID NO: 24502 - protein, 302 aa, Clostridium perfringens
MKYYNDIRDLIGNTPILKLNNISTKEGVNIYAKIEGTSPGGSCKDRVGIYMVEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGEIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEKGNIVTIFPDRGDRYFSTDLF

SEQ ID NO: 24503 - DNA, 927 bp, Methanosarcina barkeri
  CDS (1)..(927)
atggggcgaatatattccgacataacctggacaattggtaatacgcctcttgtcaggttaaaccgcataacagaaggtctacatgcggatgtgttagctaaagtagagtcctttaatcctatgggaagtgtgaaggacagaatagggctggcgatgattgaaaaagccgaacttgaagggaaaatcaaaaagggtaccactgttattgaagccaccagcggcaacaccggcatcggactcgcctgcgtctgcgctgcccgtggctataagctcatactggttatgcctgaaacaatgacggtagaacgaagaaaactcctgaaagccctgggagcagagctggttctgaccccaggaacggaaggaatgaaaggagcagttaataaagccgagcagatggctgctgacgatccttcgctttacttcatagcccagcaattccagaatcctgcaaatccagaaattcacagacgtacaacggctgaagaaatctggagagatactgatggcaaagcagatgtcattgtagcaggcgtgggaacaggcggaactatcacaggcgttgccagcgtcctcaaaaaacggaaacctgcttttaaggctattgcagtcgaacctgccgaatctcctgtgctcagcggcggaagccctggaccacataaaatccagggtattggtgcaggttttattcctgatgtactccagcttgaccttgttgatgaagtgatcagagtaaccggagacaacgccgctgccatgtcccggcgcctggcaaaggaagaaggcatccttgcaggcatatcttcaggcgctgctacctatgctgcactgcaggtcgcagccagggaagaaatgaacggaaagacgattgttgtgatcttgccagatacgggagaacgttatctgagcactgatctctttgactga

SEQ ID NO: 24504 - protein, 308 aa, Methanosarcina barkeri
MGRIYSDITWTIGNTPLVRLNRITEGLHADVLAKVESFNPMGSVKDRIGLAMIEKAELEGKIKKGTTVIEATSGNTGIGLACVCAARGYKLILVMPETMTVERRKLLKALGAELVLTPGTEGMKGAVNKAEQMAADDPSLYFIAQQFQNPANPEIHRRTTAEEIWRDTDGKADVIVAGVGTGGTITGVASVLKKRKPAFKAIAVEPAESPVLSGGSPGPHKIQGIGAGFIPDVLQLDLVDEVIRVTGDNAAAMSRRLAKEEGILAGISSGAATYAALQVAAREEMNGKTIVVILPDTGERYLSTDLFD

SEQ ID NO: 24505 - DNA, 933 bp, Mycobacterium leprae
  CDS (1)..(933)
atgagcattgctgaagacgtcacacaactagttggtaacacgccactggtccggctacgccgagttaccgaaggtgcgctggctgacgttgtcgccaagctggaatccttcaatcccgccaacagcgtgaaggacaggataggcgtggccatgatcgacacggccgaggaagcgggtttgatcaagccggacaccgtcatccttgagccgacgagcgggaacaccggcatcgcactagctatggtatgcgcagcacgtggctaccactgcgtgctgaccatgcccgagacaatgagcatcgaacgacgaatgttgttgcgagcgtacggcgccgaactcatcttgactccgggcgccgatggcatgtcaggagccatcgccaaggctgaggaattagccaagtccgataaaaggtattttataccacagcaattcgagaacccagcgaacccagccatccacgccgccacaaccgccgaggaagtgtggcgcgacaccgatggcaaggtagacatcttcgtttctggaatcgggaccggaggcactatcactggtgttgcccgaatcattaaagaacgccggcccgccacgcagttcgtcgccgtagagcccgccgcgtcgccggtgttatccggtggccagaagggtcctcaccccattcagggcatcggtgctggattcgtcccgtcggtgctggtcctggacctggtggacgagatcgttaccgtcggcaacgaagaagcgctcgacctagcccgcagactggctaaggaagagggactgctggtcggcatctccgcaggggcggccgtttgcgccgccctgcacgtggcccgccggccagagaatacaggaaaactgatcgtcgtcgtgctgcccgatttcggcgagcgatatttaagcacgatgctattcgcggacttagccaactag

SEQ ID NO: 24506 - protein, 310 aa, Mycobacterium leprae
MSIAEDVTQLVGNTPLVRLRRVTEGALADVVAKLESFNPANSVKDRIGVAMIDTAEEAGLIKPDTVILEPTSGNTGIALAMVCAARGYHCVLTMPETMSIERRMLLRAYGAELILTPGADGMSGAIAKAEELAKSDKRYFIPQQFENPANPAIHAATTAEEVWRDTDGKVDIFVSGIGTGGTITGVARIIKERRPATQFVAVEPAASPVLSGGQKGPHPIQGIGAGFVPSVLVLDLVDEIVTVGNEEALDLARRLAKEEGLLVGISAGAAVCAALHVARRPENTGKLIVVVLPDFGERYLSTMLFADLAN

SEQ ID NO: 24507 - DNA, 1329 bp, Arabidopsis thaliana (mouse-ear cress)
  CDS (1)..(1329)
atggtggcgatgatcatggcttcaaggtttaaccgggaagctaagctcgcatctcaaatcttgtctacacttttgggaaaccgaagctgctacacatccatggccgccacatcttcctctgctttacttcttaatccgttgacttcttcttcttcttcttctactctccgtcgtttcagatgctcgccagagatctcttctctctccttctcctccgcttctgatttctctctagcgatgaagaggcagagtcggagttttgctgatggttcggaacgagatccgtctgttgtgtgtgaggctgttaagcgcgagactggacctgatggactcaacatcgctgacaatgtgtctcagctcattgggaaaactcctatggtgtacttgaacagtatagcaaaaggttgtgtagcaaatattgctgccaaactcgagatcatggagccatgttgcagtgtcaaggataggattgggtacagtatggttactgatgctgagcaaaaaggatttatatcacctggaaagagtgttcttgtggaacctacaagtggaaacacgggtattggcctagcattcatcgctgcttcaaggggctatagacttatcttgacaatgccagcatccatgagtatggaaagaagggttcttttaaaggcatttggagctgagcttgtattaacagatcctgctaaaggcatgactggagcggttcagaaggctgaagagatcttgaaaaacactcctgatgcatacatgctccaacagtttgacaaccctgcaaatccaaagattcattacgagactactggtcctgagatctgggatgatacaaagggcaaggtggatatctttgttgcaggaattggaactggtggaactatcactggtgttggtcgatttattaaagagaaaaatcccaaaacgcaggttattggtgtagaacccaccgaaagcgatatactttctggtggcaaaccgggacctcacaagattcaaggaattggagctggatttatacctaagaatttggatcagaaaattatggatgaagtcatagcgatttcaagtgaggaagctatagaaaccgcaaagcaactagctcttaaggaaggcttgatggttggtatatcatctggagctgcagctgctgctgcaatcaaggtggctaagagacctgagaatgctggaaaactcatagctgtaactgttaatgaatctatgaatgcggtttttcaggttgttttcccgagcttcggggagagatatctatcgaccccgctgttccagtctatccgggaagaggtggagaaaatgcagcctgaggtatga

SEQ ID NO: 24508 - protein, 442 aa, Arabidopsis thaliana (mouse-ear cress)
MVAMIMASRFNREAKLASQILSTLLGNRSCYTSMAATSSSALLLNPLTSSSSSSTLRRFRCSPEISSLSFSSASDFSLAMKRQSRSFADGSERDPSVVCEAVKRETGPDGLNIADNVSQLIGKTPMVYLNSIAKGCVANIAAKLEIMEPCCSVKDRIGYSMVTDAEQKGFISPGKSVLVEPTSGNTGIGLAFIAASRGYRLILTMPASMSMERRVLLKAFGAELVLTDPAKGMTGAVQKAEEILKNTPDAYMLQQFDNPANPKIHYETTGPEIWDDTKGKVDIFVAGIGTGGTITGVGRFIKEKNPKTQVIGVEPTESDILSGGKPGPHKIQGIGAGFIPKNLDQKIMDEVIAISSEEAIETAKQLALKEGLMVGISSGAAAAAAIKVAKRPENAGKLIAVTVNESMNAVFQVVFPSFGERYLSTPLFQSIREEVEKMQPEV

SEQ ID NO: 24509 - DNA, 1142 bp, Arabidopsis thaliana (mouse-ear cress)
  CDS (1)..(1107)
atggcctctgtttcaaggaggttactgaggagagagacgatcccctgtttcagccacaccgtgaggaaactcttctccaccgttggatctccttcttttgctcagagactcagagatctccccaaagacttcccctctaccaacgccaaacgtgacgcctctctgcttattgggaaaacgcctcttgtgttcctcaacaaagtcactgaaggttgtgaagcgtatgttgcagccaaacaagaacatttccagccaacttgtagcattaaagacagaccagctatagccatgattgcagatgcagagaagaaaaaactaatcatccctggaaaaacaacactgatagagcctacttcaggaaacatgggaatcagtttggctttcatggctgctatgaaagggtacaggattataatgacgatgccttcgtacactagcttggagaggagagtgacgatgagatcctttggtgctgagcttgttctcactgatccagccaaaggaatgggtggaactgttaagaaagcttatgacctccttgatagtactcctgatgctttcatgtgtcaacagtttgctaatcctgcaaacactcagattcattttgatacaactggtcctgagatttgggaagatacacttggaaatgttgatatatttgtgatgggaattggcagtggaggcacagtctctggtgttggccgataccttaaatctaaaaaccccaatgtcaagatatatggagtggagcctgctgaaagcaacatactcaacggtggcaaaccaggtccacatgctatcacaggcaatggtgttggattcaaaccagaaatcttggatatggatgttatggagagtgttcttgaggttagtagtgaggatgctataaagatggctagagaattggcattgaaagaaggtctcatggttgggatatcgtcgggagctaacaccgtggcagcaattagactggcgaaaatgccagagaataaaggcaaactcattgtgacaattcatgcgagcttcggagaaagatatctgtcgtctgttctgtttgatgagctgaggaaagaagcagaggagatgaagccagtttcagtggattgatgaaggaagactgacactttaccaaaaatctcggg

SEQ ID NO: 24510 - protein, 368 aa, Arabidopsis thaliana (mouse-ear cress)
MASVSRRLLRRETIPCFSHTVRKLFSTVGSPSFAQRLRDLPKDFPSTNAKRDASLLIGKTPLVFLNKVTEGCEAYVAAKQEHFQPTCSIKDRPAIAMIADAEKKKLIIPGKTTLIEPTSGNMGISLAFMAAMKGYRIIMTMPSYTSLERRVTMRSFGAELVLTDPAKGMGGTVKKAYDLLDSTPDAFMCQQFANPANTQIHFDTTGPEIWEDTLGNVDIFVMGIGSGGTVSGVGRYLKSKNPNVKIYGVEPAESNILNGGKPGPHAITGNGVGFKPEILDMDVMESVLEVSSEDAIKMARELALKEGLMVGISSGANTVAAIRLAKMPENKGKLIVTIHASFGERYLSSVLFDELRKEAEEMKPVSVD

SEQ ID NO: 24511 - DNA, 1056 bp, Corynebacterium glutamicum
  CDS (101)..(1036)
cagaggccacttcaagtagatgtttcgtaattgtttacagcgtttacgcaagcggtcgaccaacaaaaacagcacttcaatgattggagcaccacccgacatgggcaatgtgtacaacaacatcaccgaaaccatcggccacaccccactggtaaagctgaacaagctcaccgaaggcctcgacgcaactgtcctggtcaagcttgagtcattcaacccagcaaactccgtcaaggaccgtatcggtctggccatcgttgaagatgcagagaagtccggtgcactgaagccaggcggcaccatcgttgaagcaacctccggcaacaccggtatcgcactggcaatggtcggcgctgcacgcggatacaacgttgttctcaccatgccggagaccatgtccaacgagcgtcgcgttctcctccgcgcttacggtgcagagatcgttcttaccccaggtgcagcaggcatgcagggtgcaaaggacaaggcagacgaaatcgtcgctgaacgcgaaaacgcagtccttgctcgccagttcgagaacgaggcaaacccacgcgtcaaccgcgacaccaccgcgaaggaaatcctcgaagacaccgacggcaccgttgatatcttcgttgcaagcttcggcaccggcggaaccgtcaccggcgttggccaggtcctgaaggaaaacaacgcagacgtacaggtctacaccgtcgagccagaagcgtccccacttctgaccgctggcaaggctggtccacacaagatccagggcatcggcgcaaacttcatccccgaggtcctggaccgcaaggttctcgacgacgtgctgaccgtctccaacgaagacgcaatcgcattctcccgcaagctcgctaccgaagagggcatcctcggcggtatctccaccggcgcaaacatcaaggcagctcttgaccttgcagcaaagccagagaacgctggcaaaaccatcgtcaccgttgtcaccgacttcggcgagcgctacgtctccaccgttctttacgaagacatccgcgactaattcttagcgactgttaacca

SEQ ID NO: 24512 - protein, 311 aa, Corynebacterium glutamicum
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVNRDTTAKEILEDTDGTVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 24513 - DNA, 1035 bp, Rhodobacter sphaeroides
  CDS (1)..(1035)
atgcgcatccaacgtgaccttgccgaagcgatcggcaacacccccctcatccgcctccgcaaggcgtcggagctcacgggctgcgagatcctcgggaaatgcgagttcctgaacccgggccagtcggtcaaggaccgcgccgcgctctacatcatccgcgatgcggtggcgaaggggctcctgcaaccgggcggcaccatcgtcgaggggacggccggcaacaccgggatcggcctgtcgctggtgggcgcctcgatgggcttccgcacggtcatcgtcatccccgagacccagagccaggagaagaaggacatgctgcgccttgcgggcgcgcatctcgttcaggttccggcggggccctaccgcaatccgaacaactacgtccgctattcgggccgcctcgccgaggcgctggcccgcaccgaagagcgcggggcgatcttggccaaccagttcgacaataccgcgaaccgtcaggcccatgtcgagacgaccgggcccgagatctgggagcagaccgacggcaaggtcgacggcttcatctgtgccgtgggctcgggcggcacgctcgcgggcgttgccatggcgcttcagcccaggggcgtgaagatcggcctcgccgatcccgagggcgcggcgctgcacagcttctacaccgaaggcaccttcgaggcgcccggcagctcgatcaccgaaggcatcgggcagggccggatcaccgccaacctcgaggggctgacccccgacttcagctaccgcatccccgatgccgaggcgctgccgatcatcttcgacctgatgcaggaagagggcctctgcctcggcggctcgtcgggcgtgaacatcgccggcgcgatccgcatggcgcgcgagatggggccgggccaccggatcgtgaccgtgctctgcgactacggcaaccgctaccagtccaaactcttcaatccgcagttcctgcgcgacaaggggctgcccgtgccgcaatggctcgacgaggcgcccccggcgatccctgcggtgttcgaggatctctga

SEQ ID NO: 24514 - protein, 344 aa, Rhodobacter sphaeroides
MRIQRDLAEAIGNTPLIRLRKASELTGCEILGKCEFLNPGQSVKDRAALYIIRDAVAKGLLQPGGTIVEGTAGNTGIGLSLVGASMGFRTVIVIPETQSQEKKDMLRLAGAHLVQVPAGPYRNPNNYVRYSGRLAEALARTEERGAILANQFDNTANRQAHVETTGPEIWEQTDGKVDGFICAVGSGGTLAGVAMALQPRGVKIGLADPEGAALHSFYTEGTFEAPGSSITEGIGQGRITANLEGLTPDFSYRIPDAEALPIIFDLMQEEGLCLGGSSGVNIAGAIRMAREMGPGHRIVTVLCDYGNRYQSKLFNPQFLRDKGLPVPQWLDEAPPAIPAVFEDL

SEQ ID NO: 24515 - DNA, 1200 bp, Entamoeba histolytica
  CDS (83)..(1096)
atcttcattgagttatagaaataccaaggatgtaattatttaaaggttggtcaatgaactgacaaacacattaacataaataatggaacaaataagtattagctctccaagaaaaagaatttatcataacattcttgaaactattggaggtacgccattagtagaacttcatggagtaacagaacatccaagaattaagaaaggaacacgaattttagttaaattagagtatttcaatccaatgtcatcagttaaagatcgtgttggatttaatattgtttatcaagctattaaagatggaagactaaaaccaggaatggagattattgaatctacatcaggaaatacaggaattgcactttgtcaagctggagctgtttttgggtatcgagttaacattgcaatgccatcaacaatgtcagttgaaagacaaatgattatgaaagcatttggagccgaattaattctaactgaaggaaagaaaggaatgccaggtgctattgaagaagttaacaaaatgataaaagaaaatccaggaaaatattttgttgcaaatcaatttggtaatccagacaataccgcagcacatcactacactgctaatgagatttgggaagatacagatggagaagttgacattgttgtttctgctgttggaacatcagggactgttattggggttgctgagaaattaaaagaaaagaaaaaaggaattaaaataatagcagttgagccagaagaatcagcagtgttggaaggtaaagcaaagggaccacatggaattcaaggaattggagcaggttttattccagatatttataagaaagaatttgttgatgaaataataccaattaaaacacaagatgcatggaaaatggcaagagcagtagttaaatatgatggaattatgtgtggaatgtcaagtggtgcagcaattttagcaggattaaaagaagcagaaaaaccagaaaatgaaggaaaaacaatagttattattgtaccatcatgtggagaacgatatttgtcaacagacttatataagattaaagatgaaggtacaaaaatacaaattcttgattcattattgaatgaataatttgaattgaactcttcttttttaaacttaaaatgttttttttaaataaaaagtcactttatatttttttctcttcttctttcattgaatatgtaaatatcttg

SEQ ID NO: 24516 - protein, 337 aa, Entamoeba histolytica
MEQISISSPRKRIYHNILETIGGTPLVELHGVTEHPRIKKGTRILVKLEYFNPMSSVKDRVGFNIVYQAIKDGRLKPGMEIIESTSGNTGIALCQAGAVFGYRVNIAMPSTMSVERQMIMKAFGAELILTEGKKGMPGAIEEVNKMIKENPGKYFVANQFGNPDNTAAHHYTANEIWEDTDGEVDIVVSAVGTSGTVIGVAEKLKEKKKGIKIIAVEPEESAVLEGKAKGPHGIQGIGAGFIPDIYKKEFVDEIIPIKTQDAWKMARAVVKYDGIMCGMSSGAAILAGLKEAEKPENEGKTIVIIVPSCGERYLSTDLYKIKDEGTKIQILDSLLNE

SEQ ID NO: 24517 - DNA, 1524 bp, Saccharomyces cerevisiae
  CDS (1)..(1524)
atgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgagggattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctaccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataa

SEQ ID NO: 24518 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGAEGFGSILAQPENLNKTDITDYKVEGIGYDFVPQVLDRKLIDVWYKTDDKPSFKYARQLISNEGVLVGGSSGSTFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 24519 - DNA, 894 bp, Yersinia pseudotuberculosis IP 32953
  CDS (1)..(894)
atgacaaccctggaacactgcatcggccatacaccattggtgaaactacaacgcttaagccaagggctaaatgcggagatttgggtcaaactggaagggaacaatccggccggttcggttaaagatagagccgcgctggcgatgatccagcaggcagagttacgtggtgatattgcccccggtgatgtcctgattgaagcgaccagtggaaataccgggattgccttggcgatgattgccgccatgaaaggctatcacttgaagttactgatgccagaaaacatgagtcaggagcgtcaggcggcgatgcgggcttacggcgcggaactgattctggttagccgtgaacagggcatggaaggggcgcgtgatctggcgttaaccatgcaggagaacggcgaaggtaacgtgctggatcaatttaataatgcggataatccctatgcgcattttacggggaccgggccggaaatttggcagcaaacggcgggtaaagtgagccactttgtctccagtatggggaccaccggtacgatcaccggtgtcagccagtatctaaaaagccaaaatccgcaggtgaaggttatcggcctgcaaccagcagaaggcagcagtattccggggatccgccggtggtcagcggaatatataccgggtattttccgccccgagctggtggatcaggtgttggatatcacgcagagtgtcgcagagcaaaccatgcggcggctggcgaaagaagaggggatattctgtggcgtcagttctggtggtgcggtggctggggcgctgcggatcgcggtagataaccctgatgcggtgattgtggcgattatctgtgaccgtggtgaccgctatttatcaactggggtttttttaagtaaggggggctaa

SEQ ID NO: 24520 - protein, 297 aa, Yersinia pseudotuberculosis IP 32953
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAVDNPDAVIVAIICDRGDRYLSTGVFLSKGG

SEQ ID NO: 24521 - DNA, 936 bp, Symbiobacterium thermophilum
  CDS (1)..(936)
atggcccggatctacgacagcatcgccgacacgatcggacggacgcccctggtccggctgaaccgggtgaccgagggggcggtggcgaccgtgctcgccaaggtggaggccttcaacccggcgtcgtcggtgaaggaccgcatcggctacgcgatgatcaaggacgcggaggagaagggcatcctgaagcccggcatgaccatcgtcgaacccaccagcggcaacacgggcatcgccctggccttcgtggcggcggcgaaggggtatcgctgcatcctcacgatgccggacacgatgtcgctggagcggcggaagctgctcaaggccttcggcgcggagctggtgctgacgccgggcgcggagggcatgaagggggccatcgccaaggccaaggagatcctcgagaacacgcccggggcctggatgccccagcagttcgagaatccggccaatcctgagatccaccggaagaccacggccgaggagatctggcaggacaccgacggccaggtggacatcgtcgtcggcggcgtgggcaccggcggcaccctcacgggcgtcggcgaggtcatcaaggcccgcaagcccgacttcaaggtggtggcggtcgagccggccgagtcgccggtcatctcgggcggcaagcccggcccgcacaagatccagggcatcggcgccgggttcatcccgaagaacctgaacaccgaggtggtggacgaggtgatcacggtggccagcgaggacgccatcgcgactgcccgccgcatggcccgggaagaggggctcctcgtcggcatctcctccggcgccgcggcctttgccgcgctgcaggtggcccgccggccggagaatgccggcaagaccattgtggtggtgctgcccgacaccggcgaacgctacctctccagcgccctgtgggccgacatccaggtgtga

SEQ ID NO: 24522 - protein, 311 aa, Symbiobacterium thermophilum
MARIYDSIADTIGRTPLVRLNRVTEGAVATVLAKVEAFNPASSVKDRIGYAMIKDAEEKGILKPGMTIVEPTSGNTGIALAFVAAAKGYRCILTMPDTMSLERRKLLKAFGAELVLTPGAEGMKGAIAKAKEILENTPGAWMPQQFENPANPEIHRKTTAEEIWQDTDGQVDIVVGGVGTGGTLTGVGEVIKARKPDFKVVAVEPAESPVISGGKPGPHKIQGIGAGFIPKNLNTEVVDEVITVASEDAIATARRMAREEGLLVGISSGAAAFAALQVARRPENAGKTIVVVLPDTGERYLSSALWADIQV

SEQ ID NO: 24523 - DNA, 936 bp, Propionibacterium acnes
  CDS (1)..(936)
atggcgaagatcgctaacgacgttaccgagctcatcggcaataccccgctggtcaagatcaataaactgttcccggactcccaggccaccgtattggccaagctcgagttctataacccggcctcgagcgtcaaggaccgtatcgctacgtcgatcgttgacgcggctgaggcttccggccagctcaatccgggaggcacgattgttgaagccacgtccggtaatacaggtgtcggtctggctctggttggtgcggctcgcggttacaaggtcatcatcactatgcctgagacaatgtcgaaggagcgccgcgccatcattcgtctgctgggtgccgagctggtgctcaccccaggcgctgacggcgtgccaggagccaacagcaaggctgccgagatcgtcgagaatacccccggtgccatcctggccagccagttcgataaccccgctaatcctgcgatccatcatgattgcactggtgaggagatctggaacgataccgagggcgaggtcgacgccatcgtcgccggtatcggtaccggtggcaccatctctggcgctggcaagtacctcaaggagaaggatcccgagatcaagatcttcggtgccgagcccgccgagtcccccgtcattactaaaggtgacaaggctccgcacaagatccagggctggggcccgggctttgtcccggataacctcgacaagtccgtcgttgacgggatcctgctggttcccggtgatgaggccatcgccttcgcccgtcgcgctgccgcagaagagggcattatcacgggtatctccggtggcggggccctgcaagctgccggtcaggtagtcgctcgtccagagtttgcgggaaagacgatcgtcgtcgttatcgctgacactggtgagcgctacctgtcgaccgctctcttcgaaggcctcctcgattga

SEQ ID NO: 24524 - protein, 311 aa, Propionibacterium acnes
MAKIANDVTELIGNTPLVKINKLFPDSQATVLAKLEFYNPASSVKDRIATSIVDAAEASGQLNPGGTIVEATSGNTGVGLALVGAARGYKVIITMPETMSKERRAIIRLLGAELVLTPGADGVPGANSKAAEIVENTPGAILASQFDNPANPAIHHDCTGEEIWNDTEGEVDAIVAGIGTGGTISGAGKYLKEKDPEIKIFGAEPAESPVITKGDKAPHKIQGWGPGFVPDNLDKSVVDGILLVPGDEAIAFARRAAAEEGIITGISGGGALQAAGQVVARPEFAGKTIVVVIADTGERYLSTALFEGLLD

SEQ ID NO: 24525 - DNA, 921 bp, Desulfotalea psychrophila
  CDS (1)..(921)
atgaccacaacaattggacaatccattggcaacacccctttactcaagctaggtcgacttgacagggactgcgctgccaccattctcgttaaacaggaatcacgaaacccagcaggcagtgtaaaatgccgggttgccgtctccatgatcgaaacaggtctgcgagagggaaagatctctaagggaacaaccatcgtcgaaccaaccagtggcaacactggtattgggctcgcctttgtctgcgcagccaagggattacgcctcattctcaccatgcccgagagcatgagcatagagagacgtaaactcctggcgcatctgggcgccgagattgttcttaccccggcagccgagggaatgacaggagccatcaccaaagcagaggaactgctaacaggcctggctgatggctttatgccagatcagtttaataatccagccaacccagagatccatagacaaacaaccggcaaagagatcctgcgagataccgatggcagggtagatatctttgtcgccggagtgggcacaggcggcacccttaccggagtgggcagtgtacttaaggcaaaaaaccctagagtgcaggtgattgcggtagagcccgccacctctgccgttatttccggcgaagccccggggccccacggcatccagggtatcggggcaggattcatccccggtaatcttgatatcagtctcatcgacgaaaccatcaaggtaaacgacgaagatgcactcgtggcagctcaagagcttgccacccaagagggcattctctgtgggataagctcaggcgctgccttctgggcaagcctggaagttgccaaacgaccggaaaatataggaaaaaccattgtcaccattctaccggataccggggaaagatacctcagcaccaatctatttagcacctcttga

SEQ ID NO: 24526 - protein, 306 aa, Desulfotalea psychrophila
MTTTIGQSIGNTPLLKLGRLDRDCAATILVKQESRNPAGSVKCRVAVSMIETGLREGKISKGTTIVEPTSGNTGIGLAFVCAAKGLRLILTMPESMSIERRKLLAHLGAEIVLTPAAEGMTGAITKAEELLTGLADGFMPDQFNNPANPEIHRQTTGKEILRDTDGRVDIFVAGVGTGGTLTGVGSVLKAKNPRVQVIAVEPATSAVISGEAPGPHGIQGIGAGFIPGNLDISLIDETIKVNDEDALVAAQELATQEGILCGISSGAAFWASLEVAKRPENIGKTIVTILPDTGERYLSTNLFSTS

SEQ ID NO: 24527 - DNA, 1095 bp, Debaryomyces hansenii CBS767
  CDS (1)..(1095)
atgattagaaccagcattcgtcgcttgactataagcagaaatcacgatatcaagcttccattcgtgcctttggtatcagagaacggtttcccacaggcaattgggaacacaccgcttctcaggttacccaggatctccgacaagatcggaagaaatgtttacgccaaagctgaatttatgaacccaggaggatcaattaaggacagggctgcattgtatgttattaacgatgctgaagagaagggtttgatcaaacctggtggaaccattgtggaaggtactgctggtaatacggggatcgggttggcccatgtatgcagagctaaaggctataagtgtgtgatctacatgccgaacacccaatctaagaataagattgaaactttgaggttattgggggccaccgtacacccagttccagcggttgcatttgacaatccagaaaattataaccaccaggctaagaggttcgctgaatctcaagaaaatgccgcctggaccaaccaattcgataatgttgccaacagacaggcacatattgaaacaactgggccagaaatctggtctcaattgaacggtaaagtggatgctttcacctgttccactggtacaggggggacttttgctggtgtaaccagatatttgaaggaaatctccaacggggcaaccaaatgtgtcttagctgatccaccaggatccgtcttgtattcttacatcaagtctaatggagaaacgatggaaagaggtggctcttccttcactgaaggtattggtcaaggtagagttaccgataacttgaaacaagaaatcccattggtagacgatgctttaaaaatcaccgatgaggaatcaattgaaatgttgtaccgtttattagatgaagagggattatacatcggtggtactggtgctttgaacgttgtcgctgctgtcaaagtagcccaatctttaccagaaggctcgaatgtcgttactttgttagctgattcagctcacaaatatagtgatcgtatcttctctaaaagctggttacaatcaaagggtttatttgacgctttaccttctcatttgaagaagtacgctaccctcgaatga

SEQ ID NO: 24528 - protein, 364 aa, Debaryomyces hansenii CBS767
MIRTSIRRLTISRNHDIKLPFVPLVSENGFPQAIGNTPLLRLPRISDKIGRNVYAKAEFMNPGGSIKDRAALYVINDAEEKGLIKPGGTIVEGTAGNTGIGLAHVCRAKGYKCVIYMPNTQSKNKIETLRLLGATVHPVPAVAFDNPENYNHQAKRFAESQENAAWTNQFDNVANRQAHIETTGPEIWSQLNGKVDAFTCSTGTGGTFAGVTRYLKEISNGATKCVLADPPGSVLYSYIKSNGETMERGGSSFTEGIGQGRVTDNLKQEIPLVDDALKITDEESIEMLYRLLDEEGLYIGGTGALNVVAAVKVAQSLPEGSNVVTLLADSAHKYSDRIFSKSWLQSKGLFDALPSHLKKYATLE

SEQ ID NO: 24529 - DNA, 1476 bp, Debaryomyces hansenii CBS767
  CDS (1)..(1476)
atgcctgtccctcccattgctgaagatgctttagatttaattggtaacacaccattaatcaagttgaatagaattccacaaagctttggtattaaagccaaggtttatgctaaggttgaattattcaatgcaggtggttctattaaggatagaatttccaaaaacatggttttagaagccgaaaagcaaggtagaatcaagccaggatataccttgatcgaacctacttcgggtaacaccggtattggtttggccttggtaggtgccgttagagggtacagaaccattattacattaccagaaaagatgtccaacgaaaaagtttcagttttgaaagctttaggtgctgaaattataagaactccaaccgaagcagcctgggatgccccagaatcgcatattggggtcgccagaaaattggaaaaggagatccctaattctgttatcttagaccagtattcgaatgaggctaaccctaatgctcattattacggtacaggttatgaaatttgggagcaaactaatggtaaggttacccacttaatagctggtgcgggtactggtggtactattaccggtatttccaagtacttgaaggaaaagaattcaaatattaaaattattggtgccgatccaaagggttctattttagctgtaccagaatctttaaatgatacaagtgaaggttacttagttgaaggtattggttacgactttatccctgatgttttaaagagagacagggttgactcctggatcaaaaccgatgattctgaatctttcaaattagcaagaagaattattagagaagaaggtattttagttggtggttcgtcgggttctgcattacaagccgcattagaagttgccaaggatttaactgaagacgataccgttgttgtcgttttccctgattcaatcagatcttacttaaccaagtttgccgatgatgaatggatgactactaacgggttccctatagaagaaaatgaaagtgcatcccacaaatctgatgaagtcttgaatacgacaactatcaaggatttggtttctggtaaggcaccagttgttactgttacattatctgatactgttggcaaaacttttgatttattacaaactaatggcttcgatcaattaccagttttgaacaactcaggtaaattagttggattaatcactttatctaagattttgaaatctctttctaccaagaaggtccaaatcactaattctatttcgtcaattattattgatttcagaaaattagctgattttgaaaaatccttcacaattaccaagaagtctggtttcactaagagaagttacgaaccaattacaatggatacatcgttagccttattaaacaaattcttcgaaaccaactccaacgccattgtgactgatgcggattacaagccagtccaaattgttacgaaggttgatttaatctcgtacttgacaaaaatcttataa

SEQ ID NO: 24530 - protein, 491 aa, Debaryomyces hansenii CBS767
MPVPPIAEDALDLIGNTPLIKLNRIPQSFGIKAKVYAKVELFNAGGSIKDRISKNMVLEAEKQGRIKPGYTLIEPTSGNTGIGLALVGAVRGYRTIITLPEKMSNEKVSVLKALGAEIIRTPTEAAWDAPESHIGVARKLEKEIPNSVILDQYSNEANPNAHYYGTGYEIWEQTNGKVTHLIAGAGTGGTITGISKYLKEKNSNIKIIGADPKGSILAVPESLNDTSEGYLVEGIGYDFIPDVLKRDRVDSWIKTDDSESFKLARRIIREEGILVGGSSGSALQAALEVAKDLTEDDTVVVVFPDSIRSYLTKFADDEWMTTNGFPIEENESASHKSDEVLNTTTIKDLVSGKAPVVTVTLSDTVGKTFDLLQTNGFDQLPVLNNSGKLVGLITLSKILKSLSTKKVQITNSISSIIIDFRKLADFEKSFTITKKSGFTKRSYEPITMDTSLALLNKFFETNSNAIVTDADYKPVQIVTKVDLISYLTKIL

SEQ ID NO: 24531 - DNA, 1134 bp, Yarrowia lipolytica CLIB99
  CDS (1)..(1134)
atgtctcgaattggatctgtgactcgggttgcccgtgctgcacgggctgccaccactggtgtcgctcggaacctctcttcgacctcttaccaggctggcttcaagcctcttgtggcctccaacggcttcaatggcgctatcggcaacactcctctgattcgaatcaaccacctgtcggacgagactggctgcgaagtctacggtaaggccgaattcatgaaccccggtggatccgtcaaggaccgtgctgctctctacgtggttgaggatgccgagcgaaagggcctgatcaagcccggaggaaccgtggtggagggaaccgcaggaaacaccggtattggtcttgcccacgtctgccgagccaagggctacaagtgtgtcatctacatgcccaacacccagtcccagggtaagattgacctcctccgactgctgggagccgaggtttaccccgtcccagctgtcgcctttgacaacccgcaaaactacaaccacttggccaaggctcacgctgagaagcttggagctggaaatgccgtgtggactaaccagttcgacaatgttgccaaccgacaggctcatattgagaccactggtcccgaaatctgggcccagaccgacggcaagatcgacgccttcacttgttctaccggaaccggaggctcgtttgctggaaccatgcgatacctgaaggacgtttcccacggccgagtccagtgcattcttgccgatccccctggatccgtgctccattcttacgtccaatccggaggtaagctcactgagcgagctggttcttccatcactgagggtatcggtcagggccgagtcactgagaacttggctcccgagattgccgaggtcgatggctctgttcaaatccctgatcaggcaaccattgagatggtttacaacctgctggataaggagggtctctaccttggtgcctcttcttgtctgaacgttgttgctgcctacgaggttgctaagcagattggcccaggccatgttgtggtcactctgctctgtgatggtgctcaccgatacgccgaccggctgttcagcaagaagtggctcgagtccaagggactcaccattcccgagaatctccaaaagtacgttgttctggattaa

SEQ ID NO: 24532 - protein, 377 aa, Yarrowia lipolytica CLIB99
MSRIGSVTRVARAARAATTGVARNLSSTSYQAGFKPLVASNGFNGAIGNTPLIRINHLSDETGCEVYGKAEFMNPGGSVKDRAALYVVEDAERKGLIKPGGTVVEGTAGNTGIGLAHVCRAKGYKCVIYMPNTQSQGKIDLLRLLGAEVYPVPAVAFDNPQNYNHLAKAHAEKLGAGNAVWTNQFDNVANRQAHIETTGPEIWAQTDGKIDAFTCSTGTGGSFAGTMRYLKDVSHGRVQCILADPPGSVLHSYVQSGGKLTERAGSSITEGIGQGRVTENLAPEIAEVDGSVQIPDQATIEMVYNLLDKEGLYLGASSCLNVVAAYEVAKQIGPGHVVVTLLCDGAHRYADRLFSKKWLESKGLTIPENLQKYVVLD

SEQ ID NO: 24533 - DNA, 1617 bp, Yarrowia lipolytica CLIB99
  CDS (1)..(1617)
atggtaaccttttttctacacctgtcccaagccacttttcttcctccaccacaccctcatatctttacaacatacacaatgactccccctcccgtggcccagaccgtgctcgaacacattggcgacacgcccatggttgagctccaaaagatcccccagtctctgggcatcaagtgccgaattctcggaaagtgcgagtacttcaacgctggtggatccgtcaaggaccgaattgccaagcgaatggtgcttgaggccgagaagcagggccgaatcaagcccgacgccggctacactctgattgagcccacgtctggtaataccggtattggacttgctcttgtcggcgccgtccgaggttacagaaccatcatcactctgcccgagaagatgtccaacgagaaggtgtctgtgctcaaggctctgggagccgagattgtgagaacacccactgaggccgcctgggacgcccccgagtcccacattggagttgcccgacgtctggagcaggagatccccaaggctgtcattctcgatcagtacggaaacgaggccaaccccgacgctcacctctacggcactggtgccgagatctgggagcagactgagggtaaggtgacccatctcgtcgctggcgccggaaccggaggaaccatcaccggtattgccaaggctctcaaggccaagaacaaggacgtggttgttgtggctgctgaccccaagggctccattctggccgtccccgagtctctcaacgactccaacgagggctacaaggtcgagggtatcggttacgacttcgtgcccgacgttctggaccgagacgtgatcaactcgtggatcaagaccgaggacagagagtccttcctgctgtctcgacgactcatcaaggaggagggtctgcttgtgggtggatcttctggctcggctctggctgccgctcttcaggtcgccaaggacctcaccgagaacgacactgtggttgtcgtcttccctgattctgtgcgatcttacatcaccaagttcattgatgacgactggatgaagaacaacggcttcgtagacgatgccaccctcgccgagcaggccaagcgaaagcagcagtacaagggcgctaccattgccgatctgcatctcaagcccgttgtcaccgtaaagggtgactccactgtggctactgctgtcgagctcatgcgagagaagggctttgatcagatccccgtttccagcaagtcctccggcaagctcattggccttgttactcttggtaacctgctctcttacctttctcacggccgagctacccccgagactcccgttgagaaggtcatgcttgacttccgaaagctcgactctcaccagctcaccgccgatgccattgcttctgccaccgccagcctttccattggcactccttctggcgataagaaggcctctaagcagcgacagtttgtggaggttactgttgacactcctctgtctgctctcaacaagttcttcgagcacaactccagtgttattgtcaccgagaaggactccgatggtgtcaagcccgtgcacattgttaccaaggtcgatctgctcgcttacctcgtcaagaatggttcttttgagtaa

SEQ ID NO: 24534 - protein, 538 aa, Yarrowia lipolytica CLIB99
MVTFFLHLSQATFLPPPHPHIFTTYTMTPPPVAQTVLEHIGDTPMVELQKIPQSLGIKCRILGKCEYFNAGGSVKDRIAKRMVLEAEKQGRIKPDAGYTLIEPTSGNTGIGLALVGAVRGYRTIITLPEKMSNEKVSVLKALGAEIVRTPTEAAWDAPESHIGVARRLEQEIPKAVILDQYGNEANPDAHLYGTGAEIWEQTEGKVTHLVAGAGTGGTITGIAKALKAKNKDVVVVAADPKGSILAVPESLNDSNEGYKVEGIGYDFVPDVLDRDVINSWIKTEDRESFLLSRRLIKEEGLLVGGSSGSALAAALQVAKDLTENDTVVVVFPDSVRSYITKFIDDDWMKNNGFVDDATLAEQAKRKQQYKGATIADLHLKPVVTVKGDSTVATAVELMREKGFDQIPVSSKSSGKLIGLVTLGNLLSYLSHGRATPETPVEKVMLDFRKLDSHQLTADAIASATASLSIGTPSGDKKASKQRQFVEVTVDTPLSALNKFFEHNSSVIVTEKDSDGVKPVHIVTKVDLLAYLVKNGSFE

SEQ ID NO: 24535 - DNA, 1482 bp, Kluyveromyces lactis NRRL Y
  CDS (1)..(1482)
atgggttacgatactcgccatgatgttatcgacttagtcggcaacactcctttaattcgcttgcaaaaattgccaaaggcaattggtatcaaacctaaggtctatgccaagttagagttgtacaacccaggtggttccatcaaggaccgtattgctaagtccatgatcgaagctgctgaagaagaaggtatcattcatccatccagatccactttgattgaaccaacttccggtaacaccggtattggtttggctttgatcggtgccattaagggttacagaactatcattactctacctgaaaagatgtctaacgaaaaggtttctgtcttgaaggctctaggtgctgaaattatcagaactccaactgctgctgcctgggattctccagaatctcatatcggtgttgccttacgtttagaaaaggaaattccaggtggtatcatcttggatcaatacaataacatgaagaatccagaagctcactacttcggtactggtaaggaaatccaccaccaattggaagatttatctttgttctccaagttgaaagctgttgtcgctggtgctggtacaggtggtactatctccggtatctcgaaatatatcaaggaacagaacgacaaaattgccattgtcggcgctgatcctgttggttccattttggctgtcccagaaaaattaaacgaaaccgatgtcactgaatacaaggtagaaggtattggttacgattttgttccaaaggttttgaaccgtgattctgttgaccattgggtcaagactgatgacaaatcctctttcaaatatgctcgtcaattgatctccaacgaaggtgttctagttggtggtagtagtggtagtgcatttactgctttggttgattactgtaacgaacatccagaattgactgaagatgatgttatcgtcgttatcttcccagattccgtcagatcctacttgactaagttcgtcgatgatgaatggctaaagaccaacggcctatgggatgatgccattgccactccaattgtgcaaaaagaaaccgatgtttttgaagatgccaccgtgaaggatttgaacttgaaaccagtggtctctgttgaagaagacgcttctgttgctactgtcatcaagattttaagagataactcgttcgatcaactacctgtgttaacaaaggatggaaagttgtgcggtttggtaactttgtctcaattattaaagaaattatccacttccaaggatgtttctagcattaaaagtctgttctttgatttccgtaagttgaataactttgatgacatctcttcctataacgccgacaagtctcataagaagatatttgttcgtttcgatgtcaatacaactttgtctgagttgaactctttctttgaaaagaactcagcagctatcattactgagggtctgaacccagtccatattgtcacaaaggtggatttattatcttacttggccaaataa

SEQ ID NO: 24536 - protein, 493 aa, Kluyveromyces lactis NRRL Y
MGYDTRHDVIDLVGNTPLIRLQKLPKAIGIKPKVYAKLELYNPGGSIKDRIAKSMIEAAEEEGIIHPSRSTLIEPTSGNTGIGLALIGAIKGYRTIITLPEKMSNEKVSVLKALGAEIIRTPTAAAWDSPESHIGVALRLEKEIPGGIILDQYNNMKNPEAHYFGTGKEIHHQLEDLSLFSKLKAVVAGAGTGGTISGISKYIKEQNDKIAIVGADPVGSILAVPEKLNETDVTEYKVEGIGYDFVPKVLNRDSVDHWVKTDDKSSFKYARQLISNEGVLVGGSSGSAFTALVDYCNEHPELTEDDVIVVIFPDSVRSYLTKFVDDEWLKTNGLWDDAIATPIVQKETDVFEDATVKDLNLKPVVSVEEDASVATVIKILRDNSFDQLPVLTKDGKLCGLVTLSQLLKKLSTSKDVSSIKSLFFDFRKLNNFDDISSYNADKSHKKIFVRFDVNTTLSELNSFFEKNSAAIITEGLNPVHIVTKVDLLSYLAK

SEQ ID NO: 24537 - DNA, 969 bp, Erwinia carotovora
  CDS (1)..(969)
atgagcaagatctacgaagacaattctttcacaatcggccatacgccgctggttcgcctgaaccgtatcggcaacggacgcattctggctaaagtggaatcccgcaaccccagcttcagcgtaaaatgccgtatcggctccaacctgatttgggatgcagaaaagcgtggcgttctcaaaccgggcatcgaactggttgaacctaccagcggaaacacagggatcgccctggcctacgtcgcggcggctcgcggctacaagctcactctcaccatgccggaaaccatgagcattgagcgtcgtaagctgctgaaagcgctgggggctaatctggtgctgaccgaaggcgccaaaggcatgaaaggggctatcgccaaagcagaagagattgtcgctagcgatccgagccgttatctgctgttacagcagttcagcaacccagctaacccagagattcacgaaaagaccaccggccctgaaatctgggaagatactgacggtgaggttgatgtctttatctctggcgtcggtacaggcggtacgctgactggcgtgagccgctacctcaagaacaccaaaggcaaggccataatcagcgtggcggttgaacctactgattcaccggtgatctctcaagcgcttgctggcgaagagctgaaacccggtccgcacaagattcagggcatcggcgcaggtttcattcctggaaacctagatctggaactgattgaccgcgtagaaaaagtgacgaacgaagaagcaatcagcaccgcacgccgtttgatggaagaagaaggcattctggctggtatttcttccggcgcagctgttgccgcagcactgaatttactcaaagagaaagagttcgacggtaaaactatcgtcgttattctgccctcttccggcgaacgctacctcagtaccgcactctttgccgacctgttcaccgaacaggaactgcaacaatag

SEQ ID NO: 24538 - protein, 322 aa, Erwinia carotovora
MSKIYEDNSFTIGHTPLVRLNRIGNGRILAKVESRNPSFSVKCRIGSNLIWDAEKRGVLKPGIELVEPTSGNTGIALAYVAAARGYKLTLTMPETMSIERRKLLKALGANLVLTEGAKGMKGAIAKAEEIVASDPSRYLLLQQFSNPANPEIHEKTTGPEIWEDTDGEVDVFISGVGTGGTLTGVSRYLKNTKGKAIISVAVEPTDSPVISQALAGEELKPGPHKIQGIGAGFIPGNLDLELIDRVEKVTNEEAISTARRLMEEEGILAGISSGAAVAAALNLLKEKEFDGKTIVVILPSSGERYLSTALFADLFTEQELQQ

SEQ ID NO: 24539 - DNA, 2098 bp, Xenopus laevis
  CDS (30)..(1718)
gcattaggagagaagcccgagaggtcattatgccggctgtgccacccaccacggattctgccgcttgccctcacattaaagaaaaccatgtgaccaatggcagtgtgcaggcggagcttagtgtggacaggaagtggattcggccagacttgcccagcaagtgcacctgggaactgggaaaagcaccgaccgactccccccatcaccacgtggaactgtgtgagcggccccggattctatcctgtatcctgcagaagatcggggacaccccgctggttcggatcaatcagattgggaggagatttgggctgaaatgtgaactgctggccaagtgtgagttcttcaacgctgggggcagtgtaaaggatcgcatcagtctgcggatggtggaagatgccgagagagatggaattctcaagcctggggacacaatcattgagccaacgtctgggaatacaggaatcgggttggccctggcagcagcagtaaaggggtaccgctgtatcattgtcatgccggagaagatgagtatggagaaggtggacgtgctacgtgcccttggggctgagatcgttcggactcccacaagcgcccggtttgattctccagagtctcacgtgggcgttgcatggcggctgaagaatgagatcccaaattcccacattctggatcagtatcggaatgccagtaacccccttgctcattatgacagcacagcagaggaaatcctccagcagtgcgaaggacagttggacatgttggtggcgggcgctggaactgggggaacaataactggtcttgcacgcaagcttaaagaaaagtgtccaaattgcaagattgtcggagtggatcctgaaggttctattttagcagaacccgaagaactgaaccaaacggataagactgggtatgaggtggaggggataggatacgacttcattcctactgtgctggaccggacggtggtggatgaatggtacaagtctaatgacgaggaatcgttctttatggctcgggcattaatccgagaggaggggctgttatgtggaggcagttctggcagtgctatgtcagtggcagtgaaggcagcgaaggacctgagcgaggggcaacgctgcgtggtgatcctgccagactctgtcaggaattacatgtccaagttcctcagtgacaaatggatgacacagaagcagttcctgaaggtggaaaaactggaggaaaggaagccttggtggtggaacttgaaggtttcgtctctatctctctccgctcccctcaccgttctcccaacagtgagctgtggccaaaccatccagctgctgcgagaaaaaggcttcgaccaggtgcccattgtgtctgagacagggctggtgctggggatggtgacgctggggaatatgctctcctctgtccttgctgggaaagtgaaaccttcggatctggtcactaaagtcatctataagcagttcacacaggtgaatctggctgacagcctaggaaagctttcccgaattctggagacggatcactttgctttggttcttcacgagcagattcagtatcacagcgatggctcctccagtaagaagcagatggtatttggggtggtgacggccattgatctgctcaatttcatcacgcgagaacgggagcggcgcgtcagtgaatctggggaaagggatctggtggaacgagtccggcacttcagtgcatcgtaacatggaggacaatgtcccactagtgtgttatgtacaattaaacctttcctcctgcaacatagtaaatcaggttgaaaaaaaaagacacatatctatcaagttcaaccttttaactcaatgttaacctgcctaactgctagttgaccttgaggaaggcaaaaaaacccatttaaagcctgtattgctcactgttttgtctgctcccacctgctgttacctgtcacactgtaggtcacttagaattggctgttactattgcacagattgattctgccgctgaactgcacttcataaataaaggtcattgtgcataaaaaaaaaaaaaaaaaaaaaaaaaaaaaaaaaaaaaaaaaaaaaaaaaaaaaaaaaaaaaaaaaaaa

SEQ ID NO: 24540 - protein, 562 aa, Xenopus laevis
MPAVPPTTDSAACPHIKENHVTNGSVQAELSVDRKWIRPDLPSKCTWELGKAPTDSPHHHVELCERPRILSCILQKIGDTPLVRINQIGRRFGLKCELLAKCEFFNAGGSVKDRISLRMVEDAERDGILKPGDTIIEPTSGNTGIGLALAAAVKGYRCIIVMPEKMSMEKVDVLRALGAEIVRTPTSARFDSPESHVGVAWRLKNEIPNSHILDQYRNASNPLAHYDSTAEEILQQCEGQLDMLVAGAGTGGTITGLARKLKEKCPNCKIVGVDPEGSILAEPEELNQTDKTGYEVEGIGYDFIPTVLDRTVVDEWYKSNDEESFFMARALIREEGLLCGGSSGSAMSVAVKAAKDLSEGQRCVVILPDSVRNYMSKFLSDKWMTQKQFLKVEKLEERKPWWWNLKVSSLSLSAPLTVLPTVSCGQTIQLLREKGFDQVPIVSETGLVLGMVTLGNMLSSVLAGKVKPSDLVTKVIYKQFTQVNLADSLGKLSRILETDHFALVLHEQIQYHSDGSSSKKQMVFGVVTAIDLLNFITRERERRVSESGERDLVERVRHFSAS

SEQ ID NO: 24541 - DNA, 924 bp, Acinetobacter sp
  CDS (1)..(924)
atgaacacagtagaacctaattttttagctgatgagtttttgttagatcattatgttggaaagacgccattggtgcgattacagcgtttggcgtgtcatacacaatcggtagtattggcaaaattagaaggcaacaatccagcaggatccgttaaagatcgccctgcttataacatgatcatgcaagctgaaaagcgtggaaagattcgaccaggcgatacattgattgaagcaaccagcggaaatacaggaattgccttggcgatggttgcggccatgcgtggttataaaatgaagctgattatgcccaataacatgagccaagagcgtaaagatgcaatgttggcttatggtgcagagttgattgaagtgactcagcaacaaggcatggaaggcgctcgtgatttagccttgaaaatgcaatcagaaggtcaggggcttgttttaaaccagtttggtaatcctgataatgttgaagcacattatctcaccactggccctgaaatctggcagcagactaatggaaaaatcacgcattttgtgagttcgatgggaacgacgggcaccattatgggtgtatcaaaatatctaaaagagcaaaatccagatatccagattgtcggtttacaaccatctgaaggatcaagcattgcggggattcgacgttggccacaagaatatttgccaaccatttttgaaccgtcacgtgtcgatcgaattattgatattccgcaaatcgaagctgaaaaaaccatgcgccgtcttgccagagaagaaggaattagtgcaggaacttcttcggggggtgcagtgtgggcatctctcaagattgcggaagagcagcccgatgcagtcattgtttgtattatttgtgatcgcggtgatcgttacttgtcgactggactattttcggttcaagattga

SEQ ID NO: 24542 - protein, 307 aa, Acinetobacter sp
MNTVEPNFLADEFLLDHYVGKTPLVRLQRLACHTQSVVLAKLEGNNPAGSVKDRPAYNMIMQAEKRGKIRPGDTLIEATSGNTGIALAMVAAMRGYKMKLIMPNNMSQERKDAMLAYGAELIEVTQQQGMEGARDLALKMQSEGQGLVLNQFGNPDNVEAHYLTTGPEIWQQTNGKITHFVSSMGTTGTIMGVSKYLKEQNPDIQIVGLQPSEGSSIAGIRRWPQEYLPTIFEPSRVDRIIDIPQIEAEKTMRRLAREEGISAGTSSGGAVWASLKIAEEQPDAVIVCIICDRGDRYLSTGLFSVQD

SEQ ID NO: 24543 - DNA, 999 bp, Acinetobacter sp
  CDS (1)..(999)
atgtctaccgatcaagagtttaaagcaccagcaaatttgggcatagcagtatattcaaataatgcagaagcaattggaaatacgcctttagtacgcattaatcgtattattaaaactggtgcaacggttttaggtaaagttgagagtcgaaaccctgcattctcagtaaaatgccgcattggtgctgctttaattgcagatgcagagaaacgtggtgtattaaaatctggtatgcatattgttgaaccgactagtggcaatacagggattgctttagcttttgttgcagctgcaaaaggttacccgattaccttaaccatgccagcaagtatgagtcttgagcgccgaaaagtgcttaaagctttcggtgcaaacttggttttgacagaaccagcaaaaggaatgaaaggtgcagtggaggaagcagtacgattggcgacagaacagccagatatatatttcctgccacaacagttcgaaaatccagctaaccctaaaattcacgaacaaaccacagggccagaaatttgggatgcaaccaatgggcaagttgatattttagtcgctggagttggtacaggcggcacaatttcaggtatttcgcattattttgaaaaagttcagaataaacccatttattcagttgcagttgaacctgcagaatctccgattatcactcagaccaagcgtggtgaggagattacacctgcacctcataaaatccaaggtattggcgccaattttattccaaagaatctggacttagatattgtagatgaagtcatgcccatcactagtgatgaagcattggaatgggctcgtaaatgtgcgactcaagaaggaattttggggggtatttcatgtggtgcagccttagctgctgctgcaaaaattgcagaacgacctgaaaatgaaggtaaaactattgttgtgattttaccagatagcggtgaacgctacttatcttctgtattatttgaaggtatgtttgaggaatag

SEQ ID NO: 24544 - protein, 332 aa, Acinetobacter sp
MSTDQEFKAPANLGIAVYSNNAEAIGNTPLVRINRIIKTGATVLGKVESRNPAFSVKCRIGAALIADAEKRGVLKSGMHIVEPTSGNTGIALAFVAAAKGYPITLTMPASMSLERRKVLKAFGANLVLTEPAKGMKGAVEEAVRLATEQPDIYFLPQQFENPANPKIHEQTTGPEIWDATNGQVDILVAGVGTGGTISGISHYFEKVQNKPIYSVAVEPAESPIITQTKRGEEITPAPHKIQGIGANFIPKNLDLDIVDEVMPITSDEALEWARKCATQEGILGGISCGAALAAAAKIAERPENEGKTIVVILPDSGERYLSSVLFEGMFEE

SEQ ID NO: 24545 - DNA, 1506 bp, Candida glabrata CBS138
  CDS (1)..(1506)
atggattctagacacaacgttatagatttggttggtaacactccgcttatcgagctgaagaagctgcctaaggcgtatggtattcgtcctcgtgtgtttgccaagctggagctgtacaacccaggtggttccatcaaggaccgtatcgccaagagcatgatcgagtacgcagaggagcaaggcatcatccacccttcgaggtctacgctgatcgagcccacctctggtaacaccggtattggtcttgcgcttatcggtgccgtcaagggttacagaactattatcacgttgcctgagaagatgtccaatgagaaagttagtgttctgaaggcgcttggtgctgagattatcaggacgccaacggaggctgcttgggactctcccgagtcgcacatcggtgtggcccgccgtctggagaaggagatccctggcgcgatcatcctggaccagtacaacaacatgaagaaccccgaggcccactacttcggtaccggtcgcgaaatccagaagcagctggaggacctgaagctgttctcccacttgaacgccgtggtcgccggtgccggtactggtggtaccatctccggtatctccaagtacttgaaggagcagaacccagagatcaagatcgtcggcgctgaccctgtcggctccatccttgcccagccagagaacttgaacgagaccgagatcacctcttacaaagtcgaaggtatcggctacgacttcatcccagaagtgctagacagatccttggtcgacgtgtggtacaagaccgacgacaagcctgccttcaagtacgcaagacagctgatctccaacgagggtgtcctgatcggtggctcctccggttctgcgttcacagcgctagtcgagtactgcaacgaccacccagaactgtccgaagacgacgtcctggtcgccatcttcccagactccatcagatcgtacttgaccaagttcgtcgacgacgaatggttgaagacaaacgacctgtgggacgacgagatcctgaagcgcgtagacttcgacgaaaagaagaagccagccaccgacgacgtcttcaagggcgccaccgtcaaggacttgcacttgaagccagtggtcgccgtcaaggacaacgccttggtctccgacgtcatctccatcctaagagacaacgccttcgaccaactgcctgtcctgacacaagacggtaagctaacgggtctggtgactttgtcccaattgctaaagaagctatccaccggcaaagttaacaacacagacacaatcaagaacctatacttggatttcagaaagttgaacaacttcgacgaagtctcctcttacaacgaaaacaagtccggtaagaagaagttcgtccaattcacttccgaatccactttggctgaattgaacaagttcttcgaaaagaactccagtgccgtcatcacagatggattgaagcctgttcacatcgttacaaagatggacttgctaagttacttggcttccaccgcttga

SEQ ID NO: 24546 - protein, 501 aa, Candida glabrata CBS138
MDSRHNVIDLVGNTPLIELKKLPKAYGIRPRVFAKLELYNPGGSIKDRIAKSMIEYAEEQGIIHPSRSTLIEPTSGNTGIGLALIGAVKGYRTIITLPEKMSNEKVSVLKALGAEIIRTPTEAAWDSPESHIGVARRLEKEIPGAIILDQYNNMKNPEAHYFGTGREIQKQLEDLKLFSHLNAVVAGAGTGGTISGISKYLKEQNPEIKIVGADPVGSILAQPENLNETEITSYKVEGIGYDFIPEVLDRSLVDVWYKTDDKPAFKYARQLISNEGVLIGGSSGSAFTALVEYCNDHPELSEDDVLVAIFPDSIRSYLTKFVDDEWLKTNDLWDDEILKRVDFDEKKKPATDDVFKGATVKDLHLKPVVAVKDNALVSDVISILRDNAFDQLPVLTQDGKLTGLVTLSQLLKKLSTGKVNNTDTIKNLYLDFRKLNNFDEVSSYNENKSGKKKFVQFTSESTLAELNKFFEKNSSAVITDGLKPVHIVTKMDLLSYLASTA

SEQ ID NO: 24547 - DNA, 918 bp, Bacillus thuringiensis
  CDS (1)..(918)
atgaaattatgtgaaaacgtaacagaattaataggagatacacctgtcgtccgattatctaaatttattccagaagacgcagcagatgtgtatgtaaaactagaaatgtttaatccatcgcgcagtgtgaaagaccgtgctgcctataatttactgcacgttgcagaagagaatggtcttatcaaaccaggagatacaattattgaaccgacaagtggaaatacagggataggcttagcaatgaatgcagcagctaaagggtataaagcgattttaattatgccagataatatgtcaaaagagcgtataaatttattaaaagcatacggtgcagaagtagttttaacaccagcagaacaaagaatgccaggagcaattgcgaaggcgttagaactgcaaaagcaaattccaaatagttttattccgcagcaatttgaaaatccagcaaacccgaatattcaccgttatacaactgcacttgaaatttatgaacaaatggatggagagcttgatgcgtttgtagcaacggcaggaacaggcggaactattacagggactggggaaacattaaaagagaaactaccaaacttatatattgcagtagtagaaccgaaaggatctcccgttttatcaggcggtgtgccaggtcctcataaactagtaggaacaagtccggggtttattccgaaaaatttaaatacagaagtgtataacgaaattattcaaattgcagatgaagaggctttaacgacaatgagaaacttagctagacaagaaggtttattagtagggccgtcttccggagcttctgtttatgccgcaattatgattgcaaaacgtttaggcactggaaaaaaagttttatgtgttgcacctgatacaggggaacgttatttgagtatgggattatttgaatga

SEQ ID NO: 24548 - protein, 305 aa, Bacillus thuringiensis
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 24549 - DNA, 924 bp, Bacillus thuringiensis
  CDS (1)..(924)
atgcgagtggcacaatcagtttcagaattaatcgggaaaacgccgatcgttaagttgaaccgcatcgtagaatcagacagcgcagatatatacttaaaattagaatttatgaatccggggagcagcgttaaagatcgtatcgcattagctatgattgaagatgctgagaaaaaaggattattaaaagaaggcgatacaatcattgagccgacaagtggtaacacaggaattggcttagcgatggtagcagctgctaaaggatataaggcaattttagtaatgccagaaacaatgagcgttgagcgtcgcaatttattacgtgcttatggcgctgaattagtattgactccagggcctgaaggaatgggcggagcaattcgtcaagcgactgaattagcaaaagaacatggctactttataccgcaacagttcaaaaatcaatcaaatccagaaattcatcgtttaacaacaggtccagaaattgttgagcaaatgggtgatcaattagatgcatttattgcaggtattggtacaggtggaacgattactggtgctggtgaagtgctgaaggaagcatataaagatattaaaatttatgcagtagaacctgcggattcaccggtgttatctggtggaaaaccgggtccacataaaatccaaggaattggggctggatttgttccagaaacattggatgtagaagtatatgatgaaatcattcaagtgaaaacagagcaagcgttcgaatacgcaagaagagtggctaaagaggaaggtattttagttggtatctcttcaggagcggttatttatgcagcgacagaagttgcgaaaaagttaggtaaagggaaaaaggtacttgttattatcccaagtaatggtgaacgttatttaagtacaccactttatcaatttgagtcttaa

SEQ ID NO: 24550 - protein, 307 aa, Bacillus thuringiensis
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 24551 - DNA, 951 bp, Picrophilus torridus
  CDS (1)..(951)
atgtcagatataaaagagaatgttctcaatgcaataggaaacacacctcttgtaaaattaaataaaatcaacgttaaaaatatagaaatatatgtaaagcttgagtattacagtcccggcatgagcataaaggacagaatagcccttggcatgatagaggatgccgagagaaagggtttgatcgagccgggtgacacaataataggcaaaacctcaggtaataccggcatagggcttgcgatagcctgtgctgtaaagggatacagatttgttgcggtcatgtccgctggaaattccgcagaaagacaaaaaatactaagggcccttggtgccgaggtcgttcttgtgccgcagcaacccggtgaggaacctggaagaatatcaagaaaggacaacgatgccgttgagaaaaagacacaggaattaacagaaaaattgaatgcatacaggccaaatcagtacataaattcaatgaactggaaggttcatcagcacacaacaggccaggagataataaggcagacttctggaaggctggacgcgtttgttgcatacataggcaccggtggaacctttgttggaatagcaagggccctgaaaagctttaacaatgatataaaatgctatcctgttgaaccagatgttgcagcatttctcgcaggcaaaaaggttataacgacgcagcatctgatccagggtggcggtcatgcagtgaaacctccgttctgggatgaatcaatagtggatggatatatacaggtttccgaggatgaggcaataaaaactgcaagggcacttgcaaaaaatgagggtatactaacaggtttttcaggcggtgcaaacgttgcagccgcagccaagctcgacgattcattaaggccgggcagcatcgtggttacggttttacctgatacaggacttaaatacctttcaacggttctctatgagtag

SEQ ID NO: 24552 - protein, 316 aa, Picrophilus torridus
MSDIKENVLNAIGNTPLVKLNKINVKNIEIYVKLEYYSPGMSIKDRIALGMIEDAERKGLIEPGDTIIGKTSGNTGIGLAIACAVKGYRFVAVMSAGNSAERQKILRALGAEVVLVPQQPGEEPGRISRKDNDAVEKKTQELTEKLNAYRPNQYINSMNWKVHQHTTGQEIIRQTSGRLDAFVAYIGTGGTFVGIARALKSFNNDIKCYPVEPDVAAFLAGKKVITTQHLIQGGGHAVKPPFWDESIVDGYIQVSEDEAIKTARALAKNEGILTGFSGGANVAAAAKLDDSLRPGSIVVTVLPDTGLKYLSTVLYE

SEQ ID NO: 24553 - DNA, 969 bp, Photobacterium profundum
  CDS (1)..(969)
atgagcaagatttacgaagataattcactaacgattggcaacactcctctagtacgccttaaccgtgttagtaatggtaatgtactggcaaaaattgaagctcgtaaccctagcttcagcgtaaaatgccgtatcggttcaaacatgatttgggatgctgaaaagaaaggcacactaaaggaaggcattgaacttgtagagccaaccagtggtaatactggtattgctttagccttcgttgcagcagcacgcggatataaattaacgttaacgatgcctgaaagcatgagcttagagcgccgtaaactgcttaaagcccttggtgccaacttggtattaaccgaagcaccgaaaggtatgaaaggcgcaatagaaaaagcggaagaaattgttgcatcagacccaagtaaatatctacttctacaacagtttaataacccagccaaccctgaaattcacgagaaaaccacaggacctgaaatttgggacgcaactgatggcgaaatcgatgtctttgtttcaggcgtcggtacaggtggcacactaacgggtgtaagccgattcattaagcatcagaaaggcaaagccattacaacggttgctgtagaacctactgaatcaccagttatcactcaaacactgaatggcgatgacgtaaaaccagcaccacacaaaattcaaggtattggcgcaggcttcatcccaggaaacctagacttaacattgattgatgaagtcgaattagtcagttcagaagatgctatcgcgatgacacgccgcttaatggaagaagaaggtattcttgctggtatttcctctggtgctgctgttgttgctgcaaataaaatagctgcacggcctgagttcgcaggcaaaaagattgttgtagtgttacctagctcaggtgaaaggtacctatcaacagctctttttgctggcatcttcacagaaaaagaaaaccaacagtga

SEQ ID NO: 24554 - protein, 322 aa, Photobacterium profundum
MSKIYEDNSLTIGNTPLVRLNRVSNGNVLAKIEARNPSFSVKCRIGSNMIWDAEKKGTLKEGIELVEPTSGNTGIALAFVAAARGYKLTLTMPESMSLERRKLLKALGANLVLTEAPKGMKGAIEKAEEIVASDPSKYLLLQQFNNPANPEIHEKTTGPEIWDATDGEIDVFVSGVGTGGTLTGVSRFIKHQKGKAITTVAVEPTESPVITQTLNGDDVKPAPHKIQGIGAGFIPGNLDLTLIDEVELVSSEDAIAMTRRLMEEEGILAGISSGAAVVAANKIAARPEFAGKKIVVVLPSSGERYLSTALFAGIFTEKENQQ

SEQ ID NO: 24555 - DNA, 936 bp, Corynebacterium glutamicum
  CDS (1)..(936)
atgggcaatgtgtacaacaacatcaccgaaaccatcggccacaccccactggtaaagctgaacaagctcaccgaaggcctcgacgcaactgtcctggtcaagcttgagtcattcaacccagcaaactccgtcaaggaccgtatcggtctggccatcgttgaagatgcagagaagtccggtgcactgaagccaggcggcaccatcgttgaagcaacctccggcaacaccggtatcgcactggcaatggtcggcgctgcacgcggatacaacgttgttctcaccatgccggagaccatgtccaacgagcgtcgcgttctcctccgcgcttacggtgcagagatcgttcttaccccaggtgcagcaggcatgcagggtgcaaaggacaaggcagacgaaatcgtcgctgaacgcgaaaacgcagtccttgctcgccagttcgagaacgaggcaaacccacgcgtccaccgcgacaccaccgcgaaggaaatcctcgaagacaccgacggcaacgttgatatcttcgttgcaagcttcggcaccggcggaaccgtcaccggcgttggccaggtcctgaaggaaaacaacgcagacgtacaggtctacaccgtcgagccagaagcgtccccacttctgaccgctggcaaggctggtccacacaagatccagggcatcggcgcaaacttcatccccgaggtcctggaccgcaaggttctcgacgacgtgctgaccgtctccaacgaagacgcaatcgcattctcccgcaagctcgctaccgaagagggcatcctcggcggtatctccaccggcgcaaacatcaaggcagctcttgaccttgcagcaaagccagagaacgctggcaaaaccatcgtcaccgttgtcaccgacttcggcgagcgctacgtctccaccgttctttacgaagacatccgcgactaa

SEQ ID NO: 24556 - protein, 311 aa, Corynebacterium glutamicum
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 24557 - DNA, 1047 bp, Bdellovibrio bacteriovorus
  CDS (1)..(1047)
atgtcacatatttacgactccattctggagaccatcggaaacacaccgattgtccgccttaaaaacgttaccaagggttcaaaacaccagttctttgcgaaaatcgagtatttcaatccaggtggcagcatcaaagatcgcgtcgctgtggcgatgattgaagaggcggaaaaacgcggcgatctgaaggcgggtggcactattgtcgaagccacttccggcaataccggtgtcggcctggctttggcggcggcggttaagggttataagtgcattttcgtgatgccagaaaagatgagtgaagaaaaaagagctattttgcgtgcctatggcgccaaagttgtcatcactccgatggtcgaccctgagcatccgctgagtcactattcagtgtctcagaaaattgcaaaagaaactcccggagcatttctaacgaaccagtatcacaatcctgacaaccctcagcgtcactatcaaaccacgggtccagaaatctggaagcagatggatggaaaagtggatgttgtggtcggcggggctggcactggaggcacactttccggggttgctaaatacctgaaagaaatgaatccaaacatcaaagcaatctgtgcagatccaattggaagcattctgtatgatctttattatcataagaagatcgtggatccaccgggctcttacaaagtggaaggtgtcggcgaagatatgctgccggacaacgttcacttgaatatttatgatggctttgaacgagtgtctgacccggaagcttttacgatgacccgtcgcctggtggcggaagaaggtcttcttgtggggccttccagtgctttggccctggtgggtgcgatgaaagctgcggaaaagatcgaaaagccatcaaatattgtggtggttttcccggacagcggacgagcgtatctgagcaaggccttcaatgatacatggatgattgaaaatgctcttctgaaaccggaagaagcgaaaaatgtctttaatcgcgtggtgaatgccgccgattttctggcagaactgaataagtag

SEQ ID NO: 24558 - protein, 348 aa, Bdellovibrio bacteriovorus
MSHIYDSILETIGNTPIVRLKNVTKGSKHQFFAKIEYFNPGGSIKDRVAVAMIEEAEKRGDLKAGGTIVEATSGNTGVGLALAAAVKGYKCIFVMPEKMSEEKRAILRAYGAKVVITPMVDPEHPLSHYSVSQKIAKETPGAFLTNQYHNPDNPQRHYQTTGPEIWKQMDGKVDVVVGGAGTGGTLSGVAKYLKEMNPNIKAICADPIGSILYDLYYHKKIVDPPGSYKVEGVGEDMLPDNVHLNIYDGFERVSDPEAFTMTRRLVAEEGLLVGPSSALALVGAMKAAEKIEKPSNIVVVFPDSGRAYLSKAFNDTWMIENALLKPEEAKNVFNRVVNAADFLAELNK

SEQ ID NO: 24559 - DNA, 990 bp, Bdellovibrio bacteriovorus
  CDS (1)..(990)
atgcaggccggttccgtttcagacgttgtgggtcacacaccgttaatcaaacttcaatctctttcaaaaatcaccggatgtgagatctttgccaaagccgaatatctgaatccaggtggcagcgtgaaagatcgcacagcgctgggaatcattcaaagcgccgaaaaacaaggtctgctgaagcccggggacacgattgtggaaggcaccgcagggaatacggggattggtcttgccacgctggcggcgcagcgggggtaccactgtgtgatcgtgatgccggacaaccagtccaaagaaaaataccatgcgctcgaagccctgggtgtggagcttgtgaaggtcgctccctgtccctttgccaatcccaaccacttctaccacacagcacgcgccctggctgaatctcgccccaattccttttgggccaaccagtttgagaacaccgccaatttcgagattcactacaagacgaccggccctgagatctgggagcagatgggtcaaagggtggacgcctttgtttcctctgtcggaaccggaggaacgctggcgggagtgtcggcctatttaaaagaacaagatcccaaggtattcacgcttctggcggaccccatgggctcgggtctttattcgtttgtaaaaagtggaaagttcgaagcgcagggcagctcgatcactgaggggatcgggatcatgcgcctgaccgaaaactttaaaaaggcccgtgttgatgaggccgttcaaatccacgacgaacaaatgctttcgatgctttattacctggctcagcatgaaggattgctggtggggacatcggcggccttgaacatctttgcctcataccagtatgccttgcaaaaccagggaaagggattgcggattgcgactgtgatgggagactcggcccttcgctatcaatccaaggtgtttaatccacagttcctgaatgaaaagaacctgaaaattatgcctttgattcatagttaa

SEQ ID NO: 24560 - protein, 329 aa, Bdellovibrio bacteriovorus
MQAGSVSDVVGHTPLIKLQSLSKITGCEIFAKAEYLNPGGSVKDRTALGIIQSAEKQGLLKPGDTIVEGTAGNTGIGLATLAAQRGYHCVIVMPDNQSKEKYHALEALGVELVKVAPCPFANPNHFYHTARALAESRPNSFWANQFENTANFEIHYKTTGPEIWEQMGQRVDAFVSSVGTGGTLAGVSAYLKEQDPKVFTLLADPMGSGLYSFVKSGKFEAQGSSITEGIGIMRLTENFKKARVDEAVQIHDEQMLSMLYYLAQHEGLLVGTSAALNIFASYQYALQNQGKGLRIATVMGDSALRYQSKVFNPQFLNEKNLKIMPLIHS

SEQ ID NO: 24561 - DNA, 990 bp, Bdellovibrio bacteriovorus
  CDS (1)..(990)
atgagaatatattctgatatcacgaaaaccattggtcaaacccccttaatcgaaatgcaaagaatcggcaaaggtttgccggggcgtcttctgctaaagcttgagttctttaatcccctgggatccgtcaaagaccgcatcggtctggcgatgatcgaggacgccgagcgctcaggtcagctaaagcctgggatgaaaattatcgaacccacaagcggcaacacaggcattgcgctggcttttgtggccgctgccaaaggttatgatatcactctgaccatgccagaaaccatgtctcaagagcgccgcacgttgctgctgatgctgggggcgaaaattattctgactccggggcccttgggtatgaagggggccattgccaaagccatggagcttctggaacaaacacccaatgcctggatgcctcgtcagtttgacaatccggccaatccggccattcacaaagaaaccacggctcttgaaatctggaacgacaccgatggcaaggtcgatatggtcgttagcggcgtcgggacttccggcaccatcactggtgtgggcaccgtgcttaaagccaaaaacaaaaacatcaaaatcatcgctgtcgaaccggctgaaagcccggtgctttccggcggtaaacccgggcctcacaagatccagggcctgggggcaggttttgttcccagcgtgatggacagatctgttgtcgatggggtggagcaggtgtcttcggaagagtccataaaagtggctcgggaagtgatcaaaaaagaaggcatcccggtggggatttcctcgggggcggcgatcagtgccggtcttcgccaagcggcgaaagaggaaaaccgcggtaagaatatcgtcgtgattattccaagcaccaccgaacggtatctgtcgaccttgttggccgaacaggaacgggcagaggcattgagtttgcctgtcgctacggtggatgaaaattacctgagtaaagtgaagtaa

SEQ ID NO: 24562 - protein, 329 aa, Bdellovibrio bacteriovorus
MRIYSDITKTIGQTPLIEMQRIGKGLPGRLLLKLEFFNPLGSVKDRIGLAMIEDAERSGQLKPGMKIIEPTSGNTGIALAFVAAAKGYDITLTMPETMSQERRTLLLMLGAKIILTPGPLGMKGAIAKAMELLEQTPNAWMPRQFDNPANPAIHKETTALEIWNDTDGKVDMVVSGVGTSGTITGVGTVLKAKNKNIKIIAVEPAESPVLSGGKPGPHKIQGLGAGFVPSVMDRSVVDGVEQVSSEESIKVAREVIKKEGIPVGISSGAAISAGLRQAAKEENRGKNIVVIIPSTTERYLSTLLAEQERAEALSLPVATVDENYLSKVK

SEQ ID NO: 24563 - DNA, 1038 bp, Rhodopseudomonas palustris
  CDS (1)..(1038)
atgagcatcaagaacgacgtcgtcgacgccatcggcaacacgcccctgatcaaattgaagcgcgcgtcggaggcgaccagctgcaccattctcggcaaggccgagttcatgaatccgggccagtcggtgaaggatcgggctgcgctgttcatcatccaggatgcggtgaagcgcgggacgctgcgtcccggcggcgtcgtggtcgaaggcaccgccggcaataccggcatcgggctggcactggccgccaatgcactcggtttccgtaccgtaatcgtgatcccgaacacgcagagccaggaaaagaaggacatgctgcggctatgcggcgccgagcttatcgaggtgcccgccgtcccctacgctaatcccaacaactacgtgaagctgtccggccgtctcgccgcgcagctcgccgaaaccgaaccgaacggagcgatctgggccaatcagttcgacaacgtcgccaaccgccaagcccatatcgagacgaccgcaccggaaatctggaatcagaccgatggcaaggtcgacggcttcgtcgccgcggtcggctccggcggcacgctggccggcgtgtcgatcggtctcaagcagttcaatccgaaagtccgcgccgtgctcgccgacccgttgggctcggcgctgtacaattactacaagaacggcgcgctgaaatcggaaggctcctcgattaccgaaggcatcggccagggccgcgtcaccgccaatctggaaggcgcgcagatcgacgacgcctatcagatccccgacgatgaagcggtgccgctgatctacgatctgctcgaacacgaaggactgtgcctcggcggctcgagcggcatcaacgttgccggcgcgatccgcctcgccaaggatctcggccccggccataccatcgtgaccatcctgtgcgattacggcagccgttatcagtccaagctgttcaacccggacttcatgcgcagcaagaacctgccggtgccggactggatggagaccaagagcacgattcaggtgccgttcgaaccggtgtga

SEQ ID NO: 24564 - protein, 345 aa, Rhodopseudomonas palustris
MSIKNDVVDAIGNTPLIKLKRASEATSCTILGKAEFMNPGQSVKDRAALFIIQDAVKRGTLRPGGVVVEGTAGNTGIGLALAANALGFRTVIVIPNTQSQEKKDMLRLCGAELIEVPAVPYANPNNYVKLSGRLAAQLAETEPNGAIWANQFDNVANRQAHIETTAPEIWNQTDGKVDGFVAAVGSGGTLAGVSIGLKQFNPKVRAVLADPLGSALYNYYKNGALKSEGSSITEGIGQGRVTANLEGAQIDDAYQIPDDEAVPLIYDLLEHEGLCLGGSSGINVAGAIRLAKDLGPGHTIVTILCDYGSRYQSKLFNPDFMRSKNLPVPDWMETKSTIQVPFEPV

SEQ ID NO: 24565 - DNA, 1398 bp, Rhodopseudomonas palustris
  CDS (1)..(1398)
atgagcctggcccgtcttgccacaccgaaggatcgcacgcccaaggggctgatcgatctgatcggaaacacgcccctggtgcagctgacacggctggatgccggcccgtgccggttgttcgccaaactcgaaggccagaatccaggcggttcgatcaaggatcgaccggcgctggcgatgatcgaggcgttcgagcgcagcggcgagctgcggccgggcgggaccctggtcgaagccaccgccggcaacaccggcctcgggctggcgctgatcgccgcgctgaagggctaccggctggttctcgtcatcccggacaagatgagccgcgaaaaggtgctgcacctgaaggcgatgggcgccgaggtggtgatgacccgctccgacgtcggcaaggggcacccggcttactatcaggatcttgctcagaagatcacttccgaaacccctggcgcggtgttcgtcaatcagttcgccaatccggccaatccgctcgcgcatgaatacggcaccgcgccggaaatctgggagcagatggatcggcgcgtcgacgcggtggtgtgcggcatcggctccggcggcacgctgacagggatcgcgcggttctttcagcgcgcctcgccatcgaccgagatcattctggccgatccgaaaggctccgtgctggtcgacgtggtcgaagggcgggagccgggccctgtcggaagctggctggtcgagggcatcggcgaggacttcgtcccgagcaatgccgaactgaagctggtcacacgcggctacaccgtgaccgacgcagaatccttccacgctgcgcgtgagctgcttcgacgtgaagggattctcgccggctcgtcgtcgggcacgctactggcggctgcgctgcgctattgccgcgagcagacgcggccgaagcgggtggtgacgctgctgccagacggcggcaacaaatatctgtcgaagatgttcaacgatacctggatggccgatcaaggcttcgtaccgcgccggcatgacggggatctgcgcgacctgatcgtgcgtcgccatgacgagggcgcttcgatcacggtcgctcccgaggatacgctgaacttcgcctattcgcggatgaagctgtacgaggtgtcgcaactgccggtgctggtcgacgaccgcgtcgtcggcatcatcgacgagtccgatctgttgatggcgacgatcggcgatccggccaaattcgccgagccggtgcactcggcgatgagcaagcgggtcgaaaccgtcgaggcgtcggcgccattcgagagcctgatgccggtgttcgatcgcggcctggtcgtcgtggtcgtcgacggctcgcgcttcctcggcctgatcaccaggatcgacctgatcaaccatttgcgtagcaaggtgcactga

SEQ ID NO: 24566 - protein, 465 aa, Rhodopseudomonas palustris
MSLARLATPKDRTPKGLIDLIGNTPLVQLTRLDAGPCRLFAKLEGQNPGGSIKDRPALAMIEAFERSGELRPGGTLVEATAGNTGLGLALIAALKGYRLVLVIPDKMSREKVLHLKAMGAEVVMTRSDVGKGHPAYYQDLAQKITSETPGAVFVNQFANPANPLAHEYGTAPEIWEQMDRRVDAVVCGIGSGGTLTGIARFFQRASPSTEIILADPKGSVLVDVVEGREPGPVGSWLVEGIGEDFVPSNAELKLVTRGYTVTDAESFHAARELLRREGILAGSSSGTLLAAALRYCREQTRPKRVVTLLPDGGNKYLSKMFNDTWMADQGFVPRRHDGDLRDLIVRRHDEGASITVAPEDTLNFAYSRMKLYEVSQLPVLVDDRVVGIIDESDLLMATIGDPAKFAEPVHSAMSKRVETVEASAPFESLMPVFDRGLVVVVVDGSRFLGLITRIDLINHLRSKVH

SEQ ID NO: 24567 - DNA, 999 bp, Rhodopseudomonas palustris
  CDS (1)..(999)
atgtccagcgcagcaaccgcatcgatcaaagccgtcgcagaagcaccagcccatcgtcccggccgcggccgagtgtacgagtcgatcgccgatgcttacggcgatacgccgctggtacgtctgaaccggctgccgcagcagcacggcgtcaaggcgacgatctatgccaagctcgagtacttcaatccggcgagcagcgtgaaggaccgtatcggtgcggcgatgatcgcggcgctggagcaggaaggtatcatcaagcccgacaccgtgctgatcgaaccgacctccggtaacactggtatcgcgctggccttcgtggcggccgccaagggctaccggctgaagctggtgatgccggaatcgatgtcgatcgagcgccgcaagatgctcgccttcctcggtgccgaactggtgctgaccgaagccgccaagggcatgaagggcgcggtcgccaaggccgaagagctggtggcggcgaccccgaacgccgtgatgccgcagcagttcaagaacctcgccaacccggcggtgcatcgccgcaccaccgcggaggagatctggaacgataccgacggcgcggtcgatatcttcgtggccggcgtcggcaccggcggcaccgtctcgggcgtcggccaggtgctgaagccgcgcaaggcgtcgctgaaggtggtggcggtcgagccggaggaaagcccggtgctgtcgggcggcgcgcccggcccgcacaagatccagggcatcggcgccggcttcgtgccggacatcctcgaccgctcggtgatcgacgaggtggtcaagatcccgagcgccaccgcgattgaaacctcgcgcgcgctggcgcgccacgaaggcatcccgggcggcatctcgtcgggcgccgcgatcgccgccgcgatcgaactcggcaagcggccggaaaatgccggcaagacgatcgtggcgatcgtgccgtcgttctcggaacgctacctgtcgacggtgctgttcgaaggcgtctga

SEQ ID NO: 24568 - protein, 332 aa, Rhodopseudomonas palustris
MSSAATASIKAVAEAPAHRPGRGRVYESIADAYGDTPLVRLNRLPQQHGVKATIYAKLEYFNPASSVKDRIGAAMIAALEQEGIIKPDTVLIEPTSGNTGIALAFVAAAKGYRLKLVMPESMSIERRKMLAFLGAELVLTEAAKGMKGAVAKAEELVAATPNAVMPQQFKNLANPAVHRRTTAEEIWNDTDGAVDIFVAGVGTGGTVSGVGQVLKPRKASLKVVAVEPEESPVLSGGAPGPHKIQGIGAGFVPDILDRSVIDEVVKIPSATAIETSRALARHEGIPGGISSGAAIAAAIELGKRPENAGKTIVAIVPSFSERYLSTVLFEGV

SEQ ID NO: 24569 - DNA, 936 bp, Corynebacterium diphtheriae
  CDS (1)..(936)
atggctaaaatttacgacagcatcctcgacaccgtgggcaataccccactgattaagctcaatcgcctcgacaaatacctccccggcaacgttgtggtcaaagttgagttttttaaccctgcaaattctgtgaaagaccgtattggtaaagcaatcgtcgacgcagcagaagcctccggtgatctcaagccaggtggcaccatcgttgaagcaacatccggcaacaccggtatcgctctcgcactcgtcggtgctgcccgcggctacaacgttgtgctcaccatgccagaaacgatgtccctcgagcgccgcgtcatgctacgcgcctatggtgcagagatcgttctcacctctggtgcagccggaatgcaaggcgccgtagacaaagcaaacgaaatcgtcgctgagcgcgacaacgccatcctcgccagccagttcaagaacgccgccaacccagaaattcaccgtcgtactaccggcgaagaaatctggaacgacaccgacggacaggtcgacatcttcgtcgcaggcgtgggtaccggcggaaccgtcaccggcgctggcgaaaccctgaagaagcacaacccagagatcaaggtctacgccgtcgagccagcagcctccgctctcctaaccaccggcaaggcaggcccacacaagatccaaggcctcggcgcaaactttatcccaagcgttctaaaccagaaggtctacgaagaagtcattaccgtaactaacgaggacgcaatctccacctcacgccagcttgccgcacaagaaggcatcctaggcggcatttctgccggcgccaacctcaaggcagcacttgagcttgcagcattgccagaaaacgagggcaagaccatcgtcaccgtcgtacctgactacggcgagcgctacgtatcaaccgtcttgttcgacgacatccgcgactag

SEQ ID NO: 24570 - protein, 311 aa, Corynebacterium diphtheriae
MAKIYDSILDTVGNTPLIKLNRLDKYLPGNVVVKVEFFNPANSVKDRIGKAIVDAAEASGDLKPGGTIVEATSGNTGIALALVGAARGYNVVLTMPETMSLERRVMLRAYGAEIVLTSGAAGMQGAVDKANEIVAERDNAILASQFKNAANPEIHRRTTGEEIWNDTDGQVDIFVAGVGTGGTVTGAGETLKKHNPEIKVYAVEPAASALLTTGKAGPHKIQGLGANFIPSVLNQKVYEEVITVTNEDAISTSRQLAAQEGILGGISAGANLKAALELAALPENEGKTIVTVVPDYGERYVSTVLFDDIRD

SEQ ID NO: 24571 - DNA, 906 bp, uncultured bacterium 561
  CDS (1)..(906)
atgaatcccgctgaaaattcgtaccccacgattgagagtgttgtgggggaaaccccgttagtacgtttgcagaggctgacgcagaactccagtaaccatgtgctctgtaaactcgagggcaataaccccgcaggttctgtgaaggataggcccgcgttgagtatgattgttgaggctgaagcgcggggcgatattcgacctggggatacgttgattgaggcgaccagtggtaacacgggaattgccctggctatggctgctgcgattcggggctaccatatgcgcttgattatgcccgctcatatgagttcggagcgaaaattggcgatggctgcctatggcgccgagcttattcaggtgactcgagaggagggtatggagggtgcaagagacctggcggaggcgatgcaggctcgaggagagggcacggttcttaatcagtttggaaactttgataacccgttggcgcattaccgtggcaccggaccagaaatttggcgtcagaccggtggacaagtaacgcactttattagctcgatgggcaccacgggaactatcatgggagtctcagcctttttaaaggaacaaaatcccgacattgagatcattggcttacaacctcaagatggctctcagatcccaggaataaggcgttggtcagaggcgtatcggccaacaatttttcagtcagcgaaggtcgaccgtaccattgacatctctcaggcggaatccgaagttatgatgcgccgtctcgccagtgaggaggggatttttgctggagtatcttccggggggtcaatcagtgctgcactgcaagtcagtcaggaagttgagggcgcaaccattgtcgcgatcgtctgtgatcggggcgatcgctatctttcgacgggtgtttacggaatttga

SEQ ID NO: 24572 - protein, 301 aa, uncultured bacterium 561
MNPAENSYPTIESVVGETPLVRLQRLTQNSSNHVLCKLEGNNPAGSVKDRPALSMIVEAEARGDIRPGDTLIEATSGNTGIALAMAAAIRGYHMRLIMPAHMSSERKLAMAAYGAELIQVTREEGMEGARDLAEAMQARGEGTVLNQFGNFDNPLAHYRGTGPEIWRQTGGQVTHFISSMGTTGTIMGVSAFLKEQNPDIEIIGLQPQDGSQIPGIRRWSEAYRPTIFQSAKVDRTIDISQAESEVMMRRLASEEGIFAGVSSGGSISAALQVSQEVEGATIVAIVCDRGDRYLSTGVYGI

SEQ ID NO: 24573 - DNA, 927 bp, Desulfovibrio vulgaris
  CDS (1)..(927)
atggacatcgcatcaagcatgacggacctcgtgggcaagacgcccatggtgcgcctcaacaaggtcacactcggctgtgtcgccgaggtcgtcgccaaactcgagaatttcaacccgtgcagttccgtgaaggaccgcatcgccctcaacatggtggaagccgccatcgcacggggagagattgccccgggcgcggtgcttgtggaacccaccagcggcaacaccggagtgggccttgccttcgtatgcgccgtgcgcggcctcaagctggtgctgaccatgccggagagcatgagcgccgaacgccgggcactgctcaaggccttcggcaccacgctggtgctcacgcccgcagccaaggggatgcgtggcgcggtggaagaggccgagcgcatcgtggccgacacccccggtgcggtgatgctgcaacagttcgccaaccccgacaaccccgctgcccatgaggccaccaccggcccggagatatgggccgacaccgacggcatgatcgactgcttcgtggcgggggtcggcacgggcggcaccatcaccggtacgggacgctacctcaagggacgcaaccccgacatccgggtcatcgccgtcgaacccgcagaatcggccgtgctttccggcggtgcccccggcccccatgccattcagggcatcggtgcggggttcgtcccgcccgtgctcgacacgtcggtctatgacgaggtgatgcccgtccccggtgccgacgcgctgaccatggcccggcggctgcttcaggaggagggcatcctgtgcggcatctcttcgggtgccaacgtgcatgccgccatcgcctacgccagacgccccgagaatgcgggcaagcgcgtggtgtgcatcatctgcgacacgggcgaacgctacctttcgacaccgctcttcgcccccgagtag

SEQ ID NO: 24574 - protein, 308 aa, Desulfovibrio vulgaris
MDIASSMTDLVGKTPMVRLNKVTLGCVAEVVAKLENFNPCSSVKDRIALNMVEAAIARGEIAPGAVLVEPTSGNTGVGLAFVCAVRGLKLVLTMPESMSAERRALLKAFGTTLVLTPAAKGMRGAVEEAERIVADTPGAVMLQQFANPDNPAAHEATTGPEIWADTDGMIDCFVAGVGTGGTITGTGRYLKGRNPDIRVIAVEPAESAVLSGGAPGPHAIQGIGAGFVPPVLDTSVYDEVMPVPGADALTMARRLLQEEGILCGISSGANVHAAIAYARRPENAGKRVVCIICDTGERYLSTPLFAPE

SEQ ID NO: 24575 - DNA, 915 bp, Thermus thermophilus
  CDS (1)..(915)
atgcgggtggagggcgccatcggcaagacccccgtggtccgcctcgccaaggtggtggagccggatatggccgaggtctgggtcaagctggaagggctgaaccctgggggctccatcaaggaccgccccgcctggtacatgatcaaggacgccgaggagcgggggatcctgaggccgggctcgggacaggtcatcgtggagcccacgagcggcaacaccggcatcggcctcgccatgatcgccgcaagccggggctaccgcctcatcctcaccatgcccgcccagatgtccgaggagcggaagcgggtcctcaaggcctttggcgccgagctcgtcctcaccgacccggaaaggcggatgctcgcggcgagggaggaggcgctaaggctcaaggaggagctcggggccttcatgccggaccagttcaaaaaccccgccaacgtccgggcccactacgagaccacggggcccgagctctacgaggccctggagggccgcatagacgccttcgtctacggctccggcaccgggggaacgatcacgggggtgggccgctacctcaaggaaaggatcccccacgtgaaggtcatcgccgtggagcccgcccgctccaacgtcctctccggggggaagatggggccgcaccagttccagggcatgggcccgggcttcatccccgagaacctggacctttccctcctggacggggtgatccaggtctgggaggaggacgcctttcccttggcccggcggctcgcacgggaggaggggcttttcctggggatgagctcgggggggatcgtctgggccgccctccaggtggcccgggagctcggccccgggaagcgggtggcctgcatcagcccggacggcggctggaagtacctctccacccccctttacgccgagccctag

SEQ ID NO: 24576 - protein, 304 aa, Thermus thermophilus
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGPHQFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 24577 - DNA, 924 bp, Bacillus cereus
  CDS (1)..(924)
atgcgagtggcacaatcagtttcagaattaatcgggaaaacgccgatcgttaagttgaaccgcatcgtagaatcagacagcgcagatatatacttaaaattagaatttatgaatccagggagcagtgttaaagatcgtatcgcattagctatgattgaagatgctgagaaaaaaggattattaaaagaaggcgatacaatcattgaaccgacaagtggtaacacaggaattggtttagcgatggtagcagctgctaaaggatataaggcaattttagtaatgccagaaacaatgagtattgaacgtcgtaatttattacgtgcttacggtgcggaattagtattgactccaggtcctgaaggaatgggtggagcaattcgtaaagcgactgaattagcaaaagagaatggttacttcataccacaacagttcaaaaatcaatcgaatccagaaattcaccgtttaacaacaggtccagaaattgttgaacaaatgggcgaccaattagatgcgtttattgcaggtattggtacgggtggaacgattactggtgctggtgaagtgctgaaggaagcgtataaagatattaaaatttatgcagtagaacctgcggattcaccagtattatctggtgggaaaccaggtccacataaaatccaaggaattggggctggatttatcccagagacattggatgtagaagtatatgatgaaattgttcaagtgaaaacggagcaagcgtttgaatatgcaagaagagtggcgaaagaggaaggtattctagttggtatctcttctggagcagttatttatgcagcaacagaaattgcgaaaaagttaggcaaagggaaaaaggtacttgttattatcccaagtaacggtgaacgttatttaagtacaccactttatcaatttgagtcttaa

SEQ ID NO: 24578 - protein, 307 aa, Bacillus cereus
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSIERRNLLRAYGAELVLTPGPEGMGGAIRKATELAKENGYFIPQQFKNQSNPEIHRLTTGPEIVEQMGDQLDAFIAGIGTGGTITGAGEVLKEAYKDIKIYAVEPADSPVLSGGKPGPHKIQGIGAGFIPETLDVEVYDEIVQVKTEQAFEYARRVAKEEGILVGISSGAVIYAATEIAKKLGKGKKVLVIIPSNGERYLSTPLYQFES

SEQ ID NO: 24579 - DNA, 933 bp, Mycobacterium paratuberculosis
  CDS (1)..(933)
atgagcatcgccgagaacgtcacgcagctgatcggaaacaccccgctggtccggttgaaccgggtcaccgaaggtgcggtcgccgacgtcgtcgccaagttggaattcttcaacccgggcaacagcgtgaaggaccgtatcggggtggccatgatcgatgcggccgagcaggcgggcctgatcaaaccggacaccatcattctcgagccgacgagcggcaacaccggtatcgcgctggcgctggtggccgcggcgcgcggctaccgctgcgtgctcaccatgccggagacgatgagcgtggagcggcgaatgttgttgcgcgccttgggcgccgagatcgtgctgacgccgggcgccgacggcatgccgggcgcgatcgccaaggccgaggaattggccaagagcgacgaccggtatttcgtgccgcagcagttcgagaacccggccaacccggcgattcaccgcagcaccaccgcggaggaagtgtggcgcgacaccgacggcaaggtcgacatcttcgtcgccggcgtcggcaccggcggcaccatcaccggtgtcgcccaagtcatcaaggaacgcaagccgtcggcgcagttcatcgccgtggagccggccgcgtcgccggtgttgtccggcggccagaaggggccgcatccgatccagggtctcggcgctgggttcgtgccgccggtgcttgccatggatctggtcgacgaggtcatcgccgtcggcaacgaggagtcgatcgcgctggcccgccggctggccgccgaggaggggctgctggtcggcatctcctcgggggcggcgctggtggccgccctgcaggtggcccgccggcccgagaacgccggcaagctggtggtcgtcgtgctccccgacttcggtgagcggtacctgagcacgccgctgttcgccgacctggccgattag

SEQ ID NO: 24580 - protein, 310 aa, Mycobacterium paratuberculosis
MSIAENVTQLIGNTPLVRLNRVTEGAVADVVAKLEFFNPGNSVKDRIGVAMIDAAEQAGLIKPDTIILEPTSGNTGIALALVAAARGYRCVLTMPETMSVERRMLLRALGAEIVLTPGADGMPGAIAKAEELAKSDDRYFVPQQFENPANPAIHRSTTAEEVWRDTDGKVDIFVAGVGTGGTITGVAQVIKERKPSAQFIAVEPAASPVLSGGQKGPHPIQGLGAGFVPPVLAMDLVDEVIAVGNEESIALARRLAAEEGLLVGISSGAALVAALQVARRPENAGKLVVVVLPDFGERYLSTPLFADLAD

SEQ ID NO: 24581 - DNA, 1407 bp, Mycobacterium paratuberculosis
  CDS (1)..(1407)
atgcggatcgcgcagcacatcagtgacctcatcggcggcacgccgctggtgcggctgaactccgtcgtgcccgacggcgcgggcatcgtggcggccaaggtcgaatacctcaaccccggcggcagctccaaggaccggatcgcggtcaggatgatcgacgccgccgaggccagcggggcgctgaagcccggcggcaccatcgtcgaacccacctcgggcaacaccggcgtggggctggcgctggtggcccagcagcgcggctacaagtgcgtgttcgtctgcccggacaaggtcggcgaggacaagcgcaacgtgttgatggcgtacggcgccgaggtggtggtgtgcccgacggcggtgccgcccgagcatccggacagctactacagcgtctcggaccggctggtcaccgagatcgaaggcgcctggaagcccgaccagtacgccaacccggagggcccggccagccactacgccaccaccggcccggagatctgggccgacaccgacggcaaggtcacccatttcgtcgccggcatcggcaccggcggcaccatcaccggcgcgggccgctacctcaaggaggtgtccggcggccgggtccgcgtcatcggcgccgaccccgagggatcggtgtattccggcggcaccggccggccctatctggtcgagggcgtcggcgaggacttctggccgcaggcctacgaccgcacggtgcccgacgagatcatcgcggtctccgactccgactcgttcaacatgacccggcggctggcccgcgaggaggcgatgctggtcggcgggtcctgcggcatggccgtggtggcggcgctgcgggtggccgagcaggccgggcccgacgcgctggtggtggtgctgctgcccgacggcgggcgcggctacatggcgaagatcttcaacgacgcctggatgtcctcctacgggttcctgcgtacccggctggacgggtcgaccgaccagtcccgcgtcggcgacgtgttgcgccgcaagtccggtgagctgcccgacctggtgcacacccacccgtcggaaaccgtgcgcgacgccatcggcatcctgcgcgagtacggggtgtcccagatgccggtggtcggcgccgagccgccggtgatggccggcgaggtcgccggcagcgtctccgaacgtgagctgctgtcagcggttttcgagggccgggcgaagctggccgacgcggtctcgctgcacatgagcccgccgctgccgatgatcggcgccggcgaatcggtcagcgcggcgggcaaggcgctgcgcgattgggacgccctgatggtggtcgaggagggcaagccggtgggtgtgatcacccgctacgacttgctcggtttcctctccgagggaccccgcggatcgggcgggcggcgctag

SEQ ID NO: 24582 - protein, 468 aa, Mycobacterium paratuberculosis
MRIAQHISDLIGGTPLVRLNSVVPDGAGIVAAKVEYLNPGGSSKDRIAVRMIDAAEASGALKPGGTIVEPTSGNTGVGLALVAQQRGYKCVFVCPDKVGEDKRNVLMAYGAEVVVCPTAVPPEHPDSYYSVSDRLVTEIEGAWKPDQYANPEGPASHYATTGPEIWADTDGKVTHFVAGIGTGGTITGAGRYLKEVSGGRVRVIGADPEGSVYSGGTGRPYLVEGVGEDFWPQAYDRTVPDEIIAVSDSDSFNMTRRLAREEAMLVGGSCGMAVVAALRVAEQAGPDALVVVLLPDGGRGYMAKIFNDAWMSSYGFLRTRLDGSTDQSRVGDVLRRKSGELPDLVHTHPSETVRDAIGILREYGVSQMPVVGAEPPVMAGEVAGSVSERELLSAVFEGRAKLADAVSLHMSPPLPMIGAGESVSAAGKALRDWDALMVVEEGKPVGVITRYDLLGFLSEGPRGSGGRR

SEQ ID NO: 24583 - DNA, 927 bp, Geobacter sulfurreducens
  CDS (1)..(927)
atggagcatccccctttttcgcttgccggcagcatcggcgccacccccctcgttgagctgcgacacctgaacccgaatccgcgggttcgcatcctggccaaattggaggggaataacgtgggcggttccgtcaaggaccgtccggctctctacatgctggccaaggcggaggagtccggcgagttggtgccggagaagaccatcctcgagccgacctccggcaataccggcatcgctctggccatgctcggcacggtcaagggataccgggtcaagctcgtgatgcccgcctgcgtaagccttgaacggcgcgccgtgctggaggcctatggcgccgagttggtcctctctccccacgacgaggccaccgacggagccatccggctggcccaccgcatcctggaagaggagccggaccgctactacatgcccaaccagtacgccaatcccaacaatcccctggctcactatgagaccactgcgcctgagattttccgggacaccggcggtgccgtcgacttcttcgtggccggcatggggacgggcggcaccttgatgggaacgagccgctatttccgggagaagaagccttccgtgcgcatcgtgggcgtggagccgcgattggggcacaaggtgcaggggctcaagaacatgcaggaagccatcgtgcctcccatctaccaccccgaggccctggacctgaagctgacggtccatgacgagccggccttcgacacggcccgtgagctggccgcccgcgagggccttttcgtggggatgtccagcggcgccgccgtggcgggtgccgtccaggtggcacgggatgccccggcaggcagcaccatcgtagtgctcctgccggaccggggggaccgctatctcagcacggtcctgttccggtcggtttgcggcaagtgccctccctga

SEQ ID NO: 24584 - protein, 308 aa, Geobacter sulfurreducens
MEHPPFSLAGSIGATPLVELRHLNPNPRVRILAKLEGNNVGGSVKDRPALYMLAKAEESGELVPEKTILEPTSGNTGIALAMLGTVKGYRVKLVMPACVSLERRAVLEAYGAELVLSPHDEATDGAIRLAHRILEEEPDRYYMPNQYANPNNPLAHYETTAPEIFRDTGGAVDFFVAGMGTGGTLMGTSRYFREKKPSVRIVGVEPRLGHKVQGLKNMQEAIVPPIYHPEALDLKLTVHDEPAFDTARELAAREGLFVGMSSGAAVAGAVQVARDAPAGSTIVVLLPDRGDRYLSTVLFRSVCGKCPP

SEQ ID NO: 24585 - DNA, 924 bp, Geobacter sulfurreducens
  CDS (1)..(924)
atgccgctactaaccaacgacaaggtaatcgagcagatcggcaatacccctctcctgagactggcaaagcttgagcgaaagggttcggcagccgtattcggcaaggcggagttcttcaaccccggcggcagcatcaaggatcgtatctgcctcgccatgatcgaggccgccgagcgtgacggcaccctcaagcccggcgccacggtggtggagcccaccagcggcaatacgggcatcggcctgtccatgatctgcgcggtcaaggggtacaagctcatcctgaccatgcccgataccatgactgtggagcggcggcggctgctggcggcgtacggcgccgaactgatcctcacccccggcgcccaggggatgcgcggggccgttatgaaggcggaggaactggcggcccagccggggcacgtgatgatgcaccagttcaagaacccggcaaacccggatatccatcgccggaccacggggccggagatcgtggaaaccctgtccggcacgaccatcgacgccttcgtggcgggggtgggcaccggcggcaccatcaccggcgtcggcgaggtgctcaggacgcacaactcctcggtgcgggtcgtggcggtggagccggctgattcgccggtcctctcgggaggccagcccggtccccacaagatccagggaatcggagccggcttcgttcccgatgtgctcaataccaaggtgtatgacgagatcatcaccgtttccaacgacgatgcctatgccaccgtgcgcgacttggcccgcgaggagggcatcctcgtcggcatctcctcaggtgccaacgtcttcgccgcccttcaggtggctgccaagctcgggccgggcaagaacgtggtaacgatcctgtgcgacaccggcgagcggtacctttccaccggggtgttcgactga

SEQ ID NO: 24586 - protein, 307 aa, Geobacter sulfurreducens
MPLLTNDKVIEQIGNTPLLRLAKLERKGSAAVFGKAEFFNPGGSIKDRICLAMIEAAERDGTLKPGATVVEPTSGNTGIGLSMICAVKGYKLILTMPDTMTVERRRLLAAYGAELILTPGAQGMRGAVMKAEELAAQPGHVMMHQFKNPANPDIHRRTTGPEIVETLSGTTIDAFVAGVGTGGTITGVGEVLRTHNSSVRVVAVEPADSPVLSGGQPGPHKIQGIGAGFVPDVLNTKVYDEIITVSNDDAYATVRDLAREEGILVGISSGANVFAALQVAAKLGPGKNVVTILCDTGERYLSTGVFD

SEQ ID NO: 24587 - DNA, 1479 bp, Ashbya gossypii
  CDS (1)..(1479)
atgtacgataaccgccatcacgtgattgatttagttggtaacactcctctagtggagttgagcaagctgcccaaggcccttggcattaagcctcaggtgtatgccaagctagagctgtacaacccaggcgggtccatcaaggaccggattgccaagaccatgattgagcgcgcagaagagagtggcatcatccacccatcgcgctcgacgctgatcgagccaacgtcgggcaacactggtatcggtttggcgctgatcggggccatcaagggctaccgcacgatcatcactctgccagagaagatgtcgaacgagaaggtctccgtgttgaaggcgttgggtgcggagatcattcgtacgcccactgccgcggcatgggattcgcccgagtctcacatcggtgtggcgcgcaagctcgagaaggagattcccggcgccatcattctggaccagtacaacaacgagatgaacccatacgcccactacttcggcacgggcagggaaatccaccaccagctgcgtaacttaggcaagttcgaccagctgcacggcttggtggccggcgctggtaccggtggtaccatctccggtaccgccaagtacctgaaggagcagaagccggacgtgaaggtcgtcggcgctgacccaatgggttccatccttgctcagcctgcttcgttgaacgacaccgacatcagcgagtacaaggtcgagggtattggttacgatttcattcctgaagtcctagaccggtctttggtcgaccaatggattaagacggaggacaaggcctccttcaagtacgcccgtcagttgatctccaacgagggaacccttgtgggcggctcttctggctctgcatttgcggcgcttgtggagtactgcaacgcgcaccccgaactcaccgaggatgacgtgcttgttgtcattttcccagactctatccgctcttacttgaccaagtttgtggacaacgagtggttgaagagcaacaacttgtgggatgacgagattgtggcccctctagccaagaacgaagaggacgccttcaatggcgccaccgtcaaggacttgcagctcagaccagtcgtggctgtcagtgagactgctgctgtgtcggaagtggtcaagattttgaaggacaacggattcgaccagctgccagtgttggctgaaaacagcaagaagcttgggggtctggtgactctctcccagcttctaaagaagctgtcttctggggcagaggtctctagcatcaagagcctattcctcgacttcagaaagctaaacaacttcgatgacatctcctcgtacaatgacaacaaaacaggaaagaagaagttcgtcacctttaccgtggactccaaactatctgagttgaaccgcttctttgagaagaactcttccgccattatcacggacggttttactccagtgcatgtggtcaccaaggtggacttgctctcctacctagcctaa

SEQ ID NO: 24588 - protein, 492 aa, Ashbya gossypii
MYDNRHHVIDLVGNTPLVELSKLPKALGIKPQVYAKLELYNPGGSIKDRIAKTMIERAEESGIIHPSRSTLIEPTSGNTGIGLALIGAIKGYRTIITLPEKMSNEKVSVLKALGAEIIRTPTAAAWDSPESHIGVARKLEKEIPGAIILDQYNNEMNPYAHYFGTGREIHHQLRNLGKFDQLHGLVAGAGTGGTISGTAKYLKEQKPDVKVVGADPMGSILAQPASLNDTDISEYKVEGIGYDFIPEVLDRSLVDQWIKTEDKASFKYARQLISNEGTLVGGSSGSAFAALVEYCNAHPELTEDDVLVVIFPDSIRSYLTKFVDNEWLKSNNLWDDEIVAPLAKNEEDAFNGATVKDLQLRPVVAVSETAAVSEVVKILKDNGFDQLPVLAENSKKLGGLVTLSQLLKKLSSGAEVSSIKSLFLDFRKLNNFDDISSYNDNKTGKKKFVTFTVDSKLSELNRFFEKNSSAIITDGFTPVHVVTKVDLLSYLA

SEQ ID NO: 24589 - DNA, 1098 bp, Spinacia oleracea
  CDS (78)..(1076)
tctcatatactaacattcaactgcacgttctcttgattctactttggaaatttggttgtgtagctttgcttgggtatatggagggagagtgcagcattgcaaaagatgtgactgaactggtgggaaacacacctgtagtttatcttaatcatgtcgcagagggttgtgttgcacgcattgcagccaagcttgaaatgatggaaccatactccagtgttaaagacaggattgcagttagtatgatcaaagatgctgaagaaaaaggcttgatttctcctgagaagactgttctcatagaaatgacaagtggtaatactggcattggattggcgtttattgctgctgcaaagggctataagctaatcattgtaatgccttcgtatgtgagtcttgagagaagagtaatccttctagccttgggagcagagttgcacctcatgggtccaacaaaaagctttcctgatttcgtggccaaagctagagaattattggacaaaactccaggcggctattacattaatcaattcgaaaaccctgggaatccaaagactcattttgaaactacggggccagagatctggagagccacggaagggaaagtggatgcatttgtctctggcatagggactggtggtaccgtcactggggcaggaagattccttaaggagaaaaattctgctatcaaggtctatggtgtagagccaactgaaagtgcagtcctaaatggagaaaagcctggcaagcataaaatccaagggattggtgctggtgtcatccctccattactggactttgacataattgaggaagttgtaaaggtatctagtgacgaagcctttgaaactgctaagcttcttgcattgaaagaaggtttgctggttgggatatcgtcgggagctgccgttgctgctgctattaagctagcaaaaaagcctgagtttgctgagaaattgattgttgtgcttatccctagctttggagagcgttatttatctaccgagttgtttgcttcagagaggcaagaagtggaggctttgacttatgaaagggccgatttgccactttcccccttgtgaaacacccgctgaaaaatgagac

SEQ ID NO: 24590 - protein, 332 aa, Spinacia oleracea
MEGECSIAKDVTELVGNTPVVYLNHVAEGCVARIAAKLEMMEPYSSVKDRIAVSMIKDAEEKGLISPEKTVLIEMTSGNTGIGLAFIAAAKGYKLIIVMPSYVSLERRVILLALGAELHLMGPTKSFPDFVAKARELLDKTPGGYYINQFENPGNPKTHFETTGPEIWRATEGKVDAFVSGIGTGGTVTGAGRFLKEKNSAIKVYGVEPTESAVLNGEKPGKHKIQGIGAGVIPPLLDFDIIEEVVKVSSDEAFETAKLLALKEGLLVGISSGAAVAAAIKLAKKPEFAEKLIVVLIPSFGERYLSTELFASERQEVEALTYERADLPLSPL

SEQ ID NO: 24591 - DNA, 1221 bp, Penicillium chrysogenum
  CDS (45)..(1160)
ggtcgatgggaccatttgttcctgcattgcaagctcaagtcaggatgtttcgtcaaagtgttcggcggttcgccactacggcggctcgtgctgccgagggatccactgcctactgcacccgggtgtcaacagcccagggcgttgtcaatggactgaccgaggcgattggcaacaccccacttatccgattgaagaagctctccgagcaaaccggttgcaatgttctcggaaaggcagagttccaaaaccccggaggtagcgtgaaggaccgagcagcgctctttgtggtcaaaaacgccgaggagaagggactcctgaagcccggtggcaccgtggttgaaggaacggctggaaacactggtattggactggcgcatgtgtgtcggtcaaagggctacaagctcgtgatctatatgcccaacacccagtcccagggcaagattgacttgctccgtctgctgggagcggaagtatacccggtccccgcagtggccttcgacaacccccagaactacaaccaccaggcgcgccgacacgccgagtcactagacaacgcagtctggaccaaccagttcgacaacgttgcgaaccgtcaagcacacatcgaaactaccgggcccgagatctgggcacagacccagggcaagattgacgcctttacctgcgctaccggaaccggaggtaccctggctggtactacgcgctatctgaagactgtcagtgatggacgtgtaaagagcttcctcgccgatcctccgggcagtgttctccacagctacatccaaagtggtggcacactgatcgatcgttctggcagcagtatcactgagggtatcggccagggacgtgtgacagataaccttcagcccgatattgacttgctagatggctctgtgaacatcagtgacgagaagactatcgagatggtttaccgctgtctggatgaggagggcctgtaccttggtgccagttccgcgatgaacgtcgtggccgccaaggaggttgccgagaagttgggcaagggtaacaccgttgtgaccattctctgtgacggtgcttatcggtatgcggatcgcttgttctccagcaaatggctcgagagcaagaacctgcttggctccattccgaagcacctgcagaagtacgttgtgttgccttagaggactgtataaattgaataaactgtattcccaaaaaaaaaaaaaaaaaaaaaaaaaaaaa

SEQ ID NO: 24592 - protein, 371 aa, Penicillium chrysogenum
MFRQSVRRFATTAARAAEGSTAYCTRVSTAQGVVNGLTEAIGNTPLIRLKKLSEQTGCNVLGKAEFQNPGGSVKDRAALFVVKNAEEKGLLKPGGTVVEGTAGNTGIGLAHVCRSKGYKLVIYMPNTQSQGKIDLLRLLGAEVYPVPAVAFDNPQNYNHQARRHAESLDNAVWTNQFDNVANRQAHIETTGPEIWAQTQGKIDAFTCATGTGGTLAGTTRYLKTVSDGRVKSFLADPPGSVLHSYIQSGGTLIDRSGSSITEGIGQGRVTDNLQPDIDLLDGSVNISDEKTIEMVYRCLDEEGLYLGASSAMNVVAAKEVAEKLGKGNTVVTILCDGAYRYADRLFSSKWLESKNLLGSIPKHLQKYVVLP

SEQ ID NO: 24593 - DNA, 1206 bp, Solanum tuberosum
  CDS (35)..(1090)
gacaaattgtagtgagtgatttacaacttctacaatggcgtccttactaaggagaaggttttattcgagtgaatcatcatttgctcagaggctaagagatctgccaaagtatcttcctggtaccaacatcaaaactcaagtttctcaactcattgggaaaacaccattggtgtatcttaacaaagtgagtgaaggatgtggtgcttatattgctgttaaacaagaaatgatgcaacctacttctagtatcaaagatagaccagcatttgctatgataaacgatgcagaaaagaaaggattaatcacccctgggaaaacaacactaatcgagccaacatcagggaatatgggaataagtatggcatttatggctgccatgaaaggctacaaaatgattttgacaatgccatcctatacaagcttggagaggagggtgaccatgagagcattcggagctgatttagtgaccactgatccaactaaaggaatgggaggaactattaagaaagcgtatgatcttttggaatctacacctaatgcttatatgcttcaacaattctccaatccagccaatactcaagctcattttgagactactggccctgaaatttgggaagatactcaaggtaatgttgacatctttgtcatgggaataggaagcggaggcacagtctctggtgttggacagtatctgaaatcgaaaaatcctaatgtcaagatatatggaattgagccaactgaaagcaatgtattgaatggtggaaacccaggtcctcacgaaataactggcaatggggttggattcaagccggatatccttgacatggatgtaatggaagaagttctgatggtttcgagcgaagaatcggtaaacatggctagggaattggcgttgaaggaaggccttatggttggtatatcatcaggagcaaatacagtagctgcacttagactcgccaacaggccagaaaacaaaggaaaactcatagtgacaatacatccaagttttggagagaggtacttgtcatctgttctgtatgaagatatcaggaaagaggcacagaatatgcaacctgtatcagttgattaatggtctattattatagtgatagctgtagtgaaactagtacaaaaagaaataatatatgtactacattttctgaaataatgtttatgctttaaataataatgaaaatttatcctttt

SEQ ID NO: 24594 - protein, 351 aa, Solanum tuberosum
MASLLRRRFYSSESSFAQRLRDLPKYLPGTNIKTQVSQLIGKTPLVYLNKVSEGCGAYIAVKQEMMQPTSSIKDRPAFAMINDAEKKGLITPGKTTLIEPTSGNMGISMAFMAAMKGYKMILTMPSYTSLERRVTMRAFGADLVTTDPTKGMGGTIKKAYDLLESTPNAYMLQQFSNPANTQAHFETTGPEIWEDTQGNVDIFVMGIGSGGTVSGVGQYLKSKNPNVKIYGIEPTESNVLNGGNPGPHEITGNGVGFKPDILDMDVMEEVLMVSSEESVNMARELALKEGLMVGISSGANTVAALRLANRPENKGKLIVTIHPSFGERYLSSVLYEDIRKEAQNMQPVSVD

SEQ ID NO: 24595 - DNA, 999 bp, Wolinella succinogenes
  CDS (1)..(999)
atgtataatcctcctagattaattgcgcaagagagttttaaaaagatcaaaactttaaacgaaggagaaaaaatgaaagtcgctcagaatgttcaagaactcatcggcaagacccccctagttaggctcaatttcgcctctaaagagagtggagctaatgtcatcggcaaatgcgaattcatgaacccctcaggctcggtcaaagaccgaatcgccctagggatgatcaatgccgccattggggcgggtaaaatcacccctgagaccatcgtcattgagcccaccagtggaaatacaggaatcggactggcttctgtctgcgccgccaaaggaatcaagctcattctcactatgccaagctccatgagtattgagcggcgtaaactattggcggctttgggagcgcaaatcgagctaacccctgccgaaaaagggatgaaaggtgcagtggagagagctttggagctcgcccaagagaccaaaaactctttcgttcctcagcagtttgaaaaccccgccaaccctgaatatcaccgagtgaccacggcggtggagatttgggaagatttagatggcaaggtggatgtgctagtggctggagtcggcacgggcggcacgatcacaggcgtgggcgaggtgctcaaggcaaagaatcctaatctcaaaatctacgccgttgagcctatcgattctcctgtcctctctggaggcaagcccggccctcacaagattcagggaatcggagcaggatttgtccccaaggcgctcaacaccgccctctatgatgaggtgattcaggtgaaggtgagcgatgcttacgagatgtctagacgacttggcaaggaggaggggattttggttggaatctctgcaggcgccaacatttgggcctctaaagagattggcaagaaataccccggaaaaacagtggtgacgattctttgcgatacgggtgagagatacctaagcaccgagctttttgaccttcagccttcctga

SEQ ID NO: 24596 - protein, 332 aa, Wolinella succinogenes
MYNPPRLIAQESFKKIKTLNEGEKMKVAQNVQELIGKTPLVRLNFASKESGANVIGKCEFMNPSGSVKDRIALGMINAAIGAGKITPETIVIEPTSGNTGIGLASVCAAKGIKLILTMPSSMSIERRKLLAALGAQIELTPAEKGMKGAVERALELAQETKNSFVPQQFENPANPEYHRVTTAVEIWEDLDGKVDVLVAGVGTGGTITGVGEVLKAKNPNLKIYAVEPIDSPVLSGGKPGPHKIQGIGAGFVPKALNTALYDEVIQVKVSDAYEMSRRLGKEEGILVGISAGANIWASKEIGKKYPGKTVVTILCDTGERYLSTELFDLQPS

SEQ ID NO: 24597 - DNA, 969 bp, Vibrio vulnificus
  CDS (1)..(969)
atgagcaaaatctacgaagacaactctctgactattggcaatactccactggttcgtttgaacaaggtgagtaacggtaaagtgctcgcgaaaattgaagcacgcaaccctagcttcagtgttaagtgccgtatcggtgcaaacatgatttgggaagcagaaaaagaaggcaaactgaaaccaggtgttgaattggtagaaccaaccagtggtaatactggtattgcactggcatttgttgcagccgctcgtggttacaagctgacactgacgatgcctgagtccatgagtctagagcgccgtaaactattgaaagcacttggtgcaaatctagagcttactgaagcggcgaaaggcatgaaaggcgcaatcgctaaagcagaagaaattgttgctagcaaccctgaaaaatacctacttcttcaacaattcaataacccagcaaacccagaaatccacgaaaaaaccactggtccagaaatctgggaagccacagatggcgctatcgatgtctttgttgctggtgtaggtactggtggtaccattactggtaccagccgttacatcaaaggtgagaaagggaaacaaattctttccgttgctgttgagccaacagaatctcctgtaatttctcaagcgctggcaggtgaagaaatcaagccagcaccacacaaaatccaaggtatcggcgctggtttcattcctggtaacctcgacttgtcactgattgaccgtgttgagaaagtgacatcggaagaagccattgaaatggctcgtcgcctaatggaagaagaaggtatcttggcgggtatttcatcaggagcagcagtagtggcagcaaaccgccttgctgaactccctgaattcgaaggaaaaaccattgtcactgtactacctagctctggtgaacgttacctaagtaccgccctatttgctggcatctttactgagaaagagaaccagcagtaa

SEQ ID NO: 24598 - protein, 322 aa, Vibrio vulnificus
MSKIYEDNSLTIGNTPLVRLNKVSNGKVLAKIEARNPSFSVKCRIGANMIWEAEKEGKLKPGVELVEPTSGNTGIALAFVAAARGYKLTLTMPESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 24599 - DNA, 1029 bp, Photorhabdus luminescens
  CDS (1)..(1029)
atgaatcttagtaaaaacatattacaaactataggtaatactccagtagttatgttgaatggtagatatactaaaggtattaatgtctttctcaaaatggagaatattaaccccggtgggagtattaaagatcgtattgcagttgctatgttggaaagggctgaggctcagggagaattaagaccgggaatggtggtgattgaaccatcatcggggaatacggcaattggtctggcaatggcgtgtgctgttaaaggttatcgatttattgcggttttagatcgcatggtgccggcagcaaaacgcgataaaataaaagcatttggtgcggaaattattttcctaccagaatttgaagcgggaaaagatactgtcaaatatcgcattgatttaactaaagagattataaaagtctatccgaatgcgtttagccctatgcaatttgaaaatcaggttaatcctgatgagcattatcgttccacggggcgtgagttgtatgaaatctttggcaataatttgacagcttgttttgcgacagcaggaagttgtggaacactgactggaatttcccgttatttgaaagagaaagatccacaggtgcgaatttatggtgttgaacccgtggggtcaattattttcggtggtgaaccaggaaaatatctggtacaaggtgcaggattagcgtttataccttctattttggatcgtaccaatatcgatattaccttgaaagttgcagatattgatgcattccgagtagcaagaaagttagccagaaatgaaggtattttaattggtggaacgggaggttgtgcggtaagcgcagcattaaatcgcctggatgattttaaacctggcgataatattgttgtcattattcctgatagtggagaacgttatatcgacacaatttataatgatgcttggttatttgaaaataatttctcagaattaattgaggaaagtaaaacagaacctcaattagaagaaattattacaaacatggggtgcgtattaaatgagttctga

SEQ ID NO: 24600 - protein, 342 aa, Photorhabdus luminescens
MNLSKNILQTIGNTPVVMLNGRYTKGINVFLKMENINPGGSIKDRIAVAMLERAEAQGELRPGMVVIEPSSGNTAIGLAMACAVKGYRFIAVLDRMVPAAKRDKIKAFGAEIIFLPEFEAGKDTVKYRIDLTKEIIKVYPNAFSPMQFENQVNPDEHYRSTGRELYEIFGNNLTACFATAGSCGTLTGISRYLKEKDPQVRIYGVEPVGSIIFGGEPGKYLVQGAGLAFIPSILDRTNIDITLKVADIDAFRVARKLARNEGILIGGTGGCAVSAALNRLDDFKPGDNIVVIIPDSGERYIDTIYNDAWLFENNFSELIEESKTEPQLEEIITNMGCVLNEF

SEQ ID NO: 24601 - DNA, 954 bp, Photorhabdus luminescens
  CDS (1)..(954)
atgaataaaatttacgaagataattctttgactattggtcgtaccccgttaattcgcctaaaacactttggcaatgggcgtattctggcaaaagtagaatcccgtaacccaagttttagtgtaaaatgtcgcattggttccaacatgatttgggatgctgaaaaacacggtatcctacaacccgggaaagagttggtagaacctaccagcggtaataccgggatagcccttgcttatgttgccgccgctcggggctacaaattaacgctgactatgccagaaaccatgagtattgagcgccgcaagctattgaaagcattgggagcgcaactggtgctgacggaaggcgctaaaggtatgaagggtgccattgagaaagctaacgagattaaagctagcgatcccgatcgttatattatcctgcaacagtttagcaatccggcaaacccggaaatccatgaaaaaaccacaggcccggaaatctgggaagacacagacggtgaagtagatgtatttgttaccggtgtagggactggcggtacattaacaggggttgcccgttacctgaaaaacaccaaaggtaaaaatatcaccacggttgctgtagagccggaagaatcacccgtcatcagccagactctggccggtgaagaagtgaaaccgggtccccataagattcaaggtattggtgcaggtttcattccagataaccttgatttgacactggttgatcgcgttttcaaaatcagcagtgaggaagctatcaaaaccgcacgtgaaatcatggtaaaagagggcattctggcaggtatctcctctggagccgccgttgcagcagcggtgaaactttctcaggaaccagaatataaagataaaaatatcgtcgtcattctggcttcatcaggtgaacgttatctaagcagtgtactgtttgctgacttgtctgatgaataa

SEQ ID NO: 24602 - protein, 317 aa, Photorhabdus luminescens
MNKIYEDNSLTIGRTPLIRLKHFGNGRILAKVESRNPSFSVKCRIGSNMIWDAEKHGILQPGKELVEPTSGNTGIALAYVAAARGYKLTLTMPETMSIERRKLLKALGAQLVLTEGAKGMKGAIEKANEIKASDPDRYIILQQFSNPANPEIHEKTTGPEIWEDTDGEVDVFVTGVGTGGTLTGVARYLKNTKGKNITTVAVEPEESPVISQTLAGEEVKPGPHKIQGIGAGFIPDNLDLTLVDRVFKISSEEAIKTAREIMVKEGILAGISSGAAVAAAVKLSQEPEYKDKNIVVILASSGERYLSSVLFADLSDE

SEQ ID NO: 24603 - DNA, 882 bp, Photorhabdus luminescens
  CDS (1)..(882)
atggcaagcttggaacattttataggtaacaccccgctggtaaaattacaacgaatcaccgataagctagggggggaaatatgggtgaagcttgaaggtaataatccggcaggctcgataaaggacagaacagcgctatcaatgattcagcaagctgaattgcgcggtgaaatttctcccggtgacgtattaattgaagccactagcggaaatacgggtattgcgttagcaatgattgccgcagtgaaaggttatcaccttaaattactgatgcctgataatatgagccttgagcgtcaggcttctatgcgagcttatggtgcagaactgattttagtgagtagagcaatgggcatggaaggtgcacgtgatttagctcagcaaatggagcgtaatggtgaaggtaaagttcttgatcaattcaataacccagataatcctttagcgcattttacgacgacagggccggaaatttggcagcagacgcaagggcgtattacacattttgtttccagtatgggaacgacgggaaccattaccggtgttagccgctatttaaaaagccagtctaatcgtgtacagattattggcttacaaccggcggagaatagccatattcccggtattcgccgttggtcgccggcttatttgcctggcattttccgcaaggagctagttgatcaagtgctggatatcactcagaaagaagctgaagataccatgcgtttattagctcagaaagaagggattttctgtggagttagttccggcggtgctgttgctggagcattaagtattgcagcacaaaatccaggttctgttattgttaccattatttgcgatcgtggtgatagatatctttctaccggagtatttaattaa

SEQ ID NO: 24604 - protein, 293 aa, Photorhabdus luminescens
MASLEHFIGNTPLVKLQRITDKLGGEIWVKLEGNNPAGSIKDRTALSMIQQAELRGEISPGDVLIEATSGNTGIALAMIAAVKGYHLKLLMPDNMSLERQASMRAYGAELILVSRAMGMEGARDLAQQMERNGEGKVLDQFNNPDNPLAHFTTTGPEIWQQTQGRITHFVSSMGTTGTITGVSRYLKSQSNRVQIIGLQPAENSHIPGIRRWSPAYLPGIFRKELVDQVLDITQKEAEDTMRLLAQKEGIFCGVSSGGAVAGALSIAAQNPGSVIVTIICDRGDRYLSTGVFN

SEQ ID NO: 24605 - DNA, 1368 bp, Photorhabdus luminescens
  CDS (1)..(1368)
atgaccacatcacgctctgttctcgatatgattggtaataccccattgctggagttaacgcatctgaataccggtccatgtcaattatttattaagctggagaatcaaaatcccggcggatctattaaagatcgcgttgctctttccatgatcgagcaggcggaagaacaagggttacttcaatctggtgggacaattatcgaagctactgctggtaataccggcatcgggttggcactggtcgctgccttgaaaggctataaattgattctggttgttccagataagatgagccgagagaaggtgtttcatctgcgtgctctgggtaccgatgtacgtcttactcgttctgatgtcagcaaaggtcatccagagtactatcaagattatgccctacgtctggcgcaagagatccccggtgcttattatatcgatcagttcaataatccggctaattcagcagcgcatactaccactaccggaccggaaatctggcagcaaatggaccacaatgtcgatgccgtggtgatcggtgtcgggtccggcggtacgctcggcggtttgagccactatttcgctcaagtttcgccggaaactgagtttgttctggcagatccaactggttctatcttggtagactatatcgaacacggcaaatatggtgaggccgggagttggcaggtggaaggtattggcgaagattttgtccctcctctgggcaatttcagtcgagtgcaccacgcataccgtgtcagtgatgcagaagctttctccagtgcccgtgatctgttgctaaaggaaggtgtgctggcgggttcttccagcggaaccttgctcgccgccgcactgcgctactgccgtgcgcaaaccacccccaaacgtgtggttacgctagcgtgtgacagcggaaacaagtatctgtcaaaaatgtttaacgattattggatgctggaacagggattccaatcacgtgtgcaacagcacgatctcagcgattatattacttaccgctatcaggatggcgctacggtttttatatcgccagaagatacgttaaaaactgcacatacccgaatgcgcttgtatgagatttctcaattaccggtgctgaaagaagagcaagtcgttggcattatcgacgagtgggatttgatgcacaccgtgcaggctgatccacgcaattttagcctgcccgttagccacgccatgactcatcaggtgagaacgctggataaaaacgattctctgcaacaattgatggcaactttcgacgccggacatgtggcgctgatcgtcgataatggccgttttcttgggctggtaactcgcacagatgtgctgaacgcatggcgtcagcaacttaattga

SEQ ID NO: 24606 - protein, 455 aa, Photorhabdus luminescens
MTTSRSVLDMIGNTPLLELTHLNTGPCQLFIKLENQNPGGSIKDRVALSMIEQAEEQGLLQSGGTIIEATAGNTGIGLALVAALKGYKLILVVPDKMSREKVFHLRALGTDVRLTRSDVSKGHPEYYQDYALRLAQEIPGAYYIDQFNNPANSAAHTTTTGPEIWQQMDHNVDAVVIGVGSGGTLGGLSHYFAQVSPETEFVLADPTGSILVDYIEHGKYGEAGSWQVEGIGEDFVPPLGNFSRVHHAYRVSDAEAFSSARDLLLKEGVLAGSSSGTLLAAALRYCRAQTTPKRVVTLACDSGNKYLSKMFNDYWMLEQGFQSRVQQHDLSDYITYRYQDGATVFISPEDTLKTAHTRMRLYEISQLPVLKEEQVVGIIDEWDLMHTVQADPRNFSLPVSHAMTHQVRTLDKNDSLQQLMATFDAGHVALIVDNGRFLGLVTRTDVLNAWRQQLN

SEQ ID NO: 24607 - DNA, 963 bp, Gloeobacter violaceus
  CDS (1)..(963)
atgcatatcgctcacgacatcaccgaactgatcggccgcactccgctggtgcagctcaaccgtattccggccgccgagggtgcccttgcccgcatcgtggtcaaactcgaaagtttcaacccggccgcctccgtcaaagaccgcatcggcgtctcgatgatcaacgaagccgaaaagtcgggctttatcctgccgggcaaaacgaccctggtcgaacccacctccggcaacaccggcatcgccctggccatggtggcggcggcgcgcggctaccggctcatcctcacgatgcccgagacgatgagcagcgagcggcgggcgctcctgcgggcctacggcgcccaactcgaattgacccccggttcagaagggatgcgcggggccatccgccgcgctgaggagattacccgcgaagtgcccgacgcgtttatactccagcagtttcgcaaccccgccaatcccaagatccaccgcgagacgaccgccgaagaactctggcgcgacaccgacgggcagatggatatttttgtctccggggtgggtaccggcggcaccgtgaccggggtgggcgaagtctggaaggtgcgcaagcccggcgtgcagatcgtggcagtggaaccggcggcaagcccggtgctctccggcggtaaacccggctcgcacctcatccagggcattggcgcgggctttgtaccggatgtactgcggcgcgacgtgatcgacgaagtgatcgccgtagccgatgagaaagcgatcgaatacagccgcaggcttgccaaagaagaagggcttctctcgggcatctccaccggggcggctctgtgggcggctctgcagctggccaagcgccccgagaacaccggcaagctcattgtctttatccaacccagcttcggcgagcgctacttgagcacggcccttttccagaacgaagggcaatcgcccaccgccgtcgcccgctag

SEQ ID NO: 24608 - protein, 320 aa, Gloeobacter violaceus
MHIAHDITELIGRTPLVQLNRIPAAEGALARIVVKLESFNPAASVKDRIGVSMINEAEKSGFILPGKTTLVEPTSGNTGIALAMVAAARGYRLILTMPETMSSERRALLRAYGAQLELTPGSEGMRGAIRRAEEITREVPDAFILQQFRNPANPKIHRETTAEELWRDTDGQMDIFVSGVGTGGTVTGVGEVWKVRKPGVQIVAVEPAASPVLSGGKPGSHLIQGIGAGFVPDVLRRDVIDEVIAVADEKAIEYSRRLAKEEGLLSGISTGAALWAALQLAKRPENTGKLIVFIQPSFGERYLSTALFQNEGQSPTAVAR

SEQ ID NO: 24609 - DNA, 963 bp, Gloeobacter violaceus
  CDS (1)..(963)
atggtgagcaccgagattggcccgagcgccctgggaagcgtccagcctcccgccgagacggacctgctgcagtgggtgggcaacacgcctttgctgcgcctggagcgggtgacggcggggctttccccggacgtcgaagtgtacggcaaggcggagtggttcaacccgggcggctccgtcaaagatcgcccggcgctcaatatgattctcgaaggcgagcgcagcggccggctgacccgcgagaaaattattctcgatgccacctccggcaacaccggcatcgcctacgcctggatcgccgcgcgccggggctatcgcgtcaaactggccctgcccctgaacgcgagcgaagagcgcaagcgcatcctcaaggcctacggcgtcgatctcatcctcaccgatccgaccctcggttccgacggtgccatccaggaggcacgccggctctacgcagcggatcccgaacggtacttctatcccgaccagtacagcaacaacgccaactggcaggcgcactatctgacgacgggcgtcgaaatctaccagcagaccggtgggcgggtcacccattttgtggcggggctcggcacctcgggcacctgcatgggggtgggacggcgcctcaaggagttcgacccggccgttcgggtgattgccatgcagcccgactcgcccttccatgggctcgaagggctcaaacacatggagacggcgatcgtcccggcgatctacaaccctgctttgcccgaccggcaggtcgaagtgtccaccgaggaagcccaacgcaccgtcaagcgcctcgcccgtgaggagggcatgctggtgggcatctccgcagggggcaacgtggcggcggctttacgcctggcgcgcgaactcgaccgcggcgtggtggtcaccattttgtgcgacagtgccgacaagtacctttcggagcgcttctgggacgacccgaatctataa

SEQ ID NO: 24610 - protein, 320 aa, Gloeobacter violaceus
MVSTEIGPSALGSVQPPAETDLLQWVGNTPLLRLERVTAGLSPDVEVYGKAEWFNPGGSVKDRPALNMILEGERSGRLTREKIILDATSGNTGIAYAWIAARRGYRVKLALPLNASEERKRILKAYGVDLILTDPTLGSDGAIQEARRLYAADPERYFYPDQYSNNANWQAHYLTTGVEIYQQTGGRVTHFVAGLGTSGTCMGVGRRLKEFDPAVRVIAMQPDSPFHGLEGLKHMETAIVPAIYNPALPDRQVEVSTEEAQRTVKRLAREEGMLVGISAGGNVAAALRLARELDRGVVVTILCDSADKYLSERFWDDPNL

SEQ ID NO: 24611 - DNA, 933 bp, Chromobacterium violaceum
  CDS (1)..(933)
atgcgcatcgccaacaccatcaccgatctgatcggcaacaccccgctggtcaagctcaaccgcgtcaccgagggcgtcggcgccaccgtcgtcgccaagctggagttcttcaatccggcgcacagcgtcaaggaccgcatcgcggtggcgatgctggacgcggcggagcaagccggcaagatcggtccgaacaccgtcatcgtcgaacccacctcgggcaataccggcatcggcctggcgatggtgtgcgcggcgcgcggctacaagctggtgatcaccatgccggaaaccatgagcaaggagcgccgccagctgttgaaggcctacggcgccgaactgatcctgaccccggggccggacggcatgggcggcgccatcgccaaggcgaaggcgctggtcgacgaatttcccgacacctacttcatgccgcagcagtttgaaaacccggccaacccggaaatccaccgccacaccaccgcggaagaggtgtggaacgacaccgacggcaaggtggacatcttcgtggccggggtcggcaccggcggcaccatcaccggggtcggcgaggtgttgaaggcgcgcaagccgggcgtgcagatcgtcgcggtggagccggacgcgtcggcggtgctgtccggcagccccaagggcccgcacccgatccagggcataggcgcgggcttcgtgccagccatcctcaataccggcatttacgacgagatcatccgcgtcaagaacgaggacgcgctgcagaccgcgcgcgaggtggccaccaaggaaggcatcctggtcggcatctcgtccggcgcggcggtgtggtcggcgctgcagctggccaaacggccggaaaacgccggcaagctgatcgtagtggtgatcccgtcgttcggcgagcgttacctgtccaccgtgctgttcgagcatcttggctga

SEQ ID NO: 24612 - protein, 310 aa, Chromobacterium violaceum
MRIANTITDLIGNTPLVKLNRVTEGVGATVVAKLEFFNPAHSVKDRIAVAMLDAAEQAGKIGPNTVIVEPTSGNTGIGLAMVCAARGYKLVITMPETMSKERRQLLKAYGAELILTPGPDGMGGAIAKAKALVDEFPDTYFMPQQFENPANPEIHRHTTAEEVWNDTDGKVDIFVAGVGTGGTITGVGEVLKARKPGVQIVAVEPDASAVLSGSPKGPHPIQGIGAGFVPAILNTGIYDEIIRVKNEDALQTAREVATKEGILVGISSGAAVWSALQLAKRPENAGKLIVVVIPSFGERYLSTVLFEHLG

SEQ ID NO: 24613 - DNA, 1371 bp, Chromobacterium violaceum
  CDS (1)..(1371)
atgcaggacaatagcgtcttatcgctgatcggcaacacgccattggttcgcgtcagccatctggataccgggccgtgcgagctgtacctgaagctggaaagccacaatccgggcggctccatcaaggatcggatcgccttgaccatgatcgaggcggccgagcgggacggcaagttgaaaccgggcggggccatcatcgaggccaccgccggcaataccgggctgggtctcgcgctggtggccgcgcagaagggctacccgctgacgctggtggtgccggacaagatgagccgggagaagattttgcatctgcaggcgctgggcgcccaggtggtgctgacccgctccgacgtcggcaagggccatccggagtactaccaggacctggcggcgcgcatcgccagcgagacgcccggcgcctactacatcgaccagttcaacaacccggccaatccgctggcgcatgaaaccaccaccgggccggaaatctggcgccagatgaacggcgaggtggacgcggtggtggtcggcgtcggctccagcggcacgctgaccggcctgacccgcttcttccgcgccaaggcgccggccaccgccttcgtgctggccgatccggtggggtctgtgttggccgattatgtcgaaaccggcagcttcggccaggccggcagctggctgatcgagggcataggcgaggacttcatcccgccgcagaccgatctgtcgatggtgaagcgcgccttccgcgtcagcgatcaggaaagcttcgacaccgcccagcaactgctgcgcagcgagggcattctggccggttcgtcgtccggcgcgttgcttgccgccgcgttgcgctactgccgcgagcaaaccgagcccaagcgggtggtgacgctggtgtgcgacagcggcaacaagtacctgtccaagatgtacaaccgcgactggctggtcgaccagggcatgctgcgcctgcccgaggtgggcggactgaccgatctgatcgtccgccgccaccaggacggcagcacggtgtcttgccatccggacgagccgctcaatgtggcttaccagcggatgcgcctgcacgacgtgtcgcagatgccggtgctggacgacgacaaggtggtcggcgtgctggacgaatgggacctgctgctgtcggtgcacggcgagccggaaaacttccgccagaccgtggccacggcgatgagcagccatgtgcgcacgctgtcgccgcaggcctcgttgcaggatctgctgcaggtgttcaacgacggccacatcgcgctgatcgtcgacaagggccgctatctggggctgatcacccaggccgacctgctgtcgttctggcgccgccagccgcgcgccgcttaa

SEQ ID NO: 24614 - protein, 456 aa, Chromobacterium violaceum
MQDNSVLSLIGNTPLVRVSHLDTGPCELYLKLESHNPGGSIKDRIALTMIEAAERDGKLKPGGAIIEATAGNTGLGLALVAAQKGYPLTLVVPDKMSREKILHLQALGAQVVLTRSDVGKGHPEYYQDLAARIASETPGAYYIDQFNNPANPLAHETTTGPEIWRQMNGEVDAVVVGVGSSGTLTGLTRFFRAKAPATAFVLADPVGSVLADYVETGSFGQAGSWLIEGIGEDFIPPQTDLSMVKRAFRVSDQESFDTAQQLLRSEGILAGSSSGALLAAALRYCREQTEPKRVVTLVCDSGNKYLSKMYNRDWLVDQGMLRLPEVGGLTDLIVRRHQDGSTVSCHPDEPLNVAYQRMRLHDVSQMPVLDDDKVVGVLDEWDLLLSVHGEPENFRQTVATAMSSHVRTLSPQASLQDLLQVFNDGHIALIVDKGRYLGLITQADLLSFWRRQPRAA

SEQ ID NO: 24615 - DNA, 891 bp, Chromobacterium violaceum
  CDS (1)..(891)
atgtacaaacatctggaagatttcgtcggcggcacgccgctggtgcggctcaaacgcctgccgggcgacaacggcaacgtggtgctgctgaagctggagggcaacaatccggcaggatcggtgaaggaccggccggcgctgtcgatgatccgccgcgccgaggcgcgcggcgacatccggcccggcgacacgctgatcgagccgaccagcggcaacaccggcatcgcgctggcgatggcggcggcgatgatgggctaccgcatggtgctgatcatgccggagaattccagcgccgagcgggtgcaggcgatgcgcgcctacggcgccgaggtgatcctgacgccggcggccggttcgatgccggcggcgatagacctggcgcgcagcatggaggcggcaggcgagggccgcatcctggatcaattctccaatccggacaatccccaggcgcattacgagggcaccggcccggaaatctgggcggagaccgaaggcaggatcacccatttcgtgtccagcatgggcaccactggcaccatcatgggcaccggccgcttcctgaaggagaagaatccggccatccgcatcgtcggcgtccacccggagccgggcagccagatcgccggcatccgcaagtgggaagacccgtacgtgcccaagatctgcgatttttcccgcatcgacgagatcctgcacgtcggacagaaggaggcggaagacactgcccggctgctggcgaggcgcgagggcatcctggccgggccgtcgtctggcggcgcgttggcggtggctcttaggctggacgcgcaactgagggacgcggtgatcgtgtccgtggtgtgcgaccgcggcgaccgctacctgtccactggattgttcgatcctgcttga

SEQ ID NO: 24616 - protein, 296 aa, Chromobacterium violaceum
MYKHLEDFVGGTPLVRLKRLPGDNGNVVLLKLEGNNPAGSVKDRPALSMIRRAEARGDIRPGDTLIEPTSGNTGIALAMAAAMMGYRMVLIMPENSSAERVQAMRAYGAEVILTPAAGSMPAAIDLARSMEAAGEGRILDQFSNPDNPQAHYEGTGPEIWAETEGRITHFVSSMGTTGTIMGTGRFLKEKNPAIRIVGVHPEPGSQIAGIRKWEDPYVPKICDFSRIDEILHVGQKEAEDTARLLARREGILAGPSSGGALAVALRLDAQLRDAVIVSVVCDRGDRYLSTGLFDPA

SEQ ID NO: 24617 - DNA, 1131 bp, Neurospora crassa
  CDS (1)..(1131)
atgttccgtcacggcgtccgtacctttgcgaccacctccctccggaggatggccgcggtcgcgccccaagagccctcccaatacctccttaacgtctccaaggcgcagggtatcgccaagggtttgaccggagctatcggcaacaccccgctcatccgcctcaaccgcctctccgaagaaaccggctgcgagatcctcggcaaagccgagttcatgaaccccggcggttccgtcaaagaccgcgcggccctgtacgtcgtcaaggacgccgaggagcgaggcctgctacggccaggcggcaccgtcgtcgagggaaccgccggcaacaccggtatcggcctggcgcacgtgtgccgctccaagggctacaagctcgtcatctacatgcccaacacgcagtcgcagggcaagatcgacctgctccgcctgctgggcgccgaggtgtaccctgtgcccgccgtcgcgttcgagaacccagagaactacaaccaccaggcgcgccggcacgccgagcggttggacaatgccgtgtggacgaaccagttcgacaacattgccaaccggagggcgcacatcgagacgaccggccccgagatctgggcgcagacgggaggcaaggtcgatgcctttacttgcgcgacgggcaccggtggaacgtttgcgggcacgacgaggtatctgaaggaggtttcgggcggcagggtcaaggcgttcttggctgatcctcccggaagtgtgttgcactcgtacttcagctcgggcggcaagctgattgagcgcagcgggtcgagcatcaccgagggcattggccagggccgtatcaccgacaacctgaagcaggatgtggacttggtggatggatccatgaccattagcgacgagaagaccattgagatggtgtacaggtgtctggacgaggagggtctgtatcttggcgccagctcgaccctcaacgttgttgcggctaaggaggttgcggagaagctcggaaagggatcgacggttgtgacgatgctgtgcgatggtgcctacaggtatgcggaccgcttgttctcgaggaagtggttggagcagaagaaccttttgggcgcgatccccgagcacttgcaaaagtacatcgttctgccatag

SEQ ID NO: 24618 - protein, 376 aa, Neurospora crassa
MFRHGVRTFATTSLRRMAAVAPQEPSQYLLNVSKAQGIAKGLTGAIGNTPLIRLNRLSEETGCEILGKAEFMNPGGSVKDRAALYVVKDAEERGLLRPGGTVVEGTAGNTGIGLAHVCRSKGYKLVIYMPNTQSQGKIDLLRLLGAEVYPVPAVAFENPENYNHQARRHAERLDNAVWTNQFDNIANRRAHIETTGPEIWAQTGGKVDAFTCATGTGGTFAGTTRYLKEVSGGRVKAFLADPPGSVLHSYFSSGGKLIERSGSSITEGIGQGRITDNLKQDVDLVDGSMTISDEKTIEMVYRCLDEEGLYLGASSTLNVVAAKEVAEKLGKGSTVVTMLCDGAYRYADRLFSRKWLEQKNLLGAIPEHLQKYIVLP

SEQ ID NO: 24619 - DNA, 1587 bp, Neurospora crassa
  CDS (1)..(1587)
atgtctggcgatactaccaacggcgccgttgagcgcaaccccggccttaccatgtcggccaccgagttgatcggcaacactcccctcgtccgcctcaacaggatcccccagtcgctcggtattgagtgcgaggtctacggcaaggtcgagctcttcaacgccggcggcagtgtcaaggacagaatcgcccttcgcatgatcgaggaggccgagaaggaaggccgtatcaagcctggcgacactctcatcgagcccaccagtggtaacactggtattggtctcgcccttgttggcgccatcaagggctacaagaccatcatcaccctccccgagaagatgtcagccgagaaggtctccgtcctccgcgccctcggtgccaccatcatccgtactcctacgcaggccgcttgggacagtcccgaatcccacatcggtgtcgcccgccgtctcctcaaggagatccccaactcgcacattctcgaccaatacaccaaccccaacaacccgcttgcccacgagttcggtaccgccgaggagatctggaagcagaccaacggcaaggtcacggccgttgttgctggtgccggtactggcggtaccatcactggtatcgctcgcggcctccgcaagcacaacaaggacatcaaggtcattgctgccgatcctgtcggctccatcctcgctcaacccgagagtctgaacgaccccaacgccaccgctccctacaaggttgagggtatcggctacgattttatccctgacgtccttgatcgcgagtttgtcgacaaatggtacaagaccgaggaccgcgagtccttccacctcgcccgccgccttatcgctgaggagggtctcctggttggtggttcttccggcagcgccatggccgccatgatccgcgccgtcaaggactacaacctcggcaaggacgacgtcgttgtcgttgtcctccccgacagcattcgctcctacctctccaagttcgccgatgacgactggctcgccgccaacggcctcctcgttaccgacgacgaaatcaagacggccgacgaggccaagggcaccgcgactgtcaagaagcagcaagagacagagcagaagaagaccgatgatggttatgccggcgccactgttcgcgccctccgcctcaagcccgtcacctcggtcctcgccgactcgccctgctccgaggccatcgagacgatgcgcgacaagggcttcgatcagctccccgtcctcgcccccactggcggcaagctggtcggtctcgtcaccctcggaaacattctcagcttcatccagcgcggccgcgccacccccgccacccccgttgcgaaggtcatgttcgacttcagccgcctcgacgaggttgtcacggatccccgcaagttcgacaacaacctcaaggacaagcagcgcaagtttgttgacattaccatggacactcctctcgctgctctcagcaagttccttgagtggaactctgctgcgattgtcacggagaagacggacaatgggtccaagcctgtggctgtggtcaccaaggtcgacctgttgacctacatgcttcatcagcagtcgctgtag

SEQ ID NO: 24620 - protein, 528 aa, Neurospora crassa
MSGDTTNGAVERNPGLTMSATELIGNTPLVRLNRIPQSLGIECEVYGKVELFNAGGSVKDRIALRMIEEAEKEGRIKPGDTLIEPTSGNTGIGLALVGAIKGYKTIITLPEKMSAEKVSVLRALGATIIRTPTQAAWDSPESHIGVARRLLKEIPNSHILDQYTNPNNPLAHEFGTAEEIWKQTNGKVTAVVAGAGTGGTITGIARGLRKHNKDIKVIAADPVGSILAQPESLNDPNATAPYKVEGIGYDFIPDVLDREFVDKWYKTEDRESFHLARRLIAEEGLLVGGSSGSAMAAMIRAVKDYNLGKDDVVVVVLPDSIRSYLSKFADDDWLAANGLLVTDDEIKTADEAKGTATVKKQQETEQKKTDDGYAGATVRALRLKPVTSVLADSPCSEAIETMRDKGFDQLPVLAPTGGKLVGLVTLGNILSFIQRGRATPATPVAKVMFDFSRLDEVVTDPRKFDNNLKDKQRKFVDITMDTPLAALSKFLEWNSAAIVTEKTDNGSKPVAVVTKVDLLTYMLHQQSL

SEQ ID NO: 24621 - DNA, 1371 bp, Neurospora crassa
  CDS (1)..(1371)
atgtcaataagcgaccatccccgtgtctacggcacggtagctctcacagccgccttcgccgcgggtatcctcgtcacccttggcttcaaggattgctaccccgaactcgagaatcggtaccaacggcggaggaaccgcaacctaagccgatccaatggcgattatggcgtcgtagtacccaccgccaaccgggtacaccgcgagagtctcatcttcggtccggtgcgactagaagaccacgaggaagtaacaagcaatatcaacagcagtttcgactgggtcgagggcatcgagggctgcatcggcaacacccccctagtcatgatccgcagcctgtccgaggcaacaggctgtgtcatcctcgccaaagccgagctcctcaatggcgccggcggcagcccgaaagaccgagtggcactcaacatgatccaggacgccgaggagcgcgggctgcttgtgcccgggcgcggcgataccatttacgaagggactgtgggcagtacgggcatctcgctggcgacgctggcgcgcgcaaaggggtacaagtgccacatttgcatgccgaacgacatggcgatcgagaagtcgcagctgctgcaccacctgggcgcgacggtggagcgggtcgacccggcgcccatcacgtctcctgatcattttgtcaacctagcccgcaggcgggcgcgcgagcacgaggcggtgcacgcggacggcagcgtcgggttttttgctgaccaattcgagagcacggctaactaccaagcacatgtcaagaccacgggaccggaaatctaccgccagacgggcgggcaactggacgcctttgtggctggtgccggcacgggcggcactatcgccggcgtggccaagtacctgaaggaggaaaagaacctatgggagacgcgcgtggtgttggcggatccgcagggcagcgggctgttcaacaagatccgccacggcgtcatgtactcgtcgacagagcgggaaggtacacgccggcgtcagcaggtggacacgatggtggagggtatcggcatcaaccgcatcacggagaactttgagtccgggcgggtgctgattgacgatgccgtgcgagtgacagatgagcaggcctgccggatggctcggtggttggtggagcacgacggcattttctgcggcagtagcacggctgttaactgcgtggcggcggtggtgacagccatgaaactaccaagaggcagtcgggtggtgacgttattgtgcgactcgggcaatagacatctcagcaagttctggaagcatattggcgatatggggctggaaaacgatacccaggcgcaagcggaggatctttttgcggagttggggctagaggaattgaagaggtag

SEQ ID NO: 24622 - protein, 456 aa, Neurospora crassa
MSISDHPRVYGTVALTAAFAAGILVTLGFKDCYPELENRYQRRRNRNLSRSNGDYGVVVPTANRVHRESLIFGPVRLEDHEEVTSNINSSFDWVEGIEGCIGNTPLVMIRSLSEATGCVILAKAELLNGAGGSPKDRVALNMIQDAEERGLLVPGRGDTIYEGTVGSTGISLATLARAKGYKCHICMPNDMAIEKSQLLHHLGATVERVDPAPITSPDHFVNLARRRAREHEAVHADGSVGFFADQFESTANYQAHVKTTGPEIYRQTGGQLDAFVAGAGTGGTIAGVAKYLKEEKNLWETRVVLADPQGSGLFNKIRHGVMYSSTEREGTRRRQQVDTMVEGIGINRITENFESGRVLIDDAVRVTDEQACRMARWLVEHDGIFCGSSTAVNCVAAVVTAMKLPRGSRVVTLLCDSGNRHLSKFWKHIGDMGLENDTQAQAEDLFAELGLEELKR

SEQ ID NO: 24623 - DNA, 969 bp, Synechococcus sp
  CDS (1)..(969)
atggccattgcctccgatatcaccagcctgatcggaggcacacccctggttcgtctcaaccgcctgccgttgcagtccggctgcggggcagatgtgatcgccaagttggaaagcttcaacccttcggcgtcggtgaaggatcgaatcgccagcgccatggtgctggcggcggagcaggagggaacgattcaaccggggcgaacggtgctggtggagcccaccagcggcaacaccggcattgcgctggcaatggtcgcggctgcccggggctaccggctcatcctcaccatgccggacacgatgagcacggaacgccgttcgatgctgcgtgcctacggagctgagctgcagctcaccgacggtgctcagggcatggccggagcgattgctctcgccaatgaattggttgaggaaatcccggaggcttatctgctgcagcagttcgacaaccccgccaatcctgcggtgcatgaacgcaccaccgctgaagagatctggcacgactgcgacggccacctggacgccctggtggctggcgtcggcaccggcggcaccatcaccggctgtgctcgtttgctgaagcagcgcaatcctcaactgcaggtggtggcggtggagccggcgggtagtgctgtgctgtcgggcaggccgccgggtgcgcatcgcattcagggcatcggtgcggggttcgttcccgctgtgcttgagcgtgatctgatcgatgaggtgatgaccgtttcggatgaggaggcgatggatgtgggccgtcgtctggcgcggcaggagggtctgctttgcggcgtcagcagcggtgctgcggtggctgcggctctgcggcttggtcaacgctccgagtggcaggggcggcgcgtgctggtgatgctggccagttacggcgagcggtatctgtccacaccgatgttcagtggcgttgcgtcttcgccggcacgtcaggacccgatgctgtga

SEQ ID NO: 24624 - protein, 322 aa, Synechococcus sp
MAIASDITSLIGGTPLVRLNRLPLQSGCGADVIAKLESFNPSASVKDRIASAMVLAAEQEGTIQPGRTVLVEPTSGNTGIALAMVAAARGYRLILTMPDTMSTERRSMLRAYGAELQLTDGAQGMAGAIALANELVEEIPEAYLLQQFDNPANPAVHERTTAEEIWHDCDGHLDALVAGVGTGGTITGCARLLKQRNPQLQVVAVEPAGSAVLSGRPPGAHRIQGIGAGFVPAVLERDLIDEVMTVSDEEAMDVGRRLARQEGLLCGVSSGAAVAAALRLGQRSEWQGRRVLVMLASYGERYLSTPMFSGVASSPARQDPML

SEQ ID NO: 24625 - DNA, 987 bp, Synechococcus sp
  CDS (1)..(987)
atgtcccgcatttacgacgacaacagcctcgccatcggcaacaccccgctggtgaagctgaacagcgtcaccaagaactgcaaagccaccgtgctggcaaaggtcgaaggtcgcaatcccgcttacagcgtgaagtgccggatcggcgccaacatgatctgggacgctgagaagagcggcaagctcaccaaagacaaggtgattgtcgagcccacctccggcaacaccggcatcgccctcgccttcacagcggcggcccgcggctacaagctgatcctgacgatgcccgagtcgatgtcgatcgagcgtcgccggatgatggccgttctcggcgccgagctgatcctcaccgaggccgccaagggcatgcccggtgccatcgccaaggccaaggagatcgccgacagcgatcccggcaaatacttcatgccaggacagttcgacaatcccgccaaccccgaaatccacttcaagaccaccggtccggagatctggaacgactgtgacggtgccatcgatgtgctggtggccggtgtcggcaccggcggcaccatcaccggtgtgtcccgctacatcaagaacgaagccggcaaggcgatcgaatccgtcgccgtggaacccagccacagcccggtgatcacccagaccatcaacggagaaacggtcaagcccggcccccacaagatccagggcatcggcgccggcttcatccccaagaacctggacatgtccatggtcgacaaggtggagcaggtgaccaatgacgagtcgatcgccatggccctgcgcctggcccaggaagagggccttttggttggcatctcctgtggagccgccgccgcggctgccatccgcctggcagagcaggacgcttacgccggcaaaaccatcgtggtggtgctgcccgacctggccgagcgttatctgtcgtcggtgatgttcgccgatgtgcccaccggcatcatcgagcagccggttgccgtctaa

SEQ ID NO: 24626 - protein, 328 aa, Synechococcus sp
MSRIYDDNSLAIGNTPLVKLNSVTKNCKATVLAKVEGRNPAYSVKCRIGANMIWDAEKSGKLTKDKVIVEPTSGNTGIALAFTAAARGYKLILTMPESMSIERRRMMAVLGAELILTEAAKGMPGAIAKAKEIADSDPGKYFMPGQFDNPANPEIHFKTTGPEIWNDCDGAIDVLVAGVGTGGTITGVSRYIKNEAGKAIESVAVEPSHSPVITQTINGETVKPGPHKIQGIGAGFIPKNLDMSMVDKVEQVTNDESIAMALRLAQEEGLLVGISCGAAAAAAIRLAEQDAYAGKTIVVVLPDLAERYLSSVMFADVPTGIIEQPVAV

SEQ ID NO: 24627 - DNA, 960 bp, Rhodopirellula baltica
  CDS (1)..(960)
atgggaggttacagcctgatgtctcgaggaaaaactttcgacaacattgcccgcgcgatcggtgacacgccgatggtgcagatcaatcgcttggtgccttcgggtgatgcgactgtcttcgccaagtgcgagttctttcagccgctcaatagcgtgaaagaccgtatcggcgttgcgatgatcgaagctggggaacgcgatggaagcatcaaccccgatacgcacatcatcgaacccaccagtggcaacaccggaattgctctcgcgtttgtttgtgccgcgaaaggctacaagctgacgctcacgatgcctgaatcgatgtcggtcgaacgccgtgcgttgcttcgagcgatgggggccaacttggtgttgacgcctgctggtgacgggatgaagggggcaatcacaacggctcaagagttggtcgaccaaaccgacaactcgttcatgccgcagcaatttgagaacccatctaaccctgcgatccacgaagcgaccaccggccctgaaatttgggccgacacggacgggaagatcgacgcgatcgtggcgggcgttggaacgggcggaacgatcactggtgtggctcgctacttgaagaaacaaaacccagacttcaaagcattcgcggtcgaaccaaagcattcgcccgtgatcagtggcggatcacctggcaaacaccgcattcaaggaattggcgcaggcttcattcccggaaatttggacacgtcgatcattgatgacgtcgttcaggtcgatgacgaagatgcgttcgagtgggggcgtcagcttgccaagcaagaaggcatcgtcgcggggatcagcagcggtgcaaacatgtgggcggctgctcagattgctgcgcgacccgagatgaagggcaagcgtattgtcaccgtgatgtgcagcttaggtgaacgttatctcagcacgccgctgtttggtgacctaggtttgtaa

SEQ ID NO: 24628 - protein, 319 aa, Rhodopirellula baltica
MGGYSLMSRGKTFDNIARAIGDTPMVQINRLVPSGDATVFAKCEFFQPLNSVKDRIGVAMIEAGERDGSINPDTHIIEPTSGNTGIALAFVCAAKGYKLTLTMPESMSVERRALLRAMGANLVLTPAGDGMKGAITTAQELVDQTDNSFMPQQFENPSNPAIHEATTGPEIWADTDGKIDAIVAGVGTGGTITGVARYLKKQNPDFKAFAVEPKHSPVISGGSPGKHRIQGIGAGFIPGNLDTSIIDDVVQVDDEDAFEWGRQLAKQEGIVAGISSGANMWAAAQIAARPEMKGKRIVTVMCSLGERYLSTPLFGDLGL

SEQ ID NO: 24629 - DNA, 987 bp, Prochlorococcus marinus subsp
  CDS (1)..(987)
atggcaaaaatttatgaggacaacagctttgctattggaaacactccattagtaaaattaaaatcagttactaaaaacgctaaagctactgtattagcaaaaattgaaggtagaaatcctgcatatagtgttaaatgcaggattggtgcaaacatgatatgggatgcggagaaaagcggaaaacttacaaaagacaaaactatcgttgaacctacctctggaaatactggaattgccttagcttttacagcttcagcaagaggttacaaactagtccttacaatgccagaatctatgtctattgagaggagaagggtgatggcagtattgggcgccgaaattgttttaacagaggcttctaaaggtatgccaggagcaattgccaaagctaaagagatcgcagaaagtaatccctctaaatatttcatgccaggtcaatttgataatccagcaaacccagaaattcatttcaaaacaactgggcctgaaatttgggatgattgcgatggtgagattgatgtttttgttgcaggggttggaacaggtggaacaattacaggagtttcaagatacatcaaacaagagaagggcaagaatattgtttctgtagcagtagaaccatcacatagccctgttattacacagacaatgaatggcgaagaagttaaatctggaccacacaaaatacaaggaataggcgcaggatttattcctaaaaaccttgatttatcaattgttgataaagttgagcaggttactaatgatgaatcaatcgagatggctcttagattggcaaaagaagaggggcttctcgtgggaatatcttgtggagctgctgctgctgctgctgttagattagctgagcaagatgaatatgcaggaaaaactatagtggttgttttaccagatttagctgagaggtatttatcatcaattatgtttaccgaagttccaaatggaataattgaggagccagttaaagcttaa

SEQ ID NO: 24630 - protein, 328 aa, Prochlorococcus marinus subsp
MAKIYEDNSFAIGNTPLVKLKSVTKNAKATVLAKIEGRNPAYSVKCRIGANMIWDAEKSGKLTKDKTIVEPTSGNTGIALAFTASARGYKLVLTMPESMSIERRRVMAVLGAEIVLTEASKGMPGAIAKAKEIAESNPSKYFMPGQFDNPANPEIHFKTTGPEIWDDCDGEIDVFVAGVGTGGTITGVSRYIKQEKGKNIVSVAVEPSHSPVITQTMNGEEVKSGPHKIQGIGAGFIPKNLDLSIVDKVEQVTNDESIEMALRLAKEEGLLVGISCGAAAAAAVRLAEQDEYAGKTIVVVLPDLAERYLSSIMFTEVPNGIIEEPVKA

SEQ ID NO: 24631 - DNA, 969 bp, Prochlorococcus marinus subsp
  CDS (1)..(969)
atggaaatagcaggtgatattacttctttagttggcaaaacaccattagtaaaattagatcgcataaaaaaatactgtaattgtcatccagaaataatagcgaaacttgaaagttttaatccatcagcatctgtcaaagatcgtattgcttattcgatgttaaattcagccgaaaaagatggtttaattttacctgggaaaacaacattaattgaggcaacaagtggaaatactggaattgctttagcaatggttgcagcagctaaaggttatagattgatattaactatgccagatactatgagtattgagagaagggcaatgctaagagcatatggggcagaattacaactcactcctggcaaagaaggaatgaacggtgctctagatttagcaagtgaattatcttcaagtattccaaatagctttcagtttaaccagtttgaaaatcttgcaaatccagaaattcatgaaaggaccacagctaaagaaatttgggatcaatctaatcaaactattgatggattagtttctggagttggtactggaggaaccataactggatgttctcgatttctaaaaaaagttaatccaaattgcaaaatatatgcagtagagcccgcaaaaagcgctgtaatttcaggagaaaaagctggttctcattctatccaggggattggtgcaggcttcgttcctaaggtacttgacactcatttaatagatgaaatttttaagatagatgatgaagaagcattttattatgggaggttattagctcgattagagggtcttttatcaggaattagtagcggagctgctttggcagcaacaatcaaaataggtcaaaggaaagagcttattaatcaaagattaatagtgattcttccgagttttggtgaaagatacttatctacagcaatgtttgaatcaaacactgcaataaaagctagaaaagacggttatctatag

SEQ ID NO: 24632 - protein, 322 aa, Prochlorococcus marinus subsp
MEIAGDITSLVGKTPLVKLDRIKKYCNCHPEIIAKLESFNPSASVKDRIAYSMLNSAEKDGLILPGKTTLIEATSGNTGIALAMVAAAKGYRLILTMPDTMSIERRAMLRAYGAELQLTPGKEGMNGALDLASELSSSIPNSFQFNQFENLANPEIHERTTAKEIWDQSNQTIDGLVSGVGTGGTITGCSRFLKKVNPNCKIYAVEPAKSAVISGEKAGSHSIQGIGAGFVPKVLDTHLIDEIFKIDDEEAFYYGRLLARLEGLLSGISSGAALAATIKIGQRKELINQRLIVILPSFGERYLSTAMFESNTAIKARKDGYL

SEQ ID NO: 24633 - DNA, 969 bp, Prochlorococcus marinus
  CDS (1)..(969)
atgcccattgctgcggacatcacggccctggttggccgaaccccaatagtgcggctgaatcgcttgccacagttgagtggttgccatgcggaggtgctggccaagttggaaagcttcaaccccactgcctcggttaaagaccgcatcgcgggggccatgattcaagcagcggaggaagctggaaccattgctccggggcgcaccgtgttggtggaacccaccagtggcaacactgggatcgccttggccatggtggctgccgcccgaggctatcgcctcattctcaccatgccggacacgatgagtacagagcgtcgcgccatgcttagggcctatggcgctgaactgcaactcaccccaggcagcgatggaatgactggttccattgagttggcaaaggagttggtggcaaccatccctgaggcttatctgctgcagcagtttgataatcctgcgaatccgcaggtgcatgagcgtacaaccgcagaggagatctggaatgattgcgaggggcggttggatggtctgatcactggagtaggaacggggggcacactcacaggttgtgcgcgtttgctcaagcaacgcaatccaagcctgcgagtgtttgcggtagagccagcgttaagccctgttttggcaggcgggagccctgctccccatcgcattcaggggattggtgctggcttcattcctagcgttcttgatctctctttgatcgatgagatcctgccggtctctgatgacgacgcgatggagatgggtcggcgcttggcgagggaggagggcttgctaagtggggtaagcagtggcgctgctgttgcggctgcactgcaagtgggtagtagggctgagatggtgggcaagcgtcttgttgttgtcttggcaagttttggtgagcgttatctatcaacgccgatgtttagcgctgcttcggcggtgccggcgcagcgtgatggatacctttga

SEQ ID NO: 24634 - protein, 322 aa, Prochlorococcus marinus
MPIAADITALVGRTPIVRLNRLPQLSGCHAEVLAKLESFNPTASVKDRIAGAMIQAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 24635 - DNA, 987 bp, Prochlorococcus marinus
  CDS (1)..(987)
atgtcccgcatttacgaagacaacagccaggcaatcggcaacactccactggtcaaactgcacgccgtcagcaaaaacgccaaggcaactgttctcgcaaagattgaaggccgcaatcccgcctacagcgtgaaatgccgcattggcgccaacatgatctgggatgccgaaaagcgcggtttactgagcaaagagcgcacgatcattgagcccacctctggtaacaccggcattgcactggcctacacagcagcagcccgcggctacaaactgatcctcaccatgcccgaatcaatgtcgctagaacggcggcgggtgatggcagtgcttggtgcagaactcattctcacagaagcagccaagggaatgccaggcgccattgccaaggcaaaagagatcgccgaaagcgatccccagaaatacttcatgcccggtcagtttgagaatccggccaatcccgacatccacagcaaaacaaccggtccagaaatctggaacgactgtgatggcgccattgatgtgctcgtgtctggcgtaggcaccggcggcacgatcacaggtgtctcccgttacatcaagcaggagaaaggcaaagccatcatttctgtagccgtcgaaccaacccatagcccggttatcagccaaaccctcaacggggaagaggtcaaacctggtcctcacaaaatccagggcattggagccggcttcattcccaaaaacctcgatctttctttagtggatcgtgtggagcaggtcagcaatgatgaatccatcgccatggccctgcgcttggcaaatgaagaaggtctactggtgggcatctccagtggtgcggcagttgcagcggctattcgtctggcagaacaacccgaatttgcgggcaaaaccatcgtggtcgtgctgccagacatggccgagcgttatctctcttcagtgatgtttgagagtgtgcccacaggcatcattcaggcccctgtagctgcctaa

SEQ ID NO: 24636 - protein, 328 aa, Prochlorococcus marinus
MSRIYEDNSQAIGNTPLVKLHAVSKNAKATVLAKIEGRNPAYSVKCRIGANMIWDAEKRGLLSKERTIIEPTSGNTGIALAYTAAARGYKLILTMPESMSLERRRVMAVLGAELILTEAAKGMPGAIAKAKEIAESDPQKYFMPGQFENPANPDIHSKTTGPEIWNDCDGAIDVLVSGVGTGGTITGVSRYIKQEKGKAIISVAVEPTHSPVISQTLNGEEVKPGPHKIQGIGAGFIPKNLDLSLVDRVEQVSNDESIAMALRLANEEGLLVGISSGAAVAAAIRLAEQPEFAGKTIVVVLPDMAERYLSSVMFESVPTGIIQAPVAA

SEQ ID NO: 24637 - DNA, 987 bp, Prochlorococcus marinus
  CDS (1)..(987)
atgaccccaatatacgaagacaacagccttgcaataggcaacaccccgctagtaaaacttcactctgttaccaaaaactgtaaagcaacagttttggcaaaaatcgaaggtcgcaatcctgcatatagcgtcaaatgcagaattggagcgaacatgatttgggatgcagaaaagaaaggtctcctcaataaacagcaaaccattattgaacccacttcaggtaatactggtattgcccttgcttttactgctgctgcaaagggttacaaactaacactcacaatgcctgagtcaatgtccttggaaaggaggagggtaatggcagtccttggtgctgaactaattcttactgaagctgcaaaaggtatgcctggcgctattgcaaaagcaaaagagattgcagaaagtgatcctaataaatatttcatgcctggacaatttgacaaccctgccaatccagagattcacttcaaaacaacaggtccagaaatctggaatgactgcaatgggaacattgatgtacttgttgcaggagtaggcactggaggaactattactggtgtatcaaaatttttaaagcaagagaaaaggaaacaagttctttccgtagcagtagaaccatcccatagccctgtgatttcccaaaccatcaatggccaagaagtaaagccaggacctcataaaatacaaggcatcggagctggatttatccctaaaaatttagacctctcattagttgaccaagttgagcaagtcagtaatgaagaatcaatcgcaatggctcttcgcttggcaaaagaagaaggcttactagttggtatatcttgcggagctgcagcaacagctgcaattcgattggccgaacaagaacaatttgctggcaaaacaattgttgttgttttaccagaccttgctgagcgctatctctcatcagtaatgttcgcagaagtcccaacaggtattatcgaacaacccaaaaccaactaa

SEQ ID NO: 24638 - protein, 328 aa, Prochlorococcus marinus
MTPIYEDNSLAIGNTPLVKLHSVTKNCKATVLAKIEGRNPAYSVKCRIGANMIWDAEKKGLLNKQQTIIEPTSGNTGIALAFTAAAKGYKLTLTMPESMSLERRRVMAVLGAELILTEAAKGMPGAIAKAKEIAESDPNKYFMPGQFDNPANPEIHFKTTGPEIWNDCNGNIDVLVAGVGTGGTITGVSKFLKQEKRKQVLSVAVEPSHSPVISQTINGQEVKPGPHKIQGIGAGFIPKNLDLSLVDQVEQVSNEESIAMALRLAKEEGLLVGISCGAAATAAIRLAEQEQFAGKTIVVVLPDLAERYLSSVMFAEVPTGIIEQPKTN

SEQ ID NO: 24639 - DNA, 969 bp, Prochlorococcus marinus
  CDS (1)..(969)
atgccaatagcaaatgacataacaagcttagtggggcaaacaccactagtaagactaaatcgcctcccaaaagcgtttggatgtaaagcggaggtattagcaaaacttgaaagttttaatcccacagcatctgtaaaagaccgtatagcaggcgccatggtggttgaagctgaaaaacaaggaactattaaacctggtgaaactgtcttaatagaaccaacaagtggtaatacaggaatcgctctcgcaatggttgcagcagcgaaaggctatcgattaattcttacaatgcctgacacgatgagtaccgaaaggaggtcaatgcttcgagcttatggagcagaacttcaactaaccccagggaaagatggaatacaaggggctatcaacttggccaaagaattagtagcttcaatttcgcattcttacctattacaacaatttgataatccagctaatccgcagattcatgaagcgacaaccgctgaagaaatttggtcagattgcgaaggaaaacttgatggcttaatagctggaataggcactggcggaacaattactggttgcgcaagagttctaaaagctcgtaatcctgcgctaaagatttatgcaattgagccctcatcaagtgcagtactttcagggaaagagcctggccctcatagcattcaaggaatcggtgctggttttattccaaaagtacttgatatatcactaattgatgaagtaatagagattaatgatcaagaagcaatggaagctgggaggaaacttgcaaaagaagaaggtctccttagcggaattagtagtggcgcagctctagcggctgctctaaaaatagggaaaaggcccgaaatggaaaataaaaggttagtggttgtttttcctagttttggcgagagatatttatctacttctatgtttaacaatctttcaaccagccaaccaaagaaagatggatacatttag

SEQ ID NO: 24640 - protein, 322 aa, Prochlorococcus marinus
MPIANDITSLVGQTPLVRLNRLPKAFGCKAEVLAKLESFNPTASVKDRIAGAMVVEAEKQGTIKPGETVLIEPTSGNTGIALAMVAAAKGYRLILTMPDTMSTERRSMLRAYGAELQLTPGKDGIQGAINLAKELVASISHSYLLQQFDNPANPQIHEATTAEEIWSDCEGKLDGLIAGIGTGGTITGCARVLKARNPALKIYAIEPSSSAVLSGKEPGPHSIQGIGAGFIPKVLDISLIDEVIEINDQEAMEAGRKLAKEEGLLSGISSGAALAAALKIGKRPEMENKRLVVVFPSFGERYLSTSMFNNLSTSQPKKDGYI

SEQ ID NO: 24641 - DNA, 903 bp, Helicobacter hepaticus
  CDS (1)..(903)
atgatagctcaaaatattaccgaactcattggcaacactccgattttacaacttcagcaatttgctccaaatctttatggcaaatgcgagtttttaaacccaagccattctgttaaagaccgccccgcatatgcaatgatagatgaggctctaaagacaggcaaaatcacaaaagatacaactattgtagaatgcacaagcggcaatatgggcatatctctcgctatgatttgtgcttctcttggattaaaaatcatcatcactatgccagaatctatgagcatagaaagacgcaagatgatagctttgtttggtgcgaatcttgtgcttactcctgcaagtgagggtatgcaaggtgcgctcaataaggctcaagaaattttagattccacaccaaactcatttatgccaagtcaatttgataatctcgctaacaaagaaatgcacaaacgcactactgcactagagatttataaaagctttgagggaagtttggattattttgtggcaggatttggcacaggtgggacaattagcggtgtaggcgaagtgcttaaagagaagattccatctattaaaattattggtgtagagcctgctgcttcaccactgcttagcaaaggacaagcgggaccacataagattcaaggcattggcgcgaactttatccctaaaatccttaatcgcgatgtgatagattctattgaagttgtagaaaatgaagtcgctattaaaatggctcaaaatttaggcaaaatcggcgtaatggttggaatttctagtggcgcaaatgtcgcagctgcacttgaaattgccaaaaacaatccaaataaaaaagtgcttactatgcttaatgacacagcagagcgatacctttcaacggatttatttaatacgctttaa

SEQ ID NO: 24642 - protein, 300 aa, Helicobacter hepaticus
MIAQNITELIGNTPILQLQQFAPNLYGKCEFLNPSHSVKDRPAYAMIDEALKTGKITKDTTIVECTSGNMGISLAMICASLGLKIIITMPESMSIERRKMIALFGANLVLTPASEGMQGALNKAQEILDSTPNSFMPSQFDNLANKEMHKRTTALEIYKSFEGSLDYFVAGFGTGGTISGVGEVLKEKIPSIKIIGVEPAASPLLSKGQAGPHKIQGIGANFIPKILNRDVIDSIEVVENEVAIKMAQNLGKIGVMVGISSGANVAAALEIAKNNPNKKVLTMLNDTAERYLSTDLFNTL

SEQ ID NO: 24643 - DNA, 942 bp, Helicobacter hepaticus
  CDS (1)..(942)
atgctctatcgttcaagtcttgaacttatagggcatacaccacttttagaacttactcatttgaatattgcaaacaataaccgcatttttgcaaagctagaattctataatcctgcaggaggaataaaagacagggtagctctttacatctgccaaaagcttaaggaaaagggtcttttacataaagattctgttattattgaagctactgcggggaatacaggacttggtatcgcctttgtggcacaacattttgggtgcaaagctattcttatcgtacctgataaattctctattgaaaaacagattctaatgcgcgcacttggcgcacaagtcatcaatacgcccaaagaaaaaggaatgcaaggtgctatggacagagcacaagaaatgttatcttgcacaccttatgctttaagtcttaatcaatttgagaatcttgataatccacaagcacattatcttactacagctaaagaaatttatgatgatatggcaaaagtgcaagcaaatagtgaaaatggctctgacgcactcattgattatcttgtatgtggtgctgggagcggagggagctttagcggtatagttggttatcttaaaaagcaagattctcgcataaaaggtgtgctatgcgaccctgtaggctctattatcggcggtggtgaagagggttgtgcaaatattgaaggtattggtaataactttatccctcatacaatggatatttcactcattgatagtgtgcaaaaaatcacagatgaggaagcttatgagggtgtaagaatgctagctaaaaatgagggaatcttagcaggcatatcttctggagcgtgtttgatagcttgtctaaaactcgctaatgaagtgcaaaatagcctgattgtaacactttttgcagatgacttaagccgttattttagtcgcaatttaattgattaa

SEQ ID NO: 24644 - protein, 313 aa, Helicobacter hepaticus
MLYRSSLELIGHTPLLELTHLNIANNNRIFAKLEFYNPAGGIKDRVALYICQKLKEKGLLHKDSVIIEATAGNTGLGIAFVAQHFGCKAILIVPDKFSIEKQILMRALGAQVINTPKEKGMQGAMDRAQEMLSCTPYALSLNQFENLDNPQAHYLTTAKEIYDDMAKVQANSENGSDALIDYLVCGAGSGGSFSGIVGYLKKQDSRIKGVLCDPVGSIIGGGEEGCANIEGIGNNFIPHTMDISLIDSVQKITDEEAYEGVRMLAKNEGILAGISSGACLIACLKLANEVQNSLIVTLFADDLSRYFSRNLID

SEQ ID NO: 24645 - DNA, 951 bp, Haemophilus ducreyi
  CDS (1)..(951)
atgacaattttcgcagataattcatataccattggcaatacccccattgtgcgtttaaaacattttggtcaaaatggcaatttactagtgaaaattgaagcccgtaatccaagctttagtgttaaatgtcgtattggtgccaatatggtatggcaagcggaaaaagacggtattctaactaaagataaagaaattgtggatgcaacaagcggcaatacaggcattgcgttagcctatgttgcggcagctcgtggctataaaatcaccttaacaatgccagaaaccatgagcgatgaacgtaaacgtctattacgtggcttaggcgcaaatttagtgcttactgaaagcacattaggtatgaaaggcgctattgctaaagctgaagagattttcgctagcgatccaaaccgttacataatgctaaaacagtttgaaaatccagcaaatccagccattcaccaacaaacgacaggtcctgagatttggcaggcgactgaaggcaaaattgatgttatcgtagcaggcgtaggcactggcggtacaatcacaggcgtttcacgctatataaaacaagacaaaggcaaacaaattatctctgttgcagtggaaccaaaagaatccccggtaataacacaaacattaaatggcgaggaagtgcaacctggtccacataaaattcaaggtattggtgcgggctttattcctaaaaacttagatttaacgttaattgaccgcgttgaacaagtatcgagcgaagaagcccttaaaatagcacatcaacttatggctaaagaaggtattctagtcggcatttcatctggtgccgcagtcgcagcagcagatcgtttagctaaattacctgaatttgcggataaacaaattgtggcagtcttaccttctgcatcagaacgttacttaagtaccttattatttgaaggaattgaaatttaa

SEQ ID NO: 24646 - protein, 316 aa, Haemophilus ducreyi
MTIFADNSYTIGNTPIVRLKHFGQNGNLLVKIEARNPSFSVKCRIGANMVWQAEKDGILTKDKEIVDATSGNTGIALAYVAAARGYKITLTMPETMSDERKRLLRGLGANLVLTESTLGMKGAIAKAEEIFASDPNRYIMLKQFENPANPAIHQQTTGPEIWQATEGKIDVIVAGVGTGGTITGVSRYIKQDKGKQIISVAVEPKESPVITQTLNGEEVQPGPHKIQGIGAGFIPKNLDLTLIDRVEQVSSEEALKIAHQLMAKEGILVGISSGAAVAAADRLAKLPEFADKQIVAVLPSASERYLSTLLFEGIEI

SEQ ID NO: 24647 - DNA, 945 bp, Candidatus Blochmannia floridanus
  CDS (1)..(945)
atgaataaaatttatcaagataattcttatactattggtcatactccattagtacgacttaataaaattggtaatcaatttattatggccaaaattgaatcaagaaatcccagttttagcgttaaatgtcgcattggatctaacatgatatgggacgcagaaaaaaaaaatatattaaacccaaatatcactattatagaagcaactagcggaaatactggtatagctttagcatatgtaactgcagcacgaaactacaaattactcttaactatgcctgaaactatgagtattgaacgacaaaaactaatacgagctttaggtgcagatataatcttaacagaaggacatcttggtatgaaaggagcgatcaatcgcgcaaccgaaattgcaaacgataacccaagcaaatatttattactacaacaatttagtaatccagcaaatcctaatattcacgaacgcaccacaggaccagaaatttggtatgatactcatggaaatatagatatatttgttgctggagttggaactggaggtaccatcacaggagtaggaagattttttaaacaaatacaaaacaaaaaaatcactatagtagcggttgaaccaaaagattctccagtcattactcaaaccttgtctggacaaagtataaaaccagccccacataaaatccaaggaattggagcaggattcatccccaaaaatttagatttaaatttaattgatcaagtagtaactgtcgaaacagatgcagcaatttcttatgctaaattcttaatgcaaaaagaaggaattttagcaggtatttcctcaggagctgctttagcagcagcagtacaattacaacaacaggaaaaacatactaataaaaatatagttataatacttccgtcatctggagaaagatatttaagcaccatactattttcggattcatga

SEQ ID NO: 24648 - protein, 314 aa, Candidatus Blochmannia floridanus
MNKIYQDNSYTIGHTPLVRLNKIGNQFIMAKIESRNPSFSVKCRIGSNMIWDAEKKNILNPNITIIEATSGNTGIALAYVTAARNYKLLLTMPETMSIERQKLIRALGADIILTEGHLGMKGAINRATEIANDNPSKYLLLQQFSNPANPNIHERTTGPEIWYDTHGNIDIFVAGVGTGGTITGVGRFFKQIQNKKITIVAVEPKDSPVITQTLSGQSIKPAPHKIQGIGAGFIPKNLDLNLIDQVVTVETDAAISYAKFLMQKEGILAGISSGAALAAAVQLQQQEKHTNKNIVIILPSSGERYLSTILFSDS

SEQ ID NO: 24649 - DNA, 912 bp, Bordetella parapertussis
  CDS (1)..(912)
atgagcactcctacctaccccactatcgagcaaaccgtcggcaatacgccgctcgtgcgcctgcagcgcattcctggcgcggccgggcaggcgcgcggcaacgtgatcctggccaagctggagggcaacaaccctgccggctcggtcaaggaccgtcctgccctgtccatgatcctgcgcgccgaagagcgcggcgaaatccatccgggcgataccctgatcgaggccaccagcggcaataccggcatcgcgctggccatgacggcggccatgcgcgggtaccggatggtcctcatcatgcccgacaacctgtcgctcgagcggcgggccgccatgaccgcctatggcgccgaactgatcctcacgcctgccgccaagggcggcatggaatacgcccgcgacctggccacggccatgcaggccgaaggcaagggcaaggtgctggaccaattcggcaacccggacaacccgcgcgcccatatcgagggcaccggcccggaaatctggaaccagacggatggccgcgtcacgcatttcgtcagcgcgatgggcaccaccggcaccatcatgggcgtgtccacctacctgaagtcgcgcaacgcggcggtgcaggtggttggcgcgcagccggccgaaggctcgcagatcccgggcatccgcaagtggcccgaggcctacatgccgaagatcttcgaccgttcgctggtcgacgcctatgagtccatcgcgcaggccgaggcggagaccatggcgcgccggctggccgccgaagaaggcatattcgccggcatttcgtcggcgggcgccctggtggcggcgttgcgcgtggccgagcgggtcgagaacgccaccattgtattcatcgtgtgcgaccgcggcgaccgctacctgtcgaccggcgtcttcaactga

SEQ ID NO: 24650 - protein, 303 aa, Bordetella parapertussis
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRSLVDAYESIAQAEAETMARRLAAEEGIFAGISSAGALVAALRVAERVENATIVFIVCDRGDRYLSTGVFN

SEQ ID NO: 24651 - DNA, 969 bp, Propionibacterium freudenreichii shermanii
  CDS (1)..(969)
atgtctgcaatccacgattccatcaccgaactcatcttcaacacgccgctggtgcgcgcaccccattacctgaaggcagccggcgcccctgatgccgacatcgtcctcaagctggagtacttcaacccggccggttcggtgaaggaccgcattgccctggcaatgattaccgacgccgagaagcgcggcgtcctgaagcccggcggcaccatcatcgagcccagctcgggcaacaccggcatcggcctggccgccgtgggcaccgcccgcggctacaaggtgaaggtcgtgcttcccgccagcctgtcggttgagcgccgcgcgctgatccaggcctacggcggcgaggtcatcctcacccccggaccgctggccatcaagggctccatcgcctacgccaagcagctgcacgacgccgacccctcctcggtgatcctcggccagttcgacaacccggccaacccggagatccactacaagaccaccggcccggagatctggaaggacaccgacggcaccgtcgacgtcttcattgccggaatcggcaccggcggcaccctgtcgggcgccggcaagtacctggaggagcagaagcccgacctcaaggtgatcggcatcgagcccgccaagagcccgatcctcgagggtggcaagcccggcccgcacggaatccagggcattggcaccggcttcgtccccaacacgcttgaccgttcggtctacgacgaggttgtgggcatcaccgacgaggactccatcgcccaggcccgcctgctcggcaccgccgagggcatcttcgtgggcatcagctccggcgctgccctgaccgccgccctgcagatcgccgcccgcgacgagtacaagggcaagcgcatcgtggccctgctccccgattcgggcgaccgctacctgtccaccgccctcggccagttccccgagctcaccgtgcacgaggacgtcgagctctga

SEQ ID NO: 24652 - protein, 322 aa, Propionibacterium freudenreichii shermanii
MSAIHDSITELIFNTPLVRAPHYLKAAGAPDADIVLKLEYFNPAGSVKDRIALAMITDAEKRGVLKPGGTIIEPSSGNTGIGLAAVGTARGYKVKVVLPASLSVERRALIQAYGGEVILTPGPLAIKGSIAYAKQLHDADPSSVILGQFDNPANPEIHYKTTGPEIWKDTDGTVDVFIAGIGTGGTLSGAGKYLEEQKPDLKVIGIEPAKSPILEGGKPGPHGIQGIGTGFVPNTLDRSVYDEVVGITDEDSIAQARLLGTAEGIFVGISSGAALTAALQIAARDEYKGKRIVALLPDSGDRYLSTALGQFPELTVHEDVEL

SEQ ID NO: 24653 - DNA, 927 bp, Propionibacterium freudenreichii shermanii
  CDS (1)..(927)
atgatctaccacgatgtcaccgaggtagtgggacgcactccgcttgtgcggctcaaccatgtgaacgacacggacgccgtcgtgctggccaaacttgagttctacaacccggcgaactccgtcaaggaccgcatcggggtgtccatcgtggacgccgcggagaaatcgggcgcgctgggggccggcggcaccatcgtcgaggccaccagcgggaacaccgggatcgcgctcgcgatggtgggcgccgcccgcggctaccacgtggtgatcaccatgccggcgtcgatgagcagggaacgccgcgccgtgttgcacgccctgggcgccgagctcgtgctcacccccgccgtggaggggatgcggggtgcggtcacggccgccgagcgcatcgccgccgagcgtggtggcgtgctggccagccagttcgccaacgccgcgaaccccgcggcacaccacgcgaccaccggcccggagatctggaatgacaccgacggcgaggtggcggcactggtgtccggcgtcggaaccggtggcaccgtcagtggtgcgggacgctatctgaaggagcaggatccgcgcgtcgacgtgtacgccgtggagcccgacgagtcgcccctgctgtcgcgcggcagggccgcggcccatggcatccagggcatcggcgccaacttcgtgcccgacacctatgacgccgctgtggtcgatgaggtgctgtcggtgaccaccgaccaagccctcgcgatggcgaggcgtctggccgccgaggaaggcatcctggcaggcatctcatcgggcgccgcggtagcggcagcactcgaagtcggggcacgtccgcagtatcgcggccggacgatcgtggcaatcatccctgatttcggtgaacgctatttgtccacgcccctgtttgccggtttgatggactcgtga

SEQ ID NO: 24654 - protein, 308 aa, Propionibacterium freudenreichii shermanii
MIYHDVTEVVGRTPLVRLNHVNDTDAVVLAKLEFYNPANSVKDRIGVSIVDAAEKSGALGAGGTIVEATSGNTGIALAMVGAARGYHVVITMPASMSRERRAVLHALGAELVLTPAVEGMRGAVTAAERIAAERGGVLASQFANAANPAAHHATTGPEIWNDTDGEVAALVSGVGTGGTVSGAGRYLKEQDPRVDVYAVEPDESPLLSRGRAAAHGIQGIGANFVPDTYDAAVVDEVLSVTTDQALAMARRLAAEEGILAGISSGAAVAAALEVGARPQYRGRTIVAIIPDFGERYLSTPLFAGLMDS

SEQ ID NO: 24655 - DNA, 1466 bp, Porphyra purpurea
  CDS (149)..(1282)
ggcacgaggtcacaccaccagtgcgcattctttgccctccagccactcctgctcgaccctcacacagacacactactttacccagtgtgtccaacattcctttgctcgtccctccccctgacccctgctgtgcccgcgcctgtctttgatggctttcgtgtccaccgcgagccccgccgttgtcggccgatccccatcgcccgcgctgtgcggcgctcgctccacgtttgccaccggcgcccccgtcgttgcgccgtctgctccccgcgcggttgccgccggcatgtcggccgccatgatgtcggctgcggccatgaacaagaaggcgccggttgcggacgccaccggcctgattggcaacacgcccctcgtgcagctgcacaagatccccgacgcggcgggctgtgtcgccaacatttttgccaagctcgagtccatggagccgtgctcgtcggtcaaggaccgcatcggccgcggcatgatcatggacgccgaggcggcgggcaagatcacccccggcaagaccgtcctcgtggagccaacgtccggcaacacgggcattgcgcttgcgtttatcgctgcgtccaagggctacaagctcatcctgaccatgccagactccatgtcgattgagcgccgtatggtgctccgcgcctttggcgccgaggtggtgctgacgcccgccgccggtggcatgaagacagcggtctccaaggcggaagccattgccgctgagacgcccgactcgtacatcctccagcagtttgccaacccgtccaaccccaaggcccactatgagacgacgggccccgagattgccaatgctatcgactgcgacgtgtttgtatcgggcgtcggcacgggcggcaccatcaccggcgcggggcgctacctcaaggagaagaacccagagacgcgcgtcgttgctgtcgagcccgtcgagtcgccggttctgtcgggcggcaagccgggtccccacaagatccagggcattggcgccggctttgtgccagccatcctggacacgaccgtctacgatgaggtcgtgaccgtcacgtcggcagagagcattacgatggcgcgccgcattgcgttggaggagggcctcctttcgggcatctcgacgggcgcggcgctggcggcggcgctcgaggtggggaagcgtcccgagatgcagggcaagaacattgtgttcatcgcgccttcgtttggcgagcgctacctgacgtcggccctgtttgacgaacagcgggaagaggcgtatgcaatgaaggcggagtagagtccactcgagtgggtacattcccttttttgtcgtttttttttttttctaccatgcgtgcagtagcctgcactccgcggcgtgcctaggttatttctcgtagcctcggtgtgaagtaagtcgtcggcgggctgcttatccatcgctcctagttgagctgctcacaaaaaaaaaaaaaaaaaaa

SEQ ID NO: 24656 - protein, 377 aa, Porphyra purpurea
MAFVSTASPAVVGRSPSPALCGARSTFATGAPVVAPSAPRAVAAGMSAAMMSAAAMNKKAPVADATGLIGNTPLVQLHKIPDAAGCVANIFAKLESMEPCSSVKDRIGRGMIMDAEAAGKITPGKTVLVEPTSGNTGIALAFIAASKGYKLILTMPDSMSIERRMVLRAFGAEVVLTPAAGGMKTAVSKAEAIAAETPDSYILQQFANPSNPKAHYETTGPEIANAIDCDVFVSGVGTGGTITGAGRYLKEKNPETRVVAVEPVESPVLSGGKPGPHKIQGIGAGFVPAILDTTVYDEVVTVTSAESITMARRIALEEGLLSGISTGAALAAALEVGKRPEMQGKNIVFIAPSFGERYLTSALFDEQREEAYAMKAE

SEQ ID NO: 24657 - DNA, 1436 bp, Oryza sativa
  CDS (57)..(1190)
gagtgagccacagcaccgccggcagtgaccaacagcaaccaatcagcaaatcagcaatggagagggctctgatgagcctcatgaggcggcgctccctcctccagagcggcggacgagcaccgccggcgatggccgccgccgccggtggctcaccattcttctccaccctgcagcaagcagccgccgcagacccggtccagtcgcctggcatcttgccagggctcaagatcagggactctgcgtcacagctgattgggaggacacccatggtttacctgaacaaggtcactgaaggatgtggggcccggattgctgctaagctcgagttcttgcagccgtccttcagcgtcaaggacagaccagcaatttcaatgttggaagatgctgaaaagaaggggttgatcaccccaggtaagaccacactgatcgagccgacatcagggaacatgggtattggcctggcattcatggctgctcttaaagggtatgaactcatactcacaatgccttcatacaccagccttgagaggagggtgaccatgagggccttcggcgcaaaactcgtccttaccgacccaacaaaaggtatgggaggcacggtgaggaaggccgccgagctgtatgagaaccatcctagcgcgttcatgctgcagcagtttgagaatcctgcaaatgtcaaggtacactatgagacaactggtccagaaatctgggaggatacacttgggcaggttgatatttttgtcatgggaatcgggagcggcggcaccgtcactggtgttggcaagtatcttaaggagaagaaccccaatgcaaagatctatggagttgaacctgctgaagcaaatgttttgaatggtggcaaaccaggtcctcacctcatcactggaaatggagtgggatttaagccggaaattttgaatatggatataatggaaaaggttattgaggtgaaaggtgaggatgctgttaagatggctcgagaattggcactgaaggagggtcttctggttggaatatcatcaggagctaacacagttgctgctcttgaactagcaaagaagccagaaaacaaagggaagctcattgtgactgttcttccgagtttaggggagagatacctgtcatctgcattgtttgaggaattgagagcggaggctgaggccatgcagccagtgccagtggactaacttggataatcaacctaggcattgagtatttgatgaacgaaattgctatactctaaataaattttcaatttgtactttaattccccattacaaattatgtatcttcagattgtctgtcactgaactatatagatggactctctctatgtaattccacatttatcagaataacctatgatctccctctcctttctttttaagttcgggtttctattttccaattttaatggaacaggttaaaaatgc

SEQ ID NO: 24658 - protein, 377 aa, Oryza sativa
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPEILNMDIMEKVIEVKGEDAVKMARELALKEGLLVGISSGANTVAALELAKKPENKGKLIVTVLPSLGERYLSSALFEELRAEAEAMQPVPVD

SEQ ID NO: 24659 - DNA, 1059 bp, Betula verrucosa
  CDS (1)..(1059)
atgaagaggatgctctccacccaaccccttgctgattctgatccgtcttttgctcaaagaatcagggatctccctaaacatgttcctggaaccaacatcaaaaatgaagtttctcaactcattgggagaactcctcttgtatatcttaacaaagtcactgaaggctgtggagcttatattgctgtcaagcaagagatgatgcaacccactgctagcatcaaagacagaccagcatatgccatgatgatggatgcagaaaagagaaacttaattactcctgggaagacaacactcatagagcccacatcaggaaatatggggatcagtttggcatttatggcagccatgaaaggatacaaaatggttctaacaatgccctcttacacaagcttggagaggagggtgacaatgagagcatttggagctgatttagttctcaccgatcccaccaaggggatgggtggaacagttaagaaggcatacgaccttttggaatctacaccaaatgctttcatgctccaacaattttcaaatcccgtcaacacccagggtgcatttgaaactacgggtcctgagatatgggaggatacaaatggacaagttgacatttttgtcatgggaataggtagtggaggcactgtctctggggtcggacagtaccttaaatcccaaaatcctaatgttaagatatatggagtggagcctactgaaagtaatgttttgaatggtggtaaaccaggtcctcatcaaattactggcaatggggttggattcaaaccagatattttggacatggatgttatggaaagagttcttgaggttagtagtgaagattcagtaaatatggcaaggcaattagcactgaaggagggacttctggtgggaatatcatctggagccaatacaattgcagcactcagactcgctagaatgccagagaacaaaggcaaactcattgtgactgtgcatccaagtttcggggagcgatacttgtcatctgtcctgtttgaggagctgaggaaagaggctgaaaacatgcaaccagtttcagttgactga

SEQ ID NO: 24660 - protein, 352 aa, Betula verrucosa
MKRMLSTQPLADSDPSFAQRIRDLPKHVPGTNIKNEVSQLIGRTPLVYLNKVTEGCGAYIAVKQEMMQPTASIKDRPAYAMMMDAEKRNLITPGKTTLIEPTSGNMGISLAFMAAMKGYKMVLTMPSYTSLERRVTMRAFGADLVLTDPTKGMGGTVKKAYDLLESTPNAFMLQQFSNPVNTQGAFETTGPEIWEDTNGQVDIFVMGIGSGGTVSGVGQYLKSQNPNVKIYGVEPTESNVLNGGKPGPHQITGNGVGFKPDILDMDVMERVLEVSSEDSVNMARQLALKEGLLVGISSGANTIAALRLARMPENKGKLIVTVHPSFGERYLSSVLFEELRKEAENMQPVSVD

SEQ ID NO: 24661 - DNA, 1990 bp, Xenopus laevis
  CDS (68)..(1765)
ccacgcgtccgggcagccggagaggtttgagcattaggagagaagggaacgtgaccgagagctcattatgccggctgtgccgcccaccacggattctgcctcctgcccccaccttaaagaaaaccatgtgaccaacggcaacaacgacagcgtggaggcggagcttagtgtggacaggaagtggattcggccagacttgcccagcaagtgcacctgggaactgggaaaagcaccgactgaatccccccatcaccatgtgcaactgtgtgagcggccccagattctatccagtatcctgcagaagattggggacaccccgctggttcggatcaatcagattgggaagagatttgggctgaagtgtgaactgctggccaagtgtgagttcttcaacgcggggggcagtgtaaaggatcggatcagtctgcggatggtggaagatgccgagagagatggaattctcaagcccggagacacaatcattgagccaacgtctgggaatacaggaatcgggttggccctggcagcggcagtaaaggggtatcgctgtatcattgtcatgccggagaagatgagtatggagaaggtggacgtactacgtgcccttggggctgagattgttcggactcccacaagcgcccgctttgattccccagagtcccatgtgggcgtcgcatggcggctgaagaatgagatcccaaattcccacattctggatcagtatcggaatgccagtaaccccctcgctcattatgacagtacagccgaggaaatcctccagcagtgccaaggacagttggacatgttagtggcaggagctggaactggaggaacaattactggtctcgctcgcaagctgaaagagaagtgtccaaattgtaagattgttggagtggatcctgacggttctatcttagcagaacccgaggaactgaaccagacggataagactgggtatgaggtggaggggatcggatacgacttcattcctactgtgctggatcggacggtggtggatgaatggtacaagtctaatgatgaggaatctttctttatggctcgggcattaatccgagaggaggggctgttatgcggaggcagttcgggcagtgcaatgtcagcggcaatgaaggcagcaaaggaattgggtgaggggcaacgctgcgtggtgatcctgccagactctgtacggaattacatgtccaagttcctcagtgacaaatggatgacacagaagcagttcctgaaggtggaggaactggaggaaagaaagccttggtggtggaacttgaaggtatcgtctctgtctctctctgctcccctcaccgttctcccgacagtgagctgtggccaaaccatccaactgctgcgagacaaaggcttcgatcaggtgcccattgtgtctgagacagggctggtgctggggatggtgacactggggaatatgctctcatctgtccttgcgggaaaagtgaagccgtcagatctggtcactaaagttatctacaagcagttcacccaggtgaatctggccgacagcctcggaaagctttcccgcattctggagacggatcactttgctttggttcttcacggacaaattcagtatcacagcgacggctcctccagtaagaagcagatggtttttggggtggtgaccgccattgatctgctcaatttcattacgagagagcgggagcgacgagtcagtgaatctggggagagggatctggtggaacgagtccggcacttcagcgcatcataacgtggaggagaatgtgccactagtgtgttatgtacaatcaaacctttcctcctgtactgtccatcgttttgtctcctcccattcgctgttacctgtcagaccgtaggtcacttttaattggctgttacatgattgctcagattgattttgctgcttaactgcacttcataaattaaaggtcattgtgcataaaaaaaaaaaaaaaaaaaaaaaaaaaaaaaaaaa

SEQ ID NO: 24662 - protein, 565 aa, Xenopus laevis
MPAVPPTTDSASCPHLKENHVTNGNNDSVEAELSVDRKWIRPDLPSKCTWELGKAPTESPHHHVQLCERPQILSSILQKIGDTPLVRINQIGKRFGLKCELLAKCEFFNAGGSVKDRISLRMVEDAERDGILKPGDTIIEPTSGNTGIGLALAAAVKGYRCIIVMPEKMSMEKVDVLRALGAEIVRTPTSARFDSPESHVGVAWRLKNEIPNSHILDQYRNASNPLAHYDSTAEEILQQCQGQLDMLVAGAGTGGTITGLARKLKEKCPNCKIVGVDPDGSILAEPEELNQTDKTGYEVEGIGYDFIPTVLDRTVVDEWYKSNDEESFFMARALIREEGLLCGGSSGSAMSAAMKAAKELGEGQRCVVILPDSVRNYMSKFLSDKWMTQKQFLKVEELEERKPWWWNLKVSSLSLSAPLTVLPTVSCGQTIQLLRDKGFDQVPIVSETGLVLGMVTLGNMLSSVLAGKVKPSDLVTKVIYKQFTQVNLADSLGKLSRILETDHFALVLHGQIQYHSDGSSSKKQMVFGVVTAIDLLNFITRERERRVSESGERDLVERVRHFSAS

SEQ ID NO: 24663 - DNA, 924 bp, Bacillus cereus
  CDS (1)..(924)
atgaatgtatatcgtggagttcatgagttaattggtcatacaccaattgtagaaattactcgtttttcacttccaataggggtccgtttatttgcaaagcttgaattttataatccaggcggaagcgttaaggatcgtttaggaagagaattaatcgaagatgcgctagaaaaagggcttgttacccagggtggaacaattattgaaccgactgctgggaatactggtattggactggcacttgcagcattagaacatgatttacgtgttattgtttgtgtaccagagaaatttagtattgaaaaacaagaattaatgaaagcactaggtgcaactgtcgtgcatacaccgactgagcaaggaatgaccggtgcaattgctaaagcaaaagagttagtaaatgaaataccgaattcatactctccaagtcagttcgcaaatgaggcaaatcctcgtgcatattttaaaacattaggacctgaactgtgggacgcattgaatggagagattaacatatttgttgctggagcaggaactggcggtacgtttatggggactgcatcttacttgaaagaaaaaaatatagatattaaaacagttatcgtagagccagaaggatctattttaaatggtggtaaggctggttcacatgagaccgaaggaattggactggaatttatccccccatttttgaagacatcttattttgatgaaattcatacgatttctgatcgaaatgcatttttacgagtgaaagaattagcgcaaaaagaaggacttctcgttggaagctcttcaggagcagcatttcatgcgagcttacttgaggcagagaaggcagcaccaggtacaaatattgtaaccatttttccagatagcagtgagcgctatttaagtaaagacatatacaaaggatgggaataa

SEQ ID NO: 24664 - protein, 307 aa, Bacillus cereus
MNVYRGVHELIGHTPIVEITRFSLPIGVRLFAKLEFYNPGGSVKDRLGRELIEDALEKGLVTQGGTIIEPTAGNTGIGLALAALEHDLRVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 24665 - DNA, 924 bp, Bacillus cereus
  CDS (1)..(924)
atgcgagtggcacaatcagtttcagaattaatcgggaaaacgccgatcgttaagttgaaccgcatcgtagaatcagacagcgcagatatatacttaaaattagaatttatgaatccggggagtagtgttaaagatcgtatcgcattagctatgattgaagatgctgaaaaaaagggattattaaaagagggcgatacaatcattgagccgacaagtggtaacacaggaattggtttagcgatggtagcggctgctaaaggatataatgcaatcttagtaatgccagaaacaatgagtattgagcgtcgtaatttattacgtgcttacggtgcggaattagtattgactccagggcctgaaggaatgggtggagcaattcgtaaagcgactgaattagcaaaagaacatggctactttataccacaacagttcaaaaaccaatcgaatccagaaattcaccgtttaacaacaggtccagaaattattgaacaaatgggcgaccaattagatgcgtttattgcaggtattggtacaggtggaacgattactggtgctggtgaagtactgaaggaagcgtataaagatattaaaatttatgcagtagaacctgcagattcaccagtattatctggtgggaagccaggtccacataaaatccaaggaattggggcgggatttgttccggagacgttggatgtagaagtatatgatgaaattattcaagtgaaaacagagcaagcatttgaatatgcgagaagagtggctaaagaggaaggtattttagttggtatctcttcaggcgcagttatttatgcagcaacagaggttgcgaaaaagttaggtaaagggaaaaaggtacttgttattatcccgagtaacggtgaacgttatttaagtacaccactttatcaatttgaatcctaa

SEQ ID NO: 24666 - protein, 307 aa, Bacillus cereus
MRVAQSVSELIGKTPIVKLNRIVESDSADIYLKLEFMNPGSSVKDRIALAMIEDAEKKGLLKEGDTIIEPTSGNTGIGLAMVAAAKGYNAILVMPETMSIERRNLLRAYGAELVLTPGPEGMGGAIRKATELAKEHGYFIPQQFKNQSNPEIHRLTTGPEIIEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 24667 - DNA, 951 bp, Streptomyces avermitilis
  CDS (1)..(951)
atgcgctacgactccccgctcgccgcggtgggcaacacccctctggtgcgcctgccgcggctctcgccgtccgaggacgtgcggatctgggccaagctggaggaccgcaacccgacgggctcggtcaaggaccgccccgcgctccacatgatcgaacaggccgagaaggacgggcggctgacaccgggctgcacgatcctggagccgacgagcggcaacacgggcatctcgctcgccatggcggccaagctcaagggctaccgcatcgtgtgcgtgatgccggagaacacctcgcaggagcgccgtgacctgctgggcatgtggggcgccgagatcgtctccagcccggcggccggcggctccaacacggcggtccgtgtcgccaaggaactggcggccgagcacccggactgggtgatgctctaccagtacggcaacccggacaacgcgggcgcgcactacgcgaccaccgggcccgagatcctcgccgacctgccctccgtcacccacttcgtcgccggcctcggcaccaccggcacgctgatgggcgtgggccgttacctgcgcgagcagaagccggacatcaagatcgtcgccgccgagccgcgctacgacgacctggtgtacggcctgcggaacctggacgagggcttcgtccccgagctgtacgacgcgtcggtgctgaccacccgcttctccgtcggctccgcggacgcggtgacccgcacccgggagctgctccagcaggagggcatcttcgcgggcgtctccacgggcgcggcgctgcacgcggcgatcggcgtgggcaacaaggcggtcaaggcgggggagacggcggacatcgtcttcgtggtcgcggacggcggctggaagtacctgtcgacgggcgtctacaccgcggccacgacagaagaggcgatcgcgacgcttcagggacaactctgggcgtga

SEQ ID NO: 24668 - protein, 316 aa, Streptomyces avermitilis
MRYDSPLAAVGNTPLVRLPRLSPSEDVRIWAKLEDRNPTGSVKDRPALHMIEQAEKDGRLTPGCTILEPTSGNTGISLAMAAKLKGYRIVCVMPENTSQERRDLLGMWGAEIVSSPAAGGSNTAVRVAKELAAEHPDWVMLYQYGNPDNAGAHYATTGPEILADLPSVTHFVAGLGTTGTLMGVGRYLREQKPDIKIVAAEPRYDDLVYGLRNLDEGFVPELYDASVLTTRFSVGSADAVTRTRELLQQEGIFAGVSTGAALHAAIGVGNKAVKAGETADIVFVVADGGWKYLSTGVYTAATTEEAIATLQGQLWA

SEQ ID NO: 24669 - DNA, 1395 bp, Streptomyces avermitilis
  CDS (1)..(1395)
atgcaattccacgactcgatgatcagtctcgtcggcaacaccccgctggtgaggctcaacagcgtgaccgcgggcattcaggcgaccgtcctcgcgaaggtcgagtacttcaacccgggcggttccgtgaaggaccgcatcgccctgcggatgatcgaggccgcggaggagagcggcgctttgcagcccggtggcacgatcgtcgagccgaccagcggaaacaccggtgtcgggctcgccatcgtcgcgcagcagaaggggtacaagtgcatcttcgtgtgccccgacaaggtgagcactgacaagatcaatgtgctgcgtgcctacggggccgaggtggtggtctgcccgaccgccgtcgaccccgagcaccccgactcctactacaacgtctcggaccggctcgtgcgcgagacgcccggtgcgtggaagccggaccagtactccaacccgaacaaccccctttcgcactatcactccaccggccccgagctgtgggagcagacggaggggaagatcacccacttcgtcgcgggcgtgggcaccggcgggaccatttccggtaccgggcgttacctgaaggacgccagtgagggccgcgtccaggtcgtcggcgccgaccccgagggctccgtgtactccggcggctccgggcgcccgtacctcgtcgagggcgtcggcgaggacttctggccgaccgcgtacgaccgcacggtcgcggacgagatcgtcgccgtgtccgacaaggactccttccagatgacgcggcggctcgccaaggaggaggggctgctcgtcggcggttcctgcggcatggccgtcgtcgccgcgctgcgggtcgccgagcggctcgggccggacgacgtggtcgtggtgctgctgcccgacagcgggcgcgggtacctcagtaaaatcttcaacgacgaatggatggccgactacggcttcctcgaggactccgggcccagcgcccgcgtcgccgacgtcctcagcgacaaggcgggcggctccatcccctccctcgtccacatgcaccccgacgagaccgtcggcgaggcgatcgaggtgctgcgcgagtacggcgtctcgcagatgccgatcgtgaagccgggcgccggccacccggacgtcatggccgccgaggtcgtcggctcggtcgtcgaacgcgagctgctcgacgcgctgttcacgcagcgcgcctccttgcaggacccgctggagaagcacatgtccgcgccgctgccgcaggtcggttcaggcgagcccgtcggggacctgatgtccgtcctcggcacggccgacgcggcgatcgtcctcgtcgagggcaagccgaccggtgtggtcagccgccaggacctgctgtcgttcctggccaagggcggcggcaagcagtag

SEQ ID NO: 24670 - protein, 464 aa, Streptomyces avermitilis
MQFHDSMISLVGNTPLVRLNSVTAGIQATVLAKVEYFNPGGSVKDRIALRMIEAAEESGALQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASEGRVQVVGADPEGSVYSGGSGRPYLVEGVGEDFWPTAYDRTVADEIVAVSDKDSFQMTRRLAKEEGLLVGGSCGMAVVAALRVAERLGPDDVVVVLLPDSGRGYLSKIFNDEWMADYGFLEDSGPSARVADVLSDKAGGSIPSLVHMHPDETVGEAIEVLREYGVSQMPIVKPGAGHPDVMAAEVVGSVVERELLDALFTQRASLQDPLEKHMSAPLPQVGSGEPVGDLMSVLGTADAAIVLVEGKPTGVVSRQDLLSFLAKGGGKQ

SEQ ID NO: 24671 - DNA, 888 bp, Nitrosomonas europaea
  CDS (1)..(888)
atgcataacaccatcgaaaatttcatcggccatactcccctggttcggctcaagcgtattccgagtgaaaccagtaataccattctggcaaagctggaaggcaataacccggctggttcagtcaaggatcggccagcctattccatgatcatgcgtgcacagcaacgcggcgacatccggccgggagatacgctgatcgaagcaaccagtggcaataccggtattgcactggccatggcagcggcgattctgggttatcgcatgattctggtcatgccggagaatctgagcctggagcgccgtcaggtaatgtctgcatatggtgccgagattgttctgactcccaaagagggaagcatggagctggccagagatactgctgagcaactgtgcaatgccggcaagggcatcattctcgatcaattttccaatcccgataatccgctggcgcattatgaaactacagcccccgagatctggcaggatacggcgggaacggtcacacatttcgtaagcagtatgggaacgaccggcacgatcatgggctgtgcccgctatttccgcgaacaggagcagaaggtggaaattatcggtgtgcaaccacaggagaatgcacagattcccggaatccgtaaatggccggaagcttatctgcccaaaatatatcagccggagctggttgaccgtattttgctggtatcccagcaggaagccgaggaaatggctcgccgtctggcgcgtgaggaaggattgtttaccggtatttcttctggaggggctctggcagccgctctgaaggtttccgcgcaggtgcagaacgcagtgattgtttttatcgtatgcgatcgcggggatcgctacttatcgaccggggtttttccttcctga

SEQ ID NO: 24672 - protein, 295 aa, Nitrosomonas europaea
MHNTIENFIGHTPLVRLKRIPSETSNTILAKLEGNNPAGSVKDRPAYSMIMRAQQRGDIRPGDTLIEATSGNTGIALAMAAAILGYRMILVMPENLSLERRQVMSAYGAEIVLTPKEGSMELARDTAEQLCNAGKGIILDQFSNPDNPLAHYETTAPEIWQDTAGTVTHFVSSMGTTGTIMGCARYFREQEQKVEIIGVQPQENAQIPGIRKWPEAYLPKIYQPELVDRILLVSQQEAEEMARRLAREEGLFTGISSGGALAAALKVSAQVQNAVIVFIVCDRGDRYLSTGVFPS

SEQ ID NO: 24673 - DNA, 933 bp, Enterococcus faecalis
  CDS (1)..(933)
atgactaaaggttatgtaaaatcagtaacagagttaattggtcaaagcccagttgtgaaattaaaacggatggtaccagaaggagctgcagatgtttttgttaaactagagttctttaatcctggtggcagtgtgaaagatcgaattgctttaagcatgatccaacaagccgaagcagatggtcgcctaaaacctggacaaacgattattgagccgactagtggtaatacaggcattgggttagcaatggtaggtgctgcgttgggatatccagttaagattgtgatgccagatactatgagtattgaacgccgcaaattaatgcaagcatatggggctgatctattattaacccctggtgccgaaggaatgaaaggggcaattgcaaaagctacagcattagcagaagaacacgggtacttcatgcctttgcaatttaataatccagctaatccaatggtacatgaacaaaaaacaggaaaagaaattgttgatgtctttggtaaacgtggcttagatgcgtttgtttctggtgttggcactggaggaaccgttacaggagttggccatgaattgaaacggatttttccagatattgaaattgttgcagtagaaccaacagagtcgcctgttttagaaggtggcgaaccaggtccacataaaatccaaggaataggcgctggttttgtcccagaagttttagacaccaccgtttatcaaaaagttgccgctgtttctagtgaagacgcattagaaactgctcgtttaatggggccaaaagaaggtatccttgtggggatttcagcaggggcagcaattaaagctgccattgatttggcagtcgaattaggcgcaggcaaacgtgtcttagcgctggttccggataacggtgaacgttatctttcgacagctctttacgaatttccagaataa

SEQ ID NO: 24674 - protein, 310 aa, Enterococcus faecalis
MTKGYVKSVTELIGQSPVVKLKRMVPEGAADVFVKLEFFNPGGSVKDRIALSMIQQAEADGRLKPGQTIIEPTSGNTGIGLAMVGAALGYPVKIVMPDTMSIERRKLMQAYGADLLLTPGAEGMKGAIAKATALAEEHGYFMPLQFNNPANPMVHEQKTGKEIVDVFGKRGLDAFVSGVGTGGTVTGVGHELKRIFPDIEIVAVEPTESPVLEGGEPGPHKIQGIGAGFVPEVLDTTVYQKVAAVSSEDALETARLMGPKEGILVGISAGAAIKAAIDLAVELGAGKRVLALVPDNGERYLSTALYEFPE

SEQ ID NO: 24675 - DNA, 918 bp, Enterococcus faecalis
  CDS (1)..(918)
atgattgttcagtcaattttagacacaatcggagcaacaccattatttgaatttacaagtgaacaatatcctatgccagaaggcactaaaatttatgcgaaactagaatatttgaatccaggtggcagcgtcaaagatcggcttggtgtgcatcttctcaaagaagcaatgaaaacgggaaagataaatcaagccacaacaattattgaaccgacagcggggaatacagggattggacttggattagctgccagtcaactgggcctcaagacaatctttgttgtgccagaaaaatttagtcaggaaaaacaacagctgatgcaagcgttaggtgctaaaattgtcccttcgccaacagagcaagggattgtcggagcgataactagtgcccaagacttagccaaggaaattcctaatagttacgtgccgttacaatttgaaaatccggataaccctgctgcttactacgaaggattaggacctgaaattgttcaagacttaggcggaaagattactagctttgtcgcaggtttaggcagtggtggaacgtttgcaggtgttggcagatatctcaaagaacaaaatagtaagacgcaattatggggcgtggagccagaaggttcaattttaaatggcggacctgcacacggacatgaaatcgaaggcattggcgtggagttcgtgccgccttttcttaaacagattcctgtggacggcttttataccatttcagacgaggatggttttttctgggtcaaacaattagccaagaaaagcgctttgctggtgggaagctccagcggcgcagcatttgcggcggcattaagagaggcgcgccgcttaccagcaggcagcacaattgtaactatttttcctgacggtagtgatcgttatttatcaaaaaatatttattcttag

SEQ ID NO: 24676 - protein, 305 aa, Enterococcus faecalis
MIVQSILDTIGATPLFEFTSEQYPMPEGTKIYAKLEYLNPGGSVKDRLGVHLLKEAMKTGKINQATTIIEPTAGNTGIGLGLAASQLGLKTIFVVPEKFSQEKQQLMQALGAKIVPSPTEQGIVGAITSAQDLAKEIPNSYVPLQFENPDNPAAYYEGLGPEIVQDLGGKITSFVAGLGSGGTFAGVGRYLKEQNSKTQLWGVEPEGSILNGGPAHGHEIEGIGVEFVPPFLKQIPVDGFYTISDEDGFFWVKQLAKKSALLVGSSSGAAFAAALREARRLPAGSTIVTIFPDGSDRYLSKNIYS

SEQ ID NO: 24677 - DNA, 951 bp, Coxiella burnetii
  CDS (1)..(951)
atggttctcgacaatatacttcaagttatcggcaaaacgccggttgtgcgcttgcatcgaattggccaatcccttccttgcgaactctatggcaaatgcgaatttctcaatccaggcggttccgttaaagaccgaattggcgctgccatgattgaatcggcggaaaaacagggaaaaattaaaccgggcgatacgctcatcgaaccaacctctggcaatacggggatcggtattgctttagccggagccgtcaaaggctatcgagttattatcacgatgccagaaaaaatgagccacgaaaaacaagtggttttggaagcgctgggcgcaaccatttatcgaacccctacagaagcagcctatgatgatcccgaaagccatatttcactcgctaaacgtctaaaccaggaaattcctaattcttacattctcgatcaatacagcaatgcggaaaatcccgatatccattaccaaaccacaggccaagagattttggacgacatgggggaaaacctttccatggttgtaatgggcgttggtacaggcgggaccatcatcggtgttgcaaaaaaactaaaagaagtgaatccttcgattcagattatcggcgtcgatcctattggatctattctcgggggcggggatgaaattaaaccttaccttgtagaaggcatcggttatgattttattcccgaagtgctcgataacaacctcatcgatgagtacatcaaaattaacgacaaagattcttttttaatggcgcgtcgtttaattcgtgaagaggggctcttagtgggcggctcttccggatcagctgtttgggcggcttgccaagcggctcaacgattgaaagaaggcgaacgatgtctggttattttgccggatgctattcgaaattatttgactaaatttgtagacgacgcctggatgaaggcgcaagggtttttgtaa

SEQ ID NO: 24678 - protein, 316 aa, Coxiella burnetii
MVLDNILQVIGKTPVVRLHRIGQSLPCELYGKCEFLNPGGSVKDRIGAAMIESAEKQGKIKPGDTLIEPTSGNTGIGIALAGAVKGYRVIITMPEKMSHEKQVVLEALGATIYRTPTEAAYDDPESHISLAKRLNQEIPNSYILDQYSNAENPDIHYQTTGQEILDDMGENLSMVVMGVGTGGTIIGVAKKLKEVNPSIQIIGVDPIGSILGGGDEIKPYLVEGIGYDFIPEVLDNNLIDEYIKINDKDSFLMARRLIREEGLLVGGSSGSAVWAACQAAQRLKEGERCLVILPDAIRNYLTKFVDDAWMKAQGFL

SEQ ID NO: 24679 - DNA, 990 bp, Shigella flexneri
  CDS (1)..(990)
atggcaaggtttgtaacctgtaggcctgataagacgcgcaagcgtcgcatcaggcaacaccacgtatggatagagattgtgagtacattagaacaaacaataggcaatacgcctctggtgaagttgcagcgaatggggccggataacggcagtgaagtgtggttaaaactggaaggcaataacccggcaggttcggtgaaagatcgtgcggcactttcgatgatcgtcgaggcggaaaagcgcggggaaattaaaccgggtgatgtcttaatcgaagccaccagtggtaacaccggcattgcgctggcaatgattgccgcgctgaaaggctatcgcatgaaattgctgatgcccgacaacatgagccaggaacgccgtgcggcgatgcgtgcttatggtgcggaactgattcttgtcaccaaagagcagggcatggaaggtgcgcgcgatctggcgctggagatggcgaatcgtggcgaaggaaagctgctcgatcagttcaataatcccgataacccttatgcgcattacaccaccaccgggccggaaatctggcagcaaaccggcgggcgcatcactcattttgtctccagcatggggacgaccggcactatcaccggcgtttcatgctttatgcgcgaacaatccaaaccggtgaccattgttggcctgcaaccggaagaaggcagcagtattccgggcattcgccgctggcctgcggaatatctgccggggattttcaacgctgcgctggtggatgaggtgctggatattcatcagcgcgatgcggaaaacaccatgcgcgaactggcggtgcgggaaggaatattctgtggcgtcagctcaggcggcgcggttgctggagcactgcgggtggcaaaagctaaccctggtgcggtggtggtagcgatcatctgcgatcgtggcgatcgctacctctccaccggagtgtttggggaagagcattttagtcagggggcagggatttaa

SEQ ID NO: 24680 - protein, 329 aa, Shigella flexneri
MARFVTCRPDKTRKRRIRQHHVWIEIVSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSCFMREQSKPVTIVGLQPEEGSSIPGIRRWPAEYLPGIFNAALVDEVLDIHQRDAENTMRELAVREGIFCGVSSGGAVAGALRVAKANPGAVVVAIICDRGDRYLSTGVFGEEHFSQGAGI

SEQ ID NO: 24681 - DNA, 927 bp, Bacillus stearothermophilus
  CDS (1)..(927)
atggcacgcacagtcaactcgataaccgaattgatcggcgatacgccggccgtgaaacttaacaggatcgtggatgaggatagcgcggatgtgtatttgaaactggaatttatgaacccgggcagcagcgtcaaagaccggattgcgttggcgatgattgaagcggcggaaaaagcgggcaagctgaagccgggcgacacgatcgttgagccgacaagcggcaacactgggatcggattggcgatggtcgcggcggcgaaaggatataaggcggtattagtcatgccggatacgatgagcttggagcgccgcaacctgctgcgggcgtatggagccgagcttgtgctcacaccgggtgcacaagggatgcgcggaccaatcgcaaaggcggaagagctcgtccgcgagcacggctactttatgccacagcaatttaaaaacgaggcgaacccggaaatccatcgcttgacgaccgggaaagagatcgtggagcaaatgggggaccaactcgacgccttcgttgccggcgttggcacgggcggaacgaccaccggagcaggcaaagtgttgcgcgaagcttacccaaacattaaaatttacgccgttgaaccggccgattccccagtcttgtcgggaggaaaaccgggcccgcacaaaatccaagggatcggcgctggctttgttccagatattttggatacgagcatttacgatggggttattacggtaacgacggaagaagcgtttgcggcggcccgccgcgcggctcgcgaggaaggcattctcggcggcatttcgtccggcgctgcgattcatgcggcattgaaagtggcgaaagagctcggcaaagggaaaaaagtgctcgccatcatcccgagcaacggcgaacgttatttgagcacgcctctttaccaatttgaagactaa

SEQ ID NO: 24682 - protein, 308 aa, Bacillus stearothermophilus [sequence omitted]

SEQ ID NO: 24683 - DNA, 1230 bp, Oryza sativa
  CDS (1)..(1230)
atggcgtcgtggtcgtcgcccgtcgccgccgccgccttgcaggtccatttcgggtcctcctgcttcttctccgcccgatcgccacgacagaccctcctcctaccacctctcgcccgcaaccctacactgaccatccagccccggccccatcccttccggaacatcaactcctcctcctcctccagctggatgtgccacgccgtcgccgccgaggtcgagggcctcaacatcgccgacgacctcatcggcaagactccaatggtatatctcaacaacatcgtcaagggatgtgttgccaatgtcgctgctaagctcgagattatggagccctgttgcagtgtcaaggacaggataggatacagtatgatttctgatgcggaagagaaaggcttgataactcctggaaagctctcacccagtgacttaccatgcatgacatattactttatgctctatgctcagagtgttttggtggaaccaacaagtggaaatacaggcattggtcttgccttcattgctgcttccagaggatataaattaatattgaccatgcctgcatcaatgagcatggagagaagagttctactcaaagcttttggcgctgaacttgtccttactgatgccgcaaaagggatgaagggggctgtagataaggctacagagattttaaataagacacctgatgcctatatgctgcagcagtttgacaaccctgccaacccaaaggtacattatgagactactgggccagaaatctgggaggattctaaagggaaggtggatgtattcattggtggaattggaacaggtggaacaatatctggtgctggccgtttcctgaaagagaaaaatcctggaattaaggttattggtattgagccttctgagagtaacatactctctggtggaaaacctggcccacataagattcaaggcattggggcaggatttgttccaaggaacttggatagtgaagttctcgatgaagtgattgagatatctagtgatgaggctgttgagacagcaaagcaattggctcttcaggaaggattactggttggaatttcatctggggcagcagcagcagctgccattaaagttgcaaaaagaccagaaaatgctggaaagttggtagtggttgtgtttccaagctttggtgagaggtacctttcatctatcctttttcagtcgataagagaagaatgtgagaagttgcaacctgaaccatga

SEQ ID NO: 24684 - protein, 409 aa, Oryza sativa
MASWSSPVAAAALQVHFGSSCFFSARSPRQTLLLPPLARNPTLTIQPRPHPFRNINSSSSSSWMCHAVAAEVEGLNIADDLIGKTPMVYLNNIVKGCVANVAAKLEIMEPCCSVKDRIGYSMISDAEEKGLITPGKLSPSDLPCMTYYFMLYAQSVLVEPTSGNTGIGLAFIAASRGYKLILTMPASMSMERRVLLKAFGAELVLTDAAKGMKGAVDKATEILNKTPDAYMLQQFDNPANPKVHYETTGPEIWEDSKGKVDVFIGGIGTGGTISGAGRFLKEKNPGIKVIGIEPSESNILSGGKPGPHKIQGIGAGFVPRNLDSEVLDEVIEISSDEAVETAKQLALQEGLLVGISSGAAAAAAIKVAKRPENAGKLVVVVFPSFGERYLSSILFQSIREECEKLQPEP

SEQ ID NO: 24685 - DNA, 1371 bp, Xylella fastidiosa
  CDS (1)..(1371)
atggtcattcattcttccgtacttgaattgattggtaatacgccgattatcaaggcgcagcgccttgacactggtctctgtgatttatttttgaagcttgaaagcgctaatcctggtggttcaatcaaggatcgtgtgggcttgtcgatgattgaggcggctgagtgccgtggtcatatcaagccgggtgctacgttggttgatggggctgccagcagtaccagtatgggcttggcttttgtagctcggcagaagggttatcgcctgatccttgttgtaccggacaacatggcttgggaaaagatttctaatcttaaggctatgggggcggaagtgatattgacccgctcagatgtcagcaagggtcatccagagcactaccaagatttggctgaaaaactggcagccgagacaccaggagcctacttcattaatcagtttggaaatgcggacaatccagctgcgcatgagttcggtactggtccggagattctgaagcagatgggcggtcatgtggatgcggttgtattaggttgcgatagtgctggcaccatcacaggcttgtcgcgggcattcgactcagttgcttctgatgtcgaattgattttggccgatccggttggttctattcttacccagtacatcaatgagggaacacgtagtgataagtctggtacttggttggttgaagggattggaagtgattgtttgcctccgatttccgacttcaggcggatcaaaaaaacgtatgcgatcagtgatgcggagagctttcacactgcacgtgagttgttgagtaaagaggggattctgggaggttcttcaacaggtactgtgttggctgcggcattgaaatactgccgtgagcagattgagcacaagcgtgtattggtgtttgtttgcgacacgggaaacaagtatttgttaaatatgtataacgacgattggatgttggataacggttttttgaaaaggccacattatggtgatttgcgtgatctgatcctgcatccttacagtcagcgtcatactgttgtggttgatcccaatgatttgctgactgtggcttaccagcgtatgaagcgatacggtgtttcacagttgccagtgattgaggacagacagttggtcggtatccttgatgaaagcgatgtgctgttacatgtctatggtgatgagactcggttttgtgaccctgtttctaccgcgatggtcagtaaacttcaccgattggatgtgaagtcgccgattgaggcgttactccctgtgtttgagcgaggccaagtggctatagtgatggaagatgatcagtttttgggcctgattacacgcattgatttattgaattacctgcgtcgtcgtatccaatga

SEQ ID NO: 24686 - protein, 456 aa, Xylella fastidiosa
MVIHSSVLELIGNTPIIKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDKSGTWLVEGIGSDCLPPISDFRRIKKTYAISDAESFHTARELLSKEGILGGSSTGTVLAAALKYCREQIEHKRVLVFVCDTGNKYLLNMYNDDWMLDNGFLKRPHYGDLRDLILHPYSQRHTVVVDPNDLLTVAYQRMKRYGVSQLPVIEDRQLVGILDESDVLLHVYGDETRFCDPVSTAMVSKLHRLDVKSPIEALLPVFERGQVAIVMEDDQFLGLITRIDLLNYLRRRIQ

SEQ ID NO: 24687 - DNA, 969 bp, Vibrio parahaemolyticus
  CDS (1)..(969)
atgagcaaaatctacgaagataactctcttaccattggtaatacgcccctagttcgcctaaacaaagtgagcaaaggtaacgttctagcgaaaattgaagcacgcaacccaagcttcagcgttaagtgccgtatcggtgcaaacatgatttgggaagcagaaaaagctggcactttaaagccaggagtagaactagtagaaccaaccagtggtaacacaggtatcgcattagcgttcgtagcagccgctcgcggttacaaattgactctaactatgcctgaatcaatgagccttgagcgccgcaagctacttaaagcactaggcgcaaaccttgagctaactgaagcagcgaaaggcatgaaaggcgcaattgctaaagcagaagagatcgtagcaagcaatcctgaaaaataccttcttctacaacagttcaacaaccctgctaacccgcaaattcacgagaaaaccactggccctgaaatctgggatgcgacagacggtgaaatcgatgtgctagtagcaggcgttggtacaggcggtacaatcacaggtacaagccgttacattaaaggtgagaaaggtaaagcgatcacttctgttgctgtagaacctgcagaatcaccagtaatcgcgcaagcgctagcaggcgaagaaattcaaccagcgccacataaaatccaaggtatcggtgcaggtttcattcctggaaacctagatttggacattatcgaccgagttgagccagtgacttctgaagaagcaattgagatggctcgtcgactaatggaagaggaaggcatccttgcgggtatctcttcaggcgctgctgtcgttgctgcgaaccgaattgcagaactacctgaatttgaaggaaaaaccatcgtgacaattctgccaagctcaggtgaacgttacctaagtacggcactatttgctggtatctttaccgaaaaagagaaccaacaataa

SEQ ID NO: 24688 - protein, 322 aa, Vibrio parahaemolyticus
MSKIYEDNSLTIGNTPLVRLNKVSKGNVLAKIEARNPSFSVKCRIGANMIWEAEKAGTLKPGVELVEPTSGNTGIALAFVAAARGYKLTLTMPESMSLERRKLLKALGANLELTEAAKGMKGAIAKAEEIVASNPEKYLLLQQFNNPANPQIHEKTTGPEIWDATDGEIDVLVAGVGTGGTITGTSRYIKGEKGKAITSVAVEPAESPVIAQALAGEEIQPAPHKIQGIGAGFIPGNLDLDIIDRVEPVTSEEAIEMARRLMEEEGILAGISSGAAVVAANRIAELPEFEGKTIVTILPSSGERYLSTALFAGIFTEKENQQ

SEQ ID NO: 24689 - DNA, 975 bp, Pseudomonas syringae
  CDS (1)..(975)
atgagccgtatctacgctgataacgcccattccatcgggaacacaccgctggtgcagatcaaccgtatcgcgccgcgcggtgtcaccattctggccaagatcgaagggcgtaatccgggctattccgtcaagtgtcggatcggcgccaacatgatctgggacgctgaagccagcggcaggctcaagcccggcatgaccattgtcgaacccacctctggcaacaccgggatcggtctggcattcgttgccgccgctcgcggttacaaactgatgctgaccatgcccgcttccatgagcatagaacgtcgcaaggtgctcaaggcgctgggggctgaattggtgttgaccgagccagccaaggggatgaaaggcgcgattgccaaggccgaagagttgctggctggcgatcccgagacatttttcatgcctgcccaattcgacaacccggccaacccggccatccacgagaaaacgaccggccccgaaatctgggctgataccgacggcaccatcgacgtgctggtagccggcgtcgggacgggcgggactatcaccggtatttcccgatatatcaagcacacagcgggtaagccgatcctgtcggtcgcggtagaacccgacagttcgccgatcatcacccaagccatggccggtgaagaaatcacgcctgctccgcacaagattcagggcatcggcgcgggcttcattccgaaaaacctcgacctgtcgattgttgaccgggtagaacgcgtcaccgacgatgagtccaaggcgatggccaggcgcttgatgcaggaagagggcatcctgtgcggaatctcctgcggcgcagcaatggcggctgccgttcgtctggctgaaaagccggaaatgcagggcaagactatcgtcgttattctcccagactccggcgagcgttacctgtcgagcatgctgttcagcgatcttttcactgaccaggagctatcgcagtag

SEQ ID NO: 24690 - protein, 324 aa, Pseudomonas syringae
MSRIYADNAHSIGNTPLVQINRIAPRGVTILAKIEGRNPGYSVKCRIGANMIWDAEASGRLKPGMTIVEPTSGNTGIGLAFVAAARGYKLMLTMPASMSIERRKVLKALGAELVLTEPAKGMKGAIAKAEELLAGDPETFFMPAQFDNPANPAIHEKTTGPEIWADTDGTIDVLVAGVGTGGTITGISRYIKHTAGKPILSVAVEPDSSPIITQAMAGEEITPAPHKIQGIGAGFIPKNLDLSIVDRVERVTDDESKAMARRLMQEEGILCGISCGAAMAAAVRLAEKPEMQGKTIVVILPDSGERYLSSMLFSDLFTDQELSQ

SEQ ID NO: 24691 - DNA, 984 bp, Pseudomonas syringae
  CDS (1)..(984)
atgattttatttttaaatttcaggtatgaaaacatgaattctatcgagctggccataggcaatacgcccatggtggaactgaaaagttttgatctgccaccaggcataaggatttttgcaaagctggagtttttgaatcctggtggaagtatcaaggatcgtgtcgtaaaccatatatttaacgacgctgaagcccgcggactattgtgccgcggttcgacagtaatagaaaacacatcgggcaataccggtgccgctatcgcaatgctggcggccgctagaggttatcgcgttattctcaccatgccggataaagtcagcaaagaaaaacaagatacactcagggctttgggcgctgaagtcattatgtgcccaacgtcagccgctccggattcacctgagcattatgttcaggtagcgaagtctttacacgccgatacgcccaactcgttcatgctgcatcaatatgataaccctctaaatccggaagctcacaagctcacgactggtccagagatttggcgagacttgaaggggggtatctccgtatttgtggctgctggcagcacgggcggtacaatatcaggcatttcacgttatctgaaaagtcaggacaaaactatcagatcggtgctcctggatcccaaaggatctatttattataaatacttttacgagggcgtgattgatccactagtgataggcccttaccaggttgaaggtgtgggagaagatcatttggccaagtgtatggattttgaaatgatcgacgacgttattcagtttgatgatgctgctgcctttggaacatgtaggttgctcgctcaaaaggaagggttgctgtgtgggggaagttcaggggcgaatgtctggggatgccttcaagttgcaaagcgtctttcgtcccctgcaaatatcgtcactgtgttgccagacagcggagttaagtacctgtcaaaaatatataactcgccgtttacgtga

SEQ ID NO: 24692 - protein, 327 aa, Pseudomonas syringae
MILFLNFRYENMNSIELAIGNTPMVELKSFDLPPGIRIFAKLEFLNPGGSIKDRVVNHIFNDAEARGLLCRGSTVIENTSGNTGAAIAMLAAARGYRVILTMPDKVSKEKQDTLRALGAEVIMCPTSAAPDSPEHYVQVAKSLHADTPNSFMLHQYDNPLNPEAHKLTTGPEIWRDLKGGISVFVAAGSTGGTISGISRYLKSQDKTIRSVLLDPKGSIYYKYFYEGVIDPLVIGPYQVEGVGEDHLAKCMDFEMIDDVIQFDDAAAFGTCRLLAQKEGLLCGGSSGANVWGCLQVAKRLSSPANIVTVLPDSGVKYLSKIYNSPFT

SEQ ID NO: 24693 - DNA, 903 bp, Pseudomonas syringae
  CDS (1)..(903)
atgaccctgcagtatcaaaccatcgccgattgcgtcggcaacaccccgcttgtgcgtctgcaacgcatgatgggcactaccagcaataccatcctgttgaaactggaaggtaacaaccctgctggttcggtaaaagaccgcccggcgttgtcgatgatcacccgtgccgagctgcgcggccagatcgtccccggcgacacgctgatcgaagccacctccggcaacaccggcattgcgctggccatggcggcggcgatcaagggttaccgcatgattctgatcatgccggacaactccagtgccgaacgcaaggcggcaatgaccgcctatggcgccgagctgattctggtcagcaaggacgaaggcatggaaggcgcgcgtgatctggctgatcgcatgcaggcagagggtcgcggcaaagtgctcgatcagttcgccaacggcgacaatcccgaggcgcattacacgtccaccggtccggaaatctggcaacaaacggcgggcaccgttacccacttcgtcagttcgatgggcaccaccggcaccatcatgggcacttcgcgctacctcaaggagcagaaccccgacgtgcagatcgtcggtctgcaaccgatggaaggcgcgtcaatccctggtattcgccgctggccttatgagtacctgccgaaaatctatcagtcggatcgcgtcgatcgcatcatcgacatggggcagaccgaggccgaagaaaccatgcgcaggctggctcgtgaagagggcattttctgtggcgtttcgtccggcggttcggtggccggtgcgctgcgtattgcccgcgaagtcgaaaacgccaccattgtggcaatcatctgtgaccgaggcgaccgctacctgtcgaccggtatctacgacatgcccaactga

SEQ ID NO: 24694 - protein, 300 aa, Pseudomonas syringae
MTLQYQTIADCVGNTPLVRLQRMMGTTSNTILLKLEGNNPAGSVKDRPALSMITRAELRGQIVPGDTLIEATSGNTGIALAMAAAIKGYRMILIMPDNSSAERKAAMTAYGAELILVSKDEGMEGARDLADRMQAEGRGKVLDQFANGDNPEAHYTSTGPEIWQQTAGTVTHFVSSMGTTGTIMGTSRYLKEQNPDVQIVGLQPMEGASIPGIRRWPYEYLPKIYQSDRVDRIIDMGQTEAEETMRRLAREEGIFCGVSSGGSVAGALRIAREVENATIVAIICDRGDRYLSTGIYDMPN

SEQ ID NO: 24695 - DNA, 975 bp, Pseudomonas putida
  CDS (1)..(975)
atgagccgtatcttcgcagacaacgcccactccatcggtaacacgccgctggtgcagatcaaccgcatcgctccgcgcggtgtgaccatcctggccaagatcgaagggcgcaaccccgggtactcggtcaaatgccgcattggcgcgaacatggtctgggacgccgagagcagcggcaagctcaaaccgggcatgaccattgtcgagcccacctcgggcaacaccggcatcggcctggccttcgtcgccgccgcccgcggctacaagctgatgctgaccatgcccgcttcgatgagcctggagcgccgcaaggtgctgaaggcactgggcgccgaactggtattgaccgatccggccaagggcatgaagggcgcgatcgagaaggccaacgaaatcgtcgcctccgacccggagcagtacttcctgccgggccagttcgaaaacccggccaacccggccattcacgagaaaaccaccggtcctgagatctggaacgacacggacggcgccatcgacgtgctggtggcaggcgtgggcactggcgggaccatcaccggcgtgtcgcgctacatcaaacatacccagggcaaggccatcctgtcggtggcagtggaacccgtggcatcgccactgatcagccagaccctggccggcgaagaactcaagccaagcccgcacaaaatccagggcatcggcgccggtttcgtgccgaaaaacctcgacctgtcgattgtcgaccaagtggagacggtgaccgacgaagagtccaaggccatggcgattcgcctgatgcaggaagagggcatcctttgtggtatttcctgcggtgcggcaatggcggcagcggtgcgtctggccgaaaaaccggaaatgcagggtaagaccatcgtcgtaatcctgcccgattcgggcgagcgatacttgtcgagcatgctgttcagcgacatgttcagcgagcaggaaacccagcagtag

SEQ ID NO: 24696 - protein, 324 aa, Pseudomonas putida
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPEQYFLPGQFENPANPAIHEKTTGPEIWNDTDGAIDVLVAGVGTGGTITGVSRYIKHTQGKAILSVAVEPVASPLISQTLAGEELKPSPHKIQGIGAGFVPKNLDLSIVDQVETVTDEESKAMAIRLMQEEGILCGISCGAAMAAAVRLAEKPEMQGKTIVVILPDSGERYLSSMLFSDMFSEQETQQ

SEQ ID NO: 24697 - DNA, 900 bp, Pseudomonas putida
  CDS (1)..(900)
atgaccttgcagtacccaaccatcgccgattgcgtcggcaatacgccactggttcgcctgcagcgcatcgctggcgaaaccagcaataccctcctgctcaagctcgaaggtaacaatcctgccggctcggtgaaagaccgcccggccctgtcgatgatcgctcgcgccgaattgcggggccagatcaagccaggcgataccctgatcgaagccacctccggcaacacgggcatcgccctggcgatggcggcggcgatcaagggctacaagatgatcctgatcatgcccgacaactccaccgccgagcgcaaggccgccatgacggcctatggcgccgagctgatcctggtgaccaaggaggaggggatggaaggcgcccgtgacctggccgagaagctgcaggccgaaggccgtggcctggtgctcgaccagttcgccaacggcgacaacccgatcgcccactacaacagcaccggcccggagatctggcagcagacccagggcaccattacccatttcgtcagctccatggggaccaccggtaccatcatgggctgctcgcagtacctcaaggaacagaaccccgcggtgcagatcatcggcctgcaaccgatggaaggctcggctattccgggcattcgccgctggcccgaggaatatttgccgaaaatcttcgacgccacccgcgtcgaccgcgtggtcgacatgtcgcagcaggaagccgaagacaccacccgtcgccttgcgcgtgaagagggcattttctgcggcgtgtcttctggtggtgcggtcgcggccatgttgcgtctgtcccgcgaagtggaaaatgcggtcatggttgcgatcatttgcgaccgcggcgaccgttatctgtccactggcctgtttgatccacgctaa

SEQ ID NO: 24698 - protein, 299 aa, Pseudomonas putida
MTLQYPTIADCVGNTPLVRLQRIAGETSNTLLLKLEGNNPAGSVKDRPALSMIARAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGTITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPR

SEQ ID NO: 24699 - DNA, 912 bp, Lactobacillus plantarum
  CDS (1)..(912)
atgctcattcagcacgttcaagaacttatcggccacacccccctgatggcgttacccatcgaggttccaaatcacagtcacatctatgccaagcttgaaatgttcaaccccggcggcagtattaaggaccggctgggagcctatctgattgaagacggcttgcaacggggccgggttaacgccaagacaacgattattgaaccaactgctggtaacaccggaattggtttagccttagcaactcaagcgcaccacctacgtaccatcttagtcgtcccagaaaagttcagtatggaaaaacaagttttaatgcaagcattgggtgctgaaattgttcatacacctagcgaggaaggaatcaaaggtgccattcgcaaagctgaggcactagccgcaacgatttccaacagttacgtccccatgcaattcaagaatccggctaatcccgcggcttattaccacacactggcaccagaaattctggcggacatgcctgcacctataaccgccttcgtcgctggagccggtagcggtgggacatttgccggagtagcggcttatcttcaagcccaagattcagcaaccaaagccgtagtcgttgagccagaaggttccattttaaatggtggaccagctcacgcacatcgtaccgagggaatcggcgtcgaattcatcccaccatttttcgatcaggttcgcatcgatcagacactgaccatcgcggacaatgatgcctttgcccaagttcgacacctagcccgtgaccacggtttactgattggcagttctagcggcgctgcgctagccgctagtttacaacttgccaccaacctgcctgccaatagtcatatcgtgaccatctttccagacagtagtgagcgttatctgagccaaaaaatctatacgaaatga

SEQ ID NO: 24700 - protein, 303 aa, Lactobacillus plantarum
MLIQHVQELIGHTPLMALPIEVPNHSHIYAKLEMFNPGGSIKDRLGAYLIEDGLQRGRVNAKTTIIEPTAGNTGIGLALATQAHHLRTILVVPEKFSMEKQVLMQALGAEIVHTPSEEGIKGAIRKAEALAATISNSYVPMQFKNPANPAAYYHTLAPEILADMPAPITAFVAGAGSGGTFAGVAAYLQAQDSATKAVVVEPEGSILNGGPAHAHRTEGIGVEFIPPFFDQVRIDQTLTIADNDAFAQVRHLARDHGLLIGSSSGAALAASLQLATNLPANSHIVTIFPDSSERYLSQKIYTK

SEQ ID NO: 24701 - DNA, 918 bp, Clostridium tetani
  CDS (1)..(918)
atgaaaatatacaataatctaatagagcttataggaaagacaccacttgtaaacctaaataaatttgaaaagaaaaatggattagattcaaatataattgcaaaggtggaatattttaatccatcaggtagtgtaaaggatagagcagcattatctatgatagaagaagctgagaggactaatctaataaataaagatactgtaataattgagccaactagtggaaatacaggtataggcttagctttaatttgtgcaattaaaggatatagattgattttgactatgccagagactatgagtatagaaagaagaaatatactaaaggcttatggggcagaagtagttttaactcctggaaacaagggaatgaatggttctatacaaaaagcagaagaattagcaaaggaaatgggaaatgtttttattccacaacaatttaataacccttccaactcagctattcataaaataacaacagcaaaagaaataataaatgatttggatggaaaggtagatatatttattgcgggagttggaactggtggtacagtaacaggtgttggagaaggattaaaagaatataataaaaatataaaaattgtagcagtggagcctgaaaattcacctattttgtctggtgggaaaccggggccacacaaaatacagggtataggagcaggctttattccagaaatattagatatgaatataatagatgagatatttaaagctcctaatgaagaatccatagaaattatgaagaaaatagttaaattagaaggattgtttgtaggaatatcttcaggagctgcattatatgcggcaaaagaaataggtaaaagagaagagaataaaggtaaaaatatagtggtgttattaccagacacaggtatgagatatttatcaagttattag

SEQ ID NO: 24702 - protein, 305 aa, Clostridium tetani
MKIYNNLIELIGKTPLVNLNKFEKKNGLDSNIIAKVEYFNPSGSVKDRAALSMIEEAERTNLINKDTVIIEPTSGNTGIGLALICAIKGYRLILTMPETMSIERRNILKAYGAEVVLTPGNKGMNGSIQKAEELAKEMGNVFIPQQFNNPSNSAIHKITTAKEIINDLDGKVDIFIAGVGTGGTVTGVGEGLKEYNKNIKIVAVEPENSPILSGGKPGPHKIQGIGAGFIPEILDMNIIDEIFKAPNEESIEIMKKIVKLEGLFVGISSGAALYAAKEIGKREENKGKNIVVLLPDTGMRYLSSY

SEQ ID NO: 24703 - DNA, 978 bp, Bradyrhizobium japonicum
  CDS (1)..(978)
atggacgcatcgtccgccacgcgtgcagcgcatcaacccggccgcggccggatctatgactcgattgtcgaagcttttggcgacacgccgatcgtgcgattgcgacggctgccgggcatgcacggtgtgaacgcgacgattttggcaaaacttgaatatttcaatccggccgcgagcgtgaaggaccgcatcggcgctgccatgatcatcgccatggagaaggccggtatcgtcaagccggataccgtgctgatcgaaccgacctccggcaataccggcatcgcactcgccttcgtcgccgcctcgcgcggctaccggctcaagctcgtgatgccggaatcgatgtcgatcgaacggcgcaagatgctggcctttctcggcgcggagctggtgctgacgccggccgcacaaggcatgaagggcgcgatcgccgccgccgaggagctggtgaagacgacgccgaactcggtgatgccgcagcagttcaagaacctcgccaatcccgaggtgcaccgccgcaccaccgcggaggagatctggaacgacaccgacggcaacatcgatttcttcgttgcaggcgtcggcaccggcggcacgatcaccggcgtcggccaggtgctcaagccgcgcaaggcctcgttgcgggtggtggcggtcgagccggaggagagcccggtgctatcagggggacagcatacgccgcacaagatccagggcatcggcgcgggcttcgtccctgatatcctcgatcgctccgtgatcgacgagatcgtcaaaatcaactcgaccacggcgatcgagacctcgcgcgcattggcgcggcacgagggcattccgggcggtatctcctcgggtgctgcgatcgccgccgcgctccagatcggccagcggccggaagctgcgggaaaaaccatcctggcggtggtaccgtccttctccgagcggtatctttcgacggctctgtttgagggaatctag

SEQ ID NO: 24704 - protein, 325 aa, Bradyrhizobium japonicum
MDASSATRAAHQPGRGRIYDSIVEAFGDTPIVRLRRLPGMHGVNATILAKLEYFNPAASVKDRIGAAMIIAMEKAGIVKPDTVLIEPTSGNTGIALAFVAASRGYRLKLVMPESMSIERRKMLAFLGAELVLTPAAQGMKGAIAAAEELVKTTPNSVMPQQFKNLANPEVHRRTTAEEIWNDTDGNIDFFVAGVGTGGTITGVGQVLKPRKASLRVVAVEPEESPVLSGGQHTPHKIQGIGAGFVPDILDRSVIDEIVKINSTTAIETSRALARHEGIPGGISSGAAIAAALQIGQRPEAAGKTILAVVPSFSERYLSTALFEGI

SEQ ID NO: 24705 - DNA, 1035 bp, Bradyrhizobium japonicum
  CDS (1)..(1035)
atgaccattcgaaacgacgtagtcgaagccattggcaacaccccgctgatcaagctcaagcgcgcctcggaggcgaccggctgcaccattctgggcaaggccgaattcatgaatcccggccagtcggtgaaggaccgcgccggcaagtggatgatcttggaggccgagaagcgcggcgagctcaagcccggcggcctcgtggtggaagcgaccgccggcaataccggcatcgggctcgcggtcgtggcgagtgcgcgcggctatcgcacgctgatcgtgatcccggagacgcagagccaggagaagaaggactttctcaagctgtgcggcgccgagctgatcgaggtgccggcgcttccttacgccaatcccaacaactaccagcatgtcggccgccggctcgccgacgagctgcgcaagaccgagcctaacggcgtgctgttcgccgaccagtggaacaatctcgacaatgcgaaagcgcattacgagtccacggggccggagatctgggagcagaccggcggcaaggtcgacgggttcgtctgctcggtcggcagcggcggcacgctcgccggcgtcagccgccttctgaaggaaaagaacaagaacgtccggatcgcctgcgccgacccgcatggtgccgggatgttcgattatttcaggaccggcgaagccaaggcgacgccgggcggttcgatcaccgaaggtatcggcctcaaccgggcgaccgcgatcgtcgagagcgcgaaggtcgatgacgcctatctcattcccgacactgacgccgtcacggagatctacgacctgctccagcacgagggcctgtgcctcggcggctcgaccggcatcaacatcgccggcgcgatacgcctcgccaagcagctcggccccggcaagaccatcgtcaccgtgctctgcgattccggcagccgctatcagtcaaaactgttcaatgcggacttcatgcgcgccaagaaccttccggtgccggaatggttggagaagcgcagcaacatcaagccgcccttcgtttga

SEQ ID NO: 24706 - protein, 344 aa, Bradyrhizobium japonicum
MTIRNDVVEAIGNTPLIKLKRASEATGCTILGKAEFMNPGQSVKDRAGKWMILEAEKRGELKPGGLVVEATAGNTGIGLAVVASARGYRTLIVIPETQSQEKKDFLKLCGAELIEVPALPYANPNNYQHVGRRLADELRKTEPNGVLFADQWNNLDNAKAHYESTGPEIWEQTGGKVDGFVCSVGSGGTLAGVSRLLKEKNKNVRIACADPHGAGMFDYFRTGEAKATPGGSITEGIGLNRATAIVESAKVDDAYLIPDTDAVTEIYDLLQHEGLCLGGSTGINIAGAIRLAKQLGPGKTIVTVLCDSGSRYQSKLFNADFMRAKNLPVPEWLEKRSNIKPPFV

SEQ ID NO: 24707 - DNA, 948 bp, Bacteroides thetaiotaomicron
  CDS (1)..(948)
atggaaaagattgcaaggaaattgacggatttggtaggtaacactccgttgttggaactaagtaattataataagagtaacggcttgaaggctcgtctgatcgtgaaaatcgaatcattcaatcccgcgggcagtgtaaaagaccgcgtggcattggcaatgattgaagatgccgaaatgaaaggcgtcttgactcccggcgcaacgatcatcgagcctaccagtggaaatacgggagtaggattggcattcgttgctgccgccaaggggtacaaactgattttgacgatgcccgatacgatgagcgtcgaacgtcgtaaccttttgaaagctctgggagcggaacttgtgctcactcccggtgccgacggaatgaaaggggcgattgccaaagcggaagagttgaaagctgccactccgggcagcgttatcttacagcaatttgaaaatcctgctaatcccgctatgcatctacgcactaccggactggaaatatggagagataccgaggggaaagtcgatatcttcgttgccggtgtaggtactggcgggacaattagcggagtaggagaagcattgaagatgcgcgatcccagtgtgaaggcggtggcggtagaacctgccgactctccggtactgtccggcggaaagcccggacctcacaagattcagggaatcggcgccggtttcgtaccgaagacttataatgcttctgtcgtagatgaaattattcaggtgcagaatgacgacgctatccgtaccagtcgtgcgctggcggaggaagaagggctgttggtcggcatatcttcgggagcagccgtctatgcggctaccgaactggcgaaacgtcccgaaaacgaagggaagatgatcgtagccttattgcccgatacgggagagcgttatttatctactatcctgtacgcgtttgaagagtatcctttgtaa

SEQ ID NO: 24708 - protein, 315 aa, Bacteroides thetaiotaomicron
MEKIARKLTDLVGNTPLLELSNYNKSNGLKARLIVKIESFNPAGSVKDRVALAMIEDAEMKGVLTPGATIIEPTSGNTGVGLAFVAAAKGYKLILTMPDTMSVERRNLLKALGAELVLTPGADGMKGAIAKAEELKAATPGSVILQQFENPANPAMHLRTTGLEIWRDTEGKVDIFVAGVGTGGTISGVGEALKMRDPSVKAVAVEPADSPVLSGGKPGPHKIQGIGAGFVPKTYNASVVDEIIQVQNDDAIRTSRALAEEEGLLVGISSGAAVYAATELAKRPENEGKMIVALLPDTGERYLSTILYAFEEYPL

SEQ ID NO: 24709 - DNA, 954 bp, Bacteroides thetaiotaomicron
  CDS (1)..(954)
atgatggcaaaaattgcgaataaattaacagatttagtgggtaatacacctctaatggaactttccggatatagtggaaagtatggtcttaatcagaatattatcgctaaactggaggcttttaatccggcgggaagcgtaaaagacagagtcgctctttctatgattgaagatgcggaggcccgcggggcactgaaacccggtgccaccattatcgaaccgaccagcggaaatacgggagtcggactggcgatggtagctaccattaaagggtatcacttgatattgactatgcccgaaacgatgagcttggaacggcgaaacctgttgaaagcactgggggcgcagattgtgctaacagatggcttgggcgggatggctgcttctattgccaaggcgcaggagttgcgcgatagtatccccggatctgtgatcctgcaacagtttgaaaatccttcgaatgctgctgtccatgagcggacaacaggagaggaaatctggcgggatacggatggtgaagtggcagtgttcgttgccggagtaggaaccggaggtacgatttgcggcgtggcacgcgccttaaaaaaacataatccggatgttcatatcgttgcggttgaacctgcgtcgtctcccatattggcaggaggtcaggcagcatcacaccgcatacagggaatcggggcgaattttattccgaaactttatgatgcttctgtagtggatgaagtgataggtgtgcccgatgacgaagccattcgtgcggggcgagagctggctgcgacagaaggtttgctggccggaatctcttcgggagcggccgtatatgcagcccgacagttggcacagcgtccggagttcaggaacaaaaaaatcgttgcgttgttacctgatacgggagaacgctatctgtcgaccgagttgttcgcttttgatgcctatcctttggattaa

SEQ ID NO: 24710 - protein, 317 aa, Bacteroides thetaiotaomicron
MMAKIANKLTDLVGNTPLMELSGYSGKYGLNQNIIAKLEAFNPAGSVKDRVALSMIEDAEARGALKPGATIIEPTSGNTGVGLAMVATIKGYHLILTMPETMSLERRNLLKALGAQIVLTDGLGGMAASIAKAQELRDSIPGSVILQQFENPSNAAVHERTTGEEIWRDTDGEVAVFVAGVGTGGTICGVARALKKHNPDVHIVAVEPASSPILAGGQAASHRIQGIGANFIPKLYDASVVDEVIGVPDDEAIRAGRELAATEGLLAGISSGAAVYAARQLAQRPEFRNKKIVALLPDTGERYLSTELFAFDAYPLD

SEQ ID NO: 24711 - DNA, 909 bp, Staphylococcus epidermidis
  CDS (1)..(909)
atgattgcatacgatttgataggacaaactccattagttttattagaaagctttagtgacgagaatgttaaaatatacgccaaacttgagcaatttaatcctggtggtagcatcaaagaccgtctagggaagtacttaattgaaaaagcaatagatgaaggacgacttaaagaaggggatacaatagtcgaagcgactgctggtaatacaggcattggacttgctattgcttctaatcggcacaaagtaaaatgtatcatctttgctccagaaggatttgcagaagaaaaaatttcaattatgaaagcattgggtgcagatgttagacgtacccccaaagctgagggaatgactggcgcacagcaagaggcgttggcatacgcaacacgatatggatatttatatatgaatcaattcgaaactaaagataatcctggggcatatacacaaacacttgccaaacaactcacagatgaactttcacatattgattattttgtggcaggtgttgggtccggtggtacgtttacaggagttgcacaacacttaaaaacgtatgatgtaaaaaattatattgtagaaccagaaggctctgtcttaaatggtggtgtcagtcatcctcatgcaactgaagggattggttctgaaaagtggccatcatttttagaaaaagaattagtagatggtatttttactgttgccgataaagatgcttttaataatgttaaacttgtcgcgaataaagaaggattgttagttggtagttcttcgggagcggcattacaaggagcgttggaattaaaaaaaagcattcaaaatggtgtgattgttaccatctttccagatggaagcgatcgatacatgtccaaacaaatattcaactataaggagagttttaataatgaataa

SEQ ID NO: 24712 - protein, 302 aa, Staphylococcus epidermidis
MIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 24713 - DNA, 930 bp, Oceanobacillus iheyensis
  CDS (1)..(930)
atggcaatttatgaatcgatacaacaattgattggcaatacacctttattaagaattaatgagatggacattccaaataatgttcatctctatgcaaaattagaatttttaaatcctggcggaagtgtaaaagatcgtttaggacaatatttaattgataaagcttgggagcaaggctttcttcgagagggaagtacaataatcgaaccaacagctggaaatactggtattggtttagctttagctgctagaacgaaaaagttgtcggttattttttgtgtacctgagcaatttagtgtcgaaaagcaacaaatcatgagagctttaggtgcaactatcattcatactccaaaagaaaaagggatgatgggtgcaatagaaaaagctgaacaattagttgaagaaatcccaaatagctattctccacagcagttttcaaataaatttaatcctatgacctattatgagacgatggcaccggaaatttggagtgatttacaaggagatattgatatctttgtagcgggtgcgggatcgggaggtacttttacaggttgtgcgagttattttaaggaaagaaaaaactcgattcataatgttatcgttgagcccgttggttcaattttagggggaggagaagctggtccacatttaaccgaaggaattggaatggaatttatccctgagtacatgaatcaaagctttatggatgaggtacaaactatttcggataaagaagctttttcgatggtagaagaacttgctagaaaagaaggattgttagtgggtagttcttctggttcagcgatggtagctgctttaaacaaagcaagagaagctagatcaggaacgacaattgttactattcttcctgatggaagtgatcgctatttaagtaaacagatttataatgtgtcaaagcaattgtaa

SEQ ID NO: 24714 - protein, 309 aa, Oceanobacillus iheyensis
MAIYESIQQLIGNTPLLRINEMDIPNNVHLYAKLEFLNPGGSVKDRLGQYLIDKAWEQGFLREGSTIIEPTAGNTGIGLALAARTKKLSVIFCVPEQFSVEKQQIMRALGATIIHTPKEKGMMGAIEKAEQLVEEIPNSYSPQQFSNKFNPMTYYETMAPEIWSDLQGDIDIFVAGAGSGGTFTGCASYFKERKNSIHNVIVEPVGSILGGGEAGPHLTEGIGMEFIPEYMNQSFMDEVQTISDKEAFSMVEELARKEGLLVGSSSGSAMVAALNKAREARSGTTIVTILPDGSDRYLSKQIYNVSKQL

SEQ ID NO: 24715 - DNA, 1089 bp, Synechococcus elongatus
  CDS (1)..(1089)
atgccaaaggcacactgggcgatcgctctccctgaagggaattctggcggcaaagccttttaccataaaagtattcagttcacttcaaacaacgacggcatgaatattaaacagggttttgtcggcaccgtcgggcagacgccgctgattcgcctcaattactttagtgacctcacgggctgtgaaattctcggtaaagcagagttcctcaaccccggtggctccgtcaaggatcgagcggccctctacattattgaagatgctgaaagaaaaggccttctcaaacctggcggtacagtggtcgagggtacagcgggcaataccggcattggcctagcccacatctgcaatgccaagggctacaggtgcttgattgtgattcccaatacccaatcccaagaaaaaattgacctgttgcgtaccctaggtgccgaggtgcgccccgttcctgccgtgccctacaaagaccccaataactatgtgaagctctctggccgtattgctgctgagatggagaatgccctctgggcgaaccagttcgataaccttgccaatcgccaggcccactacgaaaccactggccctgaaatctgggagcagaccgatggccgaattgatgcgtgggtagcagccactggcacggggggtacctatgcaggtgtagccctgttcctcaaggaaaaaaatcccgccattcgcaccgtgattgctgatccgatgggcagcgctatctatagctatgtaaaaacgggtaccctcagtagcacagggagttcaatcactgaaggcattggcaatagccgcattacagccaatttagcaggcgctcccattgatgatgcgattcaaattgaggatcaagagtgccttgacgtcatttatcaactgctgcactacgatggccttttcatggggggctccgtgggcattaatgtcggggcagcggtacgcctagccaaggaactcggccccggccacacaattgtcacagtgctgtgcgacgggggttcccgctatcaatcgcggctctttaacccagagtggctggccagtaaagggctacgggtgccagagattaaaaaacgttaa

SEQ ID NO: 24716 - protein, 362 aa, Synechococcus elongatus
MPKAHWAIALPEGNSGGKAFYHKSIQFTSNNDGMNIKQGFVGTVGQTPLIRLNYFSDLTGCEILGKAEFLNPGGSVKDRAALYIIEDAERKGLLKPGGTVVEGTAGNTGIGLAHICNAKGYRCLIVIPNTQSQEKIDLLRTLGAEVRPVPAVPYKDPNNYVKLSGRIAAEMENALWANQFDNLANRQAHYETTGPEIWEQTDGRIDAWVAATGTGGTYAGVALFLKEKNPAIRTVIADPMGSAIYSYVKTGTLSSTGSSITEGIGNSRITANLAGAPIDDAIQIEDQECLDVIYQLLHYDGLFMGGSVGINVGAAVRLAKELGPGHTIVTVLCDGGSRYQSRLFNPEWLASKGLRVPEIKKR

SEQ ID NO: 24717 - DNA, 966 bp, Synechococcus elongatus
  CDS (1)..(966)
atgaatattgcccccgatattactgccctcattggtcggacgccccttgtacgcctgaaccgcattccccaagcggagggctgcgttgccgaaattgtcgtcaagctagagagcatgaatcctgcggcctcagttaaggatcgcattggcctaagtatgattcaggaggcagaagcagcgggtctcattacccctggtaaaacggttttggtggagccgacatcgggaaatactgggattgccttggccatggtcgcggcggcaaagggctatcggctgattctcaccatgccagaaaccatgagtgcagagcgccgagccatgctgcgtgcctatggcgcagagctggatttgacccccggcaccgaggggatgagtggcgccattcgtcgtgctgaagagattgctgcctcccttgaagatgctttcatgttgcagcagttcaaaaatcccgccaatccaaagattcaccgtgaaaccactgcgcttgaaatttggcaagatacagacggtcaagttgatattttggtggctggcgttggtacggggggcacgattacgggggtagcagaagtgatcaaagcaaagaagcctacctttcaagcgatcgccgtcgaacccagcaatagtccagtcctttcaggaggcaaaccgggaccccacaaaattcaaggcattggtgctggctttgtgccccccgttctcaaacgagaactcattgatgaagtcatccctgtctccgatgatcaagccatccattttggtcgccgcttagcccgtgaagaaggcctgctctcaggtatttccagtggggctgccctttgtgctgccattcaggtggctcaacgtcctgaaaatgccggcaagttaattgtcatggtgcagcccagttttggcgaacgctacttgagcacccccctcttccaagaggccctgcccttggtgccaagctacttgcaaacttag

SEQ ID NO: 24718 - protein, 321 aa, Synechococcus elongatus
MNIAPDITALIGRTPLVRLNRIPQAEGCVAEIVVKLESMNPAASVKDRIGLSMIQEAEAAGLITPGKTVLVEPTSGNTGIALAMVAAAKGYRLILTMPETMSAERRAMLRAYGAELDLTPGTEGMSGAIRRAEEIAASLEDAFMLQQFKNPANPKIHRETTALEIWQDTDGQVDILVAGVGTGGTITGVAEVIKAKKPTFQAIAVEPSNSPVLSGGKPGPHKIQGIGAGFVPPVLKRELIDEVIPVSDDQAIHFGRRLAREEGLLSGISSGAALCAAIQVAQRPENAGKLIVMVQPSFGERYLSTPLFQEALPLVPSYLQT

SEQ ID NO: 24719 - DNA, 927 bp, Streptococcus mutans
  CDS (1)..(927)
atggcaaaaatttataacaacattactgaattaattggcaatacacctattgtaaaactcaacaatgttgttcctgaagatgcagctgatgtttatgttaaacttgaagctttcaatcctggttcttccgttaaagatcggattgctttaagcatgattgaagatgctgaaaaacgtggtctcatcaaacctggagataccattgtcgaaccgacaagtggtaatacaggtattggactttcatgggtcggcgctgccaaaggttacaatgtcattattacaatgcctgaaacaatgagcgttgaacgccgcaaaattatacaagcttacggtgccaaactcgtattgacaccaggaagtgctggtactaagggtgccattgacaaagctcacgagattgccaaagaagttggtggttgggtgcctctgcaatttgacaatccagctaatccaaaaattcacgaattgacaacaggtcctgagattctggaagcatttggttcacatggacttgatgctgtcgttgctggtattggtactggtggtacgattactgggatttcacgtgcccttaaaaaagacaatcctgacattaaaatctatggattggaagctgatgaatctgctgttttgtcaggtgacaaaccggggccccataaaatccaaggtatctcaacaggctttatcccagctgcattagatactcattcttatgatgaagttatccgtgttaaatctgatgatgctttggctactggtcgctacttcggcggtaaggaaggattcctacttggcatctccgcttctgctgctgtctgggccgcacttgaagtcgctaaaaaactcggtaagggtaaaaaagtcttggctattgcacctgataatggtgagcgttatctttcaaccgcactttatgaatttaactag

SEQ ID NO: 24720 - protein, 308 aa, Streptococcus mutans
MAKIYNNITELIGNTPIVKLNNVVPEDAADVYVKLEAFNPGSSVKDRIALSMIEDAEKRGLIKPGDTIVEPTSGNTGIGLSWVGAAKGYNVIITMPETMSVERRKIIQAYGAKLVLTPGSAGTKGAIDKAHEIAKEVGGWVPLQFDNPANPKIHELTTGPEILEAFGSHGLDAVVAGIGTGGTITGISRALKKDNPDIKIYGLEADESAVLSGDKPGPHKIQGISTGFIPAALDTHSYDEVIRVKSDDALATGRYFGGKEGFLLGISASAAVWAALEVAKKLGKGKKVLAIAPDNGERYLSTALYEFN

SEQ ID NO: 24721 - DNA, 927 bp, Streptococcus agalactiae
  CDS (1)..(927)
atgtcaaaaatttataattctattacagacttaatcggaaatacacccattattcaattacatcatattgttccagaaggagctgcagaggtgtacgttaagttagaatcctttaacccaggttcatctgtcaaagatcgtatcgctctagctatgattgaagatgcagagcaaaaagggattcttaaagccggagatacaatcgtagaacctacatctggtaatacaggtatcggtttggcttgggtaggaaaagctaaagggtataatgttattattgttatgccagaaaccatgtcaattgaacgtcgtaaaatcattcaagcctatggtgctcaattagtactaacacctggtagtgaagggatgaagggagctattgctaaggcaaaagaaatttctgcagagcaaaatgcttggctacccctgcaatttaataatcaagccaatccagaaatccacgaaaaaacgactggtagggaaattatcgagacttttggtgaaaaaggtttagatgcttttatcgcaggtgtgggaactggtgggacaattactggtgtctctcgtgcattaaaaaaagtcaatcctgatgtcgctatttatgctgtagaagctgatgaatctgcaatcctttctggtgagcaacctgggcctcataaaatacaagggatttctgcaggtttcattccagaaacattggctacagattcttatgatcatatcattcgcgttacatctgacgatgctattgaaacaggacgtatcatcggcggactagaaggtttcctcgcaggaatttctgcttcagctgctatttatgctgctattgaagtggccaaacaactaggaaaagggaaaaaggttttagctcttctccctgataatggcgaacgttacttatcaacaagcctgtatgattttgaatag

SEQ ID NO: 24722 - protein, 308 aa, Streptococcus agalactiae
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 24723 - DNA, 969 bp, Shewanella oneidensis
  CDS (1)..(969)
atgagcaaaattttcgaagacaattcatatactattggcaacaccccgttagtgcgtttaaaccgagtaagccaaggtaaagtgctggcgaaagtcgaatcacgcaatcccagtttcagtgtcaaatgccgtatcggtgccaatatgatttgggatgccgagaaaaaaggactgctcaccaaagatcatgagctgattgagccaacatccggtaacacgggtatcgctttagcctatgtagcagcagctcgtggttacaagctgaccctgaccatgccaaatactatgagcttagagcgtcgtaagttgcttaaagctttaggtgcaaatctggtgctgaccgaaggcgccaaaggcatgaaaggcgcgattgataaagcggaagagatccgtcaatcggcgcctgaaaaatatattttgttgcagcagtttaataaccctgccaaccccgagatccacgaaaaaaccacaggtccagaaatttggaatgacactgatggcgctgtcgatgtgtttgttgctggtgtgggtactggcggtactatcacgggtgtcagccgttacttgaaaaaagtggcaggcaaagcgattacctcggtggcggtagaacctgccgactcaccagttatcactcaaaccttagcgggattacctgtacaacctggcccacataaaattcaagggattggcgcaggttttatcccaggtaaccttgatatcgagcttatcgatcgcgttgagacagtcaccaacgatgaagcaattgaaatggcgcgccgcttgatgcaggaggaaggtattttagtgggtatttcttcaggagctgccgtggttgccgctaaccgtatcgctgctctgcctgagtttgcggataaaaccattgtggtagtactgccttcagctgcagagcgttacttatcttcagtattgttccaaggccaatttggcgacgaagaaaatatccagtaa

SEQ ID NO: 24724 - protein, 322 aa, Shewanella oneidensis
MSKIFEDNSYTIGNTPLVRLNRVSQGKVLAKVESRNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYILLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDIELIDRVETVTNDEAIEMARRLMQEEGILVGISSGAAVVAANRIAALPEFADKTIVVVLPSAAERYLSSVLFQGQFGDEENIQ

SEQ ID NO: 24725 - DNA, 924 bp, Oceanobacillus iheyensis
  CDS (1)..(924)
atgcgtgtagtcaatgatgtaactgaattaattggtcaaacaccaatggttaagttaaatcgtctccaaccagaaaatgcagctgacatatatgtaaagttagagatgtttaatccgagcggtagtgtaaaagaccgagctgcatcccatatgatacgtgtagcagaagaacaagggttaataaaacaaggagccactattatagaacctacaagtggaaatacaggcatcggtttggcaatggcggcatctgctaaaggatataaagcaattatgattatgccggataatagtacgatggaacgtcgaaatatattaaaggcgtatggagcagaagtcgtacttacgccaagtgaggaaaaaatgcctggatccatacgtaaagcgctagaacttcaaaaatccattcctaacagttttatacctcaacaatttgaaaatgtagctaacccagatgttcatcgtattagcactgctttagaaatcttggaacagatggataatcaattagatgcgtttgtctgtactgcaggaactggtggtacggtaacaggtacaggagaaacattaaaggaaaagttaccacatgtgcatgtggcggttgtggaaccagaaggatcacccgtcttatcaggaggaaagccgggaccgcataaactcgttggcacaagtccgggattcgtacctgatattttaaatacggatgtatacgatgaaatcattcaaattaaagatgaacaagctgtcactttattaaaagaccttgctcaaaaagaagggatttttcttggtccatctggagcagctgctgtatatgcggcaatggaagtagcgaagaagcttggcccaaacaaaaagcttgtatgtatagcaccagatacaggagaacgttatctatccatggatatgtttgatgaaaagtaa

SEQ ID NO: 24726 - protein, 307 aa, Oceanobacillus iheyensis
MRVVNDVTELIGQTPMVKLNRLQPENAADIYVKLEMFNPSGSVKDRAASHMIRVAEEQGLIKQGATIIEPTSGNTGIGLAMAASAKGYKAIMIMPDNSTMERRNILKAYGAEVVLTPSEEKMPGSIRKALELQKSIPNSFIPQQFENVANPDVHRISTALEILEQMDNQLDAFVCTAGTGGTVTGTGETLKEKLPHVHVAVVEPEGSPVLSGGKPGPHKLVGTSPGFVPDILNTDVYDEIIQIKDEQAVTLLKDLAQKEGIFLGPSGAAAVYAAMEVAKKLGPNKKLVCIAPDTGERYLSMDMFDEK

SEQ ID NO: 24727 - DNA, 927 bp, Oceanobacillus iheyensis
  CDS (1)..(927)
atgagggtctctgataatattacaggtttaattggcggaacaccgattgttaaattacacaatgttacagatgaaggtagtgcagatgtatacgcaaaggtagagtttatgaatcctggtagctctgtgaaagaccgtattgctatcgcgatgattgaagcagcagaacaaggtggaaagctaaaagaaggcgatactattattgagccgactagtggaaatactggtattggccttgcaatggtagcagctgcaaaaggataccgtgcagttctagtaatgccagatacgatgagtcaggaacgcaggaatctccttcgtgcttatggtgctgaacttgtactgacacctggtgctgaagggatgaaaggtgcaattgcgaaagcggtagaattgcaagaagagaatgattactttatgccgcaacaatttagcaaccctgcaaatcctgatattcacgaaaaaacgactggtaaagaaattgtggagcagatgaaagatggtcttgatggattcgtatctggtattggtactggtggaacaattaccggtgcaggtaaggtgctaaaaaatcattttcaagatattaaattatacgcagtagagccggctgattctccaatactttcaggaggaagtcctgggccgcataaaatacaaggaattggagccggctttaaaccggatgtgttagacaccgcaatctatgatgaagttttaacaattagtaatgaggaagcatatgaagcagctagaaaagttgcaacgaccaatggcatattgggaggtatttcttccggtgctgcagttgctgctgcagttaaagttgctaaacaattaggcgcaggtaagaaagttcttgctatattaccagataatggtgagcgctatctatcaacaccgttatatcaatttgataaagagtaa

SEQ ID NO: 24728 - protein, 308 aa, Oceanobacillus iheyensis
MRVSDNITGLIGGTPIVKLHNVTDEGSADVYAKVEFMNPGSSVKDRIAIAMIEAAEQGGKLKEGDTIIEPTSGNTGIGLAMVAAAKGYRAVLVMPDTMSQERRNLLRAYGAELVLTPGAEGMKGAIAKAVELQEENDYFMPQQFSNPANPDIHEKTTGKEIVEQMKDGLDGFVSGIGTGGTITGAGKVLKNHFQDIKLYAVEPADSPILSGGSPGPHKIQGIGAGFKPDVLDTAIYDEVLTISNEEAYEAARKVATTNGILGGISSGAAVAAAVKVAKQLGAGKKVLAILPDNGERYLSTPLYQFDKE

SEQ ID NO: 24729 - DNA, 930 bp, Leptospira interrogans
  CDS (1)..(930)
atgaaagctaagagcattttagaaacgatcggaaatacacctcatgtaaaaattaaccgtttgtttaatacgaaaagcgaggtttatgcaaaattagaaagatccaatccaggcgggtccattaaggatcgcattgcactttccatgatcgaagacgcggaaaaaacaggtaaacttactaaagacagcatcattgtagaacctacttctggaaatactggaattggtttagcactcgttgcagcggttaaaggttataagttacttttagttatgcctgaatctatgagtatcgagagaagaagaattatggcggcgtacggagcggagtttgaactgactccaagagaaaaaggaatgccgggtgcgatcgaaaaggcaaaacaaattgtcgcagaaaatccaaaagcgtggatgcctcaacaatttgaaaacgaagcaaatattaagattcacgtagaaacaaccgctcaagaaattgcaaaagattttccagatgggctggactacgtaattacaggtgtcggcactgggggacatatcacgggtgtggcgcaggtcctaaaacaaaaatttcctaaattgaaagtgtttgccgtggaaccagaagcatctccagtaatctccggaggaaaaccgggaccacatccgattcaaggaattggtgcgggatttattcctaaaaatttacatacaaatcttttagacggaactatacaaattagtaaagacgaagcgtttgagtatgcacaaagagcggcaaaagaagaaggactttttataggagtttcatccggagcggcacttgcagcggttgcaaaaaaattgcctgaaattccggaaggttcaagaatattaactttttcttatgacactggagaaaggtatctttctatcgaagggcttttccctgttccatctaacgcataa

SEQ ID NO: 24730 - protein, 309 aa, Leptospira interrogans
MKAKSILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 24731 - DNA, 936 bp, Corynebacterium efficiens
  CDS (1)..(936)
atgggcaacgtgtacaacaacatcactgagaccatcggccgcacccccctggtcaaactcaaccgcctcaccgagggcctggacgccaccgtcctggtgaagctcgagtccttcaaccccgcgaactccgtcaaggaccgcatcggtctagccatcatcgacgccgctgaggcctccggtgaactgaagccgggtggcaccatcgtcgaggcaacctccggcaacaccggtatcgccctggccatggtcggcgcagcccgcggttacaaggttgtcctgaccatgccggagaccatgtccaccgagcgtcgcgtcctgctgcgcgcctacggcgcggaaatcgtcctcaccccgggtgcagccggtatgcagggcgccaaggacaaggccgatgagatcgtcgccgagcgcgagaacgccatcctggcccgccagttcgagaaccccgccaacccggagatccaccgcgagaccaccgccaaggagctcatggaggacaccgacggtaacttcgacatcttcgtcgcaggtttcggcaccggcggcaccatcaccggtgtcggtggcgtgctcaaggagcacaacccggaggcccaggtctacgcagttgagcctgaggcatccccgctgctgacctctggcaaggccggcccgcacaagatccagggcatcggcgccaacttcatcccggaaaacctcgaccgtaagatcctcgatgatgtcatcaccatctccaacgaggatgccgtcacctggtcccgcaagctggccaccgaggagggcatcctgggtggtatctccaccggtgccaacatcaaggccgctctggacctggctgccaagccggagaacgccggcaagaccatcgtcaccaccgtctgtgacttcggtgagcgctacgtctccaccgtcctctacgaggacatccgcgactaa

SEQ ID NO: 24732 - protein, 311 aa, Corynebacterium efficiens
MGNVYNNITETIGRTPLVKLNRLTEGLDATVLVKLESFNPANSVKDRIGLAIIDAAEASGELKPGGTIVEATSGNTGIALAMVGAARGYKVVLTMPETMSTERRVLLRAYGAEIVLTPGAAGMQGAKDKADEIVAERENAILARQFENPANPEIHRETTAKELMEDTDGNFDIFVAGFGTGGTITGVGGVLKEHNPEAQVYAVEPEASPLLTSGKAGPHKIQGIGANFIPENLDRKILDDVITISNEDAVTWSRKLATEEGILGGISTGANIKAALDLAAKPENAGKTIVTTVCDFGERYVSTVLYEDIRD

SEQ ID NO: 24733 - DNA, 1227 bp, Bifidobacterium longum
  CDS (1)..(1227)
atggttaacatgaaaaaccgattcacttttcggattcaccgtacagtgagcgggaatactcgattttcaaaccaaagccacagtccattcgtctgggaacgtcggttcacgaacgcaacgcagcaaaacccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggctgtggccagcgccatcaagtacgcgcttgccaatgatttggacgagaaccagatcgtggtggtgctcgcccctgattccggccgcagctacttggagaagatcttcaacgacgactggatgcgtgccaacggctacggcgacatcgtggagcgcaccagcaagccctccctcgccgagcagtaccttaacggagctccctctgatgagggagctggggacggactccataactag

SEQ ID NO: 24734 - protein, 408 aa, Bifidobacterium longum
MVNMKNRFTFRIHRTVSGNTRFSNQSHSPFVWERRFTNATQQNPHNPSNEGLHMTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 24735 - DNA, 1572 bp, Phytophthora infestans
  CDS (5)..(1474)
cagcatgtcctcccccgcttcgctcgagtcgtccctgccgcccgcggcattggaggtcctgccggatatcatggcggcgatcggccagacgcccatggtatgcattaacagcatcggcaagaaagcccatttgcaatgtgagctgctagccaagtgcgaattcttcaacgccggaggttccgtcaaggaccgcatcggcaagcgcatggttgaggacgccgaggccgcgggtcgcatcaagcccggcgacacgctcatcgagcccacttccggcaacactggcatcggcttggcgctcgcgtccgccatcaagggctaccgctgcattatcacgctaccggagaagatgagtctggagaaggtgaacgtcctcaaggcgctaggagccgagattatccgcacgccgacagaggcagcgtgggactcgcccgagagccacattggcatcgccaggcgtctacaggctgagctcccgaatgcgcatatcttggaccaatacgccaatccgtccaacccattggctcactatgacggcacagccgaagagatcttggagcaatgtgacgggaaagttgacatggtcgtgatgggcgtcggtaccggtggcaccatctcgggtatcgccaagaaactcaaggagaaatgtcccagtgtgatcgtcgtcggtgtggacccagaaggttcgatcctcgcgttgccagactcgctgaacgacaagaaccgactgcagtcgtacaaggtcgaaggtatcggctacgacttcatcccggacgtactggaccgcagtctagtggaccaatgggagaagacgaacgaccaggaatcgttcatcatgtcccgtcgtctcattcgtgaggaaggactgctctgtggcggctcgagcggctcggccatggctgctgcggtccgtgctgcctccgtgttgaagcctggtcaacgctgcgtcgttgtgctgccggactcgacgcgcaactacatgtccaagttcttgaacgacgcgtggatgtacgagaacaaatacgtggaaaacacggtccacacgcgcgagaactactcgaaataccgcaaggagacggccacgtggtggtcgcagcagcgtgtgtcggtgctggagctgccgcacccgtccactgtgtcgcctcagctgtcgtgtgcagcggctattgagacgatggagcgtcacggctacgaccagctgcctgtcgtcaaggaggacggcaccgtgcagggcgtcgtgacgatcggcaacttgctgtccagactttcctctggtcgcgtcatgcgcacggatcccgtggcgaccgtgacgttcggcaacttcagtcgcgtgacccacgagagctcgttggccgaactcgccgccatctttgacaaggattacttcgctgttgtgacctccacggacggcaagattgctggcctcgccacgcggattgacctgctcaactacatcacgagcgcccgcgaggaataagcaacgataggagagagagagagaactagactgaattgggacagtggacaattttatctagggaataagtctatcgcttgttactcacaaaaaaaaaa

SEQ ID NO: 24736 - protein, 489 aa, Phytophthora infestans
MSSPASLESSLPPAALEVLPDIMAAIGQTPMVCINSIGKKAHLQCELLAKCEFFNAGGSVKDRIGKRMVEDAEAAGRIKPGDTLIEPTSGNTGIGLALASAIKGYRCIITLPEKMSLEKVNVLKALGAEIIRTPTEAAWDSPESHIGIARRLQAELPNAHILDQYANPSNPLAHYDGTAEEILEQCDGKVDMVVMGVGTGGTISGIAKKLKEKCPSVIVVGVDPEGSILALPDSLNDKNRLQSYKVEGIGYDFIPDVLDRSLVDQWEKTNDQESFIMSRRLIREEGLLCGGSSGSAMAAAVRAASVLKPGQRCVVVLPDSTRNYMSKFLNDAWMYENKYVENTVHTRENYSKYRKETATWWSQQRVSVLELPHPSTVSPQLSCAAAIETMERHGYDQLPVVKEDGTVQGVVTIGNLLSRLSSGRVMRTDPVATVTFGNFSRVTHESSLAELAAIFDKDYFAVVTSTDGKIAGLATRIDLLNYITSAREE

SEQ ID NO: 24737 - DNA, 942 bp, Streptococcus pyogenes
  CDS (1)..(942)
atgactaaaatttacaaaactataacagaattagtaggtcaaacacctattatcaaacttaaccgtttaattccaaacgaagctgctgacgtttatgtaaaattagaagcttttaacccaggatcttctgttaaagatcgtattgctttatcgatgattgaagctgctgaagctgaaggtctgataagtcctggtgacgttattatcgaaccaacaagtggtaatacaggtattggtcttgcatgggtaggtgctgctaaagggtatcgagtcattattgttatgcccgaaacgatgagcttggaaagacggcaaatcattcaggcttatggtgcagagcttgtcttaacacctggagcagaaggtatgaaaggggctattgcaaaagctgaaactttagcaatagaactaggtgcttggatgcctatgcaatttaataaccctgccaatccaagcatccatgaaaaaacaacagctcaagaaattttggaagcttttaaggagatttctttagatgcattcgtatctggtgttggtactggaggaacactttctggtgtttcacatgtcttgaaaaaagctaaccctgaaactgttatctatgctgttgaagctgaagaatctgctgtcttatctggtcaagagcctggaccacataaaattcaaggtatatcagctggatttatcccaaacacgttagataccaaagcctatgaccaaattatccgtgttaaatcgaaagatgctttagaaactgctcgactaacaggagctaaggaaggcttcctggctgggatttcttctggagctgctctttacgccgctattgaagtcgctaaacagttaggaaaaggcaaacatgtgttaactattttaccagataatggcgaacgctatttatcgactgaactctatgatgtaccagtaattaagacgaaataa

SEQ ID NO: 24738 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLAGISSGAALYAAIEVAKQLGKGKHVLTILPDNGERYLSTELYDVPVIKTK

SEQ ID NO: 24739 - DNA, 1371 bp, Chlorobium tepidum
  CDS (1)..(1371)
atgaccaacgacatttttgacatctcggacaacactccgctggttctcatgaagcagcttacccggcagaagcgcgcacggttcatggcgaagctcgaatacatgagcccctgcttttcgcactattgccgggtttcgggggccatcgtgcgtgacgccgaggagcgcggggcgattcatcccggcatgacgctcgtggactggaccttcggcaccagcggcatcgcgctcgcgatggccgccgtcagccggggctacaaagtgttgctcgccgcgccggagagcatctgccgcgagaagcaggaggtccttcgggcgctgggcgcggagctggtgctcaccccgtccgaggcgctgccgggcgatctgcaaagctgcgtcgatgtagccgagaaccttgtccgcacgctgccgaatgcctggtttgccaacatgtaccaaaatccggtcagccgccaggtgcatcaggatggcacggggccagagattttccggcagactgagggcaaggtgacgcacctcttcgtgccgatggcttcgggcgcgatgatctccgggatcggccgctacttcaaatcggtcaatccggaggttcagatcattggcgttgagccggagggttcggtttacggcgatctgcatggcggcaagagccaaggcactccctccgcgttccagctcgaagatatcggcgcggtcaggccgacctctttctgggaccccaacgtgatcgaccggatcgtgcaggtcagcgatgccgacgcattcaactgcggccgcgagttgctgcgtgccgaagcggtcttcgcgggcggagcctccggcgcggcgatggctgcggctctccgggagggcgaggcgtacggcgatgacgcgctggtggtggtgatgatgaccgactttggcggctacgacctgtcgcgcatgtacaacgatgactggatgcggcgtcagggattttaccggaaatccaagaccgcgctcgaccagatcacggcggacgacattctgcaacgcaaggcccacaaagacctcatcttcgcccagcctgagcagacgcttgccgaggttttcgaaacaatgaagcagaacgacgtttcccagatgcccattgtttcgttcggcgcgcccatcggcagcatcagtgaaaacaggattctctcgattctcattgagaacgattcggccatgaacgccaaggtggttgccttcatggaaaagccgttcccggtctgccagcccgatgcaaccatttccgaactgtcggaaaaattgcagacaaatgcatccggcgtgctcatcagcctcagcgatggccgcttgcaactgattaacaaatcagaccttatcgatgtgctgactcgcaagtga

SEQ ID NO: 24740 - protein, 456 aa, Chlorobium tepidum
MTNDIFDISDNTPLVLMKQLTRQKRARFMAKLEYMSPCFSHYCRVSGAIVRDAEERGAIHPGMTLVDWTFGTSGIALAMAAVSRGYKVLLAAPESICREKQEVLRALGAELVLTPSEALPGDLQSCVDVAENLVRTLPNAWFANMYQNPVSRQVHQDGTGPEIFRQTEGKVTHLFVPMASGAMISGIGRYFKSVNPEVQIIGVEPEGSVYGDLHGGKSQGTPSAFQLEDIGAVRPTSFWDPNVIDRIVQVSDADAFNCGRELLRAEAVFAGGASGAAMAAALREGEAYGDDALVVVMMTDFGGYDLSRMYNDDWMRRQGFYRKSKTALDQITADDILQRKAHKDLIFAQPEQTLAEVFETMKQNDVSQMPIVSFGAPIGSISENRILSILIENDSAMNAKVVAFMEKPFPVCQPDATISELSEKLQTNASGVLISLSDGRLQLINKSDLIDVLTRK

SEQ ID NO: 24741 - DNA, 933 bp, Chlorobium tepidum
  CDS (1)..(933)
atggccaccatcgcaaatatcacgaacaccatcggacgcacgccgctggtgcggctcaacaagctcgccaagggcctcgacgccgatattctcctcaagcttgaatacttcaacccgctcggcagcgtgaaggatcgcatcgggcgcgccatgatcgaagctgccgaagccgaggggaaaatcgacgcccggacgctcatcgtcgagccgaccagcggcaacaccggcatcgcgctcgccttcgtctgcgcccagcgcggctaccggctgctgctcacgatgcccgaaaccatgagcatcgagcgccgcaaactgctgcgctacctcggcgcggagctggtgctcactcccggagcgcaggggatgaaaggggcgattgaagaggcggcgcggatcgtcgaggcggagaaaaacagcttcaaccccggccagttccgcaacccggccaaccccctgattcaccaggcgaccaccggccccgaaatctggaacgacaccgaagggcgcgttgacatgcttgtttcaggcgtcggcacgggcggcaccatcaccggcacatcacgtttcatcaaggcgctgaagcccaacttcaaaagcatcgccgtggagcccaaagattcagctgtgctctccggcgggcagccggggcctcacaaaatccagggcatcggcgcgggcttcgtgcccgatgtgctcgacgtctcgctgctcgacgaggtggtgacggtgagcaacgacgacgcgatctcgaccgcgcgggcactcgcttcgcaggagggcatcctctgcggtatctcctccggcgcggcggttcacgcagccatcgaagtggcgaaacgctcgtcatccgcaggcaaaaccatcgtcgccatcatcccgagcaccggcgaacgctacctcagcactgcgctgtttgaagacatcgaagcgtga

SEQ ID NO: 24742 - protein, 310 aa, Chlorobium tepidum
MATIANITNTIGRTPLVRLNKLAKGLDADILLKLEYFNPLGSVKDRIGRAMIEAAEAEGKIDARTLIVEPTSGNTGIALAFVCAQRGYRLLLTMPETMSIERRKLLRYLGAELVLTPGAQGMKGAIEEAARIVEAEKNSFNPGQFRNPANPLIHQATTGPEIWNDTEGRVDMLVSGVGTGGTITGTSRFIKALKPNFKSIAVEPKDSAVLSGGQPGPHKIQGIGAGFVPDVLDVSLLDEVVTVSNDDAISTARALASQEGILCGISSGAAVHAAIEVAKRSSSAGKTIVAIIPSTGERYLSTALFEDIEA

SEQ ID NO: 24743 - DNA, 1075 bp, Fusobacterium nucleatum
  CDS (135)..(1055)
aaaatttaatttattatatttcaatattattctttaaaaaataagaactctatattttttttaatgagttcttttattttttttcttttagttatacaattaagttgaaaataaagttttataggaggatttttatgttagcaaattctgtaattgatttaattgggaacaccccattagtaaaaattaataatattaatacttttggaaatgaaatatatgtaaaactagaaggttcaaatcctggtagaagtacaaaagacagaattgccttaaaaatgattgaagaagctgaaaaagaaggtttaattgataaagatactgttattatagaagctacaagtggaaatacaggaattgggcttgctatgatatgtgcagttaaaaactataagttaaagattgttatgcctgatactatgagtgttgaaagaattcaacttatgagagcctatggaactgaagttatacttactgatggttcttttggaatgaaagcttgtttagaaaaattagaagaacttaaaaaacaagaaaagaaatattttattcctaaccaatttactaatgtaaataatccaaaagctcactatgaaactacagctgaggaaattttaagagatatggataataaagttgatgtatatatttgtggaacaggaacaggaggaagtttttctggaactgctaaaaaattaaaagaaaaattacctaatattaaaacttaccccgttgaacctgcgtcatctcctttactttcaaagggatatataggtccacataaaattcaaggtatgggaatgagtataggtggtataccagttgtctacgatggtagtttagctgatggaattttagtttgtgaagatgatgaagcctttaaaatgatgagagaattaagctttaaagaaggtatcttagctgggatttcaacaggtgctactctaaaagcagctcttgattattcaaaagaaaatgctaataaaagtttaagaatagttgttctttctactgactcaggagaaaaatatctatctagttctcatggcttataaaaaatattccaagaagttgc

SEQ ID NO: 24744 - protein, 306 aa, Fusobacterium nucleatum
MLANSVIDLIGNTPLVKINNINTFGNEIYVKLEGSNPGRSTKDRIALKMIEEAEKEGLIDKDTVIIEATSGNTGIGLAMICAVKNYKLKIVMPDTMSVERIQLMRAYGTEVILTDGSFGMKACLEKLEELKKQEKKYFIPNQFTNVNNPKAHYETTAEEILRDMDNKVDVYICGTGTGGSFSGTAKKLKEKLPNIKTYPVEPASSPLLSKGYIGPHKIQGMGMSIGGIPVVYDGSLADGILVCEDDEAFKMMRELSFKEGILAGISTGATLKAALDYSKENANKSLRIVVLSTDSGEKYLSSSHGL

SEQ ID NO: 24745 - DNA, 1386 bp, Rhodococcus erythropolis
  CDS (1)..(1386)
atgcgcatcgcggaacacgtcgtcgacctcatcggcaacaccccactcgtcaagctcacgtccgtcacgggcgaaaacttcggcacggtggcagccaaggtcgaatacctcaaccctggcggtagctccaaggaccgcatcgccgtcaagatgatcgacgcagccgaggcttcgggtgaactgaagcctggcggcaccatcgtcgagccgacttcgggcaacaccggaatcggcttggcactcgtggcgcaaaagcgtggatacaagtgcgttttcgtctgcccagacaaggtcagcgaagacaagcgcaacgtcctgcgtgcctacggcgccgaggtggtcgtgtgccccacggccgtcgcaccggacaacccgaacagctactacagcgtctccgaccgcctcacccgtgagatccccggcgcctggaagcccaaccagtactccaacccgggcggaccggagagccactacgagaccaccggtcccgagatctgggccgacaccgacggcaagatcacgcacttcgtcgcgggcgtcggcaccggcggcaccatcaccggcaccggccgctacctcaaggaagtttcgggcggcaaggtcaaggtcatcggcgcagaccccgaaggctccgtctactccggtggcaccggtcgcccgtacctggtcgaaggcgtcggcgaagacttctggccgtcggcatacgacccgtccatcccggacgagatcatcgccgtctcggatgccgattccttcgagatgacgcgtcgcctcgcccgcgaagagggactgctggtcggcggttcctgcggtatggccgtcgtcgctgccctcgaagtagccaagcgcgaaggccccgacgctctgatcgtcgtcctcctcccggacggcggccgcggctacctgtccaagatcttcaacgatcagtggatggcgtcgtacggattcctgcgcaccccactcgacggcaagaccaacgtccccaccgtcggcgacgtcctgcgcggcaagtcgggcgagctgccggacctcgttcacactcacccgtcggagactctgcgcgacgcgatcgagatcctgcgcgagtacggcgtgtcccagatgcccgtcgtcggtgcggaaccgccggtcatggcaggcgaggtcgccggaagcgtgtccgagcgagatctgctgagcgcggtattcgaaggccgtgcgcaccttgcggattccgtcgagaagcacatgagcaagccgttcccgctcatcggttccggcgagccggtctcggctgccacgaaggcgctcggtgacaccgacgcactcatggtcgtcgacgacggcaagccggtcggtgtcatcacgcgccacgatctcctgggtttcctgagttcggattcctga

SEQ ID NO: 24746 - protein, 461 aa, Rhodococcus erythropolis
MRIAEHVVDLIGNTPLVKLTSVTGENFGTVAAKVEYLNPGGSSKDRIAVKMIDAAEASGELKPGGTIVEPTSGNTGIGLALVAQKRGYKCVFVCPDKVSEDKRNVLRAYGAEVVVCPTAVAPDNPNSYYSVSDRLTREIPGAWKPNQYSNPGGPESHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDALIVVLLPDGGRGYLSKIFNDQWMASYGFLRTPLDGKTNVPTVGDVLRGKSGELPDLVHTHPSETLRDAIEILREYGVSQMPVVGAEPPVMAGEVAGSVSERDLLSAVFEGRAHLADSVEKHMSKPFPLIGSGEPVSAATKALGDTDALMVVDDGKPVGVITRHDLLGFLSSDS

SEQ ID NO: 24747 - DNA, 1303 bp, Arabidopsis thaliana
  CDS (93)..(1067)
agaacagttctctctttttgtcgacagtcttcttcttcttcttcttcttcgattggatctggaactgaactcaaattgggaagaattttgacatggaggaggaccggtgttcgatcaaggatgatgcaactcaattgataggtaacaccccaatggtatatctgaacaacattgtggatggttgtgtagctcgtattgcagctaagcttgaaatgatggagccttgctctagtgtcaaggagcgaattgcttatggtatgattaaagatgcagaagacaagggattgattactcctgggaagagcacactgattgaggctacctctggtaacaccgggattggtttagccttcatcggtgcagctaaaggttacaaagtggtcctcacaatgccctcatcaatgagccttgagagaaaaatcattcttttagcattaggtgcggaggttcacctcacagatcctagtaaaggcgttcaaggaataatcgacaaagctgaagagatatgtagcaaaactccagatagtatcatgctagaacagttcaaaaatccttcaaacccgcaaactcattatcgaaccacgggtccagagatatggagagactctgcaggggaagtagacatattggttgccggtgttggaactggtggaacgctttccggatcaggaagattcctcaaggagaagaataaagactttaaggtttatggtgtggaacctacagaaagtgcggtaataagtggaggcaaaccgggtacacatttgatccaaggtattggggctggactcatcccagacaatttggatttcaacgttcttgatgaagtcatccaagtgacaagtgtggaagcaattgaaacagccaaacttcttgccctgaaagaaggattactggtgggaatatcttctggagctgctgcagccgctgcgataaaggtggcaaagcggccagaaaacgccggcaaactcatagttgtgattttccctagcggtggggaacgttacctatcgacctcattgttcgaatcagtcagacatgaagcagagaatttgccaattcaatgaggcttttacacgacctgacttggttcgttttggtgaaaaagtacctagatttcggttcgacatttacactgtcatagtttcatgaactttaagatttcagatgatgtatgatctctaatctctagcctctaaggtggactgtcctttgacattctattggtggtttttttctagctaatatatgtgtaagtctgtaaaacttttgttgacaatgaatctagaactatataatggcc

SEQ ID NO: 24748 - protein, 324 aa, Arabidopsis thaliana
MEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKTPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 24749 - DNA, 1422 bp, Arabidopsis thaliana
  CDS (239)..(1210)
aattaaaaattttagttatgaaacaatataaccaaaaaattgccaagattgttcttgaatcttacttgtgcattgtaaatagagtctgttagcaaactttgaccattgagtattttgtgatttgtgtctagattcttgaatcttattctatggttattggacttcataaatccattttgttctttagtagttggtacccaaatattgatttttcaatagtttcagaaaacagaccaacatggaagatcggtgcttgatcaagaacgatgtcactgaattggttggtaacacaccaatggtgtatctgaacaatgttgttgatggttgcgtggctcgtatcgctgcaaagcttgagatgatggagccttgttctagcgtcaaagacagaatcgcgtatagtatgatcaaagatgcagaagaaaaaggattgattactcccggaaagagtacattgatagagccaactgctggtaacaccgggattggtttagcttgcatgggagctgcaagaggctataaagtgatccttgtgatgccttcaactatgagcttagagagaagaatcattctgagggcactaggtgcagaccttcatctctcggaccagcgcataggccttaaaggaatgttggagaaaactgaagcgattttaagcaaaactcctggtggttacattccacaacaatttgaaaatcctgcaaaccccgagattcattaccgaaccacgggaccggaaatatggagagattcagccgggaaagtagatatattggtcgctggcgtagggactggtggaactgctactggagtagggaagttcctcaaggagcagaacaaagacatcaaggtttgtgtggtggaaccagtagaaagtccggtacttagcggaggtcaaccaggtccacatttgattcagggaattggctctggtatcgtcccattcaatttggacttaaccattgttgatgaaattattcaagtggcaggtgaagaggctattgaaacagccaagcttcttgccctcaaagaaggattactggtgggaatatcctctggagccgcagcagcggctgcgttaaaggttgcaaagcggccagaaaacgcggggaaactcattgtggtggtttttcctagtggaggagaacgttatttatcgactaaactgttcgattcgattagatatgaagcagagaatttgcctattgaatgaatgttggacgtgtgccggtttcgtgtgtaataagagacgttcgttccaagagtccaagatttcaatttgcttattactggtcaatgtgaaatgtataaaaagttgcatatttgattatgaataattttagttgactacttccattgcaattcttggtcgaaaacatgaattttaataaaacagaataatctacatgaacgtttcattgactc

SEQ ID NO: 24750 - protein, 323 aa, Arabidopsis thaliana
MEDRCLIKNDVTELVGNTPMVYLNNVVDGCVARIAAKLEMMEPCSSVKDRIAYSMIKDAEEKGLITPGKSTLIEPTAGNTGIGLACMGAARGYKVILVMPSTMSLERRIILRALGADLHLSDQRIGLKGMLEKTEAILSKTPGGYIPQQFENPANPEIHYRTTGPEIWRDSAGKVDILVAGVGTGGTATGVGKFLKEQNKDIKVCVVEPVESPVLSGGQPGPHLIQGIGSGIVPFNLDLTIVDEIIQVAGEEAIETAKLLALKEGLLVGISSGAAAAAALKVAKRPENAGKLIVVVFPSGGERYLSTKLFDSIRYEAENLPIE

SEQ ID NO: 24751 - DNA, 1602 bp, Magnaporthe grisea
  CDS (1)..(1602)
atggctgccaacaccatggccgcgcggggcgcgcagagtgtcaccgagtcggccaccgatctcatcggaaacacgcccttggtgcggctcaacaagattccacagtcgctggggatcaaggctcaggtctttggcaagttggagcttatgaacacgggtggcagcgtcaaggacagaatagccttgcgcatgattgaggaggccgagaaggaaggcagaattaagcccggagacacactgattgagcccacgagtggcaacaccggtatcggcttggccctcgtcggcgccgtcaagggctacaagaccatcatcacgcttcccgagaagatgtcggccgaaaaggtctctgtcctcaaggctctcggtgccaccatcatccgaacacccacacaagccgcctgggacgctcccgaatcgcacatcggcgtggcaaaacgcctgctcaaggagatccccaactcgcacatccttgaccagtactcgaaccccaacaacccgctcgctcacgagcacggcaccgcagaggagatctgggctcagaccggcggaaagatcaccgccgtggttgcaggcgctggcacgggtggtaccatctctggactcgccaggggactgaggaaacactcaaagacggtcaaggtcatcgccgcggatcccatcggcagtattcttgccttgcctgaaagcttgaatgacaatggcgtgaacgagccgtacaaggtcgagggtatcggctacgacttcattcctgacgttctggaccgcgagttggtagacaagtggtacaagactgaagatcgcgagtcattcatgtacgctcgtcgtctgatcgctgaggagggcttgcttgtcggaggttcatcgggctccgcgatggcagccatggttcgagccgtcaaggacttgaacctgggcgaggacgacgttgtggttgtcgtcctcccggatagcatccgcagctacctctccaagtttgccgacgatgattggctggccgccaacgacctcctccttcccacacccgacagcagcgtgaacggtgacacgctcgacagccccgcagttgccgaagcccaagctctgcacaagtctcgggcgcggagggccagcaacccctacggtggagcgacggtgcggtcgttgcgccttaagcccgtgacatccgtgctggccgacagcaagtgctccgaggccattgagacgatgcgcgacaagggctttgaccagctgcctgtggtgcgcgacaacaagctcgttgggttggttacacttggaaacatgctgagctacgtttctcgcggccgcgtcaagaccaatagccctgtcagcgacgtcatgtttgactttggccgacttgacgaggttatcaccgatcctcgcgatgttgagggcgcagccaagatgtcgaccgcacatggccgcaagaagcgcaactttgtcgagatcaccatgaacactcccctcgacgtgctcagcaagttcctcgagtggaacagcgcggccatcgtcactgagaagagcggcgaagtgtccaagcctgtggctgttgtcaccaaggttgacctcctgacctggatgatgaaggagctgaaggcttag

SEQ ID NO: 24752 - protein, 533 aa, Magnaporthe grisea
MAANTMAARGAQSVTESATDLIGNTPLVRLNKIPQSLGIKAQVFGKLELMNTGGSVKDRIALRMIEEAEKEGRIKPGDTLIEPTSGNTGIGLALVGAVKGYKTIITLPEKMSAEKVSVLKALGATIIRTPTQAAWDAPESHIGVAKRLLKEIPNSHILDQYSNPNNPLAHEHGTAEEIWAQTGGKITAVVAGAGTGGTISGLARGLRKHSKTVKVIAADPIGSILALPESLNDNGVNEPYKVEGIGYDFIPDVLDRELVDKWYKTEDRESFMYARRLIAEEGLLVGGSSGSAMAAMVRAVKDLNLGEDDVVVVVLPDSIRSYLSKFADDDWLAANDLLLPTPDSSVNGDTLDSPAVAEAQALHKSRARRASNPYGGATVRSLRLKPVTSVLADSKCSEAIETMRDKGFDQLPVVRDNKLVGLVTLGNMLSYVSRGRVKTNSPVSDVMFDFGRLDEVITDPRDVEGAAKMSTAHGRKKRNFVEITMNTPLDVLSKFLEWNSAAIVTEKSGEVSKPVAVVTKVDLLTWMMKELKA

SEQ ID NO: 24753 - DNA, 960 bp, Xanthomonas campestris
  CDS (1)..(960)
atggccctgtacgacaacatcctcgacaccatcggccgcaccccggtggtcaaactcaaccgcctcgccccggaccacgtgtccctgtacgtcaaggtcgagtcgttcaacccgggcggatcggtcaaggaccggctggcgctggccatcatcctggacgccgaacaacgcggcctgctcaagcccggcgacaccatcgtggaagccacctccggcaacaccggcgtggcgctggccatggtcgctgccgcgcgtggctacaagttcgtcgccaccatggtggaaaccttctcgatcgagcgccgcaagctcatgcgcgcctacggcgccaaggtgatcctgaccccggccgccgagcgcggcagcggcatggtgcgcaaggccaaggaactggccgaacaacacggctggttcctggccagccagttcgccaaccccgccaatccggcctaccaccgcaacaccaccgccgccgagatcctgcgcgacttcgccggccaccggctggaccatttcgtcaccggctggggcaccggcggcaccctcaccggcgtgggcgaagtactgcgcgtggcccgcccggaagtgcgcatcaccgccaccgagccggccggcgctgcgctgctgcaaggccaggactggaagccgcacaagatccagggctggacgccggacttcgtgccggaggtgctcaaccgcgaggtcgcccacgaaatcctcagcgtggaagacaccgacgcgatcagcgtggctcggcggcttgccgcggaagaaggcatcttcaccggcatctccggcggcggcaccgtctccactgccctgcgggtggccgaaaccgcggtgccgggcgcggtgatccttgcgatgctgccggataccggcgagcgctacttctccacgccattgttcgccgacatcaacgaaggctcggacgacgattggctggccggcctgccctga

SEQ ID NO: 24754 - protein, 319 aa, Xanthomonas campestris
MALYDNILDTIGRTPVVKLNRLAPDHVSLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITATEPAGAALLQGQDWKPHKIQGWTPDFVPEVLNREVAHEILSVEDTDAISVARRLAAEEGIFTGISGGGTVSTALRVAETAVPGAVILAMLPDTGERYFSTPLFADINEGSDDDWLAGLP

SEQ ID NO: 24755 - DNA, 1371 bp, Xanthomonas campestris
  CDS (1)..(1371)
atggcgatccattcctccgtactcgaactgattggcaatacgccgatcgtcaaggcccagcgcctggacaccggtgtctgcgaactgttcctcaagctggaggcatccaatccgggcggctcgatcaaggaccgtatcggcttgtcgatgatcgaagcggccgagcagcgcggcgacctgaagcccggcgccaccctggtggaaggcacggccggcaacaccggtcttggcctggcgctggtcgcgcagcagaagggctaccgcctgatcctggtggtgccggacaagatgagccgcgagaagatcttcaatctcaaggcgatgggcgctgatgtggtgctgacccgctcggacgtggccaaggggcacccggagtattaccaggacctggccgccaagatcgcctcggagaccccgggcgcctacttcatcaaccagttcggcaacccggacaacccggccgcgcatgagttcggtaccgggccggaaatcctggcgcagatggatggccagctggacgcgatcgtgttcggctgcggcagctcaggcaccatgaccggcctgtcgcgcgccttcgccaccgcttcgccgcagaccgaactggtgctggcagacccggtgggctcgatcctcacccagtacatcgaagagggtacggtgagcgagaagtccggcagctggctggtcgaaggcatcggtgaggatttcctgccggatatctccgatttctcgcgggtcaagaaagcctattcgatcagcgatgcggaaagcttccacaccgcgcgcgagctgctggccaaggagggcatcctcggcggctcgtccaccggcacgctgctggccgcagcgctgaagtactgccgcgagcagaccacgcccaagcgcgtgctggtgttcgtctgcgataccggcaacaagtacctgtcgaagatgtacaacgactattggatgctggacaacggcttcctggagcgcgaacagcacggcgacctgcgtgacctgatcctgcgcccgtacaacaagcgcgacaccgtggtggtcgggccgaaagatctgctgactaccgcctaccagcgcatgaagctctacgacgtctcgcagttgccggtgatcgataatggcgagctggtcggcatcgtcgatgagagcgatgtgctgctgcatgtgtatggcgacgaagcacggttccgcgacccgatctccactgcaatggtcagcaagctcgaccgtctggacgtggcctcgccgatcgaagcgctgctgccggtgttcgatcgcggccaggtcgccatcgtcatggacggcaaccagttcctgggcctgatcacccgtatcgacctgctcaactacctgcgccgccgcgtgcagtaa

SEQ ID NO: 24756 - protein, 456 aa, Xanthomonas campestris
MAIHSSVLELIGNTPIVKAQRLDTGVCELFLKLEASNPGGSIKDRIGLSMIEAAEQRGDLKPGATLVEGTAGNTGLGLALVAQQKGYRLILVVPDKMSREKIFNLKAMGADVVLTRSDVAKGHPEYYQDLAAKIASETPGAYFINQFGNPDNPAAHEFGTGPEILAQMDGQLDAIVFGCGSSGTMTGLSRAFATASPQTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLEREQHGDLRDLILRPYNKRDTVVVGPKDLLTTAYQRMKLYDVSQLPVIDNGELVGIVDESDVLLHVYGDEARFRDPISTAMVSKLDRLDVASPIEALLPVFDRGQVAIVMDGNQFLGLITRIDLLNYLRRRVQ

SEQ ID NO: 24757 - DNA, 1371 bp, Xanthomonas axonopodis
  CDS (1)..(1371)
atggcgattcattcctccgtactcgagctgattggcaacacgccgatcgtcaaggcccagcgcctggacaccggcgtctgcgagctgttcctcaagctggaggcgaataatcccggtggatcgatcaaggaccgcatcggtctgtcgatgatcgaagcggccgagcggcgcggcgatctcaagcccggcgctaccctggtcgagggaactgccggcaacaccggcctgggcttggccctggtggcgcagcagaagggctaccagttgatcctggtggtgccggacaagatgagtcgcgagaagatcttcaatctcaaggccatgggcgccaacgtggtgctgacccgctcggatgtagccaagggccatcccgagtactaccaggacctggctgccaggatcgcagccgagactcctggcgcctacttcatcaaccagttcggcaacccggacaacccggccgcgcacgaattcggcaccggcccggaaatcctggcgcagatggacggccagctggacgccatcgtgttcggctgcggcagctccggcaccatgaccggcctgtcgcgcgccttcgccagcgcctcgccgcacaccgaactggtattggccgacccggtcggctcgatcctgacccagtacatcgaagaaggcacggtcagcgaaaagtccggcagctggttggtcgaaggcatcggcgaggatttcctcccggatatctccgacttttcgcgggtcaagaaggcctactccatcagcgacgcggaaagcttccataccgcgcgcgagctgctggccaaggagggcatcctcggcggctcgtccaccggcaccctgctggccgccgcattgaagtattgccgcgaacaaaccacgcccaagcgcgtgctggtgttcgtctgcgataccggcaacaagtacctgtcgaagatgtacaacgactactggatgctcgacaacggcttcctggagcgcccgcaacacggcgatctgcgcgacctgatcctgcgcccgtacaacaagcgcgacaccgtggtggtgggctcgaaggatctgctgactactgcctaccagcgcatgaagttgtacgacgtgtcgcagttgccggtgatcgacgacggcgaactggtgggcatcgtggacgaaagcgacgtgttgctgcatgtgtatggcgacgaagcccgcttccgcgacccgatttccacggccatggtcagcaagctggatcgtctggacgtggcttcgccgatcgaagcgctgctgccggtgttcgaccgtggccaggtcgccatcgtcatggacggcacgcaattccttggcctgatcacccgcatcgacctgctcaactacctgcgccgccgcgtgcagtga

SEQ ID NO: 24758 - protein, 456 aa, Xanthomonas axonopodis
MAIHSSVLELIGNTPIVKAQRLDTGVCELFLKLEANNPGGSIKDRIGLSMIEAAERRGDLKPGATLVEGTAGNTGLGLALVAQQKGYQLILVVPDKMSREKIFNLKAMGANVVLTRSDVAKGHPEYYQDLAARIAAETPGAYFINQFGNPDNPAAHEFGTGPEILAQMDGQLDAIVFGCGSSGTMTGLSRAFASASPHTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLERPQHGDLRDLILRPYNKRDTVVVGSKDLLTTAYQRMKLYDVSQLPVIDDGELVGIVDESDVLLHVYGDEARFRDPISTAMVSKLDRLDVASPIEALLPVFDRGQVAIVMDGTQFLGLITRIDLLNYLRRRVQ

SEQ ID NO: 24759 - DNA, 960 bp, Xanthomonas axonopodis
  CDS (1)..(960)
atggccctgtacgacaacattctcgacaccatcggccgcaccccggtggtcaagctccaacgcctcgccccggataacgtgaccttgtacgtcaaggtcgaatcgttcaatcccggcggctcggtcaaggaccggctggcgctggcgatcatcctggacgccgaacagcgcggcctgctcaagcccggcgacaccatcgtcgaagccacctccggcaacaccggcgtggcactggccatggtggccgcagcacgcggctacaagttcgtcgccaccatggtggaaaccttctccatcgaacgccgcaagctgatgcgtgcctatggcgccaaggtcatcctgacgccggctgccgagcgcggcagcggcatggtgcgcaaagcgaaggagctggccgaacagcacggctggttcctggccagccagttcgccaatccggccaacccggcctaccaccgcaacaccaccgctgccgagatcctgcgcgatttcgccggccaccggctggaccatttcgtcaccggctggggcaccggcggcaccctcaccggcgtgggcgaggtcctgagcgttgcgcgcccggaagtgcgcatcaccgcctcggagccggctggcgccgccttgctgcaaggccaggactggaaaccgcacaagatccagggctggaccccggacttcatacccgaggtgctcaaccgcgaggtcgcccatgaggtgctgagcgtggaagacaccgacgccatcaccgtggcgcggcgcctggccgccgaagaaggcatcttcaccggcatctccggcggtgccaccgtcgccaccgcgctgcgcgtggcagaaggcgcggtgcctggcgccgtcatcctggcgatgctgcccgacactggcgagcgctacttctcgaccccgctcttcgccgacatcaacgaaggctccgacgacgactggctggccgggctgccctga

SEQ ID NO: 24760 - protein, 319 aa, Xanthomonas axonopodis
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLSVARPEVRITASEPAGAALLQGQDWKPHKIQGWTPDFIPEVLNREVAHEVLSVEDTDAITVARRLAAEEGIFTGISGGATVATALRVAEGAVPGAVILAMLPDTGERYFSTPLFADINEGSDDDWLAGLP

SEQ ID NO: 24761 - DNA, 939 bp, Thermoanaerobacter tengcongensis
  CDS (1)..(939)
atgtcgggaagagaaaataaaatttatgaggatataactcagcttataggcaatacacctatgattaggttgaataaagttgttcctgaaaattcagcggaggtcatagtaaaattagagtcttttaacccaggtggaagtgttaaggacagaattgcattaaatatgataaaaagagctgaggaagaaggaagattaaaacctggtgggacaattgttgaacctaccagtggaaatacaggcattggtcttgcgatggttagtgctgtaaaagggtataagttgattcttgtaatgcctgatacgatgagtatagaacgacgaaatttacttttgtcatatggagcagagcttgttttaacacccggtgcagagggtatgaaaggagccataaaaaaggcacaagaaattttggaattaaatcctgattatataatgttagatcagtttaaaaatcctgcgaatccagaaatacatgaacttacaacggcaaaagaaatattaaaagatacaaatggaatagtagatgcatttgtagcaggtgtaggcacagggggaacaatatccggagtagggaaagttttaaagcaatataacaaagatataaaaatttttgcagtagaaccagaggaatctcctgtattgtcaggcggcaaacctggacctcataagatacaaggaataggagctggatttattcctgacacattaaatcttgacgttatcgatgaaattataaaggtaaaagagagagatgcttttgaaatgtcaatgaaacttgcaaaacaagaagggattctttgtggtatttcttcaggcgcaaatgtttttgcggcagttgaagttgcaaatcgcctcgggaaaggaaaacgagttgtaacagtactacctgatactggggaaagatatttaagtatgcacaaattttttgaatattga

SEQ ID NO: 24762 - protein, 312 aa, Thermoanaerobacter tengcongensis
MSGRENKIYEDITQLIGNTPMIRLNKVVPENSAEVIVKLESFNPGGSVKDRIALNMIKRAEEEGRLKPGGTIVEPTSGNTGIGLAMVSAVKGYKLILVMPDTMSIERRNLLLSYGAELVLTPGAEGMKGAIKKAQEILELNPDYIMLDQFKNPANPEIHELTTAKEILKDTNGIVDAFVAGVGTGGTISGVGKVLKQYNKDIKIFAVEPEESPVLSGGKPGPHKIQGIGAGFIPDTLNLDVIDEIIKVKERDAFEMSMKLAKQEGILCGISSGANVFAAVEVANRLGKGKRVVTVLPDTGERYLSMHKFFEY

SEQ ID NO: 24763 - DNA, 921 bp, Thermoanaerobacter tengcongensis
  CDS (1)..(921)
atggtggcgaacaatattcttgatttgatagggaaaacccctgtggtaaagttaaataaggtgcctgataaaaatagcgctgaagtgtacttgaaacttgagttttttaaccctgccggcagcgtcaaagacagaattgcacttgctatgatagaaaaggcagaaaaagaagggatattaaaaaaaggcagtgtgattgtggaacccaccagtggaaatacaggaatagggctggcaatggtgggggctgcaaaaggatataaagttataatagtcatgcctgacaccatgagcatggaaaggcggatgcttttggctgcttacggggcagaggtgattttgactcctggaaaactgggcatggagggagctattagaaaagcggaagagttagttaagcagaacaagaactatttcatgccccagcagtttgagaatttagcaaatcctctcattcatgaagagactactgcaaaggaaataatagaggattttaaggaaggtttagatgcttttgtagccggtataggtacaggagggactattacgggagttggtagggtccttaaaaaagtttttccagatataaagattgtgggggtagaaccttactctgccgcagttttatctggaagagaaccgggtccccacaagattcagggaattggagcaggctttatacccaaagtcttggatagagaagtgctaaatgaagtgataccagtgaaagatgaagatgcctttgaaatgactagaattttggccaaaaaagaaggtattttggcagggatttctactggtgcttctttgtgggcagcgcttaatgtagctaagaaattaggaaaagggaagaaagtccttgcgatagcgccagacagtggagaaaggtatttaagcactcagattttcagagaacattga

SEQ ID NO: 24764 - protein, 306 aa, Thermoanaerobacter tengcongensis
MVANNILDLIGKTPVVKLNKVPDKNSAEVYLKLEFFNPAGSVKDRIALAMIEKAEKEGILKKGSVIVEPTSGNTGIGLAMVGAAKGYKVIIVMPDTMSMERRMLLAAYGAEVILTPGKLGMEGAIRKAEELVKQNKNYFMPQQFENLANPLIHEETTAKEIIEDFKEGLDAFVAGIGTGGTITGVGRVLKKVFPDIKIVGVEPYSAAVLSGREPGPHKIQGIGAGFIPKVLDREVLNEVIPVKDEDAFEMTRILAKKEGILAGISTGASLWAALNVAKKLGKGKKVLAIAPDSGERYLSTQIFREH

SEQ ID NO: 24765 - DNA, 951 bp, Fusobacterium nucleatum
  CDS (1)..(951)
atgagaataaagtttgataggaggatttttatgttagcaaattctgtaattgatttaattgggaacactccattggtaaagattaataatattgatacttttggaaatgaaatttatgtaaaattggaaggttcaaatcctggtagaagtacaaaagacagaattgccttaaaaatgattgaggaagctgaaaaggaaggtttaattgataaagatactgttattatagaagctacaagcggaaacactggaattggacttgctatgatatgtgcagttaaaaactataaattaaaaattgttatgcctgatactatgagtatagaaagaatacagcttatgagagcttatggaactgaggttatattaactgatggttctcttggaatgaaagcctgtttagaaaaattagaagaacttaaaaagaatgaaaaaaaatattttgttcctaaccaattcactaatgtgaataatccaaaagcccactatgaaactactgctgaagaaattttaaaagatttaaataacaaagtggatgtatttatttgtggaacagggacaggaggtagtttttctggaactgctaaaaagctaaaagaaaaattgcctaatataaaaactttccctgttgaacctgcttcatctccattgctttcaaaaggttatataggtcctcataaaattcaaggtatgggaatgagtataggtggtattccagcagtttatgatggaagtttagcagatgatattttagtttgtgaagatgatgatgcttttgaaatgatgagagaattaagttttaaagaaggtattttaggtggaatttctactggtgctacttttaaagcggctcttgactattcaaaagaaaatgctgataaaggtttgaaaatagttgtcctttctactgactcaggtgaaaaatatttatctaatatttgtgatttataa

SEQ ID NO: 24766 - protein, 316 aa, Fusobacterium nucleatum
MRIKFDRRIFMLANSVIDLIGNTPLVKINNIDTFGNEIYVKLEGSNPGRSTKDRIALKMIEEAEKEGLIDKDTVIIEATSGNTGIGLAMICAVKNYKLKIVMPDTMSIERIQLMRAYGTEVILTDGSLGMKACLEKLEELKKNEKKYFVPNQFTNVNNPKAHYETTAEEILKDLNNKVDVFICGTGTGGSFSGTAKKLKEKLPNIKTFPVEPASSPLLSKGYIGPHKIQGMGMSIGGIPAVYDGSLADDILVCEDDDAFEMMRELSFKEGILGGISTGATFKAALDYSKENADKGLKIVVLSTDSGEKYLSNICDL

SEQ ID NO: 24767 - DNA, 927 bp, Methanosarcina acetivorans
  CDS (1)..(927)
atgggtcaaatctattcagacataacatggacaatcggaaacacaccgcttgtccgtttaaaccacatcacgaagggtcttcatacggatgtgctggttaaggtagagtcctttaacccgatggggagtgtaaaggacagaatcggactggcaatgcttgaggaagccgaacgtgagggaaaaatcaaagaaggcaccacaattgttgaagccacaagcgggaacaccggaatagcccttgcaggagtgtgtgctgcccgtggctataaactcatccttgttatgcctgagacgatgagcatagaacgaagaaagctgctgaaagctctgggcgcagaactcgtcctgaccccgggccccgaagggatgaaaggggcagtcaataaagcggaacagatggcttcagcagaccccactctttactatatgccccagcaatttcagaaccctgcaaaccctgaggcccaccgcaggacaactgccgaggagatctggagagatacggatgggaaagcggatgttctcgtagcaggcgtggggaccggagggacaatcacaggtattgccggagtcctcaagaaaaggaaaaccggtttcagggctattgcagtcgaacctaccgaatctcccgtactcagcggcggaagcccgggcccacacaggatccagggaataggtgcaggttttatcccggatgtccttcagcttggtcttgttgatgaaattatcaaagtatctgcagatgaagctatttccacgggaagaaggctggcaagggaagaaggcattcttgcaggcatatcttcaggagcggctacatgcgcagccctgcaggtagcatccaggaaagagatgagcggaaagacaattgttgtcatcctgccggataccggagagcgttatctgagcaccgatctgtttagctga

SEQ ID NO: 24768 - protein, 308 aa, Methanosarcina acetivorans
MGQIYSDITWTIGNTPLVRLNHITKGLHTDVLVKVESFNPMGSVKDRIGLAMLEEAEREGKIKEGTTIVEATSGNTGIALAGVCAARGYKLILVMPETMSIERRKLLKALGAELVLTPGPEGMKGAVNKAEQMASADPTLYYMPQQFQNPANPEAHRRTTAEEIWRDTDGKADVLVAGVGTGGTITGIAGVLKKRKTGFRAIAVEPTESPVLSGGSPGPHRIQGIGAGFIPDVLQLGLVDEIIKVSADEAISTGRRLAREEGILAGISSGAATCAALQVASRKEMSGKTIVVILPDTGERYLSTDLFS

SEQ ID NO: 24769 - DNA, 1267 bp, Glycine max
  CDS (82)..(1059)
ccacgcgtccggccgatgtgcttgtcttagtgtgtcagtcattcctgttcctcaagtcaagctttgtagtgagcagatataatggctgttgaaaggtccggaattgccaaagatgttacggaattgattggtaaaaccccattagtatatctaaataaacttgcggatggttgtgttgcccgggttgctgctaaactggagttgatggagccatgctctagtgtgaaggacaggattgggtatagtatgattgctgatgcagaagagaagggacttatcacacctggaaagagtgtcctcattgagccaacaagtggtaatactggcattggattagccttcatggcagcagccaggggttacaagctcataattacaatgcctgcttctatgagtcttgagagaagaatcattctattagcttttggagctgagttggttttgacagatcctgctaagggaatgaaaggtgctgttcagaaggctgaagagatattggctaagacgcccaatgcctacatacttcaacaatttgaaaaccctgccaatcccaaggttcattatgaaaccactggtccagagatatggaaaggctccgatgggaaaattgatgcatttgtttctgggataggcactggtggtacaataacaggtgctggaaaatatcttaaagagcagaatccgaatataaagctgattggtgtggaaccagttgaaagtccagtgctctcaggaggaaagcctggtccacacaagattcaagggattggtgctggttttatccctggtgtcttggaagtcaatcttcttgatgaagttattcaaatatcaagtgatgaagcaatagaaactgcaaagcttcttgcgcttaaagaaggcctatttgtgggaatatcttccggagctgcagctgctgctgcttttcagattgcaaaaagaccagaaaatgccgggaagcttattgttgccgtttttcccagcttcggggagaggtacctgtcctccgtgctatttgagtcagtgagacgcgaagctgaaagcatgacttttgagccctgaattcccgtttaaggctctcactactgaattttcttgttacttgtaccaggctttaactagattgttagagtactactgtttgtgactctgactctaaaataaaacttgctccaaaagactagtttttcttgatgcccctggagcgataattttgtgcctgcaacattaaaaagtattcaaagttgcttataaaaaaaaaaaaaaaagg

SEQ ID NO: 24770 - protein, 325 aa, Glycine max
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKIDAFVSGIGTGGTITGAGKYLKEQNPNIKLIGVEPVESPVLSGGKPGPHKIQGIGAGFIPGVLEVNLLDEVIQISSDEAIETAKLLALKEGLFVGISSGAAAAAAFQIAKRPENAGKLIVAVFPSFGERYLSSVLFESVRREAESMTFEP

SEQ ID NO: 24771 - DNA, 903 bp, Clostridium perfringens
  CDS (1)..(903)
atggtttttaacagtcttttaagtttaataggaaacacaccaatattaaaagcaaataatttatttgaagggaataatgtatttgttaagcttgaaaaatttaatccaggaggaagtataaaagatagagcagctttaggaatgatagaagaagctgaaaaaaatggattattaaaagaaaatggagttatagtagaaccaactagtggaaatacaggaattgccatagctatgattggtaaaattaaagggtataaagttattataactatgccagagacaatgagtaaagaaagaagagatatgatcaaagcttatggtgcagagataattttaactgaaggaagcaaaggaatgaagggagctattgaagaagcagagaggttagctagtacaaagggatatttcatgcctcaacagtttttaaatgaagctaatgctaaaaaacattatgaaactactgcggaagaaataataagagatattccagacttagatgtatttattgcaggggtaggaactggaggaactattacaggagtaggaagaaaattaaaggaatataatcctaatataaaaatagttgctgtagaacctagtgattcagctgtattatcaggagaaaattctggtcctcataaaattcaaggaataggtgctggattcataccaaagatatatgactcatcagtagttgatgaaataataaaggttaaaaatgaagatgcatacactatggcaaaaaactttgctgataaagaaggagttttagtaggtatatcttctggagctgcactaaaaggggcaaaggatattttagaaaatatagcaaaagataaaaaagtgttagttatagcacctgatggaggagaaaaatatttttcaacagggctatatgagtaa

SEQ ID NO: 24772 - protein, 300 aa, Clostridium perfringens
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTKGYFMPQQFLNEANAKKHYETTAEEIIRDIPDLDVFIAGVGTGGTITGVGRKLKEYNPNIKIVAVEPSDSAVLSGENSGPHKIQGIGAGFIPKIYDSSVVDEIIKVKNEDAYTMAKNFADKEGVLVGISSGAALKGAKDILENIAKDKKVLVIAPDGGEKYFSTGLYE

SEQ ID NO: 24773 - DNA, 975 bp, Ralstonia solanacearum
  CDS (1)..(975)
atggccatacgggacgggttttccggcagcatcggcaatacgccgctgatccggctggcgaggctgagcgaggaaaccggctgcgagatcctcggcaaggccgaattcctgaacccgggcggatcggtcaaggaccgcgcggccctctatatcatccgggacgccgagcggcgcggcacgctcagggccggcggcacggtggtcgagggcaccgccggcaacacgggcatcgggctggcccatctctgcgcggcgcgcggctaccgctgcgtgatcgtcatccccgagacacaatcgcccgaaaaaatggacctgctgcgcgcgctcggcgccgaagtgcgcccggtgccggccgtaccgtacaaagaccccaacaactaccagaagatcgccggccgcctcgcgcaagaaaccgccaacgcgatctgggccaaccagttcgacaacctcgtcaaccggcaggcccactacgaaaccaccggcccggaaatctggcgcgacaccgccggccgcgtggatgccttcgtctgcgcgaccggcaccggcggcacgctggcgggcgtcgcccgctacctcaaggaacagaacccggccgtgcggaccgtgctggccgatccgcacggcagcggcctgtacagcttcgtgaagaccggcagcatccaggccgaaggcagctccatcaccgagggcatcggctccacccgcgtcaccgccaacctcgaaggcacgcccatcgacgacgccgtgcgcatcgatgaccagacctgcgtcacgatggtctaccggctgctgcgggaagaaggcctgttcgtgggcggctcgaccggcatcaacgtcgccgcggcggtgcagctggcgcgcgaactggggccgggtcataccatcgtcacgctgctgtgcgatcggggcaatctgtactttgcgcggttgttcaatggggcgtggctggcgcagaaggggttggtggcgggatga

SEQ ID NO: 24774 - protein, 324 aa, Ralstonia solanacearum
MAIRDGFSGSIGNTPLIRLARLSEETGCEILGKAEFLNPGGSVKDRAALYIIRDAERRGTLRAGGTVVEGTAGNTGIGLAHLCAARGYRCVIVIPETQSPEKMDLLRALGAEVRPVPAVPYKDPNNYQKIAGRLAQETANAIWANQFDNLVNRQAHYETTGPEIWRDTAGRVDAFVCATGTGGTLAGVARYLKEQNPAVRTVLADPHGSGLYSFVKTGSIQAEGSSITEGIGSTRVTANLEGTPIDDAVRIDDQTCVTMVYRLLREEGLFVGGSTGINVAAAVQLARELGPGHTIVTLLCDRGNLYFARLFNGAWLAQKGLVAG

SEQ ID NO: 24775 - DNA, 903 bp, Ralstonia solanacearum
  CDS (1)..(903)
atggcttatcccaccatcgaagacaccatcggcaatacgccgctggtcaggctccagcgcattcccggcgaggacaacgcgcgacgcggcaacgtgatcctcggcaagctcgagggcaacaatccggccggctcggtcaaggatcgtccggcgctttcgatgatcaagcatgccgagacgcgcggccgcatcaagccgggcgacacgctgatcgaagccacctcgggcaataccggtatcgcgctggcgatggctgctgccatccgcggttacaagatggtactgatcatgccggaggacttgtcggtcgagcgccgccagagcatggcggcgtacggcgcggagatcgtcctgacgccggtcaagggcggcatggagtacgcccgcgatctggccgacgcgatggagcgggacggcaagggcgtcatcctcgaccagttcgccaatcctgacaatccgctggcgcactatgaaggcaccggcccggaaatctggcgcgacaccgaagggcgcattacccatttcgtctcggcgatgggcacgaccggcaccatcaccggcgtctcgcggttcctgaaggagaagaatcccgccatccagatcgtcggcgcgcagccggcggaaggctcgcgcattcccggcatccgcaagtggccggaggcgtatatgccgaagatctacgatcccaagcacatcgatcgtaccgagtcggtctcgcagtccgatgccgagcacatggcgcgtcgcatggcgcgcgaggaagggatcttctgcggcatctcggcggcgggcgcgctgtgcgtggcgctgcgggtggcggaggcggtcgagaacgcgaccatcgtctttgtcgtttgcgaccggggcgaccgctacctgtccaccggcgtgtttccggcctga

SEQ ID NO: 24776 - protein, 300 aa, Ralstonia solanacearum
MAYPTIEDTIGNTPLVRLQRIPGEDNARRGNVILGKLEGNNPAGSVKDRPALSMIKHAETRGRIKPGDTLIEATSGNTGIALAMAAAIRGYKMVLIMPEDLSVERRQSMAAYGAEIVLTPVKGGMEYARDLADAMERDGKGVILDQFANPDNPLAHYEGTGPEIWRDTEGRITHFVSAMGTTGTITGVSRFLKEKNPAIQIVGAQPAEGSRIPGIRKWPEAYMPKIYDPKHIDRTESVSQSDAEHMARRMAREEGIFCGISAAGALCVALRVAEAVENATIVFVVCDRGDRYLSTGVFPA

SEQ ID NO: 24777 - DNA, 2433 bp, Mus musculus
  CDS (187)..(1872)
gtccgagcgtgctctccatcctagcacaggccgagccgttttcccgcgtccgagtctagcagctggaacctgctccttttctcccatccttgctgagtttgtttgagtggagccaacactcccagaggggactcaagagccaacgacttaacacgacaggtcttcgctccctctgaaaatcccagcatgccttcagggacatcccagtgtgaagatggctctgctgggggcttccagcacttggacatgcactcagaaaagagacaactggagaagggcccctcaggggacaaggatcgagtctggatccggcctgataccccaagcagatgtacctggcagctgggcagggccatggcggactccccacattatcacacagtgctgaccaaatcccccaaaattttaccagatattctgaggaaaattgggaacacccctatggtcagaatcaacaagatctcaaagaatgccggtctcaagtgtgagctcttggccaagtgtgagttcttcaatgcgggtgggagtgtgaaggaccgcatcagccttcggatgatcgaagatgctgagcgagctggaaacttgaagcctggagacactatcattgagccaacttctggcaacacagggatcgggctggctctggctgctgcagtgaagggctatcgctgcattatcgtgatgccggagaagatgagtatggagaaggtggatgtgctgcgggctctgggagccgagattgtgaggacgcccaccaatgccagatttgattcccccgagtcccacgtgggagtggcatggcgactgaagaacgaaatccctaattctcacattctggaccagtaccgcaatgccagcaaccctttggcacactacgatgacaccgccgaggagatcctgcagcagtgtgacgggaagctggatatgctggtggcttcagcaggcacgggtggcaccatcacagggatcgccagaaagctgaaggagaagtgccctggctgtaaaatcatcggtgtcgatcctgaaggctccatccttgcggagcccgaggagctgaaccagacggagcaaacagcctatgaggtggaagggattggctacgacttcatcccgacagtcctggacagggcggtggtggataagtggttcaagagcaacgatgaagattccttcgcctttgcccgcatgctcatcgcacaggaaggactgctatgtggtggaagctctggcagcgccatggctgtggctgtgaaggctgcccgggagctgcaggaagggcagcgctgtgtggtcatcctgcctgactctgtgcggaactacatgtccaagttcctgagtgacaaatggatgctgcagaaaggtttcatgaaagaggagctctcagtgaagaggccctggtggtggcgtctgcgtgttcaagagctgagcctgtcggccccgctgaccgtgttgcccacggtcacctgtgaggacaccatcgccatcctccgggagaagggttttgaccaggcacctgtggtcaacgagtctggggccatcctagggatggtgaccctcgggaacatgctgtcatccctgctggctggaaaggtgcggccatcagacgaagtctgcaaagtcctctacaagcagttcaaaccgatccacctgaccgacacgctgggcacactctctcacatcctggagatggaccacttcgccctggtggtccacgagcagatccaatcacgagaccaggcctggtcaggagtggtgggggggcccacagactgcagcaatggcatgtccagcaagcagcagatggtgtttggggttgtcactgccattgacctgctaaacttcgtggcagcccgtgagcagacccagacatagagccaggactggcttccatcctccttgctggggcttcttggctttcagagacacctaccagcttcctcacccaagtccagcaggtggctgctgaggccagcaccctcccctcctaacacccagctacctaaatgaatcctctatgcccgagtagcttacagggcctttcctctggtgtcacagaactgaggaatgttagccaggaaggatgggcacagactacaatagcaacaagactcagggtgcccaaaaaaagcgtcctccccacagagggctccatcgtgggaaagggcaaaccttggactgattgtgtggacatcctcagggacctggttagccctagcatgggagtgtgtaggttttaaatgaaggtgggcttctgtgacctgagacccacagctgtgaagtgcctgcacaaagtgtcaccacctgggccatgaccctgcttagcccactcctcacgtcccactccttccctgacaagcacccactttctgtctcaatggatctccctgttctggactcttcctataaatggaatcacataaaaaaaaaaaaaaa

SEQ ID NO: 24778 - protein, 561 aa, Mus musculus
MPSGTSQCEDGSAGGFQHLDMHSEKRQLEKGPSGDKDRVWIRPDTPSRCTWQLGRAMADSPHYHTVLTKSPKILPDILRKIGNTPMVRINKISKNAGLKCELLAKCEFFNAGGSVKDRISLRMIEDAERAGNLKPGDTIIEPTSGNTGIGLALAAAVKGYRCIIVMPEKMSMEKVDVLRALGAEIVRTPTNARFDSPESHVGVAWRLKNEIPNSHILDQYRNASNPLAHYDDTAEEILQQCDGKLDMLVASAGTGGTITGIARKLKEKCPGCKIIGVDPEGSILAEPEELNQTEQTAYEVEGIGYDFIPTVLDRAVVDKWFKSNDEDSFAFARMLIAQEGLLCGGSSGSAMAVAVKAARELQEGQRCVVILPDSVRNYMSKFLSDKWMLQKGFMKEELSVKRPWWWRLRVQELSLSAPLTVLPTVTCEDTIAILREKGFDQAPVVNESGAILGMVTLGNMLSSLLAGKVRPSDEVCKVLYKQFKPIHLTDTLGTLSHILEMDHFALVVHEQIQSRDQAWSGVVGGPTDCSNGMSSKQQMVFGVVTAIDLLNFVAAREQTQT

SEQ ID NO: 24779 - DNA, 969 bp, Rhizobium meliloti
  CDS (1)..(969)
atgcctgaagcgcgcaagcccggccgcggccgcgtcttttcctcgatcaccgagacgatcggcgacactcccatcgtgcggctggacaagctcgccaaggaaaagggcgtgaaggcgaacctgctcgccaagctcgaattcttcaacccgatcggctccgtcaaggaccgcatcggcgtcgcgatgatcgaatcgctcgaggcgcaagggaagatcacgcccggccgcacgacgctggtcgagccgacttcgggcaatacgggcatagcactcgccttcgtcgcggccgccaagggctacaggctgatcctcaccatgcccgagacgatgtcggtcgaacgccgcaagatgctgacgcttctcggtgccgaactggtgctgacggaaggcgccaagggcatgaagggcgcaatcgccaaggcccaggaactcaccgagacgctgcccgacgcgatcattccgcagcagttcgagaacccggccaatccggaaatccaccgcacgacgaccgccgaggagatctggaacgacacggaaggcgcagtcgacatcctcgtgtccggcatcggcaccggcggcaccatcaccggtgccggccaggtgctcaaggcccgtaagccatcggtcagggtgatcgccgtcgagcccgaagaatcccctatcctttccggcggcgccccgggtccgcacaagatccagggtatcggcgcgggtttcgcaccagcgatcctcgacacgagcgtctatgacgaagtcgtcacggtaaatgcgggcgaggccatagaggcggcgcggctcgtcgccagactcgaaggcgtgccggtcggcatttccgccggtgccgcgctccaggcggcgatagaggtgggacagcgcgaggaaaacgccggcaggaatatcgtcgtgatcattccgtcctttgccgaacggtatctttcgacggtgctgttcgagggattgggagcctag

SEQ ID NO: 24780 - protein, 322 aa, Rhizobium meliloti
MPEARKPGRGRVFSSITETIGDTPIVRLDKLAKEKGVKANLLAKLEFFNPIGSVKDRIGVAMIESLEAQGKITPGRTTLVEPTSGNTGIALAFVAAAKGYRLILTMPETMSVERRKMLTLLGAELVLTEGAKGMKGAIAKAQELTETLPDAIIPQQFENPANPEIHRTTTAEEIWNDTEGAVDILVSGIGTGGTITGAGQVLKARKPSVRVIAVEPEESPILSGGAPGPHKIQGIGAGFAPAILDTSVYDEVVTVNAGEAIEAARLVARLEGVPVGISAGAALQAAIEVGQREENAGRNIVVIIPSFAERYLSTVLFEGLGA

SEQ ID NO: 24781 - DNA, 1601 bp, Pichia pastoris
  CDS (14)..(1519)
agaaatacatactatgtcagacaacaaccaacctttgccaccggtttccaactccattctggagcacattggaaagactccacttgttaaacttaacagaatacccaaaattcttaatttgaaaccacaggtttatgctaaagttgaactgttcaactcaggtggttccatcaaggaccgtattgctctgagaatggttgagcaagctgagaaagagggtagaatcaagccagggtacacgctaattgagccaacgtcaggtaacactggtattggtctggcattagtaggtgcagtcaagggctacagaactattatcactcttccagagaaaatgtctaatgaaaaagttgctgtgctgaaagctctcggggctgaaattataagaactccaaccgaggctgcttgggattccccagagtctcacattggtgttgcaagaaggttggagaaagaaattccaaatgctgtaatcttagaccagtatggtaatgttaacaatccagatgcccatttctacaccactggtgcggaaatctgggatcagactaatggtaaagttacccacggtgttgctggtgcaggaactggaggtacgattacaggtattgccaaatttttgaagtctaaaaaccctaatattcaaattatcggtgctgatcctcatggttccattctagctcttcctgaatcattgaacactagtaatgagcaatacaaagttgaaggtattgggtatgactttatcccagaagttttggatagagaaattgtggacacttggtacaaaacagatgataaggatttcttcaagctggccaggcaattgatttctgaagaaggaattctagttggaggatcttccggctctgcgctttctgctgctgttaaaataatcaatgatgccaagcttgatgaaagtgctgtagttgttgtcgtttgtccagacagtatcagatcttatctaaccaagttcgctgatgatgactggatgaaactcaatggattcactgaagacgagcctgcacctctcaaaaggaagtccagcttttcaaaggacactctgtcgtcctatacgatcaaagatttggcgctcaaacctgtggtctctgtcaccattgacgattcaattgaatccacaattaatatccttcaaaccaagggttttgatcagttaccagtgttgaagaacgataagcttgctggtattgtcactctgtctcaattgttacgattactttctaataagaagattcatcttacttccaaggtagaatctgcctactttgatttttccaagcttgaaaactttgaaaaatcttacaacattaacaaggagtcaacaaacaagagaagagaataccagaagatcactactagcaccacgctggccaaattgaacaagttttttgagaccagttcagctgctatagtagaaaatgataagggtcaaccgatccacatcgtttccaaggttgatctgctttctttcttagcctccaaaggagagtttaattaatatgtaaactatgcagaattttagaaaagatatttccgtgcctgcgtaccatctaggcatacactatctaaaaaaaaaaaaa

SEQ ID NO: 24782 - protein, 501 aa, Pichia pastoris
MSDNNQPLPPVSNSILEHIGKTPLVKLNRIPKILNLKPQVYAKVELFNSGGSIKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQLPVLKNDKLAGIVTLSQLLRLLSNKKIHLTSKVESAYFDFSKLENFEKSYNINKESTNKRREYQKITTSTTLAKLNKFFETSSAAIVENDKGQPIHIVSKVDLLSFLASKGEFN

SEQ ID NO: 24783 - DNA, 1089 bp, Rhizobium loti
  CDS (1)..(1089)
atgttgaatcgacagaaaatcaggaccaccgccgggcgcggccgcctgttcgacagcattctcgacaccgtcggcgacacgccggtgatccgcgtcaacaatctcgggccggcccatgcgacggtctacgtcaaggccgagttcttcaaccccgccgcctcggtcaaggaccggctggcgctcaacatcatcgaggagggcgagcgcagcggtgcgttgaagcccggccagacggtggtcgaggccaccagtggcaacaccggcattgggctggccatggtctgcgcgcaaaagggctatccgctggtcgtcaccatggccgacagcttttccgtcgagcgccgcaagctgatgcgcatgctgggcgccaaggtggtgctgacgccgcgcgccgaaaagggttttggcatgtacaagaaggcggtggagctggccgaggccaatggctggttcctcgcccgccagttcgagaccgccgccaacgccgccatccacgaggcgaccacggcgcgcgagatcatcaatgatttcgccggctcgcggctcgactgcttcgtcaccggctacggcaccggcggcaccgtcgtcggcgtggcgcgtgtgctgcgccgcgagcggccggacacccgcatcgtgctctccgaaccggccaatgcgcagctcattggcagcggcaaggcacagcagcgcggtgcccatggcgcccctgccgccagccatccggccttcgagccgcatccgatccagggctggacgccggacttcatccccaatgtgctgcaagaggcgatcgacgccagcctctatgacgaggtgatgccgattgccgggcccgaaggcatcaaatgggccaaggcactggctcagaaggagggcatctttaccggaatttccggcggcgccaccttcgccgtggcacggcaggtcgcggaaaaggcgccggccggatcggtgatcctgtgcatgctgcccgacaccggcgagcgctacatgtcgacgccgctgttcgacggcatcgaggccgagatggatgccgaggagatggcgctgtcgcgctcgacgcccggcggccagttcccggcggcttga

SEQ ID NO: 24784 - protein, 362 aa, Rhizobium loti
MLNRQKIRTTAGRGRLFDSILDTVGDTPVIRVNNLGPAHATVYVKAEFFNPAASVKDRLALNIIEEGERSGALKPGQTVVEATSGNTGIGLAMVCAQKGYPLVVTMADSFSVERRKLMRMLGAKVVLTPRAEKGFGMYKKAVELAEANGWFLARQFETAANAAIHEATTAREIINDFAGSRLDCFVTGYGTGGTVVGVARVLRRERPDTRIVLSEPANAQLIGSGKAQQRGAHGAPAASHPAFEPHPIQGWTPDFIPNVLQEAIDASLYDEVMPIAGPEGIKWAKALAQKEGIFTGISGGATFAVARQVAEKAPAGSVILCMLPDTGERYMSTPLFDGIEAEMDAEEMALSRSTPGGQFPAA

SEQ ID NO: 24785 - DNA, 1440 bp, Rhizobium loti
  CDS (1)..(1440)
atgagcgagcacggaaaagctgcgccaggcagcgccccctcggatggccaatctgcgcgcctgcggccaccttataaatcggttctcgacctgatcggccagacgccggtggtcgagctgaccaagttcgacaccggcaaatgccggctgttcatcaagctcgaaagccagaacccgggcggctcgatcaaggaccgcatcgcgctgtcgatgatcgcggcggccgagagagagggcaagctcaagcgcggcggcaccatcgtcgaggcgaccgccggcaataccggcctcggccttgcccaggtcggcatccccaagggctaccgcatcgtgctggtggtgcccgacaagatgtcgcgcgagaagatccagcatctgcgcgcgctgggcgccgaggtgcgcatgacgcgctccgatgtcggcaagggccacccggaatattaccaggacatggccgagaagatcgccgccgaagtgcccggcgccttctatgccaaccagttcgccaatccggccaacccgctggcgcatgagacgacgaccggcccggaaatcttttcgcagctcgacggcaatgtcgacgcggtggtcgtcggcgtcggctcgggcggcacgctgaccgggcttggccgctatttttcgaaagtctcgcccaagaccgaaatggtgctggccgatccggtcggctcggtgctggcgccgctgatcaagaccggcaagatggaagaggccggcagctggacggtggaaggcatcggcgaggatttcgtgccgcccaatgccgatctgtcgctggtcaagaaggcctattcgatatcagacaagcaaagcatgctggcggtgcgtgatctgctgtcacgcgaaggcattctggctggttcgtcctcgggcacgcttttatcggccgccttgcgctattgccgcgagcagacgacgccgaagcgcgtcgtcaccttcgtctgcgacagcggcaacaagtacctgtccaaggtcttcgacgatttctggctggccgaacagggcctggccgaacacgagcagcatggcgatctgcgcgacctcgtgatgcgctcgcaccgcaccggcgacacggtctatgtcggccccgacgaaagcctgctcaacgcctacggccgcatgcgccgttccgatgtctcgcagctgccggttctggaagatggcaagctgatcggcatcgtcgacgagagcgatattctggccaaggtcgacggaccctatgacggccgctgggagcgcttcaacggtccggtgcgcacggcgatgacctccaatctgcacacgctgcaggccagccagacgctggatgcactgttgccggtgttcgaccgcaacgaggtcgccatcatcttcgacggcgacgagttcgtcggcctgatcacccggatcgacctgatcaaccatttgaggcgcgcacgatga

SEQ ID NO: 24786 - protein, 479 aa, Rhizobium loti
MSEHGKAAPGSAPSDGQSARLRPPYKSVLDLIGQTPVVELTKFDTGKCRLFIKLESQNPGGSIKDRIALSMIAAAEREGKLKRGGTIVEATAGNTGLGLAQVGIPKGYRIVLVVPDKMSREKIQHLRALGAEVRMTRSDVGKGHPEYYQDMAEKIAAEVPGAFYANQFANPANPLAHETTTGPEIFSQLDGNVDAVVVGVGSGGTLTGLGRYFSKVSPKTEMVLADPVGSVLAPLIKTGKMEEAGSWTVEGIGEDFVPPNADLSLVKKAYSISDKQSMLAVRDLLSREGILAGSSSGTLLSAALRYCREQTTPKRVVTFVCDSGNKYLSKVFDDFWLAEQGLAEHEQHGDLRDLVMRSHRTGDTVYVGPDESLLNAYGRMRRSDVSQLPVLEDGKLIGIVDESDILAKVDGPYDGRWERFNGPVRTAMTSNLHTLQASQTLDALLPVFDRNEVAIIFDGDEFVGLITRIDLINHLRRAR

SEQ ID NO: 24787 - DNA, 1035 bp, Rhizobium loti
  CDS (1)..(1035)
atgccccgttctgtgatcgacgcgatcggcaacacgcctctgatccgccttaacaaagcgtccgaagaaaccggctgcgagatcctgggcaaggccgaattcatgaatccggggcaatcagtcaaggatcgcgccgggcttttcatcatccgcgacgccgaacggcgcggcctattgaagccgggcggcgtcatcgtcgagggaacggcaggcaatacgggcatcgggctgacgctggtcgccaaggcgctgggttatcgcacggtcatcgtcattcccgatacgcagagccaggaaaagaaggacacgatccggctactcggcgccgagctgatcgaggtgccggccgtgccctacaagaaccccaacaattacgtgaaactgtcgggacggctggccgagcagatggcgaggaccgagtccaacggcgccatctgggccaatcagttcgacaatgtcgccaaccgcgatgggcatatccgcaccacggcggaggaaatctgggcacagaccggcggcaaggttgacggtttcgtctcggcggtgggttcaggcggcacgctggccggcgtcgctttcgggctgaaggccaagagcaaggatgtgaaaatcgcgctcgccgacccgcttggtgccgccctctacagcttttacaccagcggcgagttgaagtccgaaggcagctcgatcaccgaaggcatcgggcaggggcgcatcaccgccaatctagaagggttcacgccggatttctcgttccagatcaaggacgaggacgcgcttccgatcgtcttcgacctgatccaggaagagggcctgtgcgtcggcggctcgaccggcatcaacattgccggcgccatccggctcgccagggaattaggccccggccacaccatcgtgaccattctttgcgactacggcacgcgctaccagtcgaagctgttcaatccggaattcctgcgcgagaagaatctcccggtgccggggtggatggaactgcagagcaagatttcggtgcctttcgaaaaggtcgaatga

SEQ ID NO: 24788 - protein, 344 aa, Rhizobium loti
MPRSVIDAIGNTPLIRLNKASEETGCEILGKAEFMNPGQSVKDRAGLFIIRDAERRGLLKPGGVIVEGTAGNTGIGLTLVAKALGYRTVIVIPDTQSQEKKDTIRLLGAELIEVPAVPYKNPNNYVKLSGRLAEQMARTESNGAIWANQFDNVANRDGHIRTTAEEIWAQTGGKVDGFVSAVGSGGTLAGVAFGLKAKSKDVKIALADPLGAALYSFYTSGELKSEGSSITEGIGQGRITANLEGFTPDFSFQIKDEDALPIVFDLIQEEGLCVGGSTGINIAGAIRLARELGPGHTIVTILCDYGTRYQSKLFNPEFLREKNLPVPGWMELQSKISVPFEKVE

SEQ ID NO: 24789 - DNA, 1370 bp, Trypanosoma cruzi
  CDS (15)..(1169)
aagacgtccaaaccatggctcaaaacccctcagcagtaaacaacaaaaaggaagtgcccgacaggcgaacatgcattcttgacaccgtcctcgacgccatcggctccaccccctgcatccgactcaatcacgtgccgaagaaacacggcgtgtgctgcgatgtggttgcaaagtgtgaattcctcaaccccggtggcagcgtcaaggaccgcattgctcggcaaatgattctggacgcggaggcgagtggccgactgcgccccaatcaaacaattattgaggcgacaagtgggaacacgggcatcgggctcagtctggtggctgcggtgaagaaataccccatgatcatcaccatgcccaaaaagatgtcacatgagaaggaggtgaccctccaggccctgggagcagaggtgattcgaacggagaccgcattgccatgggatcacccggatagtctcattggcatggctcggcgtctggagaaggagaagggctacgtgttgctggaccagtaccggaacccaagcaatccgaaggcgcactacgaaggcactgctcaggagatttacgatcagtgcggtggaaaggttgacatggcggtgttcaccactgggacgggcggcacaatggccggagtggcaaaacgattaaaggaattgctgcccaacattgtcattgtcggcgtcgatccgtacgggagcattttggccgatccctcggtaccgctggatccgaagccgtacctcgttgagggcatcgggtacgattttgtgccagatgtctgcgaacggaagtacgttgatcggtgggtgaagtccgctgacaaggaaagctttgcgctggcgtcggaggttcaccgcgaagaggcgctcctcgtcggagggagcagtggtgccgccatgtggggtgtgctgcaggcagcgaaagatcttcgtcctgaccagcggtgcgttgtggtattcccggatggcatccgcaactacatgacaaagttcccggacaagaattggctggtggagaacggcctggaggagggcgaagtgacacgcccaacctacgggtcgctggaggcgcagctggaagaggcaaagaaaaaactgtcggagtatgaggcgaaatgcggcggcagcgtggaggagggtaaacgttgctgtgaaaaagcaaagtaatatatgaatacatacatacatatatataaataaaacataaacatacataacggggcaaaacgaggtaacttttgaataaattctgggatcagggcgaatgcaaggcaacgataattgcatgggtacggcagcattgttagggagggaagtggagtgtttggggggcactgcgggcgagcgaagacaagagcaaaaaaaaaa

SEQ ID NO: 24790 - protein, 384 aa, Trypanosoma cruzi
MAQNPSAVNNKKEVPDRRTCILDTVLDAIGSTPCIRLNHVPKKHGVCCDVVAKCEFLNPGGSVKDRIARQMILDAEASGRLRPNQTIIEATSGNTGIGLSLVAAVKKYPMIITMPKKMSHEKEVTLQALGAEVIRTETALPWDHPDSLIGMARRLEKEKGYVLLDQYRNPSNPKAHYEGTAQEIYDQCGGKVDMAVFTTGTGGTMAGVAKRLKELLPNIVIVGVDPYGSILADPSVPLDPKPYLVEGIGYDFVPDVCERKYVDRWVKSADKESFALASEVHREEALLVGGSSGAAMWGVLQAAKDLRPDQRCVVVFPDGIRNYMTKFPDKNWLVENGLEEGEVTRPTYGSLEAQLEEAKKKLSEYEAKCGGSVEEGKRCCEKAK

SEQ ID NO: 24791 - DNA, 1200 bp, Arabidopsis thaliana
  CDS (1)..(1200)
atgttttctgctgttcgatttttttttttctctgatttatattcgagtttgaacttaaatcatggttttggtttcactttacaattttggatctcatgcagtttcaaaacactcttcgatttatatgaatgttttatattattagggacattgcttgcagactgtgtcttaaatctttttgattttcttgtgatcttcagaactcaaattgggaagaattttgacatggaggaggaccggtgttcgatcaaggatgatgcaactcaattgataggtaacaccccaatggtatatctgaacaacattgtggatggttgtgtagctcgtattgcagctaagcttgaaatgatggagccttgctctagtgtcaaggagcgaattgcttatggtatgattaaagatgcagaagacaagggattgattactcctgggaagagcacactgattgaggctacctctggtaacaccgggattggtttagccttcatcggtgcagctaaaggttacaaagtggtcctcacaatgccctcatcaatgagccttgagagaaaaatcattcttttagcattaggtgcggaggttcacctcacagatcctagtaaaggcgttcaaggaataatcgacaaagctgaagagatatgtagcaaaaatccagatagtatcatgctagaacagttcaaaaatccttcaaacccgcaaactcattatcgaaccacgggtccagagatatggagagactctgcaggggaagtagacatattggttgccggtgttggaactggtggaacgctttccggatcaggaagattcctcaaggagaagaataaagactttaaggtttatggtgtggaacctacagaaagtgcggtaataagtggaggcaaaccgggtacacatttgatccaaggtattggggctggactcatcccagacaatttggatttcaacgttcttgatgaagtcatccaagtgacaagtgtggaagcaattgaaacagccaaacttcttgccctgaaagaaggattactggtgggaatatcttctggagctgctgcagccgctgcgataaaggtggcaaagcggccagaaaacgccggcaaactcatagttgtgattttccctagcggtggggaacgttacctatcgacctcattgttcgaatcagtcagacatgaagcagagaatttgccaattcaatga

SEQ ID NO: 24792 - protein, 399 aa, Arabidopsis thaliana
MFSAVRFFFFSDLYSSLNLNHGFGFTLQFWISCSFKTLFDLYECFILLGTLLADCVLNLFDFLVIFRTQIGKNFDMEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKNPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 24793 - DNA, 948 bp, Pasteurella multocida
  CDS (1)..(948)
atgaccatttactcagataattcttattcaattggtaatacaccacttgtgcgcttgaaacactttggtcaaggcaatattgtggtcaaagtggaagggcgtaatcccagttttagtgtgaagtgccgtattggggcgaatatggtatggcaagcagaaaaagacggtatcttgacgaaagaaaaagaaattgtcgatgctaccagtgggaatactgggatcgccttagcctatgtggcagctgcacgcggttataaaatcactttaacgatgccagaaaccatgagtgcagaacgtaaacgtttattacgtggattgggcgtcaatttagttttaacggaaggtgcattgggcatgaaaggggctattgccaaagcagaagaaattgtcgcgtctgatccacaacgctatgtaatgttaaagcagtttgaaaatccggctaatccagccattcaccaacaaacaaccggaccggaaatttggcgtgatacggatggtcaaattgatgtgctggttgctggtgttggcaccggcgggacgattacagggattagccgttatattaaacaagataaaggtaaagcgattctctctgtggcagttgaacctgcggaatcaccagtgattagtcaaactttagccggtgaagagatcaagcctgccccacataaaattcaaggcattggcgcgggctttatccctaaaaatttagaccttgcattagtggatcgtgttgaaaccgtgagtagtgaggaagccatgcaaactgcacgtcgattaatggcagaagaaggcattttaggggggatttcatcaggagcggcggtggctgccgcagatcgtttggcaaaattacctgaatttgccgagaaattaatcgtagtgattttaccgtctgcgtcagaacgctatttaagtacggcattatttgaaggcattgaggcttaa

SEQ ID NO: 24794 - protein, 315 aa, Pasteurella multocida
MTIYSDNSYSIGNTPLVRLKHFGQGNIVVKVEGRNPSFSVKCRIGANMVWQAEKDGILTKEKEIVDATSGNTGIALAYVAAARGYKITLTMPETMSAERKRLLRGLGVNLVLTEGALGMKGAIAKAEEIVASDPQRYVMLKQFENPANPAIHQQTTGPEIWRDTDGQIDVLVAGVGTGGTITGISRYIKQDKGKAILSVAVEPAESPVISQTLAGEEIKPAPHKIQGIGAGFIPKNLDLALVDRVETVSSEEAMQTARRLMAEEGILGGISSGAAVAAADRLAKLPEFAEKLIVVILPSASERYLSTALFEGIEA

SEQ ID NO: 24795 - DNA, 1392 bp, Streptomyces venezuelae
  CDS (1)..(1392)
atgcaattccacgactcgatgatcagcctcgtcggcaacaccccgctggtgaagctcaacaacgtcacagcgggcattcaggcgaccgtcctggccaaggtcgagtacttcaaccccggaggctcggtcaaggaccggatcgccgtgcggatgatcgaggcggccgagcagagcggcgagctcaagcccggtgggaccatcgtcgagcccacgtccggcaacaccggcgtcggcctggcgatcgtggcccagcagaagggctacaagtgcatcttcgtctgccccgacaaggtgtccctcgacaagatcaacgtgctgcgggcgtacggcgccgaggtcgtcgtctgccccaccgcggtcgacccggagcacccggactcgtactacaacgtctcggaccggctcgtccgtgagacgccgggcgcctggaagcccgaccagtactccaacccgaacaacccgcgctcccactacgagaccaccggtcccgagctctgggagcagacggacgggaagatcacccacttcgtggcgggcgtcggcaccggcggcaccatctccggcaccggcaactacctcaaggaggccagcggcggctccgtgaagatcatcggcgccgacccggagggctccgtctactccggcggctccgggcgcccgtacctcgtcgagggcgtcggcgaggacttctggccgaccgcctacgaccggaacgtcacggaccggatcgtcgccgtgtccgacaaggactccttccagatgacccgccgcctcgccaaggaggagggcctcctcgtcggcggctcctgcggcatggccgtcgtggccgccctggaggtcgccagggagctcggcccggacgacgtcgtcgtcgtgctgctgccggactccggccgcggctacatgtcgaagatcttcagcgacgagtggatggccggccacggcttcctggaggacacctcctcggccaccgtcgcggacgtcctgcgccacaaggagggcggcaccatgccctccctggtccacatgcacccggacgagaccgtcggccaggccatcgaggtgctccgcgagtacggcgtctcgcagatgccgatcgtgaagccgggcgcgggccaccccgacgtgatggccgccgaggtcgtcggatcggtcgtcgagcgtgacgtgctcgacgccctcttcacccagcgcgcctccctggaggactcgctggagagccacatgagcgcgccgctgccgcaggtcggctcgggcgagccggtcgccgccctgatgtccgtcctcggcgacgcggccgacgcggcgatcgtgctggtcgagggcaagccgaccggtgtggtgagccgtcaggacctgctggccttcctggccaacggcggcgccaagtag

SEQ ID NO: 24796 - protein, 463 aa, Streptomyces venezuelae
MQFHDSMISLVGNTPLVKLNNVTAGIQATVLAKVEYFNPGGSVKDRIAVRMIEAAEQSGELKPGGTIVEPTSGNTGVGLAIVAQQKGYKCIFVCPDKVSLDKINVLRAYGAEVVVCPTAVDPEHPDSYYNVSDRLVRETPGAWKPDQYSNPNNPRSHYETTGPELWEQTDGKITHFVAGVGTGGTISGTGNYLKEASGGSVKIIGADPEGSVYSGGSGRPYLVEGVGEDFWPTAYDRNVTDRIVAVSDKDSFQMTRRLAKEEGLLVGGSCGMAVVAALEVARELGPDDVVVVLLPDSGRGYMSKIFSDEWMAGHGFLEDTSSATVADVLRHKEGGTMPSLVHMHPDETVGQAIEVLREYGVSQMPIVKPGAGHPDVMAAEVVGSVVERDVLDALFTQRASLEDSLESHMSAPLPQVGSGEPVAALMSVLGDAADAAIVLVEGKPTGVVSRQDLLAFLANGGAK

SEQ ID NO: 24797 - DNA, 927 bp, Bacillus stearothermophilus
  CDS (1)..(927)
atggcgagaacagtaaactccatcacggaattaatcggtgatacaccggcagtgaaactaaatcgtattgtcgatgaagacagtgccgatgtctatctaaaacttgagtttatgaacccaggaagcagcgtcaaagaccggattgccttggcgatgattgaagcggcggaaaaagaagggaaattaaaaccaggcgatacgattatcgagccgacaagtggaaacacgggaattggcttggccatggttgccgccgcaaaaggctataaagcgattttagtcatgccagatacgatgagtttagagcgccgcaatttattgcgtgcatatggcgctgaattagtgcttacgccgggaagccaagggatgcggggcgccattgaaaaggcagaagaattagtcagagaacatggctattttatgccccaacagtttaaaaatgaggctaacccagaaattcaccgcttaacgacagggaaggaaattgttgaacaaatgggcgatcaattagatgcgttcattgccggcgtcggtacgggcggaacgattaccggagcaggacaagttcttcgtgaaaaatatccaaatattaaaatttatgccgtagagcctgctgattcaccggtattatcgggtggaaaaccaggcccgcacaaaattcaaggaattggagccggatttgtgccagacgttttagatacaaacatttacgatgaagtcattacggtgacaacggaggaagcgtttgccgctgctcgccgcgctgcccgcgaagaaggaatccttggcggaatttcttctggtgctgccattcatgccgcgttgaaagtggcgaaacaacttggaaaaggaaagaaagtattggccattattccaagtaatggcgaacgctacttaagcacgccgctttaccaattcgaagactaa

SEQ ID NO: 24798 - protein, 308 aa, Bacillus stearothermophilus
MARTVNSITELIGDTPAVKLNRIVDEDSADVYLKLEFMNPGSSVKDRIALAMIEAAEKEGKLKPGDTIIEPTSGNTGIGLAMVAAAKGYKAILVMPDTMSLERRNLLRAYGAELVLTPGSQGMRGAIEKAEELVREHGYFMPQQFKNEANPEIHRLTTGKEIVEQMGDQLDAFIAGVGTGGTITGAGQVLREKYPNIKIYAVEPADSPVLSGGKPGPHKIQGIGAGFVPDVLDTNIYDEVITVTTEEAFAAARRAAREEGILGGISSGAAIHAALKVAKQLGKGKKVLAIIPSNGERYLSTPLYQFED

SEQ ID NO: 24799 - DNA, 951 bp, Selenomonas ruminantium
  CDS (19)..(951)
acaaggaggaattttgtcatggcaaagatttacaacagtgtaacagaacttatcggcaatacgccgctcttaaaagcaaataatttcatcgaggcaaatgacctgcaggctaatattctggttaagctggaatatctgaatcctgccggcagcgtcaaagatcgcattgccaaagccatgattgagcaggcggaaaaggaaggcaaaatcaccaaagacacggtgattattgagccgaccagcggcaacacgggcattggcctggcaagttttgcggcagcccgcggctataaggcaatcctgaccatgccggaaaccatgagcgtggagcgccgcaatctcctgaaggcctatggtgcacagattgtgctgactgatggcgctaagggcatgaagggggccattgccaaggccgaagaactggcaaaagagacgccgaatgcgttcatcccatcccagtttacgaatcaggcaaacccggctattcacgaagcaacgaccggcccggaaatctggcaggatgcggaaggcaaagtcgatgtctttatcgctggtgtcggcacgggcggcacgcttacaggtgtaggccgttatctcaaaaagcaaaacgctgctgtgcatatcgtagctgtagagccggaaagttcgccggtactcagccagggcacggccggcccgcacaagattcagggcattggtgcaggttttgtgccggaaacactcgataccaaggtctacgatgaagtcctgccaatcagcaacgaagatgccttcaaatatggccgtcagtttgcccatagcgaaggtgtgctggtcggtatctccgccggtgcagcactagcggcagccgttcagctggccaagcgtccggaatttgcgggcaagaacatcgtggctctgctgcctgacacgggtgaccgctatctttccacagaactctttaatgactaa

SEQ ID NO: 24800 - protein, 310 aa, Selenomonas ruminantium
MAKIYNSVTELIGNTPLLKANNFIEANDLQANILVKLEYLNPAGSVKDRIAKAMIEQAEKEGKITKDTVIIEPTSGNTGIGLASFAAARGYKAILTMPETMSVERRNLLKAYGAQIVLTDGAKGMKGAIAKAEELAKETPNAFIPSQFTNQANPAIHEATTGPEIWQDAEGKVDVFIAGVGTGGTLTGVGRYLKKQNAAVHIVAVEPESSPVLSQGTAGPHKIQGIGAGFVPETLDTKVYDEVLPISNEDAFKYGRQFAHSEGVLVGISAGAALAAAVQLAKRPEFAGKNIVALLPDTGDRYLSTELFND

SEQ ID NO: 24801 - DNA, 1378 bp, Solanum tuberosum
  CDS (55)..(1215)
agtggtaacaacgcagagtacgcggggaaggaagatagagatagcaaagcaacaatggcatctttcatcaacaatcccttaacttctctctgtaacactaagtctgaagctaataatctcttcaaaatttcccctttaagagctcaatcactgggtttttccaagcttaatggcagcagaaaagttgctttcccttctgttgtttgcaaagcggtgtctgtaccaacgaaatcgagtacagagattgaagggcttaacatcgctgaagatgttacacagcttattgggaacacaccaatggtttaccttaacaccatcgctaagggttgtgtagcaaacattgctgctaaacttgagattatggagccatgttgcagtgttaaggacaggatagggttcagtatgatagttgatgcagaggagaagggacttatatctccggggaagactgttctagttgagcctacaagtggaaacacaggcattgggcttgccttcattgctgcttccagaggatataagctcatcttaacgatgcctgcatcaatgagtcttgaaagaagggtcattctaaaagcttttggagctgaacttgttttaactgacccagccaaagggatgaaaggagctgtttcaaaggctgaagaaatattgaataacacaccagatgcctatatccttcaacaatttgacaatcccgccaaccccaagatacactatgaaacaacgggtccagagatctgggaagacacaaaaggcaagattgacatacttgttgctggcattggaactggtggaaccattacaggaacaggccgattccttaaagagcaaaatccaaacattaagattattggtgtggagcccacagaaagtaacgttctatcagggggcaaacctggccctcacaaaattcaagggattggagcaggttttattccaggaaacttggatcaagatgtaatggatgaagtgatagagatatcgagtgacgaagctgttgaaactgcgaagcaattagcgctacaagaagggttgttggttgggatttcttccggagcagctgctcttgctgccattcaggttgggaagagacctgagaatgcaggaaagcttattggggttgtatttccaagctatggggaacgatacctctcctctattcttttccagtcaatacgagaggaatgcgagaaaatgaagccagaattgtgaagatcttccttttttcgagctatcttctgattcttaataatgctatctggcttttctagctgccacacttttgtttgttatatttagttggctgctggtgtatacaatagatcaggtattaagatggttctcataacaaagattaaaaaaaaaaaaaaaaaaa

SEQ ID NO: 24802 - protein, 386 aa, Solanum tuberosum
MASFINNPLTSLCNTKSEANNLFKISPLRAQSLGFSKLNGSRKVAFPSVVCKAVSVPTKSSTEIEGLNIAEDVTQLIGNTPMVYLNTIAKGCVANIAAKLEIMEPCCSVKDRIGFSMIVDAEEKGLISPGKTVLVEPTSGNTGIGLAFIAASRGYKLILTMPASMSLERRVILKAFGAELVLTDPAKGMKGAVSKAEEILNNTPDAYILQQFDNPANPKIHYETTGPEIWEDTKGKIDILVAGIGTGGTITGTGRFLKEQNPNIKIIGVEPTESNVLSGGKPGPHKIQGIGAGFIPGNLDQDVMDEVIEISSDEAVETAKQLALQEGLLVGISSGAAALAAIQVGKRPENAGKLIGVVFPSYGERYLSSILFQSIREECEKMKPEL

SEQ ID NO: 24803 - DNA, 1354 bp, Solanum tuberosum
  CDS (85)..(1062)
agtggtaacaacgcagagtacgcggggagtcacagtagatttcatttcttgtcttttgtcaaatcctagaattaacctgataatatggcgggggaaaagattggaattgccaaggatgtaactgaattgattggtaacactcctttggtatacctgaataatgttgtggatgggtgtgttgcacgtgttgctgccaggctggaaagcatggagccatgctctagtgttaaggataggatcggttatagtatgattacagatgctgaggagaagggtctcatcaaacccggcgagagtgtcctcatcgaacctacgagtggaaacactggtgtaggattggcattcatggctgctgctaaaggctacaaactcatcattacgatgccttcttcaatgagtcttgagagaagaattattctgcgtgctttcggtgctgagttggtgcttaccgatccagcaaaagggatgaagggtgctatttcaaaggctgaagagataaaggccaaaatacccaactcctatattcttcagcaatttgaaaaccctgctaacccaaagatacactatgagaccactggtcctgagatctggaaaggctcaaatgggaaagtggatgctctagtctctggaattggaacaggaggcacgataactggttcaggcaagtatttgagagagcagaaccccaacgttaagctgtatggcgtggaaccagttgaaagtgctatcctttctggtggaaagcctggtccacataagattcaggggattggtgctggtttcattcctggtgttttggaagttaaccttattgatgatgtagttcaggtttcaagtgaagaatccatagaaatggctaagcttctggcattgaaggaaggattgctagtgggaatttcatctggtgctgctgcggcggcggcaattaaagtcgctaagcgccctgaaaatgctgggaagctcattgttgttattttcccaagcttcggagagcgatatctttcctctgtactcttcgaaactgtcagacgagaagcagagaacatgactgtggagccttgaactttttgccctccgattaccacatcatagtcgcaaagtgggcttccgatgaaagcagaatgttcttgtctgaaccttcccctttctattttgctgaaactgctagaaaataaggccttttctttcttttattggctatgtactttaaagtaaagaaaccattcaagtatattttagtgcttttgtaattctactgtttctacaacatttgtaattctactgtttctacaacatttgaaatttaaagaggtgttgcttcttgttcatggaaaaaaaaaaaaaaaaaaaaaaa

SEQ ID NO: 24804 - protein, 325 aa, Solanum tuberosum
MAGEKIGIAKDVTELIGNTPLVYLNNVVDGCVARVAARLESMEPCSSVKDRIGYSMITDAEEKGLIKPGESVLIEPTSGNTGVGLAFMAAAKGYKLIITMPSSMSLERRIILRAFGAELVLTDPAKGMKGAISKAEEIKAKIPNSYILQQFENPANPKIHYETTGPEIWKGSNGKVDALVSGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 24805 - DNA, 1250 bp, Solanum tuberosum
  CDS (96)..(1139)
ggaggtacacaaaaaaaagaagctcaattgcatagagagtacctttttttttttttgtgtaaattttaaagtgcaataattttgagaattcatcaatggcaactttaagcagattcttaaagaaaagatcattagctagcaacagattgttctctacacaacttcctcatactaacatcaagtctgaagtttctcaattaattgggaaaacaccaatggtttatcttaaaaaagtgacagaaggatgtggagcatatatagctgtgaaacaagagatgtttcagcctacttctagcatcaaagacagaccagcattggcaatgatcaatgatgcagaaaagaaaggcttaatatcacctgaaaagacgacgttgattgagccaacatcaggaaatatggggattagtatggcatttatggcagcaatgaaaggctacaaaatggttttgactatgccatcgtacacgagcatggagaggagagtgacaatgagagcatttggagccgatttaatcctcaccgatccaaccaaaggaatgggaggcactgttaagaaggcttatgagcttttggaatctacacctaatgctttcatgcttcaacaattttccaaccctgcaaacactcaggttcatttcgacacaactggccctgaaatatgggaagaaactctaggtaatgttgacatatttgtcatgggaataggaagtggaggcactgttactggtgttggactatatcttaaatccaaaaatcctaatgtcaagatatatggactcgagccaactgaaagcaatatactgaatggtggaaaaccaggtcctcatcatataacgggaaatggggtcggatccaagccagatatcgttgatatggatctaatggaggaagtactaatggtttctagcgaagacgctgtaaacatggctagggagttggcagtgaaggaaggactcatggttgggatatcgtcaggagctaatacagtagcagctctaagacttgctcaaaaaccagaaaacaaaggcaaactcatagtgactgtacatgcaagttttggagagcgatacttatcatctgtgttgtatcaagatctgaggaaagaagctgagaatatgcaacctgtttcagtcgattaaatatcgaaaactcagcaagaaaaatgtatttttttttgttcattctaaatgatgttttctgaatgtctactgttggttgattaaaaaaaaaaaaaaaaaaaaaaaaaaaaa

SEQ ID NO: 24806 - protein, 347 aa, Solanum tuberosum
MATLSRFLKKRSLASNRLFSTQLPHTNIKSEVSQLIGKTPMVYLKKVTEGCGAYIAVKQEMFQPTSSIKDRPALAMINDAEKKGLISPEKTTLIEPTSGNMGISMAFMAAMKGYKMVLTMPSYTSMERRVTMRAFGADLILTDPTKGMGGTVKKAYELLESTPNAFMLQQFSNPANTQVHFDTTGPEIWEETLGNVDIFVMGIGSGGTVTGVGLYLKSKNPNVKIYGLEPTESNILNGGKPGPHHITGNGVGSKPDIVDMDLMEEVLMVSSEDAVNMARELAVKEGLMVGISSGANTVAALRLAQKPENKGKLIVTVHASFGERYLSSVLYQDLRKEAENMQPVSVD

SEQ ID NO: 24807 - DNA, 1493 bp, Nicotiana tabacum
  CDS (88)..(1062)
ttgttgttgttgttgtgtttttgcagaatcacaagataaggaagctagctaacttcaaagcatccactagcaactcagcaagaaactatggaagagaagagtgatattgcaaaggatgtcacagagcttatcgggaacacccctatggtatatctcaacaaaatcgttgaaggttgcgctgcccaaattgcagccaagttggagtcaatggaaccatgctcaagtgtcaaagacaggatggcatacagtatgatcaaagatgcagaagataagggcctgattactcctggaaagacagtcctccttgaggtgaccagtggtaataccggcattggtcttgcatttattgcagcagctcgtggctacaagctcgtgacagtgatgccagcatcatacagtcttgagagaaggattgttcttaaagctttgggttctgagttatacatcacagatccagccaaaggtatagatggtgtgcttcagaaggctgaagaaatactagataggacgccaaactgtcatttctttcgtcagtttgagaaccctgccaatccaaagatccattatgaaacaactggaccagaaatatggaagtgcacaggagggaaaattgatatttttattgccgggattggaactggaggcacagtgacgggagctggaaggttccttaaggagaagaatccagaaataaaggtatatggtatggaaccagcccgaaaatgcaattctgaatggaggacaaaagggccacataaaatccaaggaattggtgctggttttgtcccagtcgttctcgatctcagcatcctggatgaagttcttcaagtatctagtgatgaagctattgaaatgacaaagcttcttgcattgaaagaaggtttgctggtaggaatatcgtcgggggctgcagctgctgcagcgataaaagtagcaaaaaagccagaaaatgctgggaaactcattgcggttatcttccctagttttggggaacgttatctctccaccgtgctgtttgattctattcgagaagaggtggctaacatgacttttgaacaatagtatgcttctttggactgagtgatagggtattgaaggaagttatgtgttgtaacttgaggttaaatagaaaatacaactgtaagtgtttcctcctaaataggtgaactattgttcacaaatacaaatgttctcatcatttgtaaggtataaagaacaattatctctttgcctgcggatatcaacctctcttattctagtgttctgcagttgtttgttatgacttatgagttccttggttggctctcgtctctgcgagctcagcggcagcttgttgggctgggcagccagcttgagtctgttcctgatgctggacttcaccaatggtaatcactgcttcttcagcctaagattttgctcgtctcctttgtaatttacacaagaattagcttttaacctctcttttttcttggtgaaaaaaaaaaaaaaaaaaa

SEQ ID NO: 24808 - protein, 324 aa, Nicotiana tabacum
MEEKSDIAKDVTELIGNTPMVYLNKIVEGCAAQIAAKLESMEPCSSVKDRMAYSMIKDAEDKGLITPGKTVLLEVTSGNTGIGLAFIAAARGYKLVTVMPASYSLERRIVLKALGSELYITDPAKGIDGVLQKAEEILDRTPNCHFFRQFENPANPKIHYETTGPEIWKCTGGKIDIFIAGIGTGGTVTGAGRFLKEKNPEIKVYGMEPARKCNSEWRTKGPHKIQGIGAGFVPVVLDLSILDEVLQVSSDEAIEMTKLLALKEGLLVGISSGAAAAAAIKVAKKPENAGKLIAVIFPSFGERYLSTVLFDSIREEVANMTFEQ

SEQ ID NO: 24809 - DNA, 927 bp, Methanosarcina thermophila
  CDS (1)..(927)
atgggtcggatattttctgatataacctggacaattggcaatactcctcttgtcaggctaaaccgcataaccaaaggactgcatgcggatgtgctggcaaaagtcgaatccttcaatcccatgggcagtgtgaaggacagaatagggctggcaatgatcgaagaagccgaacgtgaagggagaatcaaagaaggcaccactattattgaagcaaccagcggcaataccggcatcgcacttgcatgcgtttgtgctgcccgcggctacaatcttatactggttatgcctgaaactatgactgtagaacgaagaaaactgcttaaagctctgggagcggaacttgtcctgacctcgggagcggaaggaatgaggggggcagtcaataaagccgaacagatggctgccgacgattctgcactttatttcataccccagcaattccagaaccccgcaaaccctgagattcacagaaggacaacagccgaagagatctggagagatactgacggcaaagccgatgttattgtagcgggcgtgggaactggcggaactattacagggattgccagtgctatcaaaaaacggaggccttcttttaaggcgattgcagtcgagcctgccgaatctcctgtactcagcggaggaagccctggcccgcacaggatccagggaatcggtgcaggttttgttcctgatgttctccagctagagctgattgatgaaattatcaaagttacaggagatgaagccgctgccacagcccgaaggctggcaaaggaagaaggtattcttgcagggatatcttcaggggctgctacctgggctgcacttcaggtcgcatccagagaagaaatgcgcggaaagacgattgttgtaattctgccggatacgggagagcgttatttgagcactgacctgtttgactga

SEQ ID NO: 24810 - protein, 308 aa, Methanosarcina thermophila
MGRIFSDITWTIGNTPLVRLNRITKGLHADVLAKVESFNPMGSVKDRIGLAMIEEAEREGRIKEGTTIIEATSGNTGIALACVCAARGYNLILVMPETMTVERRKLLKALGAELVLTSGAEGMRGAVNKAEQMAADDSALYFIPQQFQNPANPEIHRRTTAEEIWRDTDGKADVIVAGVGTGGTITGIASAIKKRRPSFKAIAVEPAESPVLSGGSPGPHRIQGIGAGFVPDVLQLELIDEIIKVTGDEAAATARRLAKEEGILAGISSGAATWAALQVASREEMRGKTIVVILPDTGERYLSTDLFD

SEQ ID NO: 24811 - DNA, 1269 bp, Salmonella enterica subsp
  CDS (205)..(1176)
tcatctcaaaattggcgttagtgttagacatatattcaagcctatctcttatctggagatacagctactgtctggtgtttcagggggctacatcatcattatttcccttccgcatatagatatgctaaatccttacttccgcatattctttaagcgggtatgctgatgccgtacccccaaatttcatacagttaaggacgggccatgagtaagatttttgaagacaactccctgactatcggtcacacgccgctggtacgactgaaccgcattggtaacggccgtatcctggcaaaggtagaatctcgtaacccgagctttagcgtaaaatgccgtatcggcgccaatatgatctgggatgctgaaaagcgcggcgttttgaaacctggcgtggaactggtcgaaccgaccagcggcaacaccggtatcgccctcgcctacgtggcggcgggccgcggctacaagctaacgctaaccatgccggaaaccatgagcattgagcgccgcaaactgctgaaagcgctgggcgccaacctggtactgaccgaaggcgcaaaaggcatgaaaggcgctattcaaaaagcggaagaaatcgtcgccagcaaccgggaaaaattcctgctgctgcagcagttcaacaacccggctaatccggaaatccacgaaaagaacaccgggccggaaatctggggagagaccgatggtcaggttggactctttatctctggggtaggcgccgggggtacgctgaacggggtcggccgcttcttaaaaagcccaagggggaaaaaaaatcttatcaccgtcgcgggcgaaccgaccgattcgccggtcataccccaggcgctggcaggagaagagctcaagccgggcccgcacaaaattcagggtatcggcgccggcttcattcctggcaacctggatctaaagctggtggacaaagtgatcggcattaccaacgaggaagctatctccacggcgcgccgtctgatggaagaagaaggcatcctggcgggtatctcttccggggccgccgttgccgccgcgttgaagctgcaggaagatgaggcctttaccaataagaatattgtggttactctgccttctccaggtgagcgttatttaagcaccgcgctgttcgccgatctcttcactgagaaagaactgcaacagtaagtgccagcttgtaaaaagcaccttttcaggtgctttttgtgcatactcagttacctctgaggctgattaccagcacattattaccgaattaca

SEQ ID NO: 24812 - protein, 323 aa, Salmonella enterica subsp
MSKIFEDNSLTIGHTPLVRLNRIGNGRILAKVESRNPSFSVKCRIGANMIWDAEKRGVLKPGVELVEPTSGNTGIALAYVAAGRGYKLTLTMPETMSIERRKLLKALGANLVLTEGAKGMKGAIQKAEEIVASNREKFLLLQQFNNPANPEIHEKNTGPEIWGETDGQVGLFISGVGAGGTLNGVGRFLKSPRGKKNLITVAGEPTDSPVIPQALAGEELKPGPHKIQGIGAGFIPGNLDLKLVDKVIGITNEEAISTARRLMEEEGILAGISSGAAVAAALKLQEDEAFTNKNIVVTLPSPGERYLSTALFADLFTEKELQQ

SEQ ID NO: 24813 - DNA, 1386 bp, Streptomyces coelicolor
  CDS (1)..(1386)
atgcaattccacgactcgatgatcagcctcgtcggcaacaccccgctggtgcggctcaacagcgtgagcaaggggatcagggcgaccgtcctggccaaggtggagtacttcaacccgggcggctcggtgaaggaccgcatcgccctgcgcatgatcgaggccgcggagaagagcggtgagctgcagccgggcggcacgatcgtcgagccgaccagcggcaacaccggcgtcggcctcgccatcgtggcccagcagaagggctacaagtgcatcttcgtctgccccgacaaggtgtccaccgacaagatcaacgtgctgcgcgcgtacggcgccgaggtcgtcgtctgcccgaccgccgtcgacccggagcaccccgactcctactacaacgtctccgaccggctggtccgcgagacgccgggcgcctggaagccggaccagtactccaacccgaacaacccgctctcccactaccactccacgggccccgagctgtgggagcagaccgaggggaagatcacccacttcgtggccggggtcggcaccggcggcaccatctccggcaccggccggtacctgaaggacgccagtgacggcgcggtcacggtgatcggcgccgaccccgagggctccgtctactccggcggctccgggcgcccctacctggtcgagggcgtcggcgaggacttctggccgacggcgtacgaccgcgaggtcgccgacgagatcgtcgccgtctccgacaaggactccttccagatgacccgccgcctcgccaaggaggagggcctgctggtgggcggctcctgcggcatggcggtcgtcgcggcgctggaagtggcggcgcggctcggcgaggacgacgtggtggtcgtcctgctgccggacagcggacgcggctatctcagcaagatcttcaacgacgagtggatggccgactacggcttcctggaggacacgggccccagcgcccgcgtcgcggaggtcctgaaccacaaggagggcggccacatcccctccctcgtccacatgcacccggacgaaaccgtcggccaggccatcgaggtgctgcgcgagtacggcgtctcgcagatgccgatcgtcaagcccggcgccggtcacccggacgtgatggccgccgaggtcgtcggctcggtggtggagcgcgagctgctggacgcgctgttcgccaagcgcgcctcgctggaggacccgctggagaagcacatgtccgccccgctgccccaggtcggctccggagagccggtcgcggacctgatgtcggtgctcggcggcgccgacgcggcgatcgtcctcgtcgagggcaagccgaccggtgtggtgagccggcaggacctgctgtccttcctcgccaaggtcaagtag

SEQ ID NO: 24814 - protein, 461 aa, Streptomyces coelicolor
MQFHDSMISLVGNTPLVRLNSVSKGIRATVLAKVEYFNPGGSVKDRIALRMIEAAEKSGELQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASDGAVTVIGADPEGSVYSGGSGRPYLVEGVGEDFWPTAYDREVADEIVAVSDKDSFQMTRRLAKEEGLLVGGSCGMAVVAALEVAARLGEDDVVVVLLPDSGRGYLSKIFNDEWMADYGFLEDTGPSARVAEVLNHKEGGHIPSLVHMHPDETVGQAIEVLREYGVSQMPIVKPGAGHPDVMAAEVVGSVVERELLDALFAKRASLEDPLEKHMSAPLPQVGSGEPVADLMSVLGGADAAIVLVEGKPTGVVSRQDLLSFLAKVK

SEQ ID NO: 24815 - DNA, 915 bp, Clostridium sticklandii
  CDS (1)..(915)
atgatttatgaaaatatcatgcaaacaataggaaaaactccaatagttaagcttaaaaatttaacagatgagaatatggcagagctttatgtaaagctggaattttttaatccaggaggttcagtaaaagatagagctgcattaaatatgatagaaaacatggaaaaagagggtaagcttaagcttggtgatattattgtagagcctacaagtggaaatactggaataggaatagcgatggtaggctcggcaaagggctacaaagtaattttatgcatgccagagactatgagtatagaaagaagaaaaatcttaaaagcctatggagctgagctggttttaactgaaggagctaaaggcatgaaaggtgctatagcaaaagctgaagaaatggcacaagaagatggctatattatcctaagacagtttgacaatagctataacgtagatgctcactataaaaacacagctaaggaaataataagtgacctacctgatttagatgctctagtcgtaggagtaggaacaggaggaacacttactggagttgctaaagcatttaaagaaagctctataaatgcagaaattgttgctgtagagccagtagattcagcagttttatctggaaatgctccagggccgcataagcttcaagggataggcgcaggatttgtgcctagtattttagatactgagtatataagcaagatagaacaaattcaaacgcaggaagcttttaatgcatctagacttatggcttcaaaagaaggaatcctccttggaatttcagggggagcagcattagaggctgcgattagaacagctaaacgtcttggaaaagggaaaaaagtctgtttgttgctccctgataacggagaaagatatctaagcacagctttatatggagatgaataa

SEQ ID NO: 24816 - protein, 304 aa, Clostridium sticklandii
MIYENIMQTIGKTPIVKLKNLTDENMAELYVKLEFFNPGGSVKDRAALNMIENMEKEGKLKLGDIIVEPTSGNTGIGIAMVGSAKGYKVILCMPETMSIERRKILKAYGAELVLTEGAKGMKGAIAKAEEMAQEDGYIILRQFDNSYNVDAHYKNTAKEIISDLPDLDALVVGVGTGGTLTGVAKAFKESSINAEIVAVEPVDSAVLSGNAPGPHKLQGIGAGFVPSILDTEYISKIEQIQTQEAFNASRLMASKEGILLGISGGAALEAAIRTAKRLGKGKKVCLLLPDNGERYLSTALYGDE

SEQ ID NO: 24817 - DNA, 1671 bp, Allium tuberosum
  CDS (417)..(1394)
acataggattcgacatggaggctggagaaggtcgatggcctgtcggagttgtggaaggggctatacgagggagtcgaactcgaggaacgaggacgacgtgatgtaggcttggtgcaggtcaacgattaagtatatgaggcaattttgatgcgatgcgattattggagaggtctgcaatgaacctgcgttagtggtcaaggcgaactagtgcttcatcgggtgagagatggtgggtctagtcatgatggagtgaaatcattaggtgagcgatggtcagagctagggaaaaacacgacgatgttggttgttgttgggtcttgaagccaatttttgttgcagcaagagatttgagtaaaattggtgatggaggtgatggccagatgcagagagtctggattgatgagctaatttaacctatgggtgaagttggacctgcaattgcaaaggatgttactgaattgattggtaaaactccattggtatatctcaacaaagttacagctggctgcaaggctcgtattgctgccaagcttgaaatgatggagccttgttctagtgttaaggacaggattgggtacagcatgattactgaggcagagaaacaaggccttattactcctggggtgagtgttcttattgaaccaactagtggcaatacgggcatagggctggcgttcatggcagcagctaaaagctataagctcattttgacaatgcctgcttctatgagtcttgagagaaggattattctcaaagcttttggtgctgaattggtcctaactgatcctgttaagggtatgaaaggagcatgtgagaaagctgaggagatagctgcaaaaacaccaaattcttatgttcttcaacagtttgaaaacccctctaacccaaagattcattatgagacaaccggccctgaaatatggaaggcaactgatgggaaaattgatggacttgtatctggtattggaacgggaggtacaattactgggagtggcaaatatctcaaagaacaaaaccccagtgtcaagctctatggggttgaaccagtggaaagtgctattttatctggtggaaagccaggaccgcataaaattcaagggataggagcaggttttattcctggtgttttagatgtcaatcttatagatgaaactcttcaggtttcaagtgaggaagcaatagaaatggcgaaacaacttgccctacaagaagggcttttggtaggaatttcgtctggagctgctgcaattgctgctattagagttgcacagcgtccggagaatgaaggaaaactgattgtggttgtcttccccagctttggcgagcgatatctttctaccgtgctcttccagtcaattaagaaagaggccgagagcatggtgtttgaaccttaagaggccatctgcttttcgccttgttttctttgtttcattttttcagaataagcacaatgaatgcttcattagtttcgttgcccatggtgtcctgtttcgaagctttcggttatggcttgcacgtatactcatcaactacttgtggcattgtattgtatgcgtgctattttatcatttgtgcttgagagacttgataattttaaactacatttgtgtgacattggatattgatgtatatggcttttcatagctctattattttttataaaaaaaaaaa

SEQ ID NO: 24818 - protein, 325 aa, Allium tuberosum
MGEVGPAIAKDVTELIGKTPLVYLNKVTAGCKARIAAKLEMMEPCSSVKDRIGYSMITEAEKQGLITPGVSVLIEPTSGNTGIGLAFMAAAKSYKLILTMPASMSLERRIILKAFGAELVLTDPVKGMKGACEKAEEIAAKTPNSYVLQQFENPSNPKIHYETTGPEIWKATDGKIDGLVSGIGTGGTITGSGKYLKEQNPSVKLYGVEPVESAILSGGKPGPHKIQGIGAGFIPGVLDVNLIDETLQVSSEEAIEMAKQLALQEGLLVGISSGAAAIAAIRVAQRPENEGKLIVVVFPSFGERYLSTVLFQSIKKEAESMVFEP

SEQ ID NO: 24819 - DNA, 1868 bp, Oryctolagus cuniculus
  CDS (71)..(1726)
actcccgcgccgggcaggcccgcccgccgaccccaggctcgtctcccgcgccgccgagcagatcccagcaatgccttccgagacagcccaggcaggagaggggcccgctggctgcccccacctctcgggggcccagggctcggacaggagcctggaccagagaccccccgggaacaaggatgccccggagcgcgtgtggatccggccggatgtcccaagcaggtgtacctgggagctgggccggcctgtcgccgactccccacaccagcacgcagccctggcaaaatcgccaaaaatcttgcccgatattctccagaaaatcggggacacccccatggtgcggatcaacaagatcgggaagaactttggcctgaagtgtgagctcttggccaagtgtgagttcttcaacgcgggcggcagcgtcaaagaccgcatcagcctgcgcatgatcgaggacgccgagcgtgccgggaccctgaggcccggggacaccatcattgagcccacgtccgggaacacagggatcgggctggccctggccgctgccgtcaagggctaccgatgcatcatcgtgatgccggagaagatgagtctggagaaggtggacgtcctgcgggccctgggggccgagattgtgaggacgcccaccaacgcgcggttcgactcccccgagtcccacgtcggcgtggcgtggcggctcaagcaggaaattcccaattcacacatcctagaccaataccgcaacgccagcaacccactggctcactacgacaccacggccgaggagatcctacagcagtgtgatgggaagctggacatgctggtggcctcggcgggcacgggcggcaccatcacgggcatcgccaggaagctgaaggagaagtgcccgggatgccagatcatcggcgtggaccccgagggctccatcctggcggagccggaggagctgaaccagacggaggtgacggcctacgaggtggagggcatcggctacgacttcatccccaccgtgctcgaccggacggtggtggacaggtggttcaagagcaccgacaaggaggccttcgccttcgcccgcatgctgatcgcgcaggaggggctgctgtgcggtggcagtgccggcagcgcagtggccgtggccgtgaaagccgcccaggagctgcaggagggtcagcgctgcgtggtcatcctgcccgactccgtgcggaactacatgtccaagttcctgagtgacaggtggatgctgcagaagggcttcctggaagaggaggagctctcggtgaagaggccgtggtggtggcacctgcgggtgcaggagctgagcctgtcagtcccgctgaccgtcctgcctggtgtcacctgcagcgacaccatcgacatcctccgggggaaaggctttgaccaggcgcccgtggtggatgaaacgggagagatcctgggcatggtgaccctggggaacatgctgtcgtccctgctcgccgggaaggtgcagccgtccgaccaggtctgcaaggttctctacaagcagttcaagcagatccgcctgacggacaccctgggcgcactctcccacatcctggagatggaccacttcgccctggtggtgcacgagcagatccagtacggcggcgacgagcagcccagcaaacggcagacggtgttcggcgtggtcaccgctatggacctgctccacttcgtggccagccgggggcaggaccagcagtgacgcgtgggagttgggcatgggggcccccagcacgcggagcgaggccccgtcttgcggttcccccggttaacccttggccatgcccacggctctatttatggcgtcctggtgaacgggcttcctattaaaacgtctcaccgac

SEQ ID NO: 24820 - protein, 551 aa, Oryctolagus cuniculus
MPSETAQAGEGPAGCPHLSGAQGSDRSLDQRPPGNKDAPERVWIRPDVPSRCTWELGRPVADSPHQHAALAKSPKILPDILQKIGDTPMVRINKIGKNFGLKCELLAKCEFFNAGGSVKDRISLRMIEDAERAGTLRPGDTIIEPTSGNTGIGLALAAAVKGYRCIIVMPEKMSLEKVDVLRALGAEIVRTPTNARFDSPESHVGVAWRLKQEIPNSHILDQYRNASNPLAHYDTTAEEILQQCDGKLDMLVASAGTGGTITGIARKLKEKCPGCQIIGVDPEGSILAEPEELNQTEVTAYEVEGIGYDFIPTVLDRTVVDRWFKSTDKEAFAFARMLIAQEGLLCGGSAGSAVAVAVKAAQELQEGQRCVVILPDSVRNYMSKFLSDRWMLQKGFLEEEELSVKRPWWWHLRVQELSLSVPLTVLPGVTCSDTIDILRGKGFDQAPVVDETGEILGMVTLGNMLSSLLAGKVQPSDQVCKVLYKQFKQIRLTDTLGALSHILEMDHFALVVHEQIQYGGDEQPSKRQTVFGVVTAMDLLHFVASRGQDQQ

SEQ ID NO: 24821 - DNA, 1077 bp, Leishmania tarentolae
  CDS (1)..(1077)
atgacatccgctactccccatgaccacattttggccaacgcccttgaggcgatcggcaacacgccttgcatccgcttgaaccgtgtcccacagaagcatggtattcagtgcgaggtcgtggccaagtgcgagttctttaaccctggcggcagcgtgaaggaccgcattggcaagcagatggtactcgacgccgaaaagaatgggacgcttaagcctggctccgtgattgtggaggcgacgagcggcaacaccggcatcggcctctccatggcagcggcgatccgcggctaccgcatggtgattaggatgccaaagaagatgtcccatgagaaagagacgacgctgcaggcccgcggtgctgaggtgatccgtacggagacttctctcccgaacgaccacccggaaagcctcatcggtgtcgctacgcccctgcgcgatgagaagggctacgtgctgctggatcagtaccgaccccagcaacccgatccactacgagttgaccggtcagagatctacgaccagtgcggcggaaaggtcgacatggttgtcgtctccgcgggcaccggaggcaccatcaccggcgcggcaaagaagcagaaggagctcatccccgaaatcattgttgttggtgtagacccaatcggcagcgtcgtcgccgaccccgagcacccatgcgagcctgtcatgtaccaggaggtggagggcatcggctatgactttgtaccagctgtgtgcgagcggaagtacgtcgatcgctgggtcaagacgcgcgaccagcagagttttgacctcgcccgcgagctgcaccgcgatgagggtctactggtcggtggtagcagcggtgccgcgatggctggagtgctggaggcagccaaggaccttcgtgcggatcagcgctgcgtcgtgctcatggcggacggcatccgcaactacatggggaagttcgccgacaccaactggatgatcgagcacggcttccggcagggtgaggtgacccgtccaacctacgacgcactgaagaaggagctggagggggtcaaggcgaaactggcccagtacgagagtgccgctaagtag

SEQ ID NO: 24822 - protein, 358 aa, Leishmania tarentolae
MTSATPHDHILANALEAIGNTPCIRLNRVPQKHGIQCEVVAKCEFFNPGGSVKDRIGKQMVLDAEKNGTLKPGSVIVEATSGNTGIGLSMAAAIRGYRMVIRMPKKMSHEKETTLQARGAEVIRTETSLPNDHPESLIGVATPLRDEKGYVLLDQYRPQQPDPLRVDRSEIYDQCGGKVDMVVVSAGTGGTITGAAKKQKELIPEIIVVGVDPIGSVVADPEHPCEPVMYQEVEGIGYDFVPAVCERKYVDRWVKTRDQQSFDLARELHRDEGLLVGGSSGAAMAGVLEAAKDLRADQRCVVLMADGIRNYMGKFADTNWMIEHGFRQGEVTRPTYDALKKELEGVKAKLAQYESAAK

SEQ ID NO: 24823 - DNA, 990 bp, Synechococcus sp
  CDS (1)..(990)
atgccgaaaattctcaaccgactaacggagtggatcggcaataccccgctggtacgcctccaagaaactgcacagcagtatggggcgatcgcagaagtgctgctcaagctggaatatttgaatccgctcgggagtgtcaaagaccgcaccgctttgagcttgatccagtcggcgcgatcgcagggtctgatcaccgccggcaccaccctaatcgaaccgaccacgggcaacaccggcattggcttagcctttgccgcggcggctgaacagttgcggctgattctggtcatgcccgatcgcgtcagtgcggagcggatccgcttggctaaactgctgggcgccaaggttgttctcacaccggctgctgaagcgatgctgggctgtattgccaaagctcaggctttgcaacagcagattccggacagcgttattctgcagcagtttcaaaatccggcaaatcccagcattcatcaagcgaccaccggccctgagatttggcgcgataccgatggagaagtcgatatcgtcgtcgccggtgtcggaacaggcggaactctcatgggcatttcccgctatctcaagcccttgcgacctcgcttgcagagcattgccgttcaaccggcgcgatcgcccgttctctctggaggtgcagcgggatcgcatcagctgactggaatggggccaaactttgtctcccccttggtcgatcgcagcctgattgatgaaattctctcagcctatgaagaagacgcgatcgcagtcattcgcacctgcgctgcccgtgaaggaattcccctcggcgtttccagtggcgcaattgtttgggccgccttacaagttgccaaacgaccagaaaatgctggcaagcgtatcgtagcggtttgtccttccggcagtgaacgctatctctctagcactctgctcgccgacatcagccttgagagcgatgacgtctctgattgggtcgcaattccccaaggtcaagcatga

SEQ ID NO: 24824 - protein, 329 aa, Synechococcus sp
MPKILNRLTEWIGNTPLVRLQETAQQYGAIAEVLLKLEYLNPLGSVKDRTALSLIQSARSQGLITAGTTLIEPTTGNTGIGLAFAAAAEQLRLILVMPDRVSAERIRLAKLLGAKVVLTPAAEAMLGCIAKAQALQQQIPDSVILQQFQNPANPSIHQATTGPEIWRDTDGEVDIVVAGVGTGGTLMGISRYLKPLRPRLQSIAVQPARSPVLSGGAAGSHQLTGMGPNFVSPLVDRSLIDEILSAYEEDAIAVIRTCAAREGIPLGVSSGAIVWAALQVAKRPENAGKRIVAVCPSGSERYLSSTLLADISLESDDVSDWVAIPQGQA

SEQ ID NO: 24825 - DNA, 921 bp, Lactococcus lactis
  CDS (1)..(921)
atggtaaaaattgttgaaaatattactgaattagttggaaatagtccaattatcaaactaaaaaatggtccagaaaatggagcagaaatttatttaaaacttgaatattttaatcctggaggttcagttaaagaccggattgctttacaaatgattcggcaagccgaagcagatggtcgcttaaaaaagggaggaacgattgttgaacctacctctgggaacacaggaattggacttgccatggctggtgcagctttaggctataatgtggttattatcatgcctgatagttactcaaaagagcgtcgtcagcttattcaagcttatggagcagaattgattttgactccagcagctgatggcatcaaagctgccattgatttaggtcaaaaattagttgaagaaaatggttggtttatgccaatgcaatttgaaaatccagctaatttaaaagcccatgaattaacgactggtccagaaataattgaagcatttggtgaaaatggcctggacgcatttgttgcttgtgcaggcactgggggtacaatttctggcgtttctcactatcttaaaagtcaaaattctaaaatcaaaacttttgttgtcgaaccggcagaatcaccaattttaacaggaggtgagagtggtccacaccgcattcaaggaattggtattccatttatgtcaccaaatttagatacagaagcttatgatcgagtaattaatgtaacaagtgatgaggctttagagaccgcacgaaaaataggcaaaaatgaaggatttttagtaggtatatcttctggcgcagcaatttgggcagcttatgaattggcaaaaaaacttggcaaagatcaaaaagttctggctctttgtgctgacaatggtgagcgttatctttcaacagaactctatgattattaa

SEQ ID NO: 24826 - protein, 306 aa, Lactococcus lactis
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQLIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTEAYDRVINVTSDEALETARKIGKNEGFLVGISSGAAIWAAYELAKKLGKDQKVLALCADNGERYLSTELYDY

SEQ ID NO: 24827 - DNA, 1014 bp, Zymomonas mobilis
  CDS (1)..(1014)
atgaacattgcatcttcttctgtgcctaaaaaggccgaaaatattctttccatgattggcaacacatcgcttgttaggctggaaggccccagcgagctgacagggtgtaatatatatgccaaatgtgaatttactaatcctgggggatctatcaaagatagagccgctttgtcgattattgaagatgcagaagagcaggggattattgaacccggcggcgtaattgttgaaggcacaaccggcaataccggaattgggttaactttggtcggagcagccaaaggctatcataccattattgtcatgccggaaacccaaagttcggaaaagattgcgacccttcaggccttgggggctgaattggtcttggtgccggaaacctcttattccaatagcgcccattatgttcatatgtcgcggcggctggcgcaggagacagataacgcgatctgggcgaatcagtttgacaatctggcaaaccgaatggcgcatattaaaacaacttcgcaggaaatctgggcgcagacagaagggcatattgacggctttatctgtgcagccggaacgggcggtacctttgccggaaccggattaggtctgatagagcataatcccgatattgtggtggcgttggctgacccatatggggccgtttatataattattatactagcggtgaattgcgggcagaggggcattctatttgccgaaggatttggtcaaagtcgggttacaggcaatcttgatggcgcaccggttgataaccagtttttaattagcgatcaggaaggtttgcgcaaatctatcagttgcttcaaaaagagggattgtctgttgggctgtcgtcggggatcaatatcagcaggcgctattaaactcgcaaaagaattaggccccggaaaaacgattgttactattttggccgattctggattacgctatctctcgactttatataatcgccattggctgattgcgcatgatctgcctgttccagaatggctggctaaatag

SEQ ID NO: 24828 - protein, 337 aa, Zymomonas mobilis
MNIASSSVPKKAENILSMIGNTSLVRLEGPSELTGCNIYAKCEFTNPGGSIKDRAALSIIEDAEEQGIIEPGGVIVEGTTGNTGIGLTLVGAAKGYHTIIVMPETQSSEKIATLQALGAELVLVPETSYSNSAHYVHMSRRLAQETDNAIWANQFDNLANRMAHIKTTSQEIWAQTEGHIDGFICAAGTGGTFAGTGLGLIEHNPDIVVALADPYGAVYIIIILAVNCGQRGILFAEGFGQSRVTGNLDGAPVDNQFLISDQEGLRKSISCFKKRDCLLGCRRGSISAGAIKLAKELGPGKTIVTILADSGLRYLSTLYNRHWLIAHDLPVPEWLAK

SEQ ID NO: 24829 - DNA, 927 bp, Streptococcus suis
  CDS (1)..(927)
atggctatttatcaaaacattactcaattagttggaaaaacacctgttattaaactgaataatatcgttccagagggggcagcggaggtctatgtgaaattagaggcctttaacccaggatcttctgtaaaagaccgtatcgccttggctatgattgaagatgctgagaaggctggtacaatcaaacctggagatactattgttgagccaacaagtggtaacactggtatcggtcttgcttgggttggagcagcaaaaggttataatgtgattatcgtcatgcctgaaaccatgagtgttgagcgtcgtaagattatccaagcttatggagctgaacttgtcttgactcctggtagcgaagggatgaagggggctatcgccaaagcaaaagagattgctgaagaaaaaaatggctgggttcctttccagtttgctaatccatccaatccaaaagttcacgaagatacaacaggacaggaaattttggaagactttggcacaactggtttagatgcctttgtatctggcgttggtactggtggtaccgtttcaggtgtttcgcatgttttaaagacagcaaatccagatattgctatctatgctgttgaagctgatgaatcagctgtcttatctggtgaagcacctggtccgcacaagatccaaggtatttcggcaggttttattccagatactttggacactagcgcctatgatggcattattcgtgtcaaatccgatgatgccttagctacaggtcgtgctatcggtggaaaagaaggattcttagttggtatttcttcaggtgcagcaattcacgctgctatcgaagtcgctaaggagttgggaactggaaaaaaagtgttggcaatcttgcctgataacggtgagcgttacttgtcaacagctctttatgagttcaatgattaa

SEQ ID NO: 24830 - protein, 308 aa, Streptococcus suis
MAIYQNITQLVGKTPVIKLNNIVPEGAAEVYVKLEAFNPGSSVKDRIALAMIEDAEKAGTIKPGDTIVEPTSGNTGIGLAWVGAAKGYNVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 24831 - DNA, 1173 bp, Cyanidioschyzon merolae
  CDS (1)..(1173)
atggtccaacatgctgcgaacggacatgctcaatgctcttttcgccccctgcgatacaaagcagaaactcgaggccgggttgcgcgctcaacgcgcgagcgggttttgcttcgttgcctttttgatatgagactcgtacataacgtttatgactctttcgaggatgctataggaaacacgccgctgatcaagctaaggcgtgcctccgagcggactggctgcaacatctatggtaaagccgaatttatggaacccggcggatctgtgaaagaccgcgctgctctctaccttctcaccgacgctgaaaagcgagggacgctcaagctcggctcaattgtggtagaaggcacagcagggaacactggtatcggtttaacgctattgggaaactcccgcgggtatagaacggtgatagttattccagaaacacagtctgaggaaaagaaagagtttctccgatcctgtggtgccgagctcgtgcaagttccagctgcgccatacagaaacccgaacaactacgtacgcctgagcgagaggctagccaaggaacttggtgcattctgggcaaaccagttcgataaccctgcaaaccgcagagctcatgaggaaactaccggtccagaaatttgggatcaactcgatggtcatattgacgcgttcaactgtgctgtcggcactggcggcacgctggcgggggtcagtgcatttttgcgcgcaaagaatcctggcattaaaattgcactaacggatccgcaaggggccgctctcgtgcgatactatcaatgcggagagctcgtctccgtcggcgattctattaccgagggcattggtcaaagtcgaattactgggaaccttgaaggattcgtaccagatatgagcttcgagatcagtgatgcagaggcactgcaagcagcttatgatgtcgtgcggcacgaagggttgcacattggcctctcaagtggtatcaatattgccggcgcgatcagggttgcagagagtctcggccctgggcataccatcgtgacgatcctttgtgatggcggttctcgctatcaaaagaaaatgtttcagccgagttttctcgagcaaaagaaattgccgatccctacctggttgtcggattccatgaaaccagatttggctgctgcgctgtctaaagtgtatgtcccctga

SEQ ID NO: 24832 - protein, 390 aa, Cyanidioschyzon merolae
MVQHAANGHAQCSFRPLRYKAETRGRVARSTRERVLLRCLFDMRLVHNVYDSFEDAIGNTPLIKLRRASERTGCNIYGKAEFMEPGGSVKDRAALYLLTDAEKRGTLKLGSIVVEGTAGNTGIGLTLLGNSRGYRTVIVIPETQSEEKKEFLRSCGAELVQVPAAPYRNPNNYVRLSERLAKELGAFWANQFDNPANRRAHEETTGPEIWDQLDGHIDAFNCAVGTGGTLAGVSAFLRAKNPGIKIALTDPQGAALVRYYQCGELVSVGDSITEGIGQSRITGNLEGFVPDMSFEISDAEALQAAYDVVRHEGLHIGLSSGINIAGAIRVAESLGPGHTIVTILCDGGSRYQKKMFQPSFLEQKKLPIPTWLSDSMKPDLAAALSKVYVP

SEQ ID NO: 24833 - DNA, 1170 bp, Cyanidioschyzon merolae
  CDS (1)..(1170)
atgcttgtgtctaacgcaatgtacgttctggtgccgtgttcactcaaagctgcgcaagctactctccggaatcgaaaaaagaatagtacgtttgtgcgggcgaagcccgagcagaccaggattctcggatacgctcgtcgttcaccgcgtgctcgccagcgcgtgcagctggccttgactgcgccaccctcggtcgcgttggctcgcgacgtgtccgatctagtcgggaatacaccgattgtggagctcaagaaaattccggaagaggagggggtccaagcgcatatactatgtaagctggagtccatggagccctgctcgtccgtaaaagatcggatcggcaagtacatgatcgtcgaggctgaaaagcggggcgacatccagcccggaaaaacggtgctcatcgaaccaacatcaggcaatacgggaattgccctggcatatctcgctgcagctcgtggttaccgtctgattctgacgatgccagactctatgtccatagagcggcgaatggtgctgcgcgctttcggcgccgaagtggtactcacgccagccgccaaaggaatgaaaggagctgttgccaaagccgagcagttgtttcacaccactccaaatgcgtacatgcttcaacaattcaataatccggataacccgaaggcgcactacgagacaactgggcctgagatatgggccgcaaccggtggcaaggtggatgcttttgtcgctggagtcgggaccggtggcacggttactggtgctggccgttacctgcgcgagcaaaacccgcatgtctatatcatggcggtagagccggcggagtcaccggtgctcagtggcggccgaccgggcccgcacaaaatacaaggcattggagctggtttcgttccaggaattttggacaccaagatatacaacgaggtgaaacaggttacgagcatggattcaattgaaatggcacgacgtctcgcagttgaagaaggtcttctgtgtggtatctccagtggggctgctgtggttgcggcgctcgagcttggtcggcgacccgagatgaaaggcaagaatatcgtcgtcatcattccatcgttcggtgaacgctacttgacctcggcgctcttcgacaagcaacgtgaggaggcgtacaacatggtggccgtcgaggttgaaacctaa

SEQ ID NO: 24834 - protein, 389 aa, Cyanidioschyzon merolae
MLVSNAMYVLVPCSLKAAQATLRNRKKNSTFVRAKPEQTRILGYARRSPRARQRVQLALTAPPSVALARDVSDLVGNTPIVELKKIPEEEGVQAHILCKLESMEPCSSVKDRIGKYMIVEAEKRGDIQPGKTVLIEPTSGNTGIALAYLAAARGYRLILTMPDSMSIERRMVLRAFGAEVVLTPAAKGMKGAVAKAEQLFHTTPNAYMLQQFNNPDNPKAHYETTGPEIWAATGGKVDAFVAGVGTGGTVTGAGRYLREQNPHVYIMAVEPAESPVLSGGRPGPHKIQGIGAGFVPGILDTKIYNEVKQVTSMDSIEMARRLAVEEGLLCGISSGAAVVAALELGRRPEMKGKNIVVIIPSFGERYLTSALFDKQREEAYNMVAVEVET

SEQ ID NO: 24835 - DNA, 972 bp, Arabidopsis thaliana
  CDS (1)..(972)
atggaagatcggtgcttgatcaagaacgatatcactgaattgattggtaacacaccaatggtgtatctgaacaatgttgttgatggttgcgtggctcgtatcgctgcgaagcttgagatgatggagccttgttctagcgtcaaagacagaatcgcgtatagtatgatcaaagatgcagaagacaaaggattgattactcccggaaagagtacattgatagagccaactgctggtaacaccgggattggtttagcttgcatgggagctgcaagaggctataaagtgatccttgtgatgccttcaactatgagcttagagagaagaatcattctgagggcactaggtgcagagcttcatctctcggaccagcgcataggccttaaaggaatgttggagaaaactgaagcgattttaagcaaaactcctggtggttacattccacaacaatttgaaaatcctgcaaaccccgagattcattaccgaaccacgggaccggaaatatggagagattcagccgggaaagtagatatattggtcgctggcgtagggactggtggaactgctactggagtagggaagttcctcaaggagcagaacaaagacatcaaggtttgtgtggtggaaccagtagaaagtccggtacttagcggaggtcaaccaggtccacatttgattcagggaattggctctggtatcgtcccattcaatttggacttaaccattgttgatgaaattattcaagtggcaggtgaagaggctattgaaacagccaagcttcttgccctcaaagaaggattactggtgggaatatcctctggagccgcagcagcggctgcgttaaaggttgcaaagcggccagaaaacgcggggaaactcattgtggtggtttttcctagtggaggagaacgttatttatcgactaaactgttcgattcgattagatatgaagcagagaatttgcctattgaatga

SEQ ID NO: 24836 - protein, 323 aa, Arabidopsis thaliana
MEDRCLIKNDITELIGNTPMVYLNNVVDGCVARIAAKLEMMEPCSSVKDRIAYSMIKDAEDKGLITPGKSTLIEPTAGNTGIGLACMGAARGYKVILVMPSTMSLERRIILRALGAELHLSDQRIGLKGMLEKTEAILSKTPGGYIPQQFENPANPEIHYRTTGPEIWRDSAGKVDILVAGVGTGGTATGVGKFLKEQNKDIKVCVVEPVESPVLSGGQPGPHLIQGIGSGIVPFNLDLTIVDEIIQVAGEEAIETAKLLALKEGLLVGISSGAAAAAALKVAKRPENAGKLIVVVFPSGGERYLSTKLFDSIRYEAENLPIE

SEQ ID NO: 24837 - DNA, 1068 bp, Entamoeba dispar
  CDS (26)..(1036)
ctcgagaaatacattaataaaaataatggaacaaataagtattaattctccaagaaaaagaatttatcataacattcttgaaactattggaggtacaccattagttgaacttcatagagtaacagaacatccaacaattaagaaaggaacaagaatcttagttaaattagagtattttaatccaatgtcatcagtcaaagatcgtgttggattcaatattgtttatcaagctattaaaaatggaagattaaaaccaggaatggaaattattgaagctacttctggaaatacaggaattgcactttgtcaggctggagttgtttttggatatcgagttaatattgtaatgccatcaacaatgtcacttgaacgacaaatgattatgaaagcatttggagcagaattaattctaactgaaggaaagaaaggaattacaggagctattgaagaagttaacaaaaagttaaaagaaaatcctggaaaatattttgttgcaaaccaatttggtaatcctgataatactacatcacattattatactgctaatgagatttgggaagatacaaatggagaagttgatatcgttgtttctgctgttggaacatcaggaactgttattgggattgctgagaaattaaaagaaaagaaaaaaagaattaaaataatagcagttgaaccagaagaatcagcagtattagaaggtaaaccaaaaggaccacatggaattcaaggaattggagcaggttttattccagatatttataagaaagaatttgttgatgaaataataccaattaaaacacaagaagcatggaaaatggcaagaatagtagttaaatatgaaggaattatgtgtggaatgtcaagtggtgcagcaattttagcaggattaaaagaagcgggaaaatcagaaaacgaaggaaaaacaatagttattattgtaccatcatgtggagaacgatatttatcaacagaattatataaaattaaagatgaaggtacaaaaacacaaattcttgattctttattgaattaattattttaaattttaaaaaaaaaaaaaaaaaa

SEQ ID NO: 24838 - protein, 336 aa, Entamoeba dispar
MEQISINSPRKRIYHNILETIGGTPLVELHRVTEHPTIKKGTRILVKLEYFNPMSSVKDRVGFNIVYQAIKNGRLKPGMEIIEATSGNTGIALCQAGVVFGYRVNIVMPSTMSLERQMIMKAFGAELILTEGKKGITGAIEEVNKKLKENPGKYFVANQFGNPDNTTSHYYTANEIWEDTNGEVDIVVSAVGTSGTVIGIAEKLKEKKKRIKIIAVEPEESAVLEGKPKGPHGIQGIGAGFIPDIYKKEFVDEIIPIKTQEAWKMARIVVKYEGIMCGMSSGAAILAGLKEAGKSENEGKTIVIIVPSCGERYLSTELYKIKDEGTKTQILDSLLN

SEQ ID NO: 24839 - DNA, 1151 bp, Entamoeba dispar
  CDS (100)..(1110)
aaaaaagaaagatacaaatcatcaaaacgttttgtcaacgtcactttgaaatagtttgtgtttttaaatccatcacaaactttttggttgtaaataataatgcaaaatattactatcaacacaccaagaaagagaatctatcgtaacatccttgaaactattggaggtactcctttagttgaattacatggagtgaccgaacatcccactattaaaaaaaatacaaaagttcttgttaagttagaatgtttcaatccaatgtcatcagttaaggatcgtgttggatttaatattgtttatcaagctattaaggatggaagattaaaaccaggaatggaaattattgaagctacttctggaaatacaggaattggattatgtcaagctggtgctgtttttggatatccagtgaatatagtaatgccatcaacaatgtccattgaaagacaaatgatcatgaaagcatttggagctaatttagttctttcagatggaacaaaaggaatgccaggagctattgcaaaatatgaagaccttatcaaacaacatccaaataaatattttccagccaaccaatttggtaatcctgataatactgcagcacatatttatactgctaatgagatttgggaagatacaaatggagaagttgacattattgtttctgctgttggtactgcaggaactgttattggagttggcgagaatttgaagaagaagaaacaaggagttaaagttgttgctgtagaaccagaagaatcagcagttttatcaggaaaacctaaaggaccacatggaattcaaggaattggagcaggatttgttactgatatttataagaaagaagttgttgatgaaataataacaattaaaacacaagatgcatggaaaatggcaagagcaacagtaaaatatgatggaattatgtgtggaatgtcaagtggtgcagcaattttagcaggattaaaagaagcaggaaaagcagaaaatgaaggaaaaacaatagttataatattaccagattgtggtgaaagatatttatcgacagatttatataaaacagttgaagaaggaacaaaacaacaagtattagactcattattactttaaataaacaaattatttttgaattaaaaaaaaaaaaaaaaaaa

SEQ ID NO: 24840 - protein, 336 aa, Entamoeba dispar
MQNITINTPRKRIYRNILETIGGTPLVELHGVTEHPTIKKNTKVLVKLECFNPMSSVKDRVGFNIVYQAIKDGRLKPGMEIIEATSGNTGIGLCQAGAVFGYPVNIVMPSTMSIERQMIMKAFGANLVLSDGTKGMPGAIAKYEDLIKQHPNKYFPANQFGNPDNTAAHIYTANEIWEDTNGEVDIIVSAVGTAGTVIGVGENLKKKKQGVKVVAVEPEESAVLSGKPKGPHGIQGIGAGFVTDIYKKEVVDEIITIKTQDAWKMARATVKYDGIMCGMSSGAAILAGLKEAGKAENEGKTIVIILPDCGERYLSTDLYKTVEEGTKQQVLDSLLL

SEQ ID NO: 24841 - DNA, 1780 bp, Drosophila melanogaster
  CDS (66)..(1634)
tagcggtcgcttttcgcagttcgcgctagttagtcgctcctgggtcactaatcaccagcactgagatgccacaaccgaagccatacgagaggcccgcggacttcatcgatcccggcaagccgtccaagtgcaaatggcatctgggtacagccgagaagtcgccccacatccatcggggcatcgcccaccgccagcagattacgcccaacatcctcgaggtgatcggatgcacgccactggtcaagttgaacaacattcccgccagcgacggcatcgaatgcgagatgtatgccaagtgcgagttccttaatccgggtggatcagtgaaggaccgcattgggtaccgcatggtgcaggacgccgaggagcagggcctgctcaagccaggctacaccatcatcgaaccaacgtctggaaacacgggcattggactggcaatggcctgtgccgttaagggatacaagtgcattatcgtgatgccggagaagatgtccaacgagaaggtgtccgcgctgcgaaccctcggggccaagatcatacgtactccaacggaggcagcctacgattcgccggagggactgatctacgttgctcagcagctgcagcgggaaacgcccaactcgattgtcttggatcagtatcgcaacgctggcaatccgctggctcactacgatggcactgccgccgagattctgtggcagctggacaacaaggtcgatatgatagtggtctcggcgggaacggcgggaactatcagtggtattgggcgtaagatcaaggagcaggttcccagttgccagatagtcggcgtggatccctatggctcgatccttgcccgccctgctgagctcaacaagaccgatgtgcaattctacgaggtggagggcatcggctacgactttccgcccaccgtattcgatgacaccgtcgtggatgtgtggacgaaaatcggcgactcagactgtttccccatgagcagacgcctgaacgcggaggagggtctgttgtgcggcgggtccagtggcggagcgatgcacgctgccctcgagcatgcccgcaaattgaagaaaggccagcggtgcgtggtcattctgcccgatggcatacgcaactacatgaccaagttcgtgtcggacaactggatggaggcgcgcaacttcaaggagccggtaaacgagcacggtcactggtggtggagcctggccatcgcggagttggagctacccgctcccccggtcattctcaagtcggatgcaactgttggtgaggctattgccctgatgaagaaacaccgcgtggaccagctgcccgtcgtggatcaggatgatggttctgtcctgggcgtcgtgggtcaggagacgctgatcacgcagatcgtgagcatgaaccgccagcagtccgatcccgcaatcaaggcgctcaacaaacgagtaatccgactgaacgaatccgagattctgggcaagttggcccgcgtcctcgaagtggaccccagcgtgctcatcctgggcaagaacccggccggcaaggtggagctcaaagctctggccaccaagctggacgtgaccactttcattgccgccggcaagcagaagcccaaggccaatggcaccaccaacggcggcagccactaaactggagcgttctccagttcctgatctgtgtcctaaaaatccaaccacctacagactatgttacgcatttttaacttatacccgcatgcattttgattatatcaaataaagttttatcctaaagtatcaaaaaaaaaaaaaaaaaa

SEQ ID NO: 24842 - protein, 522 aa, Drosophila melanogaster
MPQPKPYERPADFIDPGKPSKCKWHLGTAEKSPHIHRGIAHRQQITPNILEVIGCTPLVKLNNIPASDGIECEMYAKCEFLNPGGSVKDRIGYRMVQDAEEQGLLKPGYTIIEPTSGNTGIGLAMACAVKGYKCIIVMPEKMSNEKVSALRTLGAKIIRTPTEAAYDSPEGLIYVAQQLQRETPNSIVLDQYRNAGNPLAHYDGTAAEILWQLDNKVDMIVVSAGTAGTISGIGRKIKEQVPSCQIVGVDPYGSILARPAELNKTDVQFYEVEGIGYDFPPTVFDDTVVDVWTKIGDSDCFPMSRRLNAEEGLLCGGSSGGAMHAALEHARKLKKGQRCVVILPDGIRNYMTKFVSDNWMEARNFKEPVNEHGHWWWSLAIAELELPAPPVILKSDATVGEAIALMKKHRVDQLPVVDQDDGSVLGVVGQETLITQIVSMNRQQSDPAIKALNKRVIRLNESEILGKLARVLEVDPSVLILGKNPAGKVELKALATKLDVTTFIAAGKQKPKANGTTNGGSH

SEQ ID NO: 24843 - DNA, 1020 bp, Oryza sativa
  CDS (1)..(1020)
atggaggaaggaggcaggagagggatcccttctctgctaaattcatcgtcatcagatgaacatatcgccactgatatcactcagcttgtaggatggacgccactgatagagctgaaccggatcgtccgaaaagacggggtaaatgcccggattgttggcaaattggagtcataccaacccctctgctctgtcaaggatcgcagtgctctgagaatgattgaggatgcagaggagaaaggtctgatctcaccaggcgttacgacgctagtcgagccgacaagtggtaatcttggaataggtgtggcatacaatgctctgctcaaaggttacaggttcgttgcagtcatgcctgctgagtattcacttgataagcaaatgttgttgacgtatctaggggccgaggttattttaactgatcctacacttggttttcagggacaattagacaaagttgaacagatcaagaatgatatgcctaacgtacatcatcttgatcagtttaaaaatgcagcaaatcctgaagcacactttgtatggacagggcctgagatttggaaggatacggcaggcaaagtagatatctttgtggctggttctggcacaggaggaacaatttcaggtgtagggaaatatttgaagatgaaaaacccagcagttaaagtaatttgtgttgagcctgcggaaagccctgtaatttcaggtggtaagccttcgcggcataaaattcagggaatgggtccaggctttgtaccaaaaaacctggatatctcaatcgtcgatgagatcatcacagtaactgcacaagatgcaatggctaatgcaaagaggctggcaagagaagagggtttacttgtgggcatatcatccggagctaatttggcagcttgtctgaaggtggcatcgaggaaagaatatgagggaaagatgattgtaaccattttccctagtggtggtgaaagatacatgaactctgacctctttgcacaagcaagggaggagtgcagcgccatgaccttttga

SEQ ID NO: 24844 - protein, 339 aa, Oryza sativa
MEEGGRRGIPSLLNSSSSDEHIATDITQLVGWTPLIELNRIVRKDGVNARIVGKLESYQPLCSVKDRSALRMIEDAEEKGLISPGVTTLVEPTSGNLGIGVAYNALLKGYRFVAVMPAEYSLDKQMLLTYLGAEVILTDPTLGFQGQLDKVEQIKNDMPNVHHLDQFKNAANPEAHFVWTGPEIWKDTAGKVDIFVAGSGTGGTISGVGKYLKMKNPAVKVICVEPAESPVISGGKPSRHKIQGMGPGFVPKNLDISIVDEIITVTAQDAMANAKRLAREEGLLVGISSGANLAACLKVASRKEYEGKMIVTIFPSGGERYMNSDLFAQAREECSAMTF

SEQ ID NO: 24845 - DNA, 1758 bp, Fugu rubripes
  CDS (1)..(1758)
atggcaggttttcatagaatctctctgctatctgctttctctcaaagaggtgaaatgtctgcaaatggaaaacaggagactgacaaaggtgttcaggatgaagcacatagcgagggtccagaaagtgaactgaaggattggatccgtcctgaccgccccagcagatgcacctgggagctgggtgcacccgcctccaagtctcctcatagccaccaaccacgcatcaaaccccccagcatcctccccaacatcctgggaaacatcggaaacacacctctggttcgtctgaacaaaatcccaaagcagtttggaatcaagtgtgatatcttggtaaagtgtgagttcttcagtgcgggaggcagcatcaaggacaggattgccctgcggatggtggaagatgctgagagagccgggctgctcaaaccaggagacaccatcattgaacccacctctggcaacacagggatcggcctcgctctggtggcctcagtgaaaggctacaggtgtgttatcaccatgccagacaggatgagcatggagaaggtggacgtgttgaaagctttaggagcagaagtagtccacacaccgagttcggcaccgttcgattcaccagaatctcaggtgggtatggcctggtgtctaaagaacaagatccccaactcacacatcctagaccagtatcgcaatgcgagcaaccccttggcccactatgatgccacagctgaggagatactggagcagtgtgacggtaaattggacatgcttgtggctggaatcggcacaggcggcacgctgaccggtgtcgctcggaagttaaaggagaagtgtccaactattgttgctgtggaccctgagggttctctcctgatccattcagatgaccattgcaaaagcagttatgaggtagagggaattggatacgactttgtccccaccgtgttggacaaatcccttgtcgattacttctacaaagtgaacgataaggagacgttcaacatgtcccgcaggctgatcagggacgagggtctcctctgcggcggcagctccggctcagccatggctgcagctgtaaaggtggctcagcatctgaaggaaggacagcgctgtgtggtcatcctggccgactctgtccgcaactacatgtcaaagtttctcagtgacaaatggatgtctgagaaaggtttccttgtcccagaagccccagtggagcccaaaccctggtggtgggggacaactgtcaactgtctccacctctcgccacctttctccacgttaccatcggtgtcctgccaggaagccattgagatcctgaaggagcgagccatcgaccatctcccagtcgtggatgactcaggtctggcacaaagtgtggttaccacggacaccatcctgtcctctgtgtcctctgggagggtcaagctttcagaccccatctccaaagtggtctgcaaacctttcaaagaggtgcgcatgtccgacagcttggggttgctctcccaaatcctggaaacggaccgttttgccctggtggtgcaggagccccaacaaaataaatccaaggggtcagctcaccaggagaagatgttgagtgttgtgacagcgatggagctcctcagctacatcacggctaaacgtgagcaggtcgttcttcctgcgagcacttcccagacacaactacaccatccacccttccgaggtcttaggatgttgcaaggtgacctgttaaaaaagccaacagccttttatctcactgtataa

SEQ ID NO: 24846 - protein, 585 aa, Fugu rubripes
MAGFHRISLLSAFSQRGEMSANGKQETDKGVQDEAHSEGPESELKDWIRPDRPSRCTWELGAPASKSPHSHQPRIKPPSILPNILGNIGNTPLVRLNKIPKQFGIKCDILVKCEFFSAGGSIKDRIALRMVEDAERAGLLKPGDTIIEPTSGNTGIGLALVASVKGYRCVITMPDRMSMEKVDVLKALGAEVVHTPSSAPFDSPESQVGMAWCLKNKIPNSHILDQYRNASNPLAHYDATAEEILEQCDGKLDMLVAGIGTGGTLTGVARKLKEKCPTIVAVDPEGSLLIHSDDHCKSSYEVEGIGYDFVPTVLDKSLVDYFYKVNDKETFNMSRRLIRDEGLLCGGSSGSAMAAAVKVAQHLKEGQRCVVILADSVRNYMSKFLSDKWMSEKGFLVPEAPVEPKPWWWGTTVNCLHLSPPFSTLPSVSCQEAIEILKERAIDHLPVVDDSGLAQSVVTTDTILSSVSSGRVKLSDPISKVVCKPFKEVRMSDSLGLLSQILETDRFALVVQEPQQNKSKGSAHQEKMLSVVTAMELLSYITAKREQVVLPASTSQTQLHHPPFRGLRMLQGDLLKKPTAFYLTV

SEQ ID NO: 24847 - DNA, 1511 bp, Dictyostelium discoideum
  CDS (1)..(1494)
atgtcagcaccagaaggaccatcaaaatgcacttggactccaaataccactgaaaacactccacataccaccagaagaactccaaagaaattaattatggataatattcttgataatattggtggaacaccattagttagagttaataaagtttcatcagatttagaatgtgaattagttgcaaaatgtgaatttttcaatgcaggtggttcagttaaggatcgtattggtcatcgtatgattgttgatgcagaagagagtggtagaattaagaaaggagatacattaattgaaccaacctctggtaacactggtattggtttagcattgacagcagccatcaaaggttacaaaatgatcattacactcccagagaaaatgtcacaagagaaagttgatgtcttgaaagcattgggaggagagatcattcgtacaccaactgaagcagcatttgatgcaccagagtcacatattggtgttgcaaagaaattaaattcagagattccaaattcccacattttagatcaatacggtaacccatccaatccattggcccattacgatggtaccgccgaagaactcctcgaacaatgtgagggtaagattgatatgatcgtttgcacagccggtaccggtggtacaatcactggtattgccagaaagatcaaagaaagacttccaaactgtatcgtcgttggtgtcgatccacatggttcaattctcgctcaaccagaatcactcaacaataccaacaagagttacaaaatcgaaggtatcggttacgatttcattccaaacgttctcgaacgtaaattagtcgatcaatggatcaaaaccgacgataaggaatctttcatcatggctcgtcgtctcattaaagaagaaggtctcctttgcgctggtagttcaggttccgctatggttggtgcactcctagccgccaaacaattgaaaaaaggtcaacgttgtgttgtcttattagccgattccattagaaactatatgaccaaacatttaaatgatgattggttagtcgacaatggtttcgttgatccagaatacaaaactaaagatcaacaagaagaagagaaatatcatggtgccaccgtcaaagatttaacactcccaaaaccaatcaccatctctgccaccaccacttgtgctgccgcagttcaactcctccaacaatatggtttcgatcaattaccagtcgttagtgaatcaaaaaaagttttggtcaactcactcttggtaacttctctcacatatgcctctaaaaaagctgtcccaactgatgctgtcagtaaagttatgttccgtttcactaaaaatgaaaaatatattccaatcactcaatcaacttctttagctactcttagcaaatttttcgaaaatcatagcagtgctatcgtaactgaaaatgatgaaatcatttcaattgtaactaaaattgatttattaacttatttaatgaaatctcaacaaaaaaattaaaaataaaataaaataaa

SEQ ID NO: 24848 - protein, 497 aa, Dictyostelium discoideum
MSAPEGPSKCTWTPNTTENTPHTTRRTPKKLIMDNILDNIGGTPLVRVNKVSSDLECELVAKCEFFNAGGSVKDRIGHRMIVDAEESGRIKKGDTLIEPTSGNTGIGLALTAAIKGYKMIITLPEKMSQEKVDVLKALGGEIIRTPTEAAFDAPESHIGVAKKLNSEIPNSHILDQYGNPSNPLAHYDGTAEELLEQCEGKIDMIVCTAGTGGTITGIARKIKERLPNCIVVGVDPHGSILAQPESLNNTNKSYKIEGIGYDFIPNVLERKLVDQWIKTDDKESFIMARRLIKEEGLLCAGSSGSAMVGALLAAKQLKKGQRCVVLLADSIRNYMTKHLNDDWLVDNGFVDPEYKTKDQQEEEKYHGATVKDLTLPKPITISATTTCAAAVQLLQQYGFDQLPVVSESKKVLVNSLLVTSLTYASKKAVPTDAVSKVMFRFTKNEKYIPITQSTSLATLSKFFENHSSAIVTENDEIISIVTKIDLLTYLMKSQQKN

SEQ ID NO: 24849 - DNA, 1280 bp, Brassica juncea
  CDS (74)..(1042)
atttgacgattttattccatataccttcttcattctctttctcactcgcgagtgaagcttgcttgcttgaatcatggcatctcgaattgctaaagatgttaccgaattgattgggaacactccattggtgtatctgaacaatgtggctgaaggatgtgttggtcgtgtcgctgctaagctcgagatgatggaaccttgctccagtgtcaaagacaggattggttttagcatgatctctgatgcagagcaaaagggtctgatcaaaccaggagagagtgtgctgattgagccaacgagtggaaacaccggagttgggttagcgttcacggcggctgccaaggggtacaagctcatcattactatgccagcttcaatgagtgtggagagaaggatcattctcttagcttttggagttgagttggtcttaactgaccctgctaaggggatgaaaggcgctatcgcaaaggccgaagagattttagccaaaacacccaatggttacatgctccaacagtttgagaaccctgccaacccaaagatacactatgagactactggacctgagatatggaaaggcactgatggaaaaatcgatggatttgtttctgggattggtactggtggtaccatcacaggtgcagggaagtatctcaaggaacagaaccctaacgttaagctgtatggagtggagccaattgaaagtgctattctatccggtgggaagccaggccctcacaagattcaagggattggtgctggctttataccaagtgtgttggaggttgatcttatagatgaagttgttcaagtttcaagtgatgaatccatcgacatggcaaggcttcttgctcttaaagaaggtcttcttgtgggaatatcatctggtgcagcagcggccgcagcaatcaaacttgcaaagaggccagaaaatgctgggaagctttttgtggcggtgttcccgagtttcggagagaggtacctgtcgactgtactattcgatgccacaaggaaagaagcagaatcaatgaccttccaggcttgaattgtctcatcttaaaatttctcaatttcttttcatttgagacgccaaaaataaaagagagatgttcagttttctcctaaagagaatcttcatcttcagtttcagtgcgtcttttgtgtttctgtatctttgtgtgagaataataatcaatctagatttcctctgttttcatttgtgaagaacacattctgtcaataagtttgagttttactttgaaaaaaaaaaaaaaaaaaaaaaa

SEQ ID NO: 24850 - protein, 322 aa, Brassica juncea
MASRIAKDVTELIGNTPLVYLNNVAEGCVGRVAAKLEMMEPCSSVKDRIGFSMISDAEQKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQA

SEQ ID NO: 24851 - DNA, 1290 bp, Oryza sativa
  CDS (74)..(1039)
gtcgacccacgcgtccgcaaggaggagcaaggattgttgttgtttcgctgtcagatcgattcctgacgggataatgggtgagaccatcgccaaggatgtcaccgagttgattgggaacacgccgttggtgtacctcaaccgggtgacggatgggtgcgtcgggcgcgtcgcggccaagctcgagtccatggagccatgctccagcgtcaaggataggattggatacagtatgatcactgatgcagaggagaaggggctgatcactccaggcaagagtgtgctgattgagccaactagtggcaacacaggcattggactggccttcatggctgctgcaaagggttacaggcttgtactcacgatgccggcctccatgagcatggagaggagaatcatattgaaggcttttggtgctgaattgatacttactgacccactcttgggaatgaaaggagctgtccaaaaggcagaagaactggcagcgaagacaaacaactcatttatcctccaacaattcgagaaccctgctaacccaaagatccattacgagaccactggacctgaaatctggaaaggaacaggaggtaaagttgatggtttagtttctggtattgggacaggtggcactattactggaactggacgatacctcagagagcaaaatcctgatatcaagatctatggtgtggagccagtcgagagcgctgtcttatctggtggaaagcctgggccacacaagattcaaggaattggagctggttttgttcctggggtcctggatgttgacctcatcaatgaaactgtacaagtttcaagtgatgaagctatcgagatggcaaaggctcttgcattgaaagaagggttgctggttggaatatcttcaggtgcagctgcagcagcagctgttaggctcgctcagaggccggaaaatgaaggaaaactttttgttgttgtcttcccaagctttggtgagcggtacctttcgtcggtgctcttccagtccatcaagaaggaagctgaaaacatggtggttgaatgaaatgcacaatatccgggaatccacaggaataaaagtttggtatctctgcttgtgtgattaaacatacattgtcctgccattttcaagttgttctgcttgtgtagcaatggggaacacagtgtgttagccttgtagtgttaaacagtttacattttatcttccctgtatatcagaaccctttacatgggcatttgtcagccagtgtgaatgaaataaagcatcatatgatttgtctcaaaaaaaaaaaaaaa

SEQ ID NO: 24852 - protein, 321 aa, Oryza sativa
MGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGTGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 24853 - DNA, 1238 bp, Brassica juncea
  CDS (18)..(992)
gtgaagcttgaatcgtcatggcctctcgtattggtattgctaatgatgtgaccgaattgattgggaacactccgttggtgtatctgaacagtgttgctgaaggatgtgttggtcgcgttgccgctaagcttgagatgatggaaccctgctccagcgtcaaagacaggattggttttagcatgatctctgatgcagagaaaaagggtctgattaaaccaggagagagtgtgttgattgagccaacgagtggaaacacgggagttgggttggcattcacggcggctgccaagggctacaagcttattattaccatgccagcttcaatgagtattgagagaagaatcattctcttagcctttggtgttgagttggttttaactgacccggccaagggcatgaaaggcgctatcgcaaaggcggaagagattttggccaaaacacccaatggttacatgctccaacagtttgagaaccctgctaacccaaagatccactatgagactactggacctgagatttggaaaggcactgagggtaaaatcgatggctttatttctgggattggtactggtggtaccataacaggtgctgggaagtatctcaaggaacagaacccgaacgttaagctgtatggtgtggagccagtcgaaagcgctattctatctggtggaaagccaggccctcacaagattcaagggataggtgctggttttataccaaatgtattggagactaatcttattgatgaagttgttcaagtttcaagtgatgaatccatcgacatggcaaggcttcttgctcgcgaagaaggtcttcttgtgggaatatcatccggtgcagcagctgcagcagcaatcaaacttgcaaagaggccagaaaacgccgggaagcttttcgtggcagtgttcccaagtttcggagagaggtacctgtcgaccgtactgttcgatgccacaaggaaagaagcagaatccatgaccttcgaggcttgaatagtctcagctggaaaagacaaatctccatttctttggttagagacgccaataataaaaaaggatgttcagtttctccaaaagagaatgttcatcctcatcttcagtttcaatgcgtctttgtttttttatttctgtatcttttgtgtgtgtgagaacaaaactcaaaactctatttcttcttgtgaacgaatcacttgctgttaataaagtttgaatttgctgaaaaaaaaaaaaaaaaaaaaa

SEQ ID NO: 24854 - protein, 324 aa, Brassica juncea
MASRIGIANDVTELIGNTPLVYLNSVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTEGKIDGFISGIGTGGTITGAGKYLKEQNPNVKLYGVEPVESAILSGGKPGPHKIQGIGAGFIPNVLETNLIDEVVQVSSDESIDMARLLAREEGLLVGISSGAAAAAAIKLAKRPENAGKLFVAVFPSFGERYLSTVLFDATRKEAESMTFEA

SEQ ID NO: 24855 - DNA, 1363 bp, Oryza sativa
  CDS (139)..(1116)
gacccacgcgtccggcctcgttcgtcctccggttttctccgcagtttcttgatccatccgcctttcctctcgcagccgtcggcggggggagtggttagttggttactggcttgcagagttttcagagagatttaggcaatggcggaatcaggccaatcgattgcgagtgatgtgactgcactgatcggcaatactcccctggtgtacctgaacaaggtggtggatggatgtgaggcccaaatcgctgccaagcttgagatcatggagccctgctccagtgtcaaggataggattggttatagcatgattacagatgcagaagagaagggtctcattactccaggaaagagtgttttgattgagcctactagtggaaatactggtattggccttgctttcatggctgctgccaagggttataagctaatcctgacaatgccagcatccatgagcatggaaaggaggatcattcttaaggccttcggtgccgagttggtccttaccgatccacttctgggcatgaaaggtgcaatccagaaggcagatgagctggcagcaaagatgcctaactcttacattctccagcagtttgagaaccctgcaaacccaaagatccactatgagacaactggacctgagatttggaaggccactgctgggaaagttgatatccttgtctctggcattggaaccggtggtacagtaaccggaacaggaaagtacctcaaggagcagaaccctgagatcaagatctatggtgttgaaccgacagaaagtgcaattttatctggaggaagacctggtccacacaaaatccaaggtataggtgctggttttgttcctggtgtacttgatgtcaatctcctggatgaagtggtccaagtctcaagtgatgaagccatcagcatggcgaagcagctagcgttgaaagaagggctgctggttgggatctcatctggtgctgctgcagtcgctgccatcagggtcgcgcagcggcccgagaacaaagggaagctcgtagttgtggtcttcccgagcttcggtgagcgctacctgtcgtctgtcctcttcgaatcgatcaagagggaggccgaaaacatggtgttcgagccatgaacggctccagcattgtgcaaattgtgcttccatggtttagggggcttggagagaatggcgtcccgagtgcatttcttcatgttggtcgcacttgccatcatgtagtcgcttgatctgaataaagaacttacatacatcaatcaaagtctggggattcgatcagctttcctggtgttatatgagcagttcatatgtgtactttcttccaaaaaaaaaaaaaaaaaaaaaaaaaaaaaaaaaaaaaaaa

SEQ ID NO: 24856 - protein, 325 aa, Oryza sativa
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMVFEP

SEQ ID NO: 24857 - DNA, 969 bp, Buchnera aphidicola
  CDS (1)..(969)
atgaataaaatatatgaagataattctttcactattggaaatacaccacttgttcgtttaaacaatataggaaacggaaacattttagcaaaaatagaatctagaaatccaagttttagtgtgaaatgtagaattggtgctaatatgatatgggacgcagaaaaaaagggacgtttaaataaaaacatagaaataattgaagcaactagtggtaatacaggaatagctttagcatatgttgcagcggcgagaaattattcattaactcttataatgcctgattctatgtctatagaaagaagaaaattattaaaatctttaggtgcacatttaatactaacaaatggaaaacacggtatgaaaggtgctatatctaaagcaaatgaaattgtatctttaaatacaaaacgttatcttttattaaaacaatttgaaaatccagccaatccagaaatacatcaaaaaaccactggtccagaaatttggaaagacaccaaaggcaatatagacatattaatttcaggcgtaggtacaggaggaactattacaggaattacaaaatatataaaaataaaagaagggaaaaaagacttaattagcgttgccgttgaacctttagaatcacctgtaattacacaatttttatcaggaaaaaaaataaaaccaggattacataaaatacaaggaataggagcaggttttattcctaaaaatttagatttatcattaattgacagaatcattacagtatccagcgaagaagcaatatttaatgctaaaaaaataatgaaaaaggaaggaatattatcaggaatttcttcaggtgcagctatagcagcggctttaaaaatacaaaaagaaaatgattttaaaaataaaaatatagtagttatattaccttcttcaggagagcgttatttaagtacagagttattttctagatcatttaaaaatgaaaacaattattaa

SEQ ID NO: 24858 - protein, 322 aa, Buchnera aphidicola
MNKIYEDNSFTIGNTPLVRLNNIGNGNILAKIESRNPSFSVKCRIGANMIWDAEKKGRLNKNIEIIEATSGNTGIALAYVAAARNYSLTLIMPDSMSIERRKLLKSLGAHLILTNGKHGMKGAISKANEIVSLNTKRYLLLKQFENPANPEIHQKTTGPEIWKDTKGNIDILISGVGTGGTITGITKYIKIKEGKKDLISVAVEPLESPVITQFLSGKKIKPGLHKIQGIGAGFIPKNLDLSLIDRIITVSSEEAIFNAKKIMKKEGILSGISSGAAIAAALKIQKENDFKNKNIVVILPSSGERYLSTELFSRSFKNENNY

SEQ ID NO: 24859 - DNA, 942 bp, Staphylococcus epidermidis
  CDS (10)..(942)
gtgttttggatggcacaaaaacctgtagattatgttacacaaattattgggaatacacctgtagtcaaattaagaaacgttgttgatgatgatgcagctgatatttatgttaagttagaatatcaaaatccaggtggttcggtaaaagatcgtatcgctttagcgatgattgaaaaagctgagcgtgaagggaaaattaaacctggtgatacaatcgttgagcctacgagtggtaacactggtataggtctagcatttgtatgtgctgccaaggggtacaaagcagtttttacaatgcctgaaacaatgagccaagagcgccgtaacttattaaaagcttatggtgctgaactagtattaacaccaggatctgaagctatgaaaggtgcaataaaaaaagctaaagaattaaaagaagagcacggctattttgaaccacaacaattcgaaaatccagcaaatcctgaaattcatgaacttacaactggaccagaattagttgaacaatttgaaggtcgacaaattgatgcatttttagctggtgtaggaactggtggtacgttatctggtgttggtaaagtattgaagaaagaatatccaaatgtggaaatagtagctattgaacctgaagcttctccagtattaagcggtggtgaaccaggccctcataaattacaaggattgggagcaggtttcgtacctgatactttaaatacagaagtttatgacagcatcatcaaagtaggtaatgatactgctatggatatggcacgtcgtgttgctagagaagaaggtatattagcaggtatttcatctggtgctgcaatatatgctgctattcaaaaagcaaaagaattaggtaaaggtaaaacagttgtaacagtattaccaagtaatggggaacgttacttatcaacaccattatattcatttgataattaa

SEQ ID NO: 24860 - protein, 310 aa, Staphylococcus epidermidis
MAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 24861 - DNA, 1459 bp, Arabidopsis thaliana
  CDS (1)..(1215)
atggctttcgcgtctccttcgctccgtcttcttcctcagtctccgttaggtcgaataacatctaaactacaccgtttcagtactgcgaaactctcactcttctcctttcaccatgattcttcatcttctttggctgtcagaactccggtatcttccttcgtcgtcggcgctatctccggaaaatcctctaccggaacgaaatcgaaatccaaaaccaaacggaaaccacctcctcctccgccagtcactactgtggctgaagagcaacacattgctgagtcagagacagtcaacattgccgaagatgtcactcaattgattggaagcacaccaatggtctatctcaatagagtcacagatggttgtttggctgacattgctgccaagctcgaatcaatggagccctgtagaagcgtcaaagataggatcggtctgagcatgatcaacgaggcagaaaacagcggagctataactccgaggaagactgtattagtagaaccaacaaccggaaacactggccttgggattgcatttgtggctgcagctaaaggctacaagcttatagtgacaatgccagcttctatcaatattgaaaggaggatgcttttacgtgcactaggagcagagattgtgctaacgaatccagagaagggtctcaaaggagcagtggataaagccaaagagattgttctcaagacaaagaacgcatatatgtttcagcaattcgacaatacagcaaatacaaagatccactttgaaactacaggaccagaaatctgggaagatacaatgggtaatgtcgatatattcgttgccggaataggaactggtggtactgtaactggtactggaggtttcttgaaaatgatgaacaaggatattaaggtagttggcgttgaaccatcagaaagaagtgtgatttctggagacaaccctggttacttaccgggaatcttggatgttaaattacttgatgaagtgtttaaggttagcaacggggaagcgattgagatggcgaggagactagctttagaggaaggattgctggttgggatttcatctggagctgctgcagtagcagcagtcagcttggctaaaagagcagagaatgccggtaaactaatcacggttctgtttccaagccatggcgagcggtatatcacaacggctctgtttagttccatcaacagagaagtccaagagatgagatattagtagcagccattagaaaagcccccaaagtttggtccttttggagagtgtaaacaacaaatctctttgcaatacagaaaagagaggtttcagaagactgtgaggttagagctcacacgagaactgagagataaacatgtctcgagcccaaccagttttattcaaagatttgtgaatgtatagaagatcatagaccttgttgcattattcttcttcttctcactcatatgtcagggaagtatgctga

SEQ ID NO: 24862 - protein, 404 aa, Arabidopsis thaliana
MAFASPSLRLLPQSPLGRITSKLHRFSTAKLSLFSFHHDSSSSLAVRTPVSSFVVGAISGKSSTGTKSKSKTKRKPPPPPPVTTVAEEQHIAESETVNIAEDVTQLIGSTPMVYLNRVTDGCLADIAAKLESMEPCRSVKDRIGLSMINEAENSGAITPRKTVLVEPTTGNTGLGIAFVAAAKGYKLIVTMPASINIERRMLLRALGAEIVLTNPEKGLKGAVDKAKEIVLKTKNAYMFQQFDNTANTKIHFETTGPEIWEDTMGNVDIFVAGIGTGGTVTGTGGFLKMMNKDIKVVGVEPSERSVISGDNPGYLPGILDVKLLDEVFKVSNGEAIEMARRLALEEGLLVGISSGAAAVAAVSLAKRAENAGKLITVLFPSHGERYITTALFSSINREVQEMRY

SEQ ID NO: 24863 - DNA, 24 bp, Primer
atgagtaagatttttgaagataac

SEQ ID NO: 24864 - DNA, 25 bp, Primer
ttactgttgcaattctttctcagtg

SEQ ID NO: 24865 - DNA, 333 bp, Escherichia coli K12
  CDS (1)..(333)
atggaaaccgtggcttacgctgattttgcacgtctggaaatgcgcgtcggaaagattgtggaagtgaaacgccatgaaaacgccgacaagctgtacatcgtacaggttgatgtggggcaaaaaacgctgcaaaccgtgaccagcctggtgccgtactacagcgaagaagagctgatggggaaaacggtggtggtcttatgcaatctgcaaaaagcgaaaatgcgtggtgaaacgtcggaatgcatgctgttgtgtgcggaaaccgatgacggcagtgaaagcgtgctgttaacgccggagcggatgatgcctgcgggcgtacgcgtcgtataa

SEQ ID NO: 24866 - protein, 110 aa, Escherichia coli K12
METVAYADFARLEMRVGKIVEVKRHENADKLYIVQVDVGQKTLQTVTSLVPYYSEEELMGKTVVVLCNLQKAKMRGETSECMLLCAETDDGSESVLLTPERMMPAGVRVV

SEQ ID NO: 24867 - DNA, 1068 bp, Mus musculus (house mouse)
  CDS (64)..(996)
gaggctgctcaagagctgcggttgggtcaccgcttcatgtttctctgccgattctggggaaagatggcaacgaatgatgctgttctgaagaggctggagcagaagggtgcagaggcggatcagatcatcgaatatctcaagcagcaggttgctcttcttaaggagaaagcaattttgcaggcaacaatgagagaagaaaagaaacttcgagttgaaaatgctaaactgaaaaaagaaatagaagagctaaagcaagagctgattctggcagaaattcataacggagtggagcaagtgcgtgttcgattgagtactccactgcagacgaactgtactgcttctgaaagtgtggtgcagtctccatcagtagcaaccaccgcctctcctgctacaaaagagcagatcaaagcgggagaagaaaagaaggtgaaagagaagactgaaaagaaaggagagaaaaaggagaagcagcagtcggcagcagcaagtactgactccaagcctatcgacgcatcgcgtctggatcttcgaattggttgtattgttactgccaagaagcaccctgatgcagattcactgtatgtggaggaagtagatgtgggagaagcagccccgcgcacggtcgtcagcgggctggtgaatcatgttcctctagaacagatgcaaaatcgtatggtggttttactctgtaatctgaagcctgcaaagatgcggggagttctgtctcaagccatggtgatgtgtgccagttcaccagagaaagtggagattctggcccctcccaacgggtccgttcctggggacagaattacttttgatgcttttcctggagagcctgacaaggagctaaaccctaagaagaagatctgggagcagatccagcctgacctgcacaccaatgctgagtgtgtggccacatacaaaggagctccctttgaggtgaaggggaagggagtttgcagagcccaaaccatggccaatagtggaattaaataagtgctctgtaactgaaagacattggcgaaaacttaataacaataaagagaagtgtgtttatcacttacatat

SEQ ID NO: 24868 - protein, 310 aa, Mus musculus (house mouse)
MATNDAVLKRLEQKGAEADQIIEYLKQQVALLKEKAILQATMREEKKLRVENAKLKKEIEELKQELILAEIHNGVEQVRVRLSTPLQTNCTASESVVQSPSVATTASPATKEQIKAGEEKKVKEKTEKKGEKKEKQQSAAASTDSKPIDASRLDLRIGCIVTAKKHPDADSLYVEEVDVGEAAPRTVVSGLVNHVPLEQMQNRMVVLLCNLKPAKMRGVLSQAMVMCASSPEKVEILAPPNGSVPGDRITFDAFPGEPDKELNPKKKIWEQIQPDLHTNAECVATYKGAPFEVKGKGVCRAQTMANSGIK

SEQ ID NO: 24869 - DNA, 1953 bp, Helicobacter pylori
  CDS (1)..(1953)
atgcaaaaatcactgatcacaacccccatttattatgtgaatgacatccctcatattggccatgcttatacgactttgattgcggacactttaaagaagtattacacgctccaaggcgaagaagtcttttttttaaccggcaccgatgagcatgggcaaaagatcgaacaaagcgcgaggcttaggaatcaaagccctaaagcttacgccgatagcattagcacgatttttaaagaccagtgggattttttcaatttggattatgatggttttatccgcaccacagacagcgaacatcaaaaatgcgtgcagaacgcctttgaaatcatgtttgaaaaaggggatatttataaaggcgcttatagcgggtattattgcgtgagctgtgagagttattgcgcgatctctaaagcggacaacacgaacgataaagtcctatgccctgattgcttgagagagaccacgcttttagaagaagagagttattttttcagattgagcgcgtatgagaagcctttgttggatttttacgctaaaaatcctgaagcgattttgcccgtttatcgtaaaaatgaggtaacttcttttattgagcagggtttattggatctgtctatcacgcgcacgagctttgaatggggcattcctttgcctaaaaaaatgaacgatcctaaacatgtggtgtatgtttggttggatgctttattgaattatgcgagcgcactagggtatttgaatgatttagacaataaaatggcgcattttgaatgcgctaggcatattgtgggtaaggatattttacgcttccatgccatttattggccggcttttttgatgagtttgaatttgcccctattcaaacagctttgcgtgcatgggtggtggacgatagagggcgtgaaaatgagtaagagcttgggtaatgttttagacgctcaaaaaatcgctatggagtatgggattgaagaattgcgctattttttattgcgtgaggtgccttttgggcaagacggggatttttctaaaaaagcgttaatagaaaggatcaatgcgaatttgaataacgatttggggaatttgttgaatcgtttgctaggcatggctaaaaaatatttcaatcattctctaaaaagcacaaaaatcaccgcttattattctaaagagctagaaaaagtgcatcaaattttagataacgctaattcttttgtgcctaaaatgcaattgcataaagctttagaggaattgtttaatgtttatgattttttaaacaaactcatcgctaaagaagagccatgggttttgcacaaaaacaacgaatcagaaaaactagaagccttattgagtttgatcgcaaacgcgcttttgcaatcaagctttttgctctatgcgttcatgccaaagagcgctgtgaaattagcgaatgctttcaacacagaaatcacgcccgataattacgaacgcttttttaaagctaaaaaattacaagatatgattttacaagacaccgagcctttattttccaaaatggagaaaattgaaaagacggaaaaagcgggagaagcctcaccagaaaaaaacgaaaaagaaaaaaaggacgcaaaagaaaaagccccactaaaacaagaaaactatatcggcattgaggatttcaaaaaagtagagatcaaagtggggcttatcaaagaagctcaaaggattgaaaaatccaataaattactgcgcttaaaagtggatttaggcgaaggccgtttgaggcagattatttcagggatcgctttggattatgagcctgaaagcttggtgggtcaaatggtgtgcgtggtggctaatttaaaacccgcaaagcttatgggcgaaatgagtgagggcatgattttagcggtgcgagatagcgacaatctagccttaattagccccactagagaaaaaattgcaggaagtttgatcagctaa

SEQ ID NO: 24870 - protein, 650 aa, Helicobacter pylori
MQKSLITTPIYYVNDIPHIGHAYTTLIADTLKKYYTLQGEEVFFLTGTDEHGQKIEQSARLRNQSPKAYADSISTIFKDQWDFFNLDYDGFIRTTDSEHQKCVQNAFEIMFEKGDIYKGAYSGYYCVSCESYCAISKADNTNDKVLCPDCLRETTLLEEESYFFRLSAYEKPLLDFYAKNPEAILPVYRKNEVTSFIEQGLLDLSITRTSFEWGIPLPKKMNDPKHVVYVWLDALLNYASALGYLNDLDNKMAHFECARHIVGKDILRFHAIYWPAFLMSLNLPLFKQLCVHGWWTIEGVKMSKSLGNVLDAQKIAMEYGIEELRYFLLREVPFGQDGDFSKKALIERINANLNNDLGNLLNRLLGMAKKYFNHSLKSTKITAYYSKELEKVHQILDNANSFVPKMQLHKALEELFNVYDFLNKLIAKEEPWVLHKNNESEKLEALLSLIANALLQSSFLLYAFMPKSAVKLANAFNTEITPDNYERFFKAKKLQDMILQDTEPLFSKMEKIEKTEKAGEASPEKNEKEKKDAKEKAPLKQENYIGIEDFKKVEIKVGLIKEAQRIEKSNKLLRLKVDLGEGRLRQIISGIALDYEPESLVGQMVCVVANLKPAKLMGEMSEGMILAVRDSDNLALISPTREKIAGSLIS

SEQ ID NO: 24871 - DNA, 336 bp, Pseudomonas aeruginosa
  CDS (1)..(336)
atggacatcatcgaatggcaggatttcgaacgcgtcgaactgcgcgtcggcaccatcctcagcgccgctcccaaccccaaggcacgcaaacccgcctatgtcctcgaggtcgacctcggaccgctcggcctgcgcacctccagcgcgcaactgaccgcacactaccaggccgagcaactggtcggacgccaggtcctctgcgtctgcaacttcgctccgaagcagatcgccggggtgcgctcggaggtcctggtcaccggggtctacgatagcgaggacaaggtggtcctggccggcttcgacaagcccctgcccaacggtgcgcgcctggcctga

SEQ ID NO: 24872 - protein, 111 aa, Pseudomonas aeruginosa
MDIIEWQDFERVELRVGTILSAAPNPKARKPAYVLEVDLGPLGLRTSSAQLTAHYQAEQLVGRQVLCVCNFAPKQIAGVRSEVLVTGVYDSEDKVVLAGFDKPLPNGARLA

SEQ ID NO: 24873 - DNA, 489 bp, Sulfolobus solfataricus
  CDS (1)..(489)
atggtctttccctcagaaatcttgttaacttccattacgacaattttacataaccgatataaaaagttagcttcaaataagtataaacttttacttcattatgtaaatcaaaatccttataattcttcaccaatgcttaacatcatgagtaatcaaattacaatagacgattttgcaaaattagaccttaaggttggaattgtgagacaagctgaaaggattgaaggaacaagattactaaaactattgattgacttgggttcagaacaaaggcaaataattgcgggtttaggagaatattataccccagaggagttattgaacaagaggataatagttatagccaatttaaagcctagagtgataagaggttttgagagccaaggtatgttattggccgctggatgtaaagaggatgaagcgaaaggaataaaacccagaatactaactgtagacggagaagttcctccaggaactaagatatgttaa

SEQ ID NO: 24874 - protein, 162 aa, Sulfolobus solfataricus
MVFPSEILLTSITTILHNRYKKLASNKYKLLLHYVNQNPYNSSPMLNIMSNQITIDDFAKLDLKVGIVRQAERIEGTRLLKLLIDLGSEQRQIIAGLGEYYTPEELLNKRIIVIANLKPRVIRGFESQGMLLAAGCKEDEAKGIKPRILTVDGEVPPGTKIC

SEQ ID NO: 24875 - DNA, 1935 bp, Clostridium acetobutylicum
  CDS (1)..(1935)
atgtcagagaagaaaaagttttatattacaacacctatttattatccatctgcaaagcttcatataggtaatacatatacaacagttgcgtcagatgcgcttgtaagattcaaaaggcttcaaggctatgatgcctttatgcttacaggaacagatgagcatggacaaaaaattcagagaatagcagaagataagggaattactccaaaagcttatgttgatgaaatagttgcaggaataaaggatttatggaagatgatgaacataagctatgataagtttataagaactacagacgaagagcatgtaaaagcagttcagaaaatagttaaaaaattctatgataatggagacatatataaatcagcttatgaaggctggtactgtactccttgtgagtccttctggacagaaactcaacttgtggatggaaagtgtcctgattgtggaagaccagtagaaaagacaaaggaagaagcttatttcttcaaaatgtcaaaatatgctgatagacttataaaatatatagaagatcatcctgattttatacagcctgaatctagaaaaaatgagatgctcaataatttcttaaaaccaggtcttcaagatttatgtatatcaagatcctcttttgattggggaattccaataacttttgatgaaaagcatgtaatttatgtttggatagatgcactttcaaactacataacagctttaggttatggaagtgataatgatgaactttataataaattttggccagctgatttacaccttgtaggaaaagatataataagattccatactatatattggccaattatgttaatggctttagacttgccacttccaaagcaagtatttggtcacggctggttattggttgatggaggaaaaatgtcaaaatccaaaggaaatgttgtagatccagtagtactaataaatgaatttggaacggatcctgttaggtattatcttcttcatgaaataccatttggttcagatggtttgtttaacaatgagatatttataaagaaaataaattcagatcttgcaaatgatcttggaaatttggtttcaagaactgctgctatgattgaaaagtattttgatggttcaattcaacctccagttgataaggaagaaattgataatgaacttattgatatggctataagtcttcctgaaaaattggatgaagacataaagaaactgaaaataccagaagcacttgatcatatatgggatctcataaagagagcaaataagtatatagatgaaacaactccatgggttcttgctaaggatgaaaataagaaggcaagacttggtactgtattatataatttagtagagagtttaagatttgttgcgacaacattaactccattcttacctgaaacaggagagaaaataaagacacaacttaatatagaacttgatacatgggaaagtctttctgcttttgatggaactcgtgcaggtactaaggtttcaaagggagaagtaatattccctagaatagatgttgataaaaaaatagaagaacttaataaattaaaagaagagcagcttaaggctactagaaaaatgcagcctttaaaacctgaaataagcatagatgatgttgataagttggatttaagagtagttaaggttttagaatgtgagccagttaaaaaatctaaaaaacttcttaagcttaaggttgaactaggtggagaagaaagacaggttctatctggaatttctcaattctataaaccagaagatcttattggaaagaaagttgttcttgtagctaatttgaaacctgcaaaattaatgggtcagctttcacaaggaatgatacttgctgttgcaactgacgatgacagtaaattatatactttagatataccagaagatataccaactggaagtattgtaagataa

SEQ ID NO: 24876 - protein, 644 aa, Clostridium acetobutylicum
MSEKKKFYITTPIYYPSAKLHIGNTYTTVASDALVRFKRLQGYDAFMLTGTDEHGQKIQRIAEDKGITPKAYVDEIVAGIKDLWKMMNISYDKFIRTTDEEHVKAVQKIVKKFYDNGDIYKSAYEGWYCTPCESFWTETQLVDGKCPDCGRPVEKTKEEAYFFKMSKYADRLIKYIEDHPDFIQPESRKNEMLNNFLKPGLQDLCISRSSFDWGIPITFDEKHVIYVWIDALSNYITALGYGSDNDELYNKFWPADLHLVGKDIIRFHTIYWPIMLMALDLPLPKQVFGHGWLLVDGGKMSKSKGNVVDPVVLINEFGTDPVRYYLLHEIPFGSDGLFNNEIFIKKINSDLANDLGNLVSRTAAMIEKYFDGSIQPPVDKEEIDNELIDMAISLPEKLDEDIKKLKIPEALDHIWDLIKRANKYIDETTPWVLAKDENKKARLGTVLYNLVESLRFVATTLTPFLPETGEKIKTQLNIELDTWESLSAFDGTRAGTKVSKGEVIFPRIDVDKKIEELNKLKEEQLKATRKMQPLKPEISIDDVDKLDLRVVKVLECEPVKKSKKLLKLKVELGGEERQVLSGISQFYKPEDLIGKKVVLVANLKPAKLMGQLSQGMILAVATDDDSKLYTLDIPEDIPTGSIVR

SEQ ID NO: 24877 - DNA, 2028 bp, Yersinia pestis
  CDS (1)..(2028)
atggctcaagtcgcgaaaaaaatattggtgacgtgcgcgctaccatacgctaacggttctattcatctcggccacatgctcgagcatatccaggcagacatctgggtccgtttccagcgaatgcgcggcaaccaggttcattttatctgtgcagatgatgcccacgggactcctatcatgctgaaagctcagcaaatgggtattgaaccagagcagatgattgccgaaatgagccaggagcaccaacaggatttcgccggttttgctatcagttatgataactatcactccacccacagtgatgaaaaccgtgaactgtcgagcctgatctatggccgtctgaaagccaacggttatataaagaaccgtactatttctcagctctatgatcctgagaaaggcatgtttctgcccgatcgtttcgtgaaaggcacttgcccaaaatgcaaagccccggaacagtacggcgataattgtgaagtctgtggcgcaacctacagcccaactgaacttatcgaccccaaatccgccgtttctggtgcgacaccagtgatgcgtgaatctgaacacttcttcttcgatttaccggctttcagtgacatgttgcaagcctggacacgctcaggtgcgctgcaagaacaagtcgcaaacaaaatgcaggaatggtttgattccggcctgcaacagtgggatatcacgcgtgatgccccttatttcggtttcgaagtaccggatgcaccgggtaaatatttttacgtctggttagatgccccaatcggttacatgggggcgtttaaaaacctatgtgataaacgtggtgacctggattttgatgaattctggggtaaagacgccaaaactgacctctatcacttcatcggtaaagatattgtttacttccacagtctgttctggccagccatgttggaaggcagtaacttccgcaagccgacaaacctgtttgtccatggctatgtcacggtaaacggcgcgaaaatgtctaaatctcgcggtacgtttattaaggcggggacttacctgaaatatctggatgcggattgcctgcgttactactacgcggcgaaactctcttcgcgtattgatgatatcgatttaaatctggaagatttcgtccaacgcgttaacgccgatatcgttaataaagtggtgaatctggcctcacgtaatgctggttttatcaataaacgctttgcaggccagttagctgaccaattggctgacccggtgttgtataaaacattcaccgatgccgcaaccagtattgctgatgcttataacaaccgtgagtcaggtaaagccattcgtgaaattatggcgctagctgatgtggctaatcgctatgttgatgaacaggctccatgggtggtcgctaaacaagaaggccgcgatgccgatctacacgctatctgctcgatggggatcaacctattccgtgtcctgatgacctatctgaaaccggtattaccctctctgacagagcgtaccgaggccttcctcaataccgagctaacttgggatagcattgaacaacctctgctgggccactctatcaccgctttcaaggcactgtttaatcgtattgatttagacaaagtaaacgaaatggtcgcctcgtctaaagaagatatggcacctgcaaccagggttacaggcccgttagccgatgatccaattcaggaaaccatcagttttgatgactttgccaaagttgatatgcgaattgcgttgattcaacaagccgaatttgttgaaggctcagataagttattaaaactaacacttgaacttggaggggagacccgccaggtattctcgggtatccgttcagcttaccctgacccaaaagccttggaaggccgcatgaccgtgatggtcgctaaccttgccccgagaaaaatgcgctttggggtttcagaaggcatggtgatggccgcaggccccggaggtagcgatatcttcctgcttagccctgacagtggtgcgcagccaggcatgcaagtgaagtga

SEQ ID NO: 24878 - protein, 675 aa, Yersinia pestis
MAQVAKKILVTCALPYANGSIHLGHMLEHIQADIWVRFQRMRGNQVHFICADDAHGTPIMLKAQQMGIEPEQMIAEMSQEHQQDFAGFAISYDNYHSTHSDENRELSSLIYGRLKANGYIKNRTISQLYDPEKGMFLPDRFVKGTCPKCKAPEQYGDNCEVCGATYSPTELIDPKSAVSGATPVMRESEHFFFDLPAFSDMLQAWTRSGALQEQVANKMQEWFDSGLQQWDITRDAPYFGFEVPDAPGKYFYVWLDAPIGYMGAFKNLCDKRGDLDFDEFWGKDAKTDLYHFIGKDIVYFHSLFWPAMLEGSNFRKPTNLFVHGYVTVNGAKMSKSRGTFIKAGTYLKYLDADCLRYYYAAKLSSRIDDIDLNLEDFVQRVNADIVNKVVNLASRNAGFINKRFAGQLADQLADPVLYKTFTDAATSIADAYNNRESGKAIREIMALADVANRYVDEQAPWVVAKQEGRDADLHAICSMGINLFRVLMTYLKPVLPSLTERTEAFLNTELTWDSIEQPLLGHSITAFKALFNRIDLDKVNEMVASSKEDMAPATRVTGPLADDPIQETISFDDFAKVDMRIALIQQAEFVEGSDKLLKLTLELGGETRQVFSGIRSAYPDPKALEGRMTVMVANLAPRKMRFGVSEGMVMAAGPGGSDIFLLSPDSGAQPGMQVK

SEQ ID NO: 24879 - DNA, 1995 bp, Listeria innocua
  CDS (1)..(1995)
atgcctgaagagaaaaatacgttttatattacaacaccaatctattatccaagcggaaaagcgcatatcggacatgcttatacgactgttgcgggggacgcgatggctcgttataaacgcttaaaaggatatgatgtgttttacttaactggaacagatgaacacggtcagaaaatccaagcaaaagcaaaagaacgcgggatttctgaacaagaatacgtggatgaaattgcagaaggtttccaagaactttggaaaaaactagaaatttctaatactgattttattcgtacaacacaagaccgtcataaaacatccgtagaaaaaatctttgaacaacttttagagcaaggcgacatttacttaggtgaatacgaaggttggtactctgtttctgatgaagaatactttacagaaacacaattagaagaagtatacaaagatgaaaatggtaaagtaatcggcggaaaagctccaagtggtaacgaagtcgagcttgttaaagaagaatcctactttttccgcatgagcaaatacgcggatcgtttagtagaatattataactcgcacccagaatttatcctacctgaatccagaaaaaatgaaatgattaacaatttcatcaagcctggcttagaggatttagcagtatctagaaccacttttgattggggtattaaagttcccggaaatccaaaacacgttgtttatgtgtggattgatgcgctttctaactatattactgcgcttggatataatacggacaatgatacgaaattccaaaaatactggcctgctgatgtacaaatcgttgggaaagaaattgttcgtttccatacgatttattggccaattatgttgatggcactagacttaccacttccaaaaatggtattcggtcatggctggattttgatgaaagacggtaaaatgtcgaaatctaaagggaatgtagtagatccttacatgttgattgaccgctacggactagacgcgcttcgttactatttattacgtgaagttccatttggttcagatggtttatttacaccggaagactttgttgaccgcgtaaactatgatcttgctaatgacttaggaaacttacttaatcgtacagttgcaatgattaataaatactttgatggtgaaattccagcttatcaaggtaatgtaacagaattcgatcaaacattagtagatttcaaaaataacgtcgtgaaagaatacgaaggtagtatggaccatatgcagttttcagtagcattaaaccaactatggtcactaatttctcgtacaaataaatatattgatgaaactgctccatgggcactagctaaagaggaagataagcgtacagaactagcgagcgtaatgacacatttagctgaaaacttacgtatcatcgcagttttacttcaaccattcctaacaagaactccaggtgaaatcttcttacaactaggcttgcaagaagaaaacttgaagaaatgggatagcatctatggctacggcgaaattccagaaggtacaacggtagtgaaaaaaggtacgccaattttcccaagactcgatgcagaagtcgaagttacttatattcaagatgaaatgaaaggctctgcaccagctcctgctgaagaaactgcagaagttgaagcacttgaaaccccgcaaatcggtattgaagatttcgacaaaattgatcttcgggttgcggaagtaaaacaagtagacaaagtgaaaaaagcagataaacttctttgtttccaattagacttaggtgaaggtaaactacgccaagttctttcaggtattgcagaattctaccaaccagaagagttaattggcaaaaaagttatcgttgtttccaacttaaaacctgtgaaacttcgcggactaatgagcgaaggcatgattctctcaggagaaaaagatggaaaactaagcgtaattgaagcaaatagcgcacttccaaatggcgcaaaagtaaaataa

SEQ ID NO: 24880 - protein, 664 aa, Listeria innocua
MPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNYDLANDLGNLLNRTVAMINKYFDGEIPAYQGNVTEFDQTLVDFKNNVVKEYEGSMDHMQFSVALNQLWSLISRTNKYIDETAPWALAKEEDKRTELASVMTHLAENLRIIAVLLQPFLTRTPGEIFLQLGLQEENLKKWDSIYGYGEIPEGTTVVKKGTPIFPRLDAEVEVTYIQDEMKGSAPAPAEETAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEANSALPNGAKVK

SEQ ID NO: 24881 - DNA, 2205 bp, Borrelia burgdorferi (Lyme disease spirochete)
  CDS (1)..(2205)
atgaaaaaaatgaatctagttacagctgctctaccctatgttaataacatacctcatcttgggaatttagttcaagtgctatcagctgatgcttttgcaagatattcgaaaatgtcaggaattgaaactctttacgtctgcggaacagatgaatatggaacagctacagaaaccaaagccttaattgaaaatactacccctttagaactttgcaataaatattatgaaatacataaatcaatttacaaatggttcaatattgaatttgacatctttggtcgcacaaccaacaagaaccatcaagacattgtacaaaattttttcctacaattagaaaaaaacggctatataaaagagagagaaactgaacagttttattgcaataaagattcaatgttcttggctgatagatatgtaataggagaatgcccagaatgccaaagcatggctaaaggagatcagtgcgacaactgttctaaacttctaaatccaacagacctaataaatccaaaatgcataatttgtaaaaacaagcctattttaaaaaaaaccaatcatctttatttagatcttcccaaaataaaaacaaaacttgaaaaatggataaaaaatccagatactagcaagaattggaataccaatgcccttaaaatgacaaaggcttttttaagagatggccttaaagaaagggcaattacaagagacctgaaatggggaattcctgtgcctaaaaaaggttttgaaaataaagtattttatgtgtggtttgatgctccaataggatacatttcaattaccaaaaacattatcaaaaattgggaatcttggtggaaaaacaatgatcaagtaaatcttgtacaatttattgggaaagacaatatattgtttcatacaattatattcccttgcatagaaattggaagtgaagaaaattggacaatattaaatcaactctcatcaagcgaatacttaaattacgaaaatcttaaattttcaaaatcagaaggaacaggaatttttggaaacgatgctattactacaggaatcccctctgatatttggcgattttatatttattataacaggcctgaaaaatctgattttcaatttatgtggcaagatctcatggaaagagtaaatacagaacttattgataatttttcaaaccttgtaaacagagtattaacatttcaaagaaaattctttggagatgtaatagaaacaatagaaattcaaaataagttttggaaacaaataacaccaaaatataataaaatactaaatctttttaaaaagacagaactaaaatctgctctcaaagaaatacttaaaatttcttcccttggaaataaaatatttcaagataacgaaccctggaaaagaaaaaacaactctccacaagaaacaaaagaactaatctcaaacttaatatacctaatcagagacttatctattttaatgatgccattcattcccgaaacaagcaaaaagatacaacaattctttggcaacagttatcaattttcaaccaaaattcttggaactaaatcgggaattaaaaaaattgaattcacagaaatattattcaataaactagagcaaaaaaaaattaataatttaaagctaaaatattcaggagataaaaacatgaaagaaaacgaacaagcagaaaacttgcctatagcaaaagagcaaccggaaaacttgtttagagaaaaagtgctcttaagagttgtaaaaataaataaaatagaaagaaatcccgaggctaaaaacttatttatattaaaactagatgacggaactaacaaggataaacaaatagtaagcggccttgaaggatattacacagaagaagaacttttaggaaaacatataataatagtagacaatttaaagcctgcaaagtttaggggaataaaatctgaaggaatgctaatagctgctgaggacaaaaataaaaattttaaagttataattgtagaagattcaattcaaaatcctattgctggagagagaataatacttgaaaacgatcagaataaagatcttgcctgcccacctaaaattgacataaataagtttttaaaagccaatatagtagcagaaaacggagagcttaaaataaacggaataaatttaatattagaaaattctaagaacaaaattttatctaaagatattccaaacggaacagtttgctaa

SEQ ID NO: 24882 - protein, 734 aa, Borrelia burgdorferi (Lyme disease spirochete)
MKKMNLVTAALPYVNNIPHLGNLVQVLSADAFARYSKMSGIETLYVCGTDEYGTATETKALIENTTPLELCNKYYEIHKSIYKWFNIEFDIFGRTTNKNHQDIVQNFFLQLEKNGYIKERETEQFYCNKDSMFLADRYVIGECPECQSMAKGDQCDNCSKLLNPTDLINPKCIICKNKPILKKTNHLYLDLPKIKTKLEKWIKNPDTSKNWNTNALKMTKAFLRDGLKERAITRDLKWGIPVPKKGFENKVFYVWFDAPIGYISITKNIIKNWESWWKNNDQVNLVQFIGKDNILFHTIIFPCIEIGSEENWTILNQLSSSEYLNYENLKFSKSEGTGIFGNDAITTGIPSDIWRFYIYYNRPEKSDFQFMWQDLMERVNTELIDNFSNLVNRVLTFQRKFFGDVIETIEIQNKFWKQITPKYNKILNLFKKTELKSALKEILKISSLGNKIFQDNEPWKRKNNSPQETKELISNLIYLIRDLSILMMPFIPETSKKIQQFFGNSYQFSTKILGTKSGIKKIEFTEILFNKLEQKKINNLKLKYSGDKNMKENEQAENLPIAKEQPENLFREKVLLRVVKINKIERNPEAKNLFILKLDDGTNKDKQIVSGLEGYYTEEELLGKHIIIVDNLKPAKFRGIKSEGMLIAAEDKNKNFKVIIVEDSIQNPIAGERIILENDQNKDLACPPKIDINKFLKANIVAENGELKINGINLILENSKNKILSKDIPNGTVC

SEQ ID NO: 24883 - DNA, 2169 bp, Pyrococcus abyssi
  CDS (1)..(2169)
atggttcgctatatggttacttcagcccttccatacgctaacggcccaattcacgccggccacttagcaggtgcgtacctacctgccgacatttttgtacgctatctaaggttaaaaggagaggacgtagtattcatatgtggaaccgacgagcatggaacgccaatatcttttagagcccttaaagaaggaaggagtcccagggaaatagttgatgagttccatgagcagataaagataacgttccagagggccaagataagcttcgacttctttgggagaactgagttgccaatccactacaagctcagccaagagttcttccttaaggcttatgaaaatggacacctagtgaagaaggtcactaagcaggcttactgtgagcacgacaagatgttcttgccagataggttcgttattgggacgtgtccgtactgtggtgccgaggatcagaagggtgatcagtgtgaagtctgtggcaggcctttaaccccggagatactaattaatcccaggtgtgcaatctgtggaaggccgatatccttcagggactcggctcactactacataaagatgcaggacttcgctgagaggctaaagaggtggattgaaaaacaaccctggaagcccaacgttaagaacatggttctaagctggatagaggaagggctagaagagagggccataactagggatttaaactggggaatccctgtcccgttagatgaagaagacatgaagggtaaagtcctctatgtttggttcgaggccccaatagggtacatttctataacgatagagcacttcaagaggataggaaagccaaacgagtggaagaaatactggctgaacatagatgggcaaacccgggtgatacacttcatagggaaggacaacataccattccacgccatattctggccggccttcctcatggcgtacggtaagtataaagatgaagaggtagaggcggaatggaacttaccgtacgatataccggcgaacgagtacttgaccctcgaaggcaagaagttttcgacgagtagaaactgggcgatttgggttcatgaattccttgatgtgttccctgccgattaccttaggtattacttaacgacgataatgcccgaaacgagggacagcgacttcagcttctcggatttcaaggtgagaattaacgaggaactcgttaataatcttggtaacttcgttcacagggctttgaccttcgttaacaggtacttcgatggagttgttccagagaggggggagctagatgagcttgacagggaagcccttgaggagatagagaaagcctttaaagaggtcggggaactgataatgaactaccgcttcaaagacgcattaaagcgcgtaatgagcttggcatccttcggaaacaggtacttcgatcataagcaaccgtggaagactgcgaaagaagataaggttagaacggggaccaccgttaacatctccttgcagatagtaaaagctcttggaatcctacttgagccgttcttgccggacgcaagcgagaagatttggcaccttctcaacctagatgaggttaagaggtgggagttcagggagctccccgctgggcacaaggttagaaagcctgagatactcttcaagaaggttaccgatgaccagataatctacttcatattgaactacatggccaaaggtaatcccgagggagctagaattctgctcgacaagtactacaagagggaagacgttattagggtcgcgaaggagaagtttggagatgaagctgaggtagttcttaggagggtttacaaggatattaaattaaaagagaaaaaggaggggaaagagatgtacgtcaagtttgatgacttcgcaaagctcgatcttagggtggggaagataatagaggtcaaggatcaccctaacgcagacaagctctacgtcgtcaaggtagatctaggggacgaagttagaacgctagtcgctgggctcaagaaatattataagcccgaggagttgctgaataggtacgtagtcgttgtcgcgaatctagagccaaagaagctgaggggaatagggagccaggggatgctactggcggctgacgatggtgagagagttgctttactaatgccagacaaggaagttaagcttggagcgaaggtaaggtaa

SEQ ID NO: 24884 - protein, 722 aa, Pyrococcus abyssi
MVRYMVTSALPYANGPIHAGHLAGAYLPADIFVRYLRLKGEDVVFICGTDEHGTPISFRALKEGRSPREIVDEFHEQIKITFQRAKISFDFFGRTELPIHYKLSQEFFLKAYENGHLVKKVTKQAYCEHDKMFLPDRFVIGTCPYCGAEDQKGDQCEVCGRPLTPEILINPRCAICGRPISFRDSAHYYIKMQDFAERLKRWIEKQPWKPNVKNMVLSWIEEGLEERAITRDLNWGIPVPLDEEDMKGKVLYVWFEAPIGYISITIEHFKRIGKPNEWKKYWLNIDGQTRVIHFIGKDNIPFHAIFWPAFLMAYGKYKDEEVEAEWNLPYDIPANEYLTLEGKKFSTSRNWAIWVHEFLDVFPADYLRYYLTTIMPETRDSDFSFSDFKVRINEELVNNLGNFVHRALTFVNRYFDGVVPERGELDELDREALEEIEKAFKEVGELIMNYRFKDALKRVMSLASFGNRYFDHKQPWKTAKEDKVRTGTTVNISLQIVKALGILLEPFLPDASEKIWHLLNLDEVKRWEFRELPAGHKVRKPEILFKKVTDDQIIYFILNYMAKGNPEGARILLDKYYKREDVIRVAKEKFGDEAEVVLRRVYKDIKLKEKKEGKEMYVKFDDFAKLDLRVGKIIEVKDHPNADKLYVVKVDLGDEVRTLVAGLKKYYKPEELLNRYVVVVANLEPKKLRGIGSQGMLLAADDGERVALLMPDKEVKLGAKVR

SEQ ID NO: 24885 - DNA, 2046 bp, Deinococcus radiodurans
  CDS (1)..(2046)
atgcaaaatcccccccagcaccctgaggcccagtcccccgagacccgggaccgtgagtttttcatcaccgccgccatcgactatgccaacggcaccccgcacatcgggcacgtctacgaaaagattctggccgacgcgattgcccgttaccagcgcctcgccgggcgcgacgtgacgtttgtgatgggcaccgacgagcacggcgaaaaaatcagcaaggcggcggccaaagggggcgtgaccccgcaggagctggtggacgacctctcggagcgggcctttcagggcctgtggaaaaagctcggcatcagctacgacttttttatccgcaccacctcggccaagcacaagaaatatgtgcaggacgtgcttcagcgggtctacgatgcgggcgacatctactttgccgagtatgagggcctctactcggtgggcgccgagcgctacgtgaccgagaaggaactggtggaaggccccgacggcgtgcggcgcttccccggcgacaaggacccgcccgagctgcggcgcgaggccaactacttcttcaacatgcagaagtaccagccctggctgctggagaccttgcagcaaaaccccgacctgattcagcccgccggctaccgcaacgaggtgctggagatgctgaaagaggacatcggcccactgagcatcagccgccccaaggcgcgggtgccgtggggcatcgagctgccctgggacaccgaccacgtgacctacgtgtggttcgatgcgctgctgagctacctgacgccgctggtgagccaggggcaggacgccagcatgagcggcaaggcgtggcacgtcatcggcaaggacatcctcaagccgcacgcggtgttctggccgaccatgctgcgcgccgccgggctgccgctctaccgccgcttggtggtgcacagccacatcctcgccgaggacgggcgcaagatgggcaagagcctgggcaacgcgattgaccccgaagaactggttgccgcgtggccggtggacgccattcggtatgcgctgctgcgcgaggcgtcgctgggggccgacagtcccttcggtgagggcgtactggttagccgcctgaactcggacctcgccaacgacctcggcaacctgctttcgcgcaccgtgagcatgattcagaagtacagaggcggcgtgattccggcagcgaccgagccgaccgaccgcgaacgcgagattgaggcggcggcgcgcgccctcccagacgaagtgctgcggctggtggacgaactgaaaatcaatatggcgatcgacgccgcgatgagcttcgtgcgcgacctcaaccgctacatcgccgagtccacgccctggaccctcgccaagtcgccggagacgcagggccgcctcgacaccgtgctctacaccgccgccgaggggctgcgcgtagcgagtgtggcgctcgaagccgtgattccgaccaaggcgaaggaactgcgcgagcagctcggcctgggccgccaaggctaccccctgcaagccgcttggggcctgacccccgccggcacccgcgtgcagggcggcgccatcctgtttcccaagcccgagccgaaggcggacgaaacgaaaaacgccgaggccaagccccccaagccccaagccaagaaagagaaaaagaccgtgaccgacactgctcccgccaagaccaccgaacagaagcccgaagctgccgcccctgcccagaacgacggcctgatttcgatcgacgacttcgccaagatcgacctgcgaatcgccgaagtcgtggcctgtgaagcggtggaaaaggccgacaagctgctcaagctgaccgtcaagctcggcgacgagacgcgcacggtggtcagcggcatccgcaagtggtacgaacccgaagcgctggtgggccgcaaggtcgtgctggtcgccaatctcaagcccgccaagctgcgcggcatcgagtcgcagggcatgattctggcagcggaggacgacgccgggaacctcgacctggtgggaaccgagctggacctgccgagcgggaccaaagttcgttga

SEQ ID NO: 24886 - protein, 681 aa, Deinococcus radiodurans
MQNPPQHPEAQSPETRDREFFITAAIDYANGTPHIGHVYEKILADAIARYQRLAGRDVTFVMGTDEHGEKISKAAAKGGVTPQELVDDLSERAFQGLWKKLGISYDFFIRTTSAKHKKYVQDVLQRVYDAGDIYFAEYEGLYSVGAERYVTEKELVEGPDGVRRFPGDKDPPELRREANYFFNMQKYQPWLLETLQQNPDLIQPAGYRNEVLEMLKEDIGPLSISRPKARVPWGIELPWDTDHVTYVWFDALLSYLTPLVSQGQDASMSGKAWHVIGKDILKPHAVFWPTMLRAAGLPLYRRLVVHSHILAEDGRKMGKSLGNAIDPEELVAAWPVDAIRYALLREASLGADSPFGEGVLVSRLNSDLANDLGNLLSRTVSMIQKYRGGVIPAATEPTDREREIEAAARALPDEVLRLVDELKINMAIDAAMSFVRDLNRYIAESTPWTLAKSPETQGRLDTVLYTAAEGLRVASVALEAVIPTKAKELREQLGLGRQGYPLQAAWGLTPAGTRVQGGAILFPKPEPKADETKNAEAKPPKPQAKKEKKTVTDTAPAKTTEQKPEAAAPAQNDGLISIDDFAKIDLRIAEVVACEAVEKADKLLKLTVKLGDETRTVVSGIRKWYEPEALVGRKVVLVANLKPAKLRGIESQGMILAAEDDAGNLDLVGTELDLPSGTKVR

SEQ ID NO: 24887 - DNA, 2109 bp, Xylella fastidiosa
  CDS (1)..(2109)
atgccatactcgcaccccctggtaccactctccttcatgaccacagcacttgtcaccaccgccctgccttacgccaatggtccactgcacctcggccatctggtcggctacattcaagctgacatctgggtacgcgcacggcgcctgggaggacacaacacctggtttgtttgcgccgacgacacccacggcaccccgatcatgctggccgcagaaaaagcgggcatgccgccggaagcctttatcgccaccacccaagccagccatgaacgcgactttgcggccttcaacgtcgcctttgaccactacgactccacacattcccccgtcaaccgccacctgaccgaacagtcttacctcacactcaaacaggccggacatatcacatgccgctcggtcgcccaattttacgacccggccaaaggcatgttcctccccgaccgctacgtcaaaggaacctgtccaaactgcggcgcaaccgaccaatatggcgacaactgcgaagcatgcggtgccacctatgaccccacagaactcaaaaacccatactcggtgatctccggcacaaccccagaactgcgcgactcagaacacttcttttttgaagtggcccacttcgacaccttcctacgccattggctgagcggcgatgtcgccttgcctagcgtcaaaaacaaactcaaagaatggctagatgccaaaggcggcctacgcccctgggacatctcccgcgatgccccctacttcggcttcgaaatcccaaaccagccaggcaagtacttctacgtgtggctggatgcaccgatcggctacttatgcagcttcaaaaccttatgcacacgcattggcgaagacttcgacacacacctacgcagcggcaccacgacagaattgcatcattttatcgggaaagacatcgtcaacttccacgccctgttttggccggcagtgctgcacggcaccggccaccgcgcccccacccggctccatgtcaacggctacctgactgtggacggtgccaaaatgtccaaatcgcgcggcaccttcatcatggcgcgcacctaccttgatgctggcttggaaccagacgcactacgctactacttcgccgccaaatcctccggagacgtcgacgacctggaccttaacctgagtgacttcgttgcacgcgtcaacgctgacctagtcggtaaactcgtcaacctagccagccgctgcgcaagtttcattggcacgcgttttaacggacaactcgccgacaccctgccagaccgcatccaatatgatcaattcgttgcagcactgacccccatccgtgacgcttacgaacgcaacgacaccgccagcgcgatccgtcaaaccatgcagctagctgacgaagccaacaaatacattgacgagaccaaaccctggatcatcgccaaacaacacaatgccgacgcacagctacacgccgtctgcacacaaggattgaacctgtttcgcgtcctgatcaccgcactcaaaccaatcctgccgcacaccagcatccaagcggagacattcctcgctgcaccagtgacggcatggcaagacgtcaaccaaccactgatcggtggccacaccatccacccctactcccccttattcacccgcatcgataaaaaagtcattgaagtgatgatcaacgcctccaaagacaccctcgcccctccccctgcttcggccaaacaacaaaacgcatccatgtcaaacacagcaccaccacccactgcggaaaaaccggaaacaactgctcccaccattggtattgacgacttcgccaaactcgatctacgcatcggcaaagtactcgtgtgcgaatacgttgaagggtcagacaaactactgcgctttgaattggatgctggccccctgggcaagcgccagatcttctcaggaatacgcgccagctacagcaacccagagacacttattggccgcaacgtcgtgttcatcgccaacctagcaccccgcaaaatgcgctttgggatcagccaagggatgatcctctcagccggcttcgacagcggtacgctggcactgctagatgctgacagcagcgcccaacccggcatgccggtgcgttaa

SEQ ID NO: 24888 - protein, 702 aa, Xylella fastidiosa
MPYSHPLVPLSFMTTALVTTALPYANGPLHLGHLVGYIQADIWVRARRLGGHNTWFVCADDTHGTPIMLAAEKAGMPPEAFIATTQASHERDFAAFNVAFDHYDSTHSPVNRHLTEQSYLTLKQAGHITCRSVAQFYDPAKGMFLPDRYVKGTCPNCGATDQYGDNCEACGATYDPTELKNPYSVISGTTPELRDSEHFFFEVAHFDTFLRHWLSGDVALPSVKNKLKEWLDAKGGLRPWDISRDAPYFGFEIPNQPGKYFYVWLDAPIGYLCSFKTLCTRIGEDFDTHLRSGTTTELHHFIGKDIVNFHALFWPAVLHGTGHRAPTRLHVNGYLTVDGAKMSKSRGTFIMARTYLDAGLEPDALRYYFAAKSSGDVDDLDLNLSDFVARVNADLVGKLVNLASRCASFIGTRFNGQLADTLPDRIQYDQFVAALTPIRDAYERNDTASAIRQTMQLADEANKYIDETKPWIIAKQHNADAQLHAVCTQGLNLFRVLITALKPILPHTSIQAETFLAAPVTAWQDVNQPLIGGHTIHPYSPLFTRIDKKVIEVMINASKDTLAPPPASAKQQNASMSNTAPPPTAEKPETTAPTIGIDDFAKLDLRIGKVLVCEYVEGSDKLLRFELDAGPLGKRQIFSGIRASYSNPETLIGRNVVFIANLAPRKMRFGISQGMILSAGFDSGTLALLDADSSAQPGMPVR

SEQ ID NO: 24889 - DNA, 2070 bp, Halobacterium sp. NRC-1
  CDS (1)..(2070)
atgacagacgaggactaccccacggacgatccggcggtggtgacctgtgggctcccctatccgaccggggacttgcacatcggccacctgcggacgtacgtgagcggcgacgcgttcagtcgcgcgctccgaaagctcggccaggagacggtgttcgtctcggggacggacatgcacgggacgccgatcgccgtccaggccatcgaggccggggttgggccgctcgacctcgggctggagcgccacgagcagtacgccgacacgttcgaggagttcagcgtcgcgttcgacacctacggccacaccgacgaggagaccaacgtcgagctcaccagggagttcgtgggggcgtgggaggacaacgaccacgtctacgagacggagatccaggtggcgtacgaccccgacgccgaccagtggctgcccgaccggtacgtcgaggggacgtgtccgtactgcggggagcacgcgcgcggcgacgagtgcgacgagggctgccagcgccacctcgaaccgggggagatcgaggcgccggtgagcaccatcacgggcaacagcgcggagtaccacgagcgcgcgcacaagttcctccggctgtcggacttccaggagtatctggaggggttcatcaaccggatggaggggacgaacaacgcgaaaaaccagccccgcgagtggatcgagggcgggctggaggatttctgcatcacgcgggacctcgactgggggatcgactaccccggggagggtggcgacgacctcgtgttgtacgtctgggtcgacgcccccatcgagtacgtcgccgccacgaagcagtactccgagcgcgtgggcaccgaggagttcgactgggcgtccgtctggaaggacggcgacggcgagatcatccacgtcatcggccgcgacatcatccagcaccacaccgtgttctggccgtcgatgctggcgggcgcggactacgccgagccgcgggcggtgtgtgcgaccgggttcgtgaacatcgacgggcgggggttgtcgacgtcgaagaaccgcgccatctgggcggcggagtacctcgatgcggggttccatccggacctgctgcggtattacctggcgaccgcgagcggcttcgagcgcgacgtgaacttctcctgggcggagttcgcgcagcgcgtgaacacggagcttgcggacgccgtggggaacttcgcgtaccgggcgctgttgttcgcgaaccggaacttcgacggcaccccccaggaggtcagcctcacggacgacgtcgagacggagatcgcgcaggcgatggacgactacgaggacgcgctgaacgagtacgatctgcggaccgccggcgagcgcgcggtggcgctggcgcggttcggcaacgagtacatccagcacaacgagccgtggaacctcgacagcgaggcggccgcgccggtgatgcgggactgcgtgcagctcgtgaaggcggttgcagtgctcctgcagccgttcctgccggagaagaccgagaccctctgggcgcagctcggtgaggacgggcgtgtgagtgacgcgacgatcgcggactgcctgcaggcgccgcccgcggagttcggggagcccgcggagctgttcgagaagatcgaggacgaccgggtcaccgagctcgacgaggcgctggccgcgaagatcgaagctgctagtagcgaggacgccgatggggagggtatggccgacgagacagccgacgacgggatcgagctcgaaccgcttgccgaggacgatatcagcttcgaggagttccaggcgctggatctgcgggtgggggaggtcgtcgaggccgagggcatcgagggcgctgacgatctggcgcgcctcgaagtcgacatcggccacgaggtgcgccagatcgtcgccggcatcaagcagctccacgacctcgacgcgctgccggggacgcgggtggtggtggtggcgaacatggagccgtcggagctgttcggcgtggagtccaacgggatggtgttggcggccggggaggacgccgacctgctgacgacccacgaggacagcgagcccggcacgaaggtgatgtag

SEQ ID NO: 24890 - protein, 689 aa, Halobacterium sp. NRC-1
MTDEDYPTDDPAVVTCGLPYPTGDLHIGHLRTYVSGDAFSRALRKLGQETVFVSGTDMHGTPIAVQAIEAGVGPLDLGLERHEQYADTFEEFSVAFDTYGHTDEETNVELTREFVGAWEDNDHVYETEIQVAYDPDADQWLPDRYVEGTCPYCGEHARGDECDEGCQRHLEPGEIEAPVSTITGNSAEYHERAHKFLRLSDFQEYLEGFINRMEGTNNAKNQPREWIEGGLEDFCITRDLDWGIDYPGEGGDDLVLYVWVDAPIEYVAATKQYSERVGTEEFDWASVWKDGDGEIIHVIGRDIIQHHTVFWPSMLAGADYAEPRAVCATGFVNIDGRGLSTSKNRAIWAAEYLDAGFHPDLLRYYLATASGFERDVNFSWAEFAQRVNTELADAVGNFAYRALLFANRNFDGTPQEVSLTDDVETEIAQAMDDYEDALNEYDLRTAGERAVALARFGNEYIQHNEPWNLDSEAAAPVMRDCVQLVKAVAVLLQPFLPEKTETLWAQLGEDGRVSDATIADCLQAPPAEFGEPAELFEKIEDDRVTELDEALAAKIEAASSEDADGEGMADETADDGIELEPLAEDDISFEEFQALDLRVGEVVEAEGIEGADDLARLEVDIGHEVRQIVAGIKQLHDLDALPGTRVVVVANMEPSELFGVESNGMVLAAGEDADLLTTHEDSEPGTKVM

SEQ ID NO: 24891 - DNA, 1323 bp, Arabidopsis thaliana (mouse-ear cress)
  CDS (1)..(1323)
atggagataacgccgttagttggaagtccgttaggaccgttagttacatcaagcaaaaaccctatcgaagaaattgcagtgtgttttcttacagcgaagagccccaaagagaagaacaaaatttcgaaaatagagaaagagaagaagttgacgatggattcaaaggcgaagcagatgattctttcagctctctgcaaacacttctctttggatcctgaaccttttgtgggcggagcgggtgaaagtgatatcaagacactttattctaatgtattgaaggcatctggaaaggaagtatctgcacaaaacaacgatgttttgaagtggctagattttgcggaaggtttctcttcagattcaaaggattggttttcagctcttgaaaagttgaatttagagttagctaccaagtcagtgctcttgggaaacggattgacgccatcggcagctgatgttgctgtgttttcagctctgcattcttcagtgcttggcctctcagattcagacaaggagaaagtaccacatgtcataagatgggtgaattacatccagaataaagaagagttgtcgacattatttgcaccaatacctgtgaagctaccagaatttagcttcgaggtaccaaaacctgccattaaggtggaaacaaattctaattcaaaaaaagctgcagaaggtgtaaagcctgttgacaagccagatgtgcagccgcagctgggcacaaagaaaactgagccagaggaaccaaagaaaaatgcagcaaaagagaaggatgccaaaaaggaaaagaagaagcctgctgaaccagaaccagctaagaaagaggcagagcttagtgtcagtttgcttaacattcaggttggtctaattcgtaaagcatggaagcacccatcggcggatagtttgctggtggaagaaatagatgtcggggaggataaagtgagacaagtagttagtggcttagcaaagttctgcagtcctgaggatctaacgaaccgcctcgttgcactcatcacaaatgtcaaacctggaaagctaagagatgtaatgtcacaaggactggttctttgtgcttcaagtgaagatcactcggtggtagagccgttgctaccacctgctggtgctaaaccaggagagcgtgtttcattttcagggattgaaggaaagccagaagatgtactgaacccaaaaaagaagcaactagagaagataacaccgggtctctacactgatgaaaatggcgtagccacatacaaaggcatacaattcatgacctcggctggaccttgcacttccagcatccccaaggcgaccatcaagtag

SEQ ID NO: 24892 - protein, 440 aa, Arabidopsis thaliana (mouse-ear cress)
MEITPLVGSPLGPLVTSSKNPIEEIAVCFLTAKSPKEKNKISKIEKEKKLTMDSKAKQMILSALCKHFSLDPEPFVGGAGESDIKTLYSNVLKASGKEVSAQNNDVLKWLDFAEGFSSDSKDWFSALEKLNLELATKSVLLGNGLTPSAADVAVFSALHSSVLGLSDSDKEKVPHVIRWVNYIQNKEELSTLFAPIPVKLPEFSFEVPKPAIKVETNSNSKKAAEGVKPVDKPDVQPQLGTKKTEPEEPKKNAAKEKDAKKEKKKPAEPEPAKKEAELSVSLLNIQVGLIRKAWKHPSADSLLVEEIDVGEDKVRQVVSGLAKFCSPEDLTNRLVALITNVKPGKLRDVMSQGLVLCASSEDHSVVEPLLPPAGAKPGERVSFSGIEGKPEDVLNPKKKQLEKITPGLYTDENGVATYKGIQFMTSAGPCTSSIPKATIK

SEQ ID NO: 24893 - DNA, 1974 bp, Staphylococcus aureus
  CDS (1)..(1974)
atggctaaagaaacattttatataacaaccccaatatactatcctagtgggaatttacatataggacatgcatattctacagtggctggagatgttattgcaagatataagagaatgcaaggatatgatgttcgttatttgactggaacggatgaacacggtcaaaaaattcaagaaaaagctcaaaaagctggtaagacagaaattgaatatttggatgagatgattgctggaattaaacaattgtgggctaagcttgaaatttcaaatgatgattttatcagaacaactgaagaacgtcataaacatgtcgttgagcaagtgtttgaacgtttattaaagcaaggtgatatctatttaggtgaatatgaaggttggtattctgttccggatgaaacatactatacagagtcacaattagtagacccacaatacgaaaacggtaaaattattggtggcaaaagtccagattctggacacgaagttgaactagttaaagaagaaagttatttctttaatattagtaaatatacagaccgtttattagagttctatgaccaaaatccagattttatacaaccaccatcaagaaaaaatgaaatgattaacaacttcattaaaccaggacttgctgatttagctgtttctcgtacatcatttaactggggtgtccatgttccgtctaatccaaaacatgttgtttatgtttggattgatgcgttagttaactatatttcagcattaggctatttatcagatgatgagtcactatttaacaaatactggccagcagatattcatttaatggctaaggaaattgtgcgattccactcaattatttggcctattttattgatggcattagacttaccgttacctaaaaaagtctttgcacatggttggattttgatgaaagatggaaaaatgagtaaatctaaaggtaatgttgtagaccctaatattttaattgatcgctatggtttagatgctacacgttattatctaatgcgtgaattaccatttggttcagatggcgtatttacacctgaagcatttgttgagcgtacaaatttcgatctagcaaatgacttaggtaacttagtaaaccgtacgatttctatggttaataagtactttgatggcgaattaccagcgtatcaaggtccacttcatgaattagatgaagaaatggaagctatggctttagaaacagtgaaaagctacactgaaagcatggaaagtttgcaattttctgtggcattatctacggtatggaagtttataagtagaacgaataagtatattgacgaaacaacgccttgggtattagctaaggacgatagccaaaaagatatgttaggcaatgtaatggctcacttagttgaaaatattcgttatgcagctgtattattacgtccattcttaacacatgcgccgaaagagatttttgaacaattgaacataaacaatcctcaatttatggaatttagtagtttagagcaatatggtgtgcttactgagtcaattatggttactgggcaacctaaacctattttcccaagattggatagcgaagcggaaattgcatatatcaaagaatcaatgcaaccgcctgctactgaagaggaaaaagaagagattcctagcaaacctcaaattgatattaaagactttgataaagttgaaattaaggcagcaacgattattgatgctgaacatgttaagaagtcagataagcttttaaaaattcaagtagacttagattctgaacaaagacaaattgtatcaggaattgccaaattctatacaccagatgatattattggtaaaaaagtagcagttgttactaacctgaaaccagctaaattaatgggacaaaaatctgaaggtatgatattatctgctgaaaaagatggtgtattaaccttagtaagtttaccaagtgcaattccaaatggtgcagtgattaaataa

SEQ ID NO: 24894 - protein, 657 aa, Staphylococcus aureus
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMVNKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLTESIMVTGQPKPIFPRLDSEAEIAYIKESMQPPATEEEKEEIPSKPQIDIKDFDKVEIKAATIIDAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 24895 - DNA, 1977 bp, Archaeoglobus fulgidus
  CDS (1)..(1977)
atgaagctcgtcacctgcggcttaccttacgctaacggcaaggctcatgtcgggcacctcaggacgtacgttcccgctgacgtttacgtccgatatctcagaatgtcgggagaagaggttgttttcgtttgcgggagcgactgtcacggcacgccgattgttgtgaatgccgagcagcagggtttatcgccaaaggaacttgtggatatatatcacgagcacttcatcaagatttttgacgctttgaacataaaatttgacttctacggcagaacggacagcgattaccaccaccaccgcaccactgagatcgtgaaaaggctaatcgaaaagggctatgtttaccccaaggagattcagcttgcctactgccccaaatgccagagatttctgcctgaccgctacgttgaaggaatctgcccgtactgcggtgcattggcaaggggagatgagtgtgatcaggggtgtggaaggcatctggagccgggggagattaaggagccgaggtgtaagatttgcggcagcaaggccgagttcaggagccagaggcactactttttcaagctgaccgagtttcaggactttctggaggattatctgtccaaactgaagggcactgagaatgctctgaactacgccagaaattgggttaagaacctgagggactggtgcataaccagaaaccttgagtggggggtaaggtttccgggcgagccgaatctggtggtttacgtctgggttgatgcccccataggctacatcagctttactgagaaggcttgtgaggaaaagggatgtgactggcggaaaatatggattgatggcgatgctgagattatccactttataggcctcgacatcgtttaccaccactgcattttctggcctgcgatgctgaaaggagctgactacgcattgccttcagcggtggtggcgagcgggatggtcaaggttgagggcaaaaccttctcgaagtcgaggggctacgttgtctgggtggaggaggactacctgaagtcgggcctgagccctgattatctgagatactacattgtaaactacaccagccaccagaaggacctgaacttctcatgggaggtcttcagggagaaggtcaacaacgaggttatcgccactctcggaaacttcctctacagagtgctgctgtttgcgtggaaaaactttggcgaagtaaggatggagggcgttgacgaggaagttctggagaaaatcagggagaccgagcaaaaaattctctcagcccttgaggagtgggagtttaaagctgcgagtgatgccttcatggagcttgccacttacggaaacgtttacttccagaacgccaagccgtgggagctaataaagactgacaaggaggcagcaagaagggctgttgcttcgtgccttcagcttgccaaagctctcataatattcgcatatccggtaatgccggaaagcatggagaggatggcaaaagcaataggccttgatttggagaatgtaagattaagcgacgcttacaaagttgatgaagtcatgaagctcagcaaacctgaggtgcccttcgccaaggtggaggatgaggttatcgagaagctgcagaaggtgatggagaagaggttcaggggagagggagagaaaatggagcagaaggaggaaataagcatagaggacttccagaaacttgacatccgcattggtagagttttgaaggccgagaaggtgaaaaagagcaagaagctcatcaagctcattattgacataggcgacgagcagaggcaaatagtgtctggaattgcagaggactacactccggaagagcttgaggggaagcttgtcgtggtgcttgcgaacctaaagccggcaaagttcatgggcgttgagagcagaggaatgattctcgctgctgagaaggatggaaaagcagtgctgctgacccctgagaaggaggttgagcccgggacgagggtttgctaa

SEQ ID NO: 24896 - protein, 658 aa, Archaeoglobus fulgidus
MKLVTCGLPYANGKAHVGHLRTYVPADVYVRYLRMSGEEVVFVCGSDCHGTPIVVNAEQQGLSPKELVDIYHEHFIKIFDALNIKFDFYGRTDSDYHHHRTTEIVKRLIEKGYVYPKEIQLAYCPKCQRFLPDRYVEGICPYCGALARGDECDQGCGRHLEPGEIKEPRCKICGSKAEFRSQRHYFFKLTEFQDFLEDYLSKLKGTENALNYARNWVKNLRDWCITRNLEWGVRFPGEPNLVVYVWVDAPIGYISFTEKACEEKGCDWRKIWIDGDAEIIHFIGLDIVYHHCIFWPAMLKGADYALPSAVVASGMVKVEGKTFSKSRGYVVWVEEDYLKSGLSPDYLRYYIVNYTSHQKDLNFSWEVFREKVNNEVIATLGNFLYRVLLFAWKNFGEVRMEGVDEEVLEKIRETEQKILSALEEWEFKAASDAFMELATYGNVYFQNAKPWELIKTDKEAARRAVASCLQLAKALIIFAYPVMPESMERMAKAIGLDLENVRLSDAYKVDEVMKLSKPEVPFAKVEDEVIEKLQKVMEKRFRGEGEKMEQKEEISIEDFQKLDIRIGRVLKAEKVKKSKKLIKLIIDIGDEQRQIVSGIAEDYTPEELEGKLVVVLANLKPAKFMGVESRGMILAAEKDGKAVLLTPEKEVEPGTRVC

SEQ ID NO: 24897 - DNA, 2172 bp, Pyrococcus horikoshii
  CDS (1)..(2172)
atggtcagatatatggtcacctccgcattaccctatgctaatggaccgattcatgcaggccacctagcaggagcataccttccagcggatatcttcgttagatacctaaggcttaaaggggaggatgtagttttcatctgcggcaccgacgaacatggaacacccatatcatttagggcccttaaagaggggaggagccccagggagatagttgatgaatttcatgagcacataaagataacgtttcaaagggctaagataagctttgatttctttggtagaacggaattaccaattcattataagctaagccaacagtttttcctgaaagcttacgagaatggtcacttagtaaagaaggttaccaagcaggcctattgtgagcatgataagatgttcctacccgatagattcgttatagggacatgcccattctgtggggccgagaaccagagaggagatcaatgtgaagtctgtggaagacctctaacacctgagatacttataaatccaaggtgtgccctctgcgggaggccgatctcattcagagaatcggcccattattatataaaaatgcaggatttcgcggagaaattgaaaagatggatagagaatcagccctggaagcctaacgtaaagaatatggttttgaagtggatagaggaagggttggaagagagggctataactagagacctaaactgggggataccagtacctcttgatgaagaggatatgaagaataaagttctctacgtgtggtttgaggctccaataggatacatctcaataaccatggaatacttcaagagacttggaaagccaaatgagtggaagaaatactggctaaacatagatagtgaaacgagagtcatacatttcataggaaaggataacataccgttccatgcgatattctggcctgcctttctcatggcctatggaaagtacaaggatgaggaagtagaggccgagtggaatctaccgtatgatattccagctaatgagtacctaaccttggaaggaaagaagttctctacaagcaggaactgggcgatctgggttcatgagttccttgatgtcttcccagcggattatctaagatactatttgacaaccataatgccagaaactagagattcagactttagctttgccgaattcaagactaggataaacgaggagctcgtcaataacttaggaaacttcgtgcacagggcgatgacctttgtgaacaggtactttgatgggatagtcccagagaggggagaactcgatgagctagatagacaagccctcgaagaaatagaaaaggcatttgaggaagttggagaacttataatgaactaccggttcaaagacgctcttaaaagggttatggagctcgcatcattcggtaataagtacttcgaccataaacaaccctggaagactgctaaagaagatagggcaaggacggggaccaccgttaacatatcactccagatagttaaggcccttgggatactactcgaacccttcctcccggatgcaagcgaaaagatatggcatcttctcaacctggacgaagtcaagaagtggaagttcaaagagcttccagcgggccatagagtgagaaaagcagagatactcttcaagaaggttacagatgaacaaataatatacttcatattaaattacatggggaggaataacccagaaggagctaaaatgttgcttgagaagtattacaagagggaagatgtgattaaggttgccaaagaaaagtttggagaagagtccaaaatcatccttaagagaatttataaggatattaaacttgaagaagggaaggaggagaaggagatggagtacgttaagtttgaggactttgcaaagctcgaccttagggtagggaagataatcgaggtaaaggatcatccaaatgcagacaagctatatatagttaaagttgacctggggaaagaagttagaactttagtggccgggcttaagaagtattacaagccagaagaattgctcaacaagtacgtcattattgttgcaaacttagagcctaaaaagcttagaggggttgaaagccagggaatgctcctggccgctgacgatggcgagaacgttgctttactgatgcccgacaaagaggttaagttgggagcaaaggttaggtaa

SEQ ID NO: 24898 - protein, 723 aa, Pyrococcus horikoshii
MVRYMVTSALPYANGPIHAGHLAGAYLPADIFVRYLRLKGEDVVFICGTDEHGTPISFRALKEGRSPREIVDEFHEHIKITFQRAKISFDFFGRTELPIHYKLSQQFFLKAYENGHLVKKVTKQAYCEHDKMFLPDRFVIGTCPFCGAENQRGDQCEVCGRPLTPEILINPRCALCGRPISFRESAHYYIKMQDFAEKLKRWIENQPWKPNVKNMVLKWIEEGLEERAITRDLNWGIPVPLDEEDMKNKVLYVWFEAPIGYISITMEYFKRLGKPNEWKKYWLNIDSETRVIHFIGKDNIPFHAIFWPAFLMAYGKYKDEEVEAEWNLPYDIPANEYLTLEGKKFSTSRNWAIWVHEFLDVFPADYLRYYLTTIMPETRDSDFSFAEFKTRINEELVNNLGNFVHRAMTFVNRYFDGIVPERGELDELDRQALEEIEKAFEEVGELIMNYRFKDALKRVMELASFGNKYFDHKQPWKTAKEDRARTGTTVNISLQIVKALGILLEPFLPDASEKIWHLLNLDEVKKWKFKELPAGHRVRKAEILFKKVTDEQIIYFILNYMGRNNPEGAKMLLEKYYKREDVIKVAKEKFGEESKIILKRIYKDIKLEEGKEEKEMEYVKFEDFAKLDLRVGKIIEVKDHPNADKLYIVKVDLGKEVRTLVAGLKKYYKPEELLNKYVIIVANLEPKKLRGVESQGMLLAADDGENVALLMPDKEVKLGAKVR

SEQ ID NO: 24899 - DNA, 1998 bp, Streptococcus pneumoniae
  CDS (1)..(1998)
atgtctgaaaaaaatttttatattacaacgccgatttactatccatctgggaaacttcatatcggttctgcctacacaactatcgcatgtgatgtcctagcacgttacaaacgcctgatgggctacgatgtattttatctgacaggtcttgatgaacatggtcagaaaatccagcagaaagcggaagaagctggtattacacctcaagcctatgttgatggaatggcggttggagttaaagaactctggcaattactagatatctcatacgataaatttatccgtacaactgatgactaccatgaaaaagttgtcgcacaagtctttgaacgcttacttgctcaagatgatatctacttgggtgaatactctggttggtattcagtatcagacgaagaattctttacagaaagccagctggcagaagttttccgtgatgaagctggaaatgtgactggtggtattgctccatcaggtcatgaggttgaatgggtttctgaagaatcatacttccttcgccttagcaaataccaagaccgtttggtcgaatttttcaaagctcatcctgaatttatcacgccagatggtcgccttaatgaaatgctacgcaacttcatcgagccaggcttggaagatttggcggtatctcgtacaacctttacatggggagtgcctgtcccatcaaatccaaaacacgttgtctacgtttggattgatgcccttcttaactatgcgacagctcttggctacgctcaagacgaacatggtaactttgacaagttctggaatggaacagtcttccatatggtaggaaaagatatccttcgcttccactctatctactggccaatccttcttatgatgttggatgttaaattacctgatcgtttgattgcccatggttggtttgtcatgaaagacggaaaaatgtctaagtcaaaagggaatgtcgtttaccctgaaatgttggtagagcgttatggactagatccacttcgttactacctcatgcgtaaccttccagttggttcagacggaacctttactcctgaagactatgtcggccgtatcaactatgaattggctaatgaccttgggaacctccttaaccgtacggtttccatgattaataagtactttgatggacaaatccctgcctatgtagaaggtgtgactgaatttgatcatgttcttgctgaggttgcagaacaatcaatcgcagacttccatacacacatggaagcagttgactatccacgtgcgcttgaagcagtctggactctgatctctcgtaccaataaatacatcgatgagaccgcaccatgggtcttggccaaggatgaagctcttcgtgaccaattggcaagtgtcatgagccacttggcagccagcattcgtgtagttgctcacttgattgaaccatttatgatggaaactagtcgtgcagttttgactcaacttggtttggaagaagtttctagtcttgaaaacttgagtttggctgacttcccagcagatgtgactgtagttgccaaaggaacacctatctttccacgtctaaatatggaagaagaaatcgcctatatcaaggaacaaatggaaggcaataaaccagcagtcgaaaaagaatggaatccggacgaagttgagctcaaactaaacaaggatgaaatcaagtttgaagactttgacaaggttgaaatccgtgtcgcagaagtcaaagaagtgtctaaagtagaaggttcagataagttgcttcaattccgcttggatgctggtgatggagaagatcgtcagattctttcaggaattgcaaaatactatccaaatgaacaagaattggtcggcaagaaagttcaaatcgttgctaacctcaaaccacgtaaaatgatgaaaaaatatgtcagccagggtatgattctctcagctgaacatgatggcaaattaacccttctcacagttgatccagctgtaccaaatggaagtgtgattgggtag

SEQ ID NO: 24900 - protein, 665 aa, Streptococcus pneumoniae
MSEKNFYITTPIYYPSGKLHIGSAYTTIACDVLARYKRLMGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAHGWFVMKDGKMSKSKGNVVYPEMLVERYGLDPLRYYLMRNLPVGSDGTFTPEDYVGRINYELANDLGNLLNRTVSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFRLDAGDGEDRQILSGIAKYYPNEQELVGKKVQIVANLKPRKMMKKYVSQGMILSAEHDGKLTLLTVDPAVPNGSVIG

SEQ ID NO: 24901 - DNA, 2436 bp, Treponema pallidum subsp. pallidum (syphilis spirochete)
  CDS (1)..(2436)
atgacgcgaaaattaatcaccgccgcactcccctatgtgaacaacgttccacatttgggaaatcttatccagggtctttctgcagacgttttcgcacgtttctgtcggatgcgcggctatcacacgtgttttgtatgtggtaccgacgaatacggcacggcaagcgaaacccgtgcggcagaacaaggtctcagtcctgcacaattgtgtgcgcactaccatgcactgcatcgcgacatctatcagtggtttgatctgtccttcgattattttgggcgcactacaagcgatgcgcatactgagcttacgcaagcgttgtttcgtcatttggatgcgcggggttttatcagtgaacatgaaagtgcgcaggcgtactgtctgcactgtgcacggtttcttgctgatcgctatttgcgcggtacctgtccccattgccgtaatgctgaggcgcgtgctgaccagtgcgagcactgtggagtgctccttgagccggaaacgctcctgaatgcgcgctgtgtgagctgtggcacggcgccggagtttcgccctacgcgtcatttgtatttaaatttgcctgcactggaaaaagcctaccgctcgtggttttgcaccacgaatcatctgtggactaaaaacgcggtgcgtatgactgaaggttggctacgtacgggattgcaggagcgtgcgatcacgcgcgatctgcgctggggggtgccagttcccaaagcaggatttgagcagaaggtattttatgtgtggttcgatgcgccagtcggttacatttccattactaagtgcggcacagaggcagcttcctcgcaagaagggggggggaccgacgatggcgtgaaagaaaaatggcagtcttggtggcttgatcagcaggatgtggagttggtccagtttgtggggaaggacaatattccctttcatacgctgtttttcccctgcatgctcatcggttccgggcagcggtggacgatgcttacgcgtctttctgcgacggagtatttgaattacgaaggggggaagttttctaagtctttaggggtgggcgtttttggttcggatgcaaaagaatcgggcattccctcagatctgtggcgtttttatctcctgtaccatagaccggaaaaaagcgatgcgcactttacctggcatgagtttcaggagcgtgtaaacagtgagttgattggtaatctgtgtaatctggtcaatcgtacgctcacctttgtggcgcgtacgtacgggggcgtggtccctgcgcaagatggagcgcgcagcacccgtgcgcaggtgatggaagaaacgcttgcgctccgcgaagcggtgcggaatactgcaaagcgcatgacagatttaatggagcaggtacagttgcgagaagcgtttagagaagtgtttgcgctctcagcgcgtgcgaataaggcgttgcaggatggtgcaccgtggaaaacgcgggcgcaggaccgtgaacgtgcagacgccttgatgcgtgagttatgctatgtgattcgggatgtgctgattttagcgcatccttttttgccgtggtacacgcagcaagcggcccgatttttgggtgttcagttgtcttcctgtgcaccagaggggggaggagctgtgtgtgctgcgaagaaagacgcggatacggcgcagccggacacagtgcaaccgaccctccgatggtcagacgtgggagaacgcaagggtttaacgcaggtgcatccgccggtgattttattccgtccgttggagacggaaactattgctgcgtatcgtgcccgctatgctggaacagccagggatggggcaggagtgagcgtaccgcgcactgcacagatgcccacgggaatgaataagaaagagacagacgctcaacaaaagaaggaggagcgtgaaatgccccctccctcagatactgcacggttatctgcatttttttctgagcgcgttgtactgaaagtagcacgagtgttgcaggtggagcgtcatccgaatgcggatatgctttttgttgaaacattagatgatggctctggcgttgagcgcgttattgtttctggtcttgtgccttatatggctgcagatgcgttgcgtggtgcgcacgtgcttattgtggataatctgcagccgcgctcactgcgtggggtacggtcttgcggcatgctgttggccgcagagtatgtagatgcgcagggcacaaaggcaattgaattggtgcaggcgccatgggctctgcccggtgaacgcgcaacacttgcgagtgcgccgccggtcattacaccgcacgggtctgccgttatcgatgcggacgcttttttttctgtgcctattcgtgtggtaaattatgcagtagaagttgcaggtgagccgctcatggttggaggaaggccactggtaatgcagcgagtgaaagagggaactgtcggctag

SEQ ID NO: 24902 - protein, 811 aa, Treponema pallidum subsp. pallidum (syphilis spirochete)
MTRKLITAALPYVNNVPHLGNLIQGLSADVFARFCRMRGYHTCFVCGTDEYGTASETRAAEQGLSPAQLCAHYHALHRDIYQWFDLSFDYFGRTTSDAHTELTQALFRHLDARGFISEHESAQAYCLHCARFLADRYLRGTCPHCRNAEARADQCEHCGVLLEPETLLNARCVSCGTAPEFRPTRHLYLNLPALEKAYRSWFCTTNHLWTKNAVRMTEGWLRTGLQERAITRDLRWGVPVPKAGFEQKVFYVWFDAPVGYISITKCGTEAASSQEGGGTDDGVKEKWQSWWLDQQDVELVQFVGKDNIPFHTLFFPCMLIGSGQRWTMLTRLSATEYLNYEGGKFSKSLGVGVFGSDAKESGIPSDLWRFYLLYHRPEKSDAHFTWHEFQERVNSELIGNLCNLVNRTLTFVARTYGGVVPAQDGARSTRAQVMEETLALREAVRNTAKRMTDLMEQVQLREAFREVFALSARANKALQDGAPWKTRAQDRERADALMRELCYVIRDVLILAHPFLPWYTQQAARFLGVQLSSCAPEGGGAVCAAKKDADTAQPDTVQPTLRWSDVGERKGLTQVHPPVILFRPLETETIAAYRARYAGTARDGAGVSVPRTAQMPTGMNKKETDAQQKKEEREMPPPSDTARLSAFFSERVVLKVARVLQVERHPNADMLFVETLDDGSGVERVIVSGLVPYMAADALRGAHVLIVDNLQPRSLRGVRSCGMLLAAEYVDAQGTKAIELVQAPWALPGERATLASAPPVITPHGSAVIDADAFFSVPIRVVNYAVEVAGEPLMVGGRPLVMQRVKEGTVG

SEQ ID NO: 24903 - DNA, 1890 bp, Thermotoga maritima
  CDS (1)..(1890)
atgaaattttacatcaccaccccaatctactacgtgaattctgagccccacataggaagtgcctataccactattgtagccgatatcatcgctcgctacaaacgtttcatgggttacgatgtgttcttcctcacgggaacagatgagcacggccagaaggtactgcaggcagcccagcaggcggggaaggacccgcaggaattctgtgacgaactggctgaaaagttcaaacggctctggaaagaactgaagatcacgaacgattatttcatccgaaccacagacgaaatgcacatgaaaactgtccaggaattcgttgcgaagatgaaggagaacggagacgtctacaagggcatctacaagggatggtactgtgttccctgtgagacgttctggaacgaggacgaggttataaaggaaggagaagaacgtttctgtccggagtgtaaaagacccgtcaaatgggtcgaggaagagaattacttcttcagactttcgaaatacagagattcccttctgaagtactacgaggagcatcccgattttgtggaaccggacttcagaagaaacgagatgttgaagatcctcgaaggtggtctcaaagacctgagcatcaccaggacgaccttcaaatggggcgttcccatgaaggacgatccggaacacgtgatctatgtgtgggtggacgctctcataaattacatatccgctatagggtacggctggaacgatgagatgttcaacaaatggtggcccgcagatttgcatctgataggaaaagaaataaacagattccactccatcatatggcctgcgatgctcatgtcggttggactcccacttccaaagaaggtgttcgcacacgggtggctcacggtgaacggccagaagatcagcaagtctctcggcaacgctatagaccccaggttcttcgtgaagagatacggcaacgatgtggtgaggtactacctgatacgggatatcatgttcggaaaagacggcgatttctcggaggaaagactcgtccacagattgaattccgatctcgcgaacgactacggaaatctccttcacaggatcacggctatgataaagaagtatttcaacggaagactcccttctccttccgctcaggaagggttcgacagctggctgaaggagaggttcttcgaaacaaaagacgcttaccatgaactcatggattcctaccggctcacagaagccctggacaagatatgggagttcatagcggacgtaaacaagtacttcaacgacacgaagccctggatacttggaaaagaggggaatatggaaaggctcggaacggtgctgtacaactcactggaggcagtgttcaaggtggctctgatgacgctcccggtgatgccagacacctccgaagaagtgttcagaagagtgtcctttgaagaaaagccttcgaaggaacatctggagaactggggtgttctgaagcctggttccacagtgatccacggcgaacctctcttcaagaaaatcgacgcgaaagacttcaaaaaggtggtggagacggtgtcggccgaacagaacgcgatcacaatagatgatttttccaaagtagacctcagaatcgcaaaggtcctcgaagcggagaaggttccaaattccagaaaacttctcagattgataatcgatcttggaacggaaaagagacagatagtggcgggaattgcagaacactacagacctgaagaactcgtaggaaaactgatcgtcgttgtcgctaatttaaaacccgcaaaactcatgggcatagagtctcagggaatgcttctcgccgcaaagtccggcgataccttgagacttttgactgtagatggagaaatcacaccaggtgcgaaggtgtcctga

SEQ ID NO: 24904 - protein, 629 aa, Thermotoga maritima
MKFYITTPIYYVNSEPHIGSAYTTIVADIIARYKRFMGYDVFFLTGTDEHGQKVLQAAQQAGKDPQEFCDELAEKFKRLWKELKITNDYFIRTTDEMHMKTVQEFVAKMKENGDVYKGIYKGWYCVPCETFWNEDEVIKEGEERFCPECKRPVKWVEEENYFFRLSKYRDSLLKYYEEHPDFVEPDFRRNEMLKILEGGLKDLSITRTTFKWGVPMKDDPEHVIYVWVDALINYISAIGYGWNDEMFNKWWPADLHLIGKEINRFHSIIWPAMLMSVGLPLPKKVFAHGWLTVNGQKISKSLGNAIDPRFFVKRYGNDVVRYYLIRDIMFGKDGDFSEERLVHRLNSDLANDYGNLLHRITAMIKKYFNGRLPSPSAQEGFDSWLKERFFETKDAYHELMDSYRLTEALDKIWEFIADVNKYFNDTKPWILGKEGNMERLGTVLYNSLEAVFKVALMTLPVMPDTSEEVFRRVSFEEKPSKEHLENWGVLKPGSTVIHGEPLFKKIDAKDFKKVVETVSAEQNAITIDDFSKVDLRIAKVLEAEKVPNSRKLLRLIIDLGTEKRQIVAGIAEHYRPEELVGKLIVVVANLKPAKLMGIESQGMLLAAKSGDTLRLLTVDGEITPGAKVS

SEQ ID NO: 24905 - DNA, 1983 bp, Bacillus halodurans
  CDS (1)..(1983)
atgtcgaaagagcaaaaaacattttatttgactacaccgatctattacccgagtgacaagctacatattggtcatgcatatacgacagtagctggtgatgcgatggctcgctacaagcggcttcgtggctataatgttatgtatttaacggggacggatgagcacggtcaaaagatcgagcaaaaagcagaggccaaagggttaacacctaagcagtttgtcgatgagattgtcagcggtattcaggatctatggaaaaagctcgacatttcttatgacgattttattcgtacgaccgaggagcgtcacataaaagtcgttcagcaaatttttgagcagttgttggatcagggagacatctaccttggggattacgaaggttggtactccattccagatgaaacgttttacacggaaactcagcttgtagataaagaatatgatgctgacgggaatctcatcggaggcaaaagccctgatagtgggcacccagtagaaaaggtccgtgaacaatcgtattttttccgaatgagtaaatacgcagataggttgctacagttttatgaagaaaatccacagttcattcagccagaatctcggaagaacgaaatgattaataactttattaaaccaggacttgaagatttggctgtttctcgcacgtcgtttacgtggggcgttccagtgccgcgcgacccgaagcatgtggtatatgtttggattgacgccctttccaactatatcactgcacttgggtatggctcggaccagcaagaaaaatacgagaactattggccagctgatgttcaccttgtcggcaaggagatcgttcgttttcatactatctattggccgattatgctgatggctttagacttgccccttccgaaaaaagtatttggtcatggctggttgttgatgaaggatggaaagatgtcaaaatcgaaagggaacgttgttgacccggtcccacttatcgatcgttacgggttagatgcgcttcgctattacttgcttcgagaggtaccgtttggctcggatggtgtcttcacaccagaagcattcgttgagcgggtgaactatgatctagccaacgatcttggtaatttgctcaaccgaacggtggccatgattgagaaatatttcgatgggaagattccttcctatgtaaaagacggtaccccgtttgatgcggatcttgtcgaacttgtgtattcaactgtaaaaaaagtagaggatgccatggaggaaatggaattttccattgcgttaacagccatcggccagctgattagtcgcacgaataaatatattgatgaaacccaaccgtgggttctggcaaaggatgaatcgaaacgtgagcaattaggggcagcaatgtaccatttagctgagtccattcgttatgtatcggtgttgctacaaccgtttatgacaaaagcaccgcaaaaaatttgggaacagcttggcattgattcctccctcacgacatgggaatccctcgaaactttcggacaaattccagggaacacgaacgtacaaaaagggcagccccttttccctcggttggatgtggaggaagaagtggctcacattaaatcccttatgggtggaagtaaaaaaccagaagaggcgccaaaagatgagaaggaagaatcggatgaaattacgatcgatgatttttcaaaagtggagctccgcatagcggaagtcatagatgctgagcctgtgaaaaaggccgatcggttgctgaagattcagcttgatcttggctatgagaaacgccaggtcgtttcaggtattgcaaaatactattctccaagtgatttaattggaaaaaaagtcatttgtgttacgaacttaaaaccagtgaagcttcgtggtgagctttcacaaggaatgatcctagctggttcggaaggagatcaattgcggttggcgacagttgatggagcattaccgaatgggtcacttgtaaaatag

SEQ ID NO: 24906 - protein, 660 aa, Bacillus halodurans
MSKEQKTFYLTTPIYYPSDKLHIGHAYTTVAGDAMARYKRLRGYNVMYLTGTDEHGQKIEQKAEAKGLTPKQFVDEIVSGIQDLWKKLDISYDDFIRTTEERHIKVVQQIFEQLLDQGDIYLGDYEGWYSIPDETFYTETQLVDKEYDADGNLIGGKSPDSGHPVEKVREQSYFFRMSKYADRLLQFYEENPQFIQPESRKNEMINNFIKPGLEDLAVSRTSFTWGVPVPRDPKHVVYVWIDALSNYITALGYGSDQQEKYENYWPADVHLVGKEIVRFHTIYWPIMLMALDLPLPKKVFGHGWLLMKDGKMSKSKGNVVDPVPLIDRYGLDALRYYLLREVPFGSDGVFTPEAFVERVNYDLANDLGNLLNRTVAMIEKYFDGKIPSYVKDGTPFDADLVELVYSTVKKVEDAMEEMEFSIALTAIGQLISRTNKYIDETQPWVLAKDESKREQLGAAMYHLAESIRYVSVLLQPFMTKAPQKIWEQLGIDSSLTTWESLETFGQIPGNTNVQKGQPLFPRLDVEEEVAHIKSLMGGSKKPEEAPKDEKEESDEITIDDFSKVELRIAEVIDAEPVKKADRLLKIQLDLGYEKRQVVSGIAKYYSPSDLIGKKVICVTNLKPVKLRGELSQGMILAGSEGDQLRLATVDGALPNGSLVK

SEQ ID NO: 24907 - DNA, 1956 bp, Methanococcus jannaschii
  CDS (1)..(1956)
atgagatatctaataacaactgccttagcttatacaaacggccctctacatttagggcatgcaagaagcacttacatcccagcagatattatatataaatacttaaagttgagaggggaagatgttatccacgttggaggaactgataaccacggagttcctataacattaactgctgaaaaagagggaaaaagcccagaggagattgttgaaaaataccataatgagattaaagaagatttagatttgttaggagtagagtttgatgcatttggcaaaactcacagccaaatacatatagaaacagctcaagagttttatctaaagctaaaagagaatggctatatctatgagaaggaaatagagcaattttactgtccaaactgtaaaaaattcttaccagatagatatgttgagggaatctgcccatactgtggaggagaggcaagaggagaccactgtgaagtttgtggaagacacttagagccgtttgagttaaaagacccatattgtgtaatttgcaaaggaaagccagagattagaaagacaaaacatcacttctttaagttaagtgctttaaaaaaggagttagaggagtatataaaaaatgcaaaagaaatgccagagcatgttaaaaatatggcattgaattggattaaagagttacatgattgggatatttcaagagatataagctggggagttccaattccagggactaatcaagtaatgtatgtttggttagaagcccctattggctatatctcatttacaaagatgttgggagagatttggaagaaatattggttagagaaagatacaaagatttatcacttcattggaaaggatataactgttcatcatgccgttttctggccaggaatgttgattgctcatggttcctttaacttaccaactgcagtagttagtggaggttatctaaccttagaaggaagaaagatgagcacaagtaaaagatgggttgtttgggttaaagattttgttaaaaactttgatgctgactatttaagatactacttaatcatgtcagcccctctctttaaagattgtgatttctcatttgatgatttcaaaaataagataaacaatgaactcatcaacataattggaaacttcacccacagagttttaacctttacccatagaaagtttaagaaagtcccaatagttgatgaagatagattaaaagaggaagataaagagctattgaaaaaatgtgaagagacacttgaggctgtggataaaaacataaggagctttaagtttagagatgctttagttaatatattacatcttgccattgaaggaaacagttacttccaaaagatggagccttgggctgttgatgatgaagaaagattgaaggaaatattatatacttgctgcaagacagtaaaaactcttgtctatctgctatacccatacatgcctaaaaaatctcttgcactattggaattaatgaatgaagaacttgatttagagcttagagggaatgaattaaagaaaccaaagattatattcaaaaagatagataataagaagatagaagagatgaagaaaaagctttatgaaaataaaaaagaagaaacaaaaggaggagaaaaaatggagcaaatagatataagttatttagaaaagattgatttaagagttggagaagttgtagaggcagaagacataccaaaatcaaagaaacttttaaaactaatggttgatttgggagatgagaagagacagattgtttcaggaattaaaggatattataaacctgaagatttagttggaaaaaaggttattgttatttgcaatttaaaaccagctaaattatgtggtgttttatctgaaggaatgattttagcagccgaagatgatgaaggaaatgttagcttattaactgttgataaggatataaaagcaggtagtaaagttagataa

SEQ ID NO: 24908 - protein, 651 aa, Methanococcus jannaschii
MRYLITTALAYTNGPLHLGHARSTYIPADIIYKYLKLRGEDVIHVGGTDNHGVPITLTAEKEGKSPEEIVEKYHNEIKEDLDLLGVEFDAFGKTHSQIHIETAQEFYLKLKENGYIYEKEIEQFYCPNCKKFLPDRYVEGICPYCGGEARGDHCEVCGRHLEPFELKDPYCVICKGKPEIRKTKHHFFKLSALKKELEEYIKNAKEMPEHVKNMALNWIKELHDWDISRDISWGVPIPGTNQVMYVWLEAPIGYISFTKMLGEIWKKYWLEKDTKIYHFIGKDITVHHAVFWPGMLIAHGSFNLPTAVVSGGYLTLEGRKMSTSKRWVVWVKDFVKNFDADYLRYYLIMSAPLFKDCDFSFDDFKNKINNELINIIGNFTHRVLTFTHRKFKKVPIVDEDRLKEEDKELLKKCEETLEAVDKNIRSFKFRDALVNILHLAIEGNSYFQKMEPWAVDDEERLKEILYTCCKTVKTLVYLLYPYMPKKSLALLELMNEELDLELRGNELKKPKIIFKKIDNKKIEEMKKKLYENKKEETKGGEKMEQIDISYLEKIDLRVGEVVEAEDIPKSKKLLKLMVDLGDEKRQIVSGIKGYYKPEDLVGKKVIVICNLKPAKLCGVLSEGMILAAEDDEGNVSLLTVDKDIKAGSKVR

SEQ ID NO: 24909 - DNA, 336 bp, Aquifex aeolicus
  CDS (1)..(336)
atggaagaaaaggctttaatagggatagaagactttttaaaagtagatctcagagtagcaaaggttctgtccgccgaaagggtagagggttccgaaaagctcctgaagctcacactttccttgggagatgaagagaggacggttgtcgcaggtatagcgaagtactacacacccgaggaactcgtagggaagaaaatcgttatagttgcaaacttaaaaccaagaaagattttcggtatagagtcccaaggaatgatactcgccgcatcggacggagagaacctctccgttatagttcccgacagggacgtgaaggagggggctaaactcagttga

SEQ ID NO: 24910 - protein, 111 aa, Aquifex aeolicus
MEEKALIGIEDFLKVDLRVAKVLSAERVEGSEKLLKLTLSLGDEERTVVAGIAKYYTPEELVGKKIVIVANLKPRKIFGIESQGMILAASDGENLSVIVPDRDVKEGAKLS

SEQ ID NO: 24911 - DNA, 339 bp, Pyrococcus horikoshii
  CDS (1)..(339)
atgaattatatggaactatacgatgtcgatgaattctggaagtttcagatgaaagttggacttgtgaagaaagctgaaaagattaagaggacaaagaagttaattaaattgatagttgactttggaaatgaggagagaacgatagttacaggtatagcagatcagatacctcctgaagaacttgaaggaaagaagtttatatttgtagttaacttaaagccgaaaaaattttcaggagtagaaagtcaaggtatgctgatccttgccgagactgaggatggtaaggtatacctaattccagttcctgaagaggttccggttggagctagggtgtggtga

SEQ ID NO: 24912 - protein, 112 aa, Pyrococcus horikoshii
MNYMELYDVDEFWKFQMKVGLVKKAEKIKRTKKLIKLIVDFGNEERTIVTGIADQIPPEELEGKKFIFVVNLKPKKFSGVESQGMLILAETEDGKVYLIPVPEEVPVGARVW

SEQ ID NO: 24913 - DNA, 1887 bp, Campylobacter jejuni
  CDS (1)..(1887)
atgcgttatattacaacaccaatttattatgtaaatgatgtacctcatttaggtcatgcttatactaccatcatagccgatactttagcaagattttatcgtttgcaaggacatgaaacaagatttctaacaggaacagatgagcatggacaaaaaatcgaagaagctgccaaactaagaaattccactcctcaagaatacgctgataaaatcagttttgaatttaaaaaattatgggatgaatttgaaatcacctatgatatttacgcaagaacaactgatacaaggcatattgaatttattaaagctatgtttttaaaaatgtggcaaaaaggtgatatttataaagatgaatacgaaggacactattgtatttcttgtgaaagcttttttactcaaagtcagcttattaacgattgttcttgcccagattgtggcaaacaaactagaattttaaaagaagaaagctattttttcaaactttcaaaatatcaagataaaattttacaatggtatgaagaaaaagatcccatcttgccaaaaaacaaaaaaaacgaacttataaattttgtccaaaacggccttaaagatctttccattacaagaacaagttttgattgggggattaaactgcctcaagaaattaatgatgataaacatattatttatgtatggcttgatgcactttttatctatgtaagctcacttgactttcaaaacaagggagaaaatgctaaattttggcctgcgcatgtgcatttagtaggaaaagatatcttgcgttttcatgccatttattggccagcttttttaatgagcgtggatttgcctttgccaaaatttataggtgcacatggctggtggactaaagaaggtgaaaaaatgagcaaatctaaaggcaatgttgtaaaacctaaagaagtagttgatgcctatggaagtgaagcttttagatatttcttgcttagagaagtgccttttggtaacgatggggattttagcgaaaatatgctgataaatcgtatcaatgcagagcttagcaatgaatttggaaatttacttaatcgcattataggtatgagtacaaaatattctcaaggaaatatttcaaaagaaggtgttttaaaattttacaatgccgaactaaatcaagcaaaagaacacttaaatttagcggtagaatttttagaaaacttacagtgtaatcgttatttagaagaactttttaaagccttaagtgtggcaaatttagccattagtaaatacgaaccttggagtttaatcaaagaaaacaaacacgaacaagctaatgctttagtagcactttgtgcaaatattttagccaaaacaagccttttattaagccctactctaccaaagtcctctcaaaaggtggccttagctttaaattttgaaatttcgtctgcaaattacacaaaaatgatacttgataatgaacttttagattttaaagcaaatccttgcgaagctttatttccaaaagtagaaaaagctcttttaaaacaagaaattaaagaagaacctaaaaaagaagaaagtcctaaaataaaaatcgatgattttgcaaaaattgaaatcaaagttgctaaggtacttgattgtcaaaatatagaagggagtgaaaaacttttaaaatttcaactcgaacttgacgataaagaaatccgtcaagtactctcaggcatagcaaaatactataaggccagtgatttaatcggtaaacaagtttgcgttataagcaatcttaaaaaagctaaaatttttggacatgaaagcgatggtatgatactttctgcaaaaagcggagataaacttgttttaatcgcccctgaacaacttgtgcaaaacggctctttagtgggttaa

SEQ ID NO: 24914 - protein, 628 aa, Campylobacter jejuni
MRYITTPIYYVNDVPHLGHAYTTIIADTLARFYRLQGHETRFLTGTDEHGQKIEEAAKLRNSTPQEYADKISFEFKKLWDEFEITYDIYARTTDTRHIEFIKAMFLKMWQKGDIYKDEYEGHYCISCESFFTQSQLINDCSCPDCGKQTRILKEESYFFKLSKYQDKILQWYEEKDPILPKNKKNELINFVQNGLKDLSITRTSFDWGIKLPQEINDDKHIIYVWLDALFIYVSSLDFQNKGENAKFWPAHVHLVGKDILRFHAIYWPAFLMSVDLPLPKFIGAHGWWTKEGEKMSKSKGNVVKPKEVVDAYGSEAFRYFLLREVPFGNDGDFSENMLINRINAELSNEFGNLLNRIIGMSTKYSQGNISKEGVLKFYNAELNQAKEHLNLAVEFLENLQCNRYLEELFKALSVANLAISKYEPWSLIKENKHEQANALVALCANILAKTSLLLSPTLPKSSQKVALALNFEISSANYTKMILDNELLDFKANPCEALFPKVEKALLKQEIKEEPKKEESPKIKIDDFAKIEIKVAKVLDCQNIEGSEKLLKFQLELDDKEIRQVLSGIAKYYKASDLIGKQVCVISNLKKAKIFGHESDGMILSAKSGDKLVLIAPEQLVQNGSLVG

SEQ ID NO: 24915 - DNA, 345 bp, Vibrio cholerae
  CDS (1)..(345)
atggactcggcgtttttgacggtagggtacgatgattttgcgcggctggatttacgtattggcaccattgttgaggcaaagcttcatcctcgttcgacccgcaactatattgtgcagattgcgttgggagagcagatgttgcaagccgtcaccgcgttagcaccttattactcggcagaacaattactcaatcaacaagtggtggtgctgtgcaatctcaaaccgagcttggtagctggtgtagaatcccactgcatgctgctgtgcgcggaaacgcaagatggagaagagagtgtattgctcaccccacaacggattatcgccaatggggtgagaatcgtttag

SEQ ID NO: 24916 - protein, 114 aa, Vibrio cholerae
MDSAFLTVGYDDFARLDLRIGTIVEAKLHPRSTRNYIVQIALGEQMLQAVTALAPYYSAEQLLNQQVVVLCNLKPSLVAGVESHCMLLCAETQDGEESVLLTPQRIIANGVRIV

SEQ ID NO: 24917 - DNA, 1956 bp, Methanobacterium thermoautotrophicum
  CDS (1)..(1956)
atgagtaaagtatttatcacctgcgcacttccatatgccaacggccccacgcatctcggtcatctgaggtcaacctacatacctgcagacatatatgcgaggtaccggagactcaggggcgatgatgtcctcttcgtctgtgccaccgatgaacacggaactcccatagccgtgaaggcagaggccgagggcaggacccccctggaggtcgccacccgctaccatgaaatgataaggggggaccttgagaggtgtgacatatcctttgacagtttcaccaggaccacagatgagctccaccacgagatagcccagaaattcttccttaaactctacgagaagggcttcatatatgagaaggacataaaacagctctactgtggggactgccagcgattcctccctgacaggtacgttgagggcacctgcccctactgtggaagtgagggtgcgcgtggagaccactgcgagggctgtggaaggcaccttgagccgctccagcttgaggatccgcgctgtatggtatgcgggtcagaaccagaggtcagggactcccggcactacttcttccgcctgaaccagttccaggatgaaatcagggagtggatcgagggctcagagatgccatcaaatgtgagaaattacgccatccagtggctccgcgagggcctgaaggactggatactcacaagggacatggaatggggtgtccaggtaccactggaggggaacgagggtaagatcatatacgtgtggggtgaggccttccttggctacatctcatctgcagccgcctggagcaaaaaaaccgggagggactggagagaatactgggactccggcgccatccacttcatcggaaaggacataatataccaccacgccatattctggccagccctcctgatggcgtatggctgcaggacccccgcgaacataatagccggggagtacctgtcacttgagggccagaagatgtccaccagtaaaaactgggtggtctggacatcagacttccttgaaaggtttgacagggaccttctcaggtactacctcaccgtcaacgcacccctcaccagggacactgacttctcatgggacgacttccagaggagggttaacgatgaactggccgatgtcctcgggaacttcctgcacaggaccttctcattcacaggtaggttctttgacgggagggtcccggctgcaggtgaacttacagctgaggacctggaattccttgaatcaatcagggccgcccacgacaccgtcgctgaactcctggacaaattccagttcagggatgccctgatgcacataatcaaacttgccaagaggggtaacaagtacttcaatgaccaggaaccctggaaggccgttaaggagtcacccgccagggcctcaacctgcctccacctctgcaatctcctggcagccaacctcgggaaactcttgaggccattcatgccatcagcagcaggcaggatactctccatcatgaacctggaggatgaagcctggggattccatgaactcagggagggacaggtgatagagagggcgaagcccctcttctccaagataactgacgaggcaattgaggaggagaaagcaaaactcattgaggaggatgatgaagtggaaaccgtgacaatcgacgactttacaactatggacataagggttggcgtgataagatcagccgagcgaatagagggatcagacaagctcctgaagctcataatagatgtgggtgagagggagatgcaggttgttgcaggacttgcagagaaatacagccccgaagatcttgttgagaggaagattacagtgcttgtgaacctcaaacccgcgaaactcttcggtgtgaagtcagagggcatggtacttgcaacaggagaatccctcaacatactcgaccccggggacgccgaagtcggtgaaaggataaggtga

SEQ ID NO: 24918 - protein, 651 aa, Methanobacterium thermoautotrophicum
MSKVFITCALPYANGPTHLGHLRSTYIPADIYARYRRLRGDDVLFVCATDEHGTPIAVKAEAEGRTPLEVATRYHEMIRGDLERCDISFDSFTRTTDELHHEIAQKFFLKLYEKGFIYEKDIKQLYCGDCQRFLPDRYVEGTCPYCGSEGARGDHCEGCGRHLEPLQLEDPRCMVCGSEPEVRDSRHYFFRLNQFQDEIREWIEGSEMPSNVRNYAIQWLREGLKDWILTRDMEWGVQVPLEGNEGKIIYVWGEAFLGYISSAAAWSKKTGRDWREYWDSGAIHFIGKDIIYHHAIFWPALLMAYGCRTPANIIAGEYLSLEGQKMSTSKNWVVWTSDFLERFDRDLLRYYLTVNAPLTRDTDFSWDDFQRRVNDELADVLGNFLHRTFSFTGRFFDGRVPAAGELTAEDLEFLESIRAAHDTVAELLDKFQFRDALMHIIKLAKRGNKYFNDQEPWKAVKESPARASTCLHLCNLLAANLGKLLRPFMPSAAGRILSIMNLEDEAWGFHELREGQVIERAKPLFSKITDEAIEEEKAKLIEEDDEVETVTIDDFTTMDIRVGVIRSAERIEGSDKLLKLIIDVGEREMQVVAGLAEKYSPEDLVERKITVLVNLKPAKLFGVKSEGMVLATGESLNILDPGDAEVGERIR

SEQ ID NO: 24919 - DNA, 1971 bp, Helicobacter pylori
  CDS (1)..(1971)
atgcaaaaatcactgatcacaacccccatttattatgtgaatgacatccctcatattggccatgcttatacgactttgattgcggacactttaaagaagtattacacgcttcaaggcgaagaagtcttttttttaaccggcaccgacgagcatgggcaaaagatcgaacaaagtgcgagactgaggaatcaaagccccaaagcttacgccgatagcattagcgcgatttttaaaaaccagtgggattttttcaatttagattatgatggttttatccgcaccacagacagcgagcatcaaaaatgcgtgcaaaacgcctttgaaatcatgtttgaaaaaggggatatttataaaggcacttatagcgggtattattgcgtgagctgtgagagttattgcgcggtctctaaagtggataatacagatagtaaagtcctatgccctgattgcttgagagagaccacgcttttagaagaagagagttattttttcaaattgagtgcgtatgaaaagcctttattggagttttacgctaaaaaccctgaagcgattttgcccatttatcgtaaaaacgaggtaacttcttttattgagcagggtttattggatctgtctatcacgcgcacgagctttgaatggggtattcctttgcctaaaaagatgaacgatcctaagcatgtggtgtatgtttggctggacgctttattgaattatgcgagcgcgttagggtatttgaacggtttagacaataaaatggcgcattttgaacgcgctaggcatattgtgggtaaggatattttacgcttccatgccatttattggccagcctttttgatgagtttgaatttgcccttattcaaacagctctgtgtgcatgggtggtggacgatagagggcgtgaaaatgagtaagagcttgggtaatgttttagacgctcaaaagctcgccatggagtatgggattgaagaattacgctattttttattgcgtgaggtgccttttgggcaagatggggatttttctaaaaaagcgttagtagaacggattaatgcgaatttgaataacgatttggggaatttgttgaatcgtttgctaggcatggctaaaaagtatttcaattattctctaaaaagcaccaaaatcactgcgtattatcctaaagagctagaaaaagcacatcaaattttagataacgctaattcttttgtgcctaaaatgcaattgcataaggctttagaggaattgtttaatatttatgattttttgaataaactcatcgctaaagaagagccgtgggtcttgcacaaaaacaacgaatcagaaaaattagaagccttattgagtttgatcgcaaacacgctactacaatcaagcttcttgctctatgcgttcatgccaaagagcgctatgaaattagcgagcgcttttcgtgtagaaatcacgcccaataattacgaacgcttttttaaggctaaaaaattacaagatatggttttacaagacaccgagcctttattttccaaaattgagaaaattgaaaagattgaaaagattgaaaagattgaaaagattgaaaaaggggaggaagccctagcagaaaaagcagaaaaaaaagaaaaagaaaaagccccaccaacacaagaaaattatattagtattgaggatttcaagaaagtagagattaaagtggggcttatcaaagaagctcaaaggattgaaaaatccaataaattactgcgcttaaaagtggatttaggcgaaaatcgtttgaggcagatcatctcagggatcgctttggattatgagcctgaaagcttggtgggtcaaatggtgtgcgtggtggctaatttaaaacccgcaaagcttatgggtgaaatgagtgagggcatgattttagcggtgcgagataatgataatctggctttaatcagccctaccagagaaaaaattgcaggaagtttgatcagctaa

SEQ ID NO: 24920 - protein, 656 aa, Helicobacter pylori
MQKSLITTPIYYVNDIPHIGHAYTTLIADTLKKYYTLQGEEVFFLTGTDEHGQKIEQSARLRNQSPKAYADSISAIFKNQWDFFNLDYDGFIRTTDSEHQKCVQNAFEIMFEKGDIYKGTYSGYYCVSCESYCAVSKVDNTDSKVLCPDCLRETTLLEEESYFFKLSAYEKPLLEFYAKNPEAILPIYRKNEVTSFIEQGLLDLSITRTSFEWGIPLPKKMNDPKHVVYVWLDALLNYASALGYLNGLDNKMAHFERARHIVGKDILRFHAIYWPAFLMSLNLPLFKQLCVHGWWTIEGVKMSKSLGNVLDAQKLAMEYGIEELRYFLLREVPFGQDGDFSKKALVERINANLNNDLGNLLNRLLGMAKKYFNYSLKSTKITAYYPKELEKAHQILDNANSFVPKMQLHKALEELFNIYDFLNKLIAKEEPWVLHKNNESEKLEALLSLIANTLLQSSFLLYAFMPKSAMKLASAFRVEITPNNYERFFKAKKLQDMVLQDTEPLFSKIEKIEKIEKIEKIEKIEKGEEALAEKAEKKEKEKAPPTQENYISIEDFKKVEIKVGLIKEAQRIEKSNKLLRLKVDLGENRLRQIISGIALDYEPESLVGQMVCVVANLKPAKLMGEMSEGMILAVRDNDNLALISPTREKIAGSLIS

SEQ ID NO: 24921 - DNA, 354 bp, Aeropyrum pernix
  CDS (1)..(354)
atgttggcaagcggaggggaggcaggtcttatcggtatagaggattttgctaaggttgacctgcgggtggggagggttgtcaaggctgagaggctcccacacagcaagaaactgctcaagcttatagtggatattgggggggaggagaggcaggtcctcgccggcatagcaaagtggtactcccccgaggagcttgtgggcaggcttgtcatagttgttgccaacctgcagccgaagaggatggcgggtgaggttagccaggggatggtgctggcagccccatgcggcgacagcgagaagcctgtgctgctgactgtcagcgagccggtggagcctggtagtagagtatgctag

SEQ ID NO: 24922 - protein, 117 aa, Aeropyrum pernix
MLASGGEAGLIGIEDFAKVDLRVGRVVKAERLPHSKKLLKLIVDIGGEERQVLAGIAKWYSPEELVGRLVIVVANLQPKRMAGEVSQGMVLAAPCGDSEKPVLLTVSEPVEPGSRVC

SEQ ID NO: 24923 - DNA, 330 bp, Pyrococcus abyssi
  CDS (1)..(330)
atggagctgtatgacgttgaggagttctggaagtttgacatgagggtagggctggtgaaaaaggccgagaagctgaagaggactaggaagcttataaggcttgatgttgactttggaagtgaagagagaacgataataactgggatagctgatcagtacaatccagaggatcttgaagggaagaagttcatcttcgtcctaaatttaaagccaaagaaattttcgggcgttgaaagtcagggaatgcttctcgttgcggaaactgaagatggaaaagtttaccttattccggttccagaagaagttcccgttgggactaaggtatggtaa

SEQ ID NO: 24924 - protein, 109 aa, Pyrococcus abyssi
MELYDVEEFWKFDMRVGLVKKAEKLKRTRKLIRLDVDFGSEERTIITGIADQYNPEDLEGKKFIFVLNLKPKKFSGVESQGMLLVAETEDGKVYLIPVPEEVPVGTKVW

SEQ ID NO: 24925 - DNA, 1989 bp, Lactococcus lactis subsp. lactis
  CDS (1)..(1989)
atgacagaaaacaaaactttttacattacaaccccaatttattatccatcaggcaagttgcatcttggtagttcttacacaactattgcttgcgacgtgcttgctcgttacaaacgtttgatgggctttgatactttttatttaacagggcttgatgaacacggaatgaaaattcaacgaaaagccgaagaattgggaatgactcctaaagaatacttggacccaatggcggctgatgttcaagaattatggaaaaaattggatatttcttatgataaatttatccgtactacagacacttatcatgaagaagccgtagcgaaggcttttgaacagttattggaacaagatgatatttatttgggaaaatatgcgggttggtattctgtttctgatgaagagtttttcactgaaacacaacttgaagaaattttccgagatgaatctggaaatattactggtggcattgcaccttctggtcatgaagtggaatgggttgaagaagaaacttatttcttccgcatgggaaaatatgctgactggcttttacaatattatgatgaacatccagattttattcaacctgaggttcgtaaaaatgaaatggtcaataatttcatcaagccaggtctagaagatttggctttgacacggacaagttttacttggggaattcctgtcccttctaatcctaagcatgtggtctacgtgtggtttgatgctttattgaactatattacagcgctcggctataattctgacaatgacagtaattttaaaaaatactggcctggaattaatatggttggtaaagaaattgttcgtttccatacgatttactggccaattatgcttcatgctctaggtttacctgctcctaaaaagattttcgctcatggatggctcttgatgaaagacggaaaaatgtctaaatcaaaaggaaatgttgtttatcctgagatgttgattgaacgttatggccttgatgcagttcgttattatttgatgcgtgcgatttcttttggacaagatggaattttcactccagaagactttgttggacgtattaattttgatttggccaatgatttggggaatttgttgaatcgtaccgtttcaatgattaacaaatataatgacggaaaaatcgaagcaactggagtttcgactgaatttgatgcaagtttggaagaagtggttgaagaaacaatcagtcatttccataaagcaatggataaatttgaattcaacgtagctttggctgatgtttggacattgatttcaagaacaaataaatatattgatgaaacagcaccttgggtccttgcaaaatcagaagacgacaaagcaaaattgaataatgttttgtatcatttggcagaaaatttacggattgcaggtgcacttttacaaccatttatgcgtgcaacatcaggtaaaatctttgagcaattgggaatggatgaaagatcattttcacttgaaaatctttcttttggctattcatttactcatcctgtagtagcaaaaggtcaacctattttcccacgtcttgatgtggaagaagaggttgcttatattaaattacaaatggctggtggtgtattgccagaaaaagagtgggtccctgaagaagttgaattgaatttaactttaccacaaattaaatttgatgattttgaaaaaattgaactaaaagttgccgaagtgcttgaagtagaacctgttgaaggttctgataaattgttgagatttaaattggatgctggtgattctgaaccacgtcaaatcttgtcaggaattgcacaattctatccaaatgaacaagaattagtaggtaaaaaattacaaatcgtagccaatttgaaaccacgtaaaatgatgaaaaaatacgtttcacaaggaatgattttgtcagccgaatttgatggaaaattgagtgtcttgaccgttgatgatgatgttcctgctggttcattgattgggtaa

SEQ ID NO: 24926 - protein, 662 aa, Lactococcus lactis subsp. lactis
MTENKTFYITTPIYYPSGKLHLGSSYTTIACDVLARYKRLMGFDTFYLTGLDEHGMKIQRKAEELGMTPKEYLDPMAADVQELWKKLDISYDKFIRTTDTYHEEAVAKAFEQLLEQDDIYLGKYAGWYSVSDEEFFTETQLEEIFRDESGNITGGIAPSGHEVEWVEEETYFFRMGKYADWLLQYYDEHPDFIQPEVRKNEMVNNFIKPGLEDLALTRTSFTWGIPVPSNPKHVVYVWFDALLNYITALGYNSDNDSNFKKYWPGINMVGKEIVRFHTIYWPIMLHALGLPAPKKIFAHGWLLMKDGKMSKSKGNVVYPEMLIERYGLDAVRYYLMRAISFGQDGIFTPEDFVGRINFDLANDLGNLLNRTVSMINKYNDGKIEATGVSTEFDASLEEVVEETISHFHKAMDKFEFNVALADVWTLISRTNKYIDETAPWVLAKSEDDKAKLNNVLYHLAENLRIAGALLQPFMRATSGKIFEQLGMDERSFSLENLSFGYSFTHPVVAKGQPIFPRLDVEEEVAYIKLQMAGGVLPEKEWVPEEVELNLTLPQIKFDDFEKIELKVAEVLEVEPVEGSDKLLRFKLDAGDSEPRQILSGIAQFYPNEQELVGKKLQIVANLKPRKMMKKYVSQGMILSAEFDGKLSVLTVDDDVPAGSLIG

SEQ ID NO: 24927 - DNA, 2049 bp, Haemophilus influenzae
  CDS (1)..(2049)
atgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgccaaagcaaaagccgatcacattcgtgattttgcaggttttaatattagttttgataactatcattccactcacagcgaagaaaacaaacagctcaccgcagaaatttacaataaactcaaagccaatggttttattaagagtaaagttatttctcagttattcgaccctgaaaaaaatatgttcttgcctgatcgttttgtgaaaggcacttgcccgaaatgcaaagcagaagatcaatatggcgataactgcgaagtgtgtgcttctacttatagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgccaacaaaatgcaagaatggtttgagagcgatttacaacaatgggatatttcacgtgatgcaccttatttcggttttgaaattcccggcgcaaaagataaattcttctatgtttggttagatgcgccaatcggctacatggcttcattcaaaaatctatgcaatcgtgaaggcattgatttcaatgaattttgggctgaaggcagtgatgcagagctttatcatttcatcggtaaagacatcgtttatttccacagcctattctggcctgcaatgcttgaaggcagtggctaccgtaaaccgactaatgtgttcgctcatggctatgtcactgtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtcaatacggatattgtaaacaaattagtgaatttagcttcacgcaatgcgggctttattgcgaaacgctttgaaggcaaacttgcggataaactggaagacaaatcattatttgcagaatttaccgcccaagccgagcaaatcgctgcttattacgaaagccgtgaatacaataaaaccattcgtgagattatggcattaacagataaagccaataaatacattgatgaaaaagccccttgggtgattgcaaaagaagaaggcaaagaggcagaattgcaagccgtatgttcaatgggtattgagcttttccgcgtattgatgtcttacttaaaacctgttcttccaaaactagcagaacgtgcagaaaccttcttacaagctgaattacgttgggataatattcatcaaccattacttggtcatacccttgcaccgtttaaagccttattctctcgtttagagaaaaaacaaattgatgccgttgtggaagaaactaaagccttatttgcagcagccaataaagccgcagaaaaaactgaagcaaaaccaaccgcactttctgccgttgaacctattgctgaaaccatcacgattgatgatttcgctaaacttgatatgcgtgtagcaaaagtattgaaatgcgaagcggtgccagaatccaataaacttttacgttttgaattagatcttggtgatcatactcgccaagtcttctctggcattaaagcggcttacaataaacctgaagaattagaaggtcgttttgtgattatggtggcaaaccttgcaccacgtaaaatgaaattcggcgtgtctgagggaatgattctatccgcaggaacaggcggtagtgacttattcttactttctgctgatagcggtgtcactgcgggcatgcaagtaaaataa

SEQ ID NO: 24928 - protein, 682 aa, Haemophilus influenzae
MTTQPRKILVTCALPYANGAIHLGHMLEHIQADIWVRFQRMRGNKIHFVCADDAHGTPIMLNADKLGITPEELIAKAKADHIRDFAGFNISFDNYHSTHSEENKQLTAEIYNKLKANGFIKSKVISQLFDPEKNMFLPDRFVKGTCPKCKAEDQYGDNCEVCASTYSPMDLINPRSAVSGTTPIVKESEHFFFDLPAFEGMLKEWTRSGSLQSEIANKMQEWFESDLQQWDISRDAPYFGFEIPGAKDKFFYVWLDAPIGYMASFKNLCNREGIDFNEFWAEGSDAELYHFIGKDIVYFHSLFWPAMLEGSGYRKPTNVFAHGYVTVDGAKMSKSRGTFIQASTYLNHIDPECLRYYYAAKLNDRIEDLDFNLEDFVQRVNTDIVNKLVNLASRNAGFIAKRFEGKLADKLEDKSLFAEFTAQAEQIAAYYESREYNKTIREIMALTDKANKYIDEKAPWVIAKEEGKEAELQAVCSMGIELFRVLMSYLKPVLPKLAERAETFLQAELRWDNIHQPLLGHTLAPFKALFSRLEKKQIDAVVEETKALFAAANKAAEKTEAKPTALSAVEPIAETITIDDFAKLDMRVAKVLKCEAVPESNKLLRFELDLGDHTRQVFSGIKAAYNKPEELEGRFVIMVANLAPRKMKFGVSEGMILSAGTGGSDLFLLSADSGVTAGMQVK

SEQ ID NO: 24929 - DNA, 2879 bp, Bacillus stearothermophilus
  CDS (646)..(2595)
ctgcagcaaaatttccgcgccttcgcggcttaaaatgattttgccgcccgctaatttaaagttgtcgtccgatacttcccccgtgacgacgcatgtcatattcggcttatattttttcaaaatgatgcgatcgtcatcgacgtaaatttccaatgcatccttttcgttaatgtccagtgtacggcgcaactcaatcgggatgacgacacggcccaactcatcgactttacgtacgatccccgtcatttcatcgtctgctctcctctccgcaatgatttttatcgtttattcgtcaatattcgacaaatttcctacaccctaatcatatcagtgtttccattatgcgtcaatcctttaatatgtaaaattttaaaaaaatgtatattgttattgtggaaaaaagtttgtggttgggtataaaggaacatgaaccattttatttgccaaaactctatccctctataataaattcgcggcgattgtccaaaataaggaggtatttttgcccatttgcgtatatttttttcgtcatggagaaatagatgtttttgtacaatgaaaaaattatgtaaaatagaagtaacgccgctctcgtcctcaggacaggggcttttgtgcgcaacagtacgagggagggcctaacagatggagaaaaagacgttttatttgacgacgccgatttattacccaagcgacaaattgcacattggccatgcttatacgaccgtggcgggggatgcgatggctcgctataagcggctgcgcggctatgatgtcatgtatttgaccggaacggacgaacatgggcaaaaaattcagcgcaaggcgcaagaaaaaggggtcacgccgcagcaatatgtcgacgacattgtcgccggcatccaagagttgtggagaaaattggacatttcatacgacgattttatccggacgacacaggagcggcataaaaaaattgtcgaaaagattttcgcccgtcttgtcgaacaaggtgatatttatttaggcgagtatgaaggctggtactgcacgccgtgcgaatcgttttacaccgaacggcagcttgttgacggcaactgcccagactgcggccggcctgttgaaaaagtgaaagaagagtcgtactttttccggatgagcaaatacgtcgaccgcctgctgcaatattacgaagaaaatccagatttcatccagccggaatcgcggaaaaacgagatgatcaacaacttcatcaagccggggctcgaggacttggctgtatcgcggacgacgtttgactggggcattaaagtgccaggtgacccgaagcacgtcatttacgtctggatcgatgcgctggccaactacatcacagcgctcggctacggtacggacaacgatgaaaagtttcgcaaatattggccggcggatgtccatctcgtcggcaaggagatcgtccgcttccatacgatttactggccgatcatgctgatggcgctcggcctgccgctgccgaaaaaagtgttcggacatggctggctgctgatgaaagatgggaaaatgtcgaaatcgaaaggcaatgtcgtggatccggtgatgatcattgatcgttacgggcttgatgcactccgctactatttgctgcgggaagtgccgtttggctctgacggggtgtttacgccggaagggtttatcgagcgcatcaattacgatttggccaacgatttaggcaatttgttgcaccggaccgtcgcgatgattgagaaatattttggcggcgcgattccgccgtaccgcggcccgaaaacgccgtttgaccgagatctttccgaaacggcgcgcgaggttgtccgtcaatatgaagaggcaatggagcggatggagttttccgttgccctctccgccgtttggcagctgattggccgaacgaacaaatatatcgacgaaacgcagccatgggtgttggcgaaagaggaaagcaaacgggaggaacttgcctctgtcatggcccatctagccgaatcgctccgctatacggcggtgttgctgcagccgtttttgacgcgcacgccggagcgcatcttcacccagctcggcatcagcgaccgttcattgaaagagtgggacagcctgtacgatttcggccttattccggaagggacgaacgtgcagaaaggggagccgctcttcccacgcttggatatcggcgttgaagtcgagtacattaaggcgcatatgcaaggcggcaaaccggcggaagcggccaaagaggaaaaacaagcggctcgggcggaggaaatctccatcgacgactttgcgaaagtcgacttgcgcgtcgccgaagtcgtgcagcccgagcgaatgaaaaacgccgacaagctgttgaagctccagcttgatctcggcggcgagaagcggcaagtgatttccggcatcgccgagttttacaagccggaggaactcatcggcaaaaaggtcatttgcgtcgccaacttaaaaccggccaagctgcgcggcgaatggtcggaaggaatgattttggccggcggcagcggcggcggcttttcgttggcaaccgtcgaccagcacgtgccaaacggcacaaaaatcaaataatgcaacgaacggatgagggggtgtcgtcgttgacacctccttgttgctattttgtaatggaaatgttactaaattgtgacatacgtaactaatttctatgctacacttaacatcaaggtggaaaagagggacttcgtatgctttttgacactcatgctcatttgaacgccgtccaatatgaggaagacttggagcaagtgatcgagcgcgcccgcgctgaaggagtttcgcacatcgtggttgtcgggtttgaccggccgacgattgaccgggcgatcgagctc

SEQ ID NO: 24930 - protein, 649 aa, Bacillus stearothermophilus
MEKKTFYLTTPIYYPSDKLHIGHAYTTVAGDAMARYKRLRGYDVMYLTGTDEHGQKIQRKAQEKGVTPQQYVDDIVAGIQELWRKLDISYDDFIRTTQERHKKIVEKIFARLVEQGDIYLGEYEGWYCTPCESFYTERQLVDGNCPDCGRPVEKVKEESYFFRMSKYVDRLLQYYEENPDFIQPESRKNEMINNFIKPGLEDLAVSRTTFDWGIKVPGDPKHVIYVWIDALANYITALGYGTDNDEKFRKYWPADVHLVGKEIVRFHTIYWPIMLMALGLPLPKKVFGHGWLLMKDGKMSKSKGNVVDPVMIIDRYGLDALRYYLLREVPFGSDGVFTPEGFIERINYDLANDLGNLLHRTVAMIEKYFGGAIPPYRGPKTPFDRDLSETAREVVRQYEEAMERMEFSVALSAVWQLIGRTNKYIDETQPWVLAKEESKREELASVMAHLAESLRYTAVLLQPFLTRTPERIFTQLGISDRSLKEWDSLYDFGLIPEGTNVQKGEPLFPRLDIGVEVEYIKAHMQGGKPAEAAKEEKQAARAEEISIDDFAKVDLRVAEVVQPERMKNADKLLKLQLDLGGEKRQVISGIAEFYKPEELIGKKVICVANLKPAKLRGEWSEGMILAGGSGGGFSLATVDQHVPNGTKIK

SEQ ID NO: 24931 - DNA, 1131 bp, Saccharomyces cerevisiae
  CDS (1)..(1131)
atgtccgatctcgttaccaagttcgaatcgcttattatttcaaagtatccagtttctttcactaaagaacaatctgctcaagctgcccaatgggaatcggttctaaaatctggtcaaatccaaccacacttagatcaattgaatttggtgttaagagacaacaccttcattgtgtccactttgtacccaacatctaccgacgttcacgtcttcgaagtcgccttaccattgattaaggatttagtggcaagctccaaggatgtcaagtcaacttataccacatacagacatattttgagatggattgattacatgcaaaacttgttggaagtgtcgagcactgacaagttagaaataaatcacgatttggacttacctcatgaagttattgagaagaagaaaaaggcacctgcgggtggcgctgctgatgccgcagccaaggcagacgaagatgttagtaagaaggctaaaaagcaagatcatccaagaggtaagcctgatgaagaaacccttaagaaattgagagaggaggcaaaggccaagaaggcagctaagaaggccgccaacgccaaacaacaacaagagcaacaaaataaggccccagaaaagccaaagccatccgcaatagatttccgtgttggttttattcaaaaagccatcaagcacccagatgccgactccctatatgtctctacaattgatgtcggtgatgaagaaggcccaagaactgtttgttctggtttggtcaagcattttcctttggacgctatgcaagaacgttatgttgttgttgtatgcaacttgaaaccagttaacatgagaggtattaaatccactgctatggtattgtgtggttctaacgacgacaaagttgaatttgtcgagccaccaaaggactctaaggccggtgacaaggtgttctttgaaggtttcggtgacgaagctccaatgaagcaattgaatccaaaaaagaagatctgggaacacttacaacctcattttactacaaatgacgggttggaagttatcttcaaagacgaagaagaaaaggaccatcctgtaagaaagttgaccaacgctaagggcgaatcattcaaggttgctagtattgctaatgctcaagtccgttaa

SEQ ID NO: 24932 - protein, 376 aa, Saccharomyces cerevisiae
MSDLVTKFESLIISKYPVSFTKEQSAQAAQWESVLKSGQIQPHLDQLNLVLRDNTFIVSTLYPTSTDVHVFEVALPLIKDLVASSKDVKSTYTTYRHILRWIDYMQNLLEVSSTDKLEINHDLDLPHEVIEKKKKAPAGGAADAAAKADEDVSKKAKKQDHPRGKPDEETLKKLREEAKAKKAAKKAANAKQQQEQQNKAPEKPKPSAIDFRVGFIQKAIKHPDADSLYVSTIDVGDEEGPRTVCSGLVKHFPLDAMQERYVVVVCNLKPVNMRGIKSTAMVLCGSNDDKVEFVEPPKDSKAGDKVFFEGFGDEAPMKQLNPKKKIWEHLQPHFTTNDGLEVIFKDEEEKDHPVRKLTNAKGESFKVASIANAQVR

SEQ ID NO: 24933 - DNA, 1995 bp, Bacillus subtilis
  CDS (1)..(1995)
atgccgcaagaaaacaatacattttacattacaacaccgatttattatccgagcggaaaattacatatcggccatgcatatacgacagtcgcaggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacgacagaaaaacggcataaagttgtcattgaaaaagtgtttcaaaagcttcttgataacggggacatctatcttgatgagtatgaaggctggtacagcatccctgatgaaacgttctacacggaaactcagctcgttgatattgagcggaatgaaaagggagaggtcatcggcggaaaaagccctgacagcggtcacccagttgaattgatcaaagaggaatcttatttcttccgcatggggaaatacgcggatcgtcttctgaaatactatgaagaaaacccgacattcattcagccagaatcacgcaaaaacgaaatgattaataactttatcaaacctggacttgaggatttggcagtatcacgtaccacttttgattggggcgtgaaggtgccggaaaatccaaagcatgttgtatatgtttggattgacgcactatttaactatttaacggcactcggttatgatacagaaaatgatgagctttatcaaaaatattggcctgccgatgttcatttagtcggtaaggagattgtacgattccatactatttactggccaattatgctgatggcgctggatcttccgctgccaaagcaagtattcgcgcatggctggcttttgatgaaagacggaaaaatgtcgaaatcaaaaggaaacgttgtagatccggttacattaattgaacgctatggtttagacgaacttcgctattacttgcttcgcgaagtgccgttcggatcagacggtgttttcacgccggaaggatttgttgagcgaatcaactatgatttagcgaatgatttaggaaatctattgaatcgtactgttgcgatgattaataagtattttgacggacaaatcggttcttacaaaggtgctgttacggaatttgaccatacgctcacttctgttgctgaagaaacagtgaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcatctcgctgaatcattgcgtatttcagcggtactgcttcagccattcttaacaaaaacacctgaaaaaatgttcgagcagctgggcattactgatgaatctttaaaagcttgggacagcattacagctttcggccagctgaaagatacaaaagtacaaaaaggcgagccattgttccctcgtttagaggcagaagaagaaattgcttacatcaaagggaaaatgcaaggttcagcaccagcgaaagaagaaacaaaagaagaagagcctcaagaggtcgatcgtttacctgaaattacgattgatcaatttatggatgtagagcttcgcgtagctgaggtcattgaggcagagccagtgaaaaaagcagaccgtttattgaagctgcagcttgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtatctatcgatcagtcgttaccaaaaggcacaagaattaaataa

SEQ ID NO: 24934 - protein, 664 aa, Bacillus subtilis
MPQENNTFYITTPIYYPSGKLHIGHAYTTVAGDAMARYKRLKGFDVRYLTGTDEHGQKIQQKAEQENITPQEYVDRAAADIQKLWKQLEISNDDFIRTTEKRHKVVIEKVFQKLLDNGDIYLDEYEGWYSIPDETFYTETQLVDIERNEKGEVIGGKSPDSGHPVELIKEESYFFRMGKYADRLLKYYEENPTFIQPESRKNEMINNFIKPGLEDLAVSRTTFDWGVKVPENPKHVVYVWIDALFNYLTALGYDTENDELYQKYWPADVHLVGKEIVRFHTIYWPIMLMALDLPLPKQVFAHGWLLMKDGKMSKSKGNVVDPVTLIERYGLDELRYYLLREVPFGSDGVFTPEGFVERINYDLANDLGNLLNRTVAMINKYFDGQIGSYKGAVTEFDHTLTSVAEETVKAYEKAMENMEFSVALSTLWQLISRTNKYIDETAPWVLAKDPAKEEELRSVMYHLAESLRISAVLLQPFLTKTPEKMFEQLGITDESLKAWDSITAFGQLKDTKVQKGEPLFPRLEAEEEIAYIKGKMQGSAPAKEETKEEEPQEVDRLPEITIDQFMDVELRVAEVIEAEPVKKADRLLKLQLDLGFEKRQVVSGIAKHYTPEELVGKKLVCVTNLKPVKLRGELSQGMILAGEADGVLKVVSIDQSLPKGTRIK

SEQ ID NO: 24935 - DNA, 2544 bp, Thermus aquaticus
  CDS (361)..(2211)
gagatcgtccccttcggctaccgggcgaccctcaaggccatcgccgacctcgggggggagcccgagctccgcatggacggggacgagttctacttcaccgacggcggccacctcatcgccgactgccgcttcggccccatcggggaccccttgggcctgcaccgggccctcttggagatccccggggtggtggagacggggctcttcgtggggatggccacccgggccctggtggcggggccttttggggtggaggagcttctgccgtagaatggaggccatgaagggcatgccccggtcctagggcggggaggcttccccgcccggggcgcgtgccccggttttttttagggagggcgcatggaaaaggtcttctacgtgaccacccccatctactacgtgaacgccgagccgcacctgggccacgcctacaccacggtggtggcggactttctggcccggtggcaccgcctggacggctaccgcaccttcttcctcaccggtaccgacgagcacggggagacggtctaccgggcggcccaggcggcgggagaggaccccaaggccttcgtggaccgggtctccgggcgcttcaaaagggcctgggacctcctcggcatcgcctacgacgacttcatccgcaccacggaggaaaggcacaagaaggtggtgcagctcgtcctaaagaaggtctacgaggccggggacatctactacggggagtacgagggcctctactgcgtctcctgcgagcgcttttacacggagaaggagctcgtggaggggctttgccccatccacggaaggcccgtggaaaggcggaaggaggggaactacttcttccgcatggagaagtaccgcccctggctccaggagtacatccaggaaaatcccgacctcatccgccccgagggctaccggaacgaggtcctggccatgctcgccgagcccatcggggacctctccatctccaggccaaaatcccgcgtcccctggggcatccccctcccctgggacgagaaccacgtgacctacgtctggtttgacgccctcctgaactacgtctccgccctggactaccccgagggggaggcctaccggaccttctggccccacgcctggcacctcatcggcaaggacatccttaagccccacgccgtcttctggcccaccatgctgaaggcggcggggatccccatgtaccgccacctgaacgtgggagggtttttgctggggccggacgggcgcaagatgtccaagaccctggggaacgtggtggaccccttcgcccttctggaaaagtacggccgggacgccctgcgctattacctccttagggagatcccctacggccaggacaccccggtgagcgaggaggccctaaggacccggtacgaggccgacctcgccgacgacctgggcaacctggtgcaaaggacccgggccatgctcttccgtttcgccgagggccgcatccccgaacccgtggcgggggaggagctcgccgaggggacggggcttgccgggaggctcaggcctttggtgcgggagctcaagttccacgtggccctcgaggaggccatggcctacgtcaaggccttgaaccgctacatcaacgagaagaagccctgggagcttttcaagaaggagccggaggaggcccgggccgtgctctaccgggtggtggagggcctgaggatcgcctccatcctcctcaccccggctatgcccgacaagatggcggagctcaggcgggccctggggcttaaggaggaggtgcgcctcgaggaggccgagcgctggggcctggccgagccccgccccatccccgaggaagcccccgtccttttccccaaaaaggaggccaaggtggaggccaagcccaaggaagaggcctggatcggcatagaggacttcgccaaggtggagctcagggtggcggaggttttggcggcggagaagcacccgaacgccgaccggcttttggtcctcaggctctccctggggaacgaggagcgcaccgtggtctcggggatcgccaagtggtaccggcccgaggagctcgtgggcaagaaggtggtcctggtggcgaacctcaagcccgccaagctccggggcattgagagccaggggatgatcctcgccgcccaggagggggaggccttggccctggtgacggtggagggggaggtgccgcccgggcggtggtgaagtaatacctccccacgccggggcaagccggcatgggggccccggcaaagggttctcaaggggctccctgggcctaagagggctgttgcggcctctgccgaagcccccataatggttgcatgggggaaacctttgcggaggtcaagcgggaactcatagccctccttcgccctggcgtgcgggtgccgaactggtccaaggctgcggagaaaaaccccggtcgcctgaagaggcggagtttgtcgtgcttgaggtggacaaggcgaagggtggcgcttcagagcggggagagcgggtagaggttcttgggggcgttggagaacgtcttggcgg

SEQ ID NO: 24936 - protein, 616 aa, Thermus aquaticus
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTYVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKKEAKVEAKPKEEAWIGIEDFAKVELRVAEVLAAEKHPNADRLLVLRLSLGNEERTVVSGIAKWYRPEELVGKKVVLVANLKPAKLRGIESQGMILAAQEGEALALVTVEGEVPPGRW

SEQ ID NO: 24937 - DNA, 2394 bp, Arabidopsis thaliana (mouse-ear cress)
  CDS (1)..(2394)
atggaagacgacggcaagagcagccccaagttaccgatccctggaaagagaaatatactaatcaccagtgctttgccttacgtcaacaacgttcctcatctcggaaacatcatcggatgtgttctgagcgctgatgtgtatgctagatactgtcgtctccgtggctataatgcgatttacatatgtggaaccgatgaatatgggactgcaactgagaccaaagctttggaggagaattgcacccccaaggaaatctgtgacaagtaccatgccattcataaagaagtttatgactggtttggtataagttttgacaagtttgggcgaacttcaactccagaacagactgaggtgtgccaagcaattttcaacaagttgtgggacaacaagtggctttcagagaacaccatgcagcagctttactgcgatacatgcaagaagttcttagctgaccggcttgttgagggttcttgtccgttcgaaggatgtaattatgattctgctcgtggagatcagtgcgaaaaatgtggaaagctcctgaatcctactgaacttaaagatccgaagtgcaaggtctgtcaaaacacaccccgaattcgcgacacagaccacctgtttattgagcttccgttactgaaagataggttggaagcgtatattaaaaagacctctgttactggatcttggagtcaaaatgctattcaaacgacaaatgcatggcttagggatgggcttagacagagatgcattacgagggatcttaagtggggagtgcctgtcccacatgagaaatacaaggacaaagtcttctatgtttggtttgatgctcctattggatacgtctcaataacgtcttgctacacatctgaatgggagaagtggtggaagaatcctgagaatgtggagctttatcagtttatggggaaagacaatgtgccatttcacactgtgatgtttccctctacccagcttggaactgaggaaaattggacactcatgaagacaatcagtgtgactgaatatttaaactatgaagacggaaagttctccaagagtaaaggtgttggagtgtttggtaatgatgtaaaagatacaaatatacctgtcgaagtgtggagatactacttgctgaccaacaggcctgaggtgtctgacacatcgttttcatggactgatttgcaagcaaaactgaatggcgagttgctgagcaacctaggcaactttgttaatcgagttctgagttttatagcaaagcctgataatgcaggttacgggtctgtcattcctgatgctcatgatgctgaatctcattctttaacaaaatcactggcggaaaaggttgaaaagtttgtggcagagtatgttgaagccatggaaaaggttaagctcaagcagggactgaaaactgctatgctgatttcaagcgaagggaactattacttgcaggcaagccaattttggaaactttacaaggaagataaacctttgtgtgcagttgttataagaactgctgctggtttagtacaccttcttgctcaattgttagaacctttcatgccatccttttcttgtgaggtatttaaacagctaaatttgcctccacaattttctctctccgacgagaggggagaggtattactagcaagtagaccatgggatattctgcctcctagccacaggataggcacccctcaacctttgttcaaggagttggaaaacgacgaagtggcacggtacagagaaaagtttgctggaagtcagtctgatagacgtgctagggatgaagcagcaaatttggcggatcaacttaataaaacaaaactttcagatgccaagaaacaaaaggcatcatcaaaaggcggaggaaaacccaaacctcaaccagctgctgatcgtgaaataactatggcaagacttgatatccgagttggtaaaattgtgaaggctgagaaacatcccaaggcagatgcattgtatgtagaagaaattgatgttgggggtggtgaaattcgcactgttgtcagtggactggtcaaatatatacctcttgaggaaatgcagaatcgtatggtttgtgttctttgcaacttgaaaccggcgaaaatgagggatattgtgtcacaagcaatggttcttgcagcttccagtagtgatggaagcaaggtggagttagttgagccccctaaaactgctaatattggagagcgagttacatttcccgggtttgaaggcgagccagacgatgtcttaaacccaaagaagaaagtatgggagacgcttttggttgatctaaacacaaaagagaatctagttgcttgctacaaagatgtgcccttcactacatctgcaggtgtatgcaaagtttcatccatcagcaatggcacgatccggtaa

SEQ ID NO: 24938 - protein, 797 aa, Arabidopsis thaliana (mouse-ear cress)
MEDDGKSSPKLPIPGKRNILITSALPYVNNVPHLGNIIGCVLSADVYARYCRLRGYNAIYICGTDEYGTATETKALEENCTPKEICDKYHAIHKEVYDWFGISFDKFGRTSTPEQTEVCQAIFNKLWDNKWLSENTMQQLYCDTCKKFLADRLVEGSCPFEGCNYDSARGDQCEKCGKLLNPTELKDPKCKVCQNTPRIRDTDHLFIELPLLKDRLEAYIKKTSVTGSWSQNAIQTTNAWLRDGLRQRCITRDLKWGVPVPHEKYKDKVFYVWFDAPIGYVSITSCYTSEWEKWWKNPENVELYQFMGKDNVPFHTVMFPSTQLGTEENWTLMKTISVTEYLNYEDGKFSKSKGVGVFGNDVKDTNIPVEVWRYYLLTNRPEVSDTSFSWTDLQAKLNGELLSNLGNFVNRVLSFIAKPDNAGYGSVIPDAHDAESHSLTKSLAEKVEKFVAEYVEAMEKVKLKQGLKTAMLISSEGNYYLQASQFWKLYKEDKPLCAVVIRTAAGLVHLLAQLLEPFMPSFSCEVFKQLNLPPQFSLSDERGEVLLASRPWDILPPSHRIGTPQPLFKELENDEVARYREKFAGSQSDRRARDEAANLADQLNKTKLSDAKKQKASSKGGGKPKPQPAADREITMARLDIRVGKIVKAEKHPKADALYVEEIDVGGGEIRTVVSGLVKYIPLEEMQNRMVCVLCNLKPAKMRDIVSQAMVLAASSSDGSKVELVEPPKTANIGERVTFPGFEGEPDDVLNPKKKVWETLLVDLNTKENLVACYKDVPFTTSAGVCKVSSISNGTIR

SEQ ID NO: 24939 - DNA, 853 bp, Arabidopsis thaliana (mouse-ear cress)
  CDS (1)..(822)
atggcggcgacgatagctgtttttaccggtggtctgaaagtgaaggctggagttctcgccgttcaaatctcatcgcttcctctccgccgcgaattccctcgttacttgtcgtcttcctcgaggaggacagtagcggcaatctcctcgtctcttcgagtctccgccgtatataaccatcagcagcgtaatcgaagctcttggcctcgagttgctactttctgtacggcggctccagatgccggcacgacggtttcagcggatgaatcggagaagaagagcgaatctcagaaggaagaggagaatgtgaaggagacggcgaatctgttagatataaaagtaggacgaattgtgaaagcttggcaacacgaagaagctgattctctgtatgttgaagaagtcgacatcggtgaagctgagcccagaatcatctgcagtggtctcgtcaaatatgttcctcttgatctccttcagggtgcatcagtggtggtgctggctaatctgaagccgaggaatatgagaggggttaagtcatgtggtatgcttttagctgcatctgacgcagctcatgaaaatgttgagcttcttgttccaccagaaggctctgttcctggagatagagtttggtttggtaacgaagaagatctcgagcagcttcctgaacctgcacctcctaataaggttcaaaagaagaagatgtgggaattggtgcaaccacttttgaagacagatgcgtctggtgtttcaatgcttaaggagcatttgatgcggacatcttctggtcttgttacttccaagtctttaagaaatgccaacatttcttgatttctgttaaaagctattttgtgatgttgtt

SEQ ID NO: 24940 - protein, 273 aa, Arabidopsis thaliana (mouse-ear cress)
MAATIAVFTGGLKVKAGVLAVQISSLPLRREFPRYLSSSSRRTVAAISSSLRVSAVYNHQQRNRSSWPRVATFCTAAPDAGTTVSADESEKKSESQKEEENVKETANLLDIKVGRIVKAWQHEEADSLYVEEVDIGEAEPRIICSGLVKYVPLDLLQGASVVVLANLKPRNMRGVKSCGMLLAASDAAHENVELLVPPEGSVPGDRVWFGNEEDLEQLPEPAPPNKVQKKKMWELVQPLLKTDASGVSMLKEHLMRTSSGLVTSKSLRNANIS

SEQ ID NO: 24941 - DNA, 582 bp, Geodia cydonium
  CDS (62)..(511)
ggcacgagcaggaggtggaggaggaggggcgagtgctgctgtagatgtgtctcgactggatatgagaattggtcgtattacatccgtggagcgacatccagatgccgatacactctatgttgaacaaattgatgtgggggaggaaaagccaaggacagtgtgcagtggactagtgacccacgtggccatcgagacaatgaacaaccgccttgttgtcgtcctctgcaaccttaagcctgtcaagatgcgtggtgtgacgtctgaggcaatggtcatgtgtgcaagttcaccagagaacattgaaatcttggatcctcccgattcatgtgttcctggggacagagtcacctttactggctacacaggttctccagacacccaactcaatccaaagaaaaaggtgtttgagacggtgcagccagatttcctcgttaacgaggagggcgtggccacataccggggaatccctttacagtggagggtaagggtgtgtgccgcacagcaaccatgaggggctctggcataaaataacttattttttccgttgtgtagcttttattatgatgaaaatcgtaaaattta

SEQ ID NO: 24942 - protein, 149 aa, Geodia cydonium
MRIGRITSVERHPDADTLYVEQIDVGEEKPRTVCSGLVTHVAIETMNNRLVVVLCNLKPVKMRGVTSEAMVMCASSPENIEILDPPDSCVPGDRVTFTGYTGSPDTQLNPKKKVFETVQPDFLVNEEGVATYRGIPLQWRVRVCAAQQP

SEQ ID NO: 24943 - DNA, 2175 bp, Borrelia garinii PBi
  CDS (1)..(2175)
atgaaaaaaatgaatctggttacagctgctctaccctatgttaacaacattcctcatcttggaaatttagtacaagtattatcagctgatgcttttgcaagatattctaaaatgtcaggaattgaaactctttatatctgtggaacagatgaatatggaacagccacagaaaccaaagccttaattgagaaaactagccctttagaactttgcaataaatattataaaatacataaatcaatttacaaatggttcaatattgaatttgatatcttcggtcgcacaaccaataagcaccatcaagacattgtacaaaattttttcctaaaattagaaaaaaatggctatataaaagagagagaaactgaacagtttttttgcaacaaagattcaatattcttagctgatagatatgtgataggagaatgcccagagtgccaaagcatagctaaaggagatcagtgcgaaaactgttctaaacttttaaatccaatagacctaataaatccaaaatgtataatttgtaaaaacaaacctgttttaaaaaaaaccaaccatctttatatagatcttcccaaaataaaaagaaaacttgagaaatggataaaaaattcgactactagcaagaattggaataccaatgcccttaaaatgacaaatgcttttttaagagatggtcttaaagaaagagcaattacaagagacctaaaatggggaattcctgtacctaaaaaaggttatgaaaataaagtattttatgtctggtttgatgctccaataggatatatttcaattaccaaaaaccttgtaaaaaattgggaatcttggtggaaaaacaatgagcaagtaaatcttgtacaatttattggaaaagacaatatattgtttcacacagttatattcccttctatagaaattggaagtaaagaaaattggacaatattaaatcagctctcatcaagcgagtacttaaattatgaaaatcttaaattttcaaaatcagaaggaacaggaatttttggaaacgatgttattactacaggaatcccttctgatgtttggcgattctatatctattataacagacccgaaaaatctgattttcaatttatgtggcaagatcttatggaaagagtaaatacagaacttattgataatttttcaaaccttgtcaacagagtattaacatttcaaaaaaaattctttggagatgtaatagaaacaatagaaattcaaaataaattttggaaacaaataataccaaaatataataaaatactaaatctttttaaaaagacagaactaaaatctgcactaaaagaaatacttaaaatttcatcccttggaaacaaaatctttcaagataatgaaccgtggaaaagaaaagatagctctccgcaagaaacaaaagagctaatctcaaacttaatatacttaatcagagatttatctattttaatgatgccattcattccagaaacaagcaaaaaaatacaacaattctttggcaacagctatcaattttctaccaaaattcttggaactaaatcgggaattaaaagaattgaattcacagaaatattattcaataaactagagcaaaaaaaaatcaacaatttaaagctaaaatattcaggagaaaaaaacatggaagaaaaagaacaaccagaaaacttatttagagaaaaagtgctcttaaaagttgtgaaaataaataaaatagaaagaaatcccgaggctaaaaacctattcatattaaaactagatgacggaactaatgaaaacaaacaaatagtaagtagccttgaaggatattatacagaaaaagagcttttgggaaaacatataataatagtagataatctaaagcctgcaaagtttagaggaataaaatctgaaggaatgctaatagctgctgaagataaaaataaaaattttaaaattataattgtagaagattcaattaaaaatcctattcctggggagcgaataatacttgaaaacgatcaaaataaagatctcatttgcccacctaaaattgacataaataaattttcaaaagctaatatagtagcaaaagacggagagctcaaaataaacggaataaacttaatattagaacattctaagaataaaatattgtctaaagatattccaaacggaatagtttgctaa

SEQ ID NO: 24944 - protein, 724 aa, Borrelia garinii PBi
MKKMNLVTAALPYVNNIPHLGNLVQVLSADAFARYSKMSGIETLYICGTDEYGTATETKALIEKTSPLELCNKYYKIHKSIYKWFNIEFDIFGRTTNKHHQDIVQNFFLKLEKNGYIKERETEQFFCNKDSIFLADRYVIGECPECQSIAKGDQCENCSKLLNPIDLINPKCIICKNKPVLKKTNHLYIDLPKIKRKLEKWIKNSTTSKNWNTNALKMTNAFLRDGLKERAITRDLKWGIPVPKKGYENKVFYVWFDAPIGYISITKNLVKNWESWWKNNEQVNLVQFIGKDNILFHTVIFPSIEIGSKENWTILNQLSSSEYLNYENLKFSKSEGTGIFGNDVITTGIPSDVWRFYIYYNRPEKSDFQFMWQDLMERVNTELIDNFSNLVNRVLTFQKKFFGDVIETIEIQNKFWKQIIPKYNKILNLFKKTELKSALKEILKISSLGNKIFQDNEPWKRKDSSPQETKELISNLIYLIRDLSILMMPFIPETSKKIQQFFGNSYQFSTKILGTKSGIKRIEFTEILFNKLEQKKINNLKLKYSGEKNMEEKEQPENLFREKVLLKVVKINKIERNPEAKNLFILKLDDGTNENKQIVSSLEGYYTEKELLGKHIIIVDNLKPAKFRGIKSEGMLIAAEDKNKNFKIIIVEDSIKNPIPGERIILENDQNKDLICPPKIDINKFSKANIVAKDGELKINGINLILEHSKNKILSKDIPNGIVC

SEQ ID NO: 24945 - DNA, 1956 bp, Symbiobacterium thermophilum
  CDS (1)..(1956)
atgaccaggttctacatcacgacgcccatctactaccccagcagcaagctgcacatcggccactcttacacgaccgtggccgcggacgcgctggcgcgctaccaccgccggctggggcatgagacgtacttcctgaccggcacggacgagcacggtcagaagatcgagcgggcggcccttgccgaggggaagaccccgatccagttcgtggacgagattgtggccggcatcaaggaactctgggcagccctgcacatctcctacgacgacttcatccgcaccaccgaggagcggcacaagaaggtcgtgcagaagatcttcaagcagctgtacgaccagggcgacatctacaagtcctcgtacgagggctggtactgtacgccgtgtgagacgttctggatcgagagcaagctgaaggagggcaacctctgcccggactgcggccgtccggtggagtggaccaaggacgagagctatttcttccgcctctccaagtacgcggaccggctgctgcggtacattgaggagaccgacttcatccagcccgcgtcccgcaagaacgagatgatctcgttcatcaaccaggggctggaggacctctgcgtctcccgcagcacggtgcgttggggcattccggtgcccttcgatgagaagcagacgatctacgtctggatcgacgccctctccaactacatctccgccctgggctggggcacggagaacgacgaactgtaccggaagttctggccggccgacgtgcacctggtgggtaaggagatcgtgcggttccacaccatcatctggccgtgcatcctgatggcgctgggcctgccgctgcccaagaaggtcttcggccacggctggctgctgttcggcacccaggccgagaagatgtccaagtccaagggcaacgtggtggatcccttcgtcctcatcgaccggtacggtgtggacgccgtccggtactacctgctgcgggaggtgcccttcggcgcggacggcacctacaccgaagaggcgttcatcctgcgcaccaacaacgacctggccaacgacctgggcaacctgctttcccgcacgacgcagatgatcaacaagttcagcgacggccgggtccccgagcccgatccggcgagcgacgaccggatcctgtccgacctggccgcccaggtgctccgggagttccaggaggccatggatcggctggagatctcctcggcgctggttgccctgtggaagctggtggatcgggcaaacaagtatattgacgagcaggcgccctgggccctggcgcgggatcccggcagggccggccagctccgcacggtgctgtacaaccttgccgagacgctgcgcctgctcggggtggcgctcacgccgttcctggtccagacgccggagcggatctgggaccagctcggcctggagcccgcacaggtgcggacgctcccctgggaggaggcggtcgcctggggcggcctgaagcccggcaccgtgatccgccggggcagcccgctgttcccgcgcatcgagctgccgaaggagaacggcgactcggttgcgaaggagggcaaggcgcagtccggcgagcccgccgccggggccgctcagccgacggagggcgtggcggagatcgaatacgacgacttcgccaaggtggagctgaaggtcgcggaggtcgtggaggccgaacggattcccaaggccgaccggctgctccgcctcgtcctccaggtgggcgaggagcgccggcagatcgtctccggcatcgcgcagcactacgcgccggaggagctggtcggcaagcggatcatcctggtggccaacctgaagccgaagaagcttcgcggggtcgaatcccacggcatgctgctggccgccaccgcggaggacggaagcctcagcctggtcacgctcgacaagccggacttccccaccgggatgcgcgtgaagtag

SEQ ID NO: 24946 - protein, 651 aa, Symbiobacterium thermophilum
MTRFYITTPIYYPSSKLHIGHSYTTVAADALARYHRRLGHETYFLTGTDEHGQKIERAALAEGKTPIQFVDEIVAGIKELWAALHISYDDFIRTTEERHKKVVQKIFKQLYDQGDIYKSSYEGWYCTPCETFWIESKLKEGNLCPDCGRPVEWTKDESYFFRLSKYADRLLRYIEETDFIQPASRKNEMISFINQGLEDLCVSRSTVRWGIPVPFDEKQTIYVWIDALSNYISALGWGTENDELYRKFWPADVHLVGKEIVRFHTIIWPCILMALGLPLPKKVFGHGWLLFGTQAEKMSKSKGNVVDPFVLIDRYGVDAVRYYLLREVPFGADGTYTEEAFILRTNNDLANDLGNLLSRTTQMINKFSDGRVPEPDPASDDRILSDLAAQVLREFQEAMDRLEISSALVALWKLVDRANKYIDEQAPWALARDPGRAGQLRTVLYNLAETLRLLGVALTPFLVQTPERIWDQLGLEPAQVRTLPWEEAVAWGGLKPGTVIRRGSPLFPRIELPKENGDSVAKEGKAQSGEPAAGAAQPTEGVAEIEYDDFAKVELKVAEVVEAERIPKADRLLRLVLQVGEERRQIVSGIAQHYAPEELVGKRIILVANLKPKKLRGVESHGMLLAATAEDGSLSLVTLDKPDFPTGMRVK

SEQ ID NO: 24947 - DNA, 1938 bp, Desulfotalea psychrophila
  CDS (1)..(1938)
atgacaacttatataacaactccaatttattacgttaatgctcagccccacctcggtcatgcctataccaccattgtggctgatacctatagccgttttcgccacctctgtggtgaggatgttcgttttcaaacgggaactgacgaacatggagaaaaaattgttgaagcagcagagaaaaatggtgaggctcctaaggagtatgttgatagaataagtggtatgtttcgtcagacctggccaattcttggcatcgagcccgataattatattcgcaccaccgatgccaaccatattgcaactgtacagaaagttctgcaacaggtctacgataagggagatatttattttgataaatataccggactctactgccgtggttgtgagcgctttttgacagaaaaagagctggtggatggaaagtgccccgatcatcagactgctcctcaggaaattgccgagcagaattatttctttaagatgtcaaagtatcagcagcagttgcttgatcatatcaatgccaatgaggattttattacccctcatcgttatcgtaatgagatgctctcctttttgagtgaaccgctggaagatctttgcatctcccgccccaagagtcgtctgacctgggggatagagcttccctttgatgataattttgttacctatgtatggtttgatgcccttattaactatttgacaggtcttggttttccagaggatgataagtataataaattttggcctgttgcagagcatgtgattgccaaagacatcctcaaaccccacgcaattttttggccaaccatgctgatggccatggaactgcctctctataagaagttgcatgtgcacggttattggaatgtggacaataccaagatgtctaagagtattggtaatgttgtccgtccaaaagagcttgtcgatgagtacggtcttgatactcttcgctattttaccctgagagaaatgtcctttggtcttgatgcttcctttagctccgatgccattgtgtcccgtaaaaattccgatttggccaacgatttaggcaatctctttagtcgttccacggccatgattcaaaagtaccgtggtggcaagttacccgccccgatcgcctgtgaggcagatagtgaactgattgccctgagcaagcaggtagttgccacctataaagaagagatgggtgcctttcgttttcacagggccctacaggctgtgtggagtttggtgggatatgccaataaatatattgtcagcaatgagccatgggccttggctaaagatgaaaatgcttggcagagactggatacagtactctataatcttgctgagtgtttacgattcctggctctgttgattcgtcctgttatgccagatacagcatcaagaatggccacaggtctaggcctggcgacggatgcatcgatccttaactctcttgccttgggtggcgagtggggagttgtgcccgtgggcaccgttttaggtgaggctattaccctcttcccacgcatggaaacagcgaaaagtgaagagaaaaaggcagggaagaaggattgtcagggtgcaaaaaaacaggaggcagtgatctccgaggatggtcttgccaattttgctgattttcaaaagtttgagttgagggtggcagatattgtggttgctgagaggattaagaagtccgatcgtctcttaaagttgacagtcatggctccggaggagaggatcattgttgccgggattgcagcacattatagtccagaggatgttgttggtctcaaggttattattgttgctaatttgaagccggcaaaattgatgggtgttatgtctcagggtatggtgcttgcggccaaggtgagtgaagatggtggcgaacgattggtgctctccggggttcagggtgatgtccctgctggaactcgggtagcgtaa

SEQ ID NO: 24948 - protein, 645 aa, Desulfotalea psychrophila
MTTYITTPIYYVNAQPHLGHAYTTIVADTYSRFRHLCGEDVRFQTGTDEHGEKIVEAAEKNGEAPKEYVDRISGMFRQTWPILGIEPDNYIRTTDANHIATVQKVLQQVYDKGDIYFDKYTGLYCRGCERFLTEKELVDGKCPDHQTAPQEIAEQNYFFKMSKYQQQLLDHINANEDFITPHRYRNEMLSFLSEPLEDLCISRPKSRLTWGIELPFDDNFVTYVWFDALINYLTGLGFPEDDKYNKFWPVAEHVIAKDILKPHAIFWPTMLMAMELPLYKKLHVHGYWNVDNTKMSKSIGNVVRPKELVDEYGLDTLRYFTLREMSFGLDASFSSDAIVSRKNSDLANDLGNLFSRSTAMIQKYRGGKLPAPIACEADSELIALSKQVVATYKEEMGAFRFHRALQAVWSLVGYANKYIVSNEPWALAKDENAWQRLDTVLYNLAECLRFLALLIRPVMPDTASRMATGLGLATDASILNSLALGGEWGVVPVGTVLGEAITLFPRMETAKSEEKKAGKKDCQGAKKQEAVISEDGLANFADFQKFELRVADIVVAERIKKSDRLLKLTVMAPEERIIVAGIAAHYSPEDVVGLKVIIVANLKPAKLMGVMSQGMVLAAKVSEDGGERLVLSGVQGDVPAGTRVA

SEQ ID NO: 24949 - DNA, 1119 bp, Kluyveromyces lactis NRRL Y
  CDS (1)..(1119)
atgtcctgtgatctattgaacaaatttgaagctttatcaatttctgcgccatcgttgacccaagagcaaaaagctcttgaggctcaatgggattccgttgccaagtctgggaacattcagggtagttttgaggaattgaatctacatttgagggatcacactttcgttttgggtactgctcaaccaaccgtctccgatgttacattgttcgaacatgttttaccagttgccaaggagttgatcaactcttctaaagatgtcaagggtaactatgctaagtacagacatattcttagatggtcacaatacttgaacgatttattacaattgaacgacttgactttgaacattgatttggatcttccacgtgaagtcatcgaaaagaagaagaaggaagataagaaggacgaggctgaagcttccaagaagggcggtgaagcagcagcaaagaaggatggtaaggccgataaacaaccaagaggtaagccagatgaagaaactttaaagaaattgagagaagaagctaaggcaaagaaggctgccaagaaggccgccaatgcccaacaagcccaagcaccagcccaagagtctgccaaaccatctccaggtgtaattgatttccgtgttggtttcattcaaaaggctatcaagcatccagatgctgactctctatatgtttctaccatcgatgttggtgatgaagagggtccaagaaccgtttgttctggtctagtgaaatacttcccattggaagctatgcaagaacgttatgtcgttgttgtttgcaacttaaagccagttaatatgaggggtatcaaatccactgctatggttctttgtggttctgatgaaaacaacgtcgaatttgttgaacccccagctggatccaaggctggtgacaaggtgttctttgaaggtttcggcgatgaagaacctataaaacaattgaatccaaagaagaagatttgggaacaattgcaaccacatttcagtactaatgaacaacttgaggttattttcaaggatgaagatgacaaggctcaacaaattagaaagctaactaacaaaaacggagatgccttcaaagttgcttccattgctaacgcttgtgttcgttag

SEQ ID NO: 24950 - protein, 372 aa, Kluyveromyces lactis NRRL Y
MSCDLLNKFEALSISAPSLTQEQKALEAQWDSVAKSGNIQGSFEELNLHLRDHTFVLGTAQPTVSDVTLFEHVLPVAKELINSSKDVKGNYAKYRHILRWSQYLNDLLQLNDLTLNIDLDLPREVIEKKKKEDKKDEAEASKKGGEAAAKKDGKADKQPRGKPDEETLKKLREEAKAKKAAKKAANAQQAQAPAQESAKPSPGVIDFRVGFIQKAIKHPDADSLYVSTIDVGDEEGPRTVCSGLVKYFPLEAMQERYVVVVCNLKPVNMRGIKSTAMVLCGSDENNVEFVEPPAGSKAGDKVFFEGFGDEEPIKQLNPKKKIWEQLQPHFSTNEQLEVIFKDEDDKAQQIRKLTNKNGDAFKVASIANACVR

SEQ ID NO: 24951 - DNA, 624 bp, Kluyveromyces lactis NRRL Y
  CDS (1)..(624)
atgtttctacaaggagttgtgaagcgattggtacgggatttccatgttagcaggatttgcaatgaggcaaaacggtttcctttcgagctattgaacttgaaggttgggaaattccaacaagtagcattgcatcccaattcggagaaaatgtacgtttctcaagtggaattggggaatggatctgtgaaacagatctgtagtgggatcagacaatacattccgagagatcagttacaggataagttatgcatagtggtagataatataaaaaaatgtaaactcagaggagaacccagcgaagcaatgatattgtgcggtgaacatacagatgccggatctggaataacgtctgtgaaacttgcatatcctgtggctgaatccctggaacaatcggcacagttagtggggcaacaggtagttattgatctagatcaaaagatcaccgataggaagattaaacctaagaaatgggactgcatttcatccagtttgtatacgaatggaaatggtgaaattgtattccagcaaggggacagttcggaaaaacagctgtttgtgaaattaggggaccagttaattccagtcagagttgacggccttcctgagcatagtacagtgcggtga

SEQ ID NO: 24952 - protein, 207 aa, Kluyveromyces lactis NRRL Y
MFLQGVVKRLVRDFHVSRICNEAKRFPFELLNLKVGKFQQVALHPNSEKMYVSQVELGNGSVKQICSGIRQYIPRDQLQDKLCIVVDNIKKCKLRGEPSEAMILCGEHTDAGSGITSVKLAYPVAESLEQSAQLVGQQVVIDLDQKITDRKIKPKKWDCISSSLYTNGNGEIVFQQGDSSEKQLFVKLGDQLIPVRVDGLPEHSTVR

SEQ ID NO: 24953 - DNA, 2031 bp, Erwinia carotovora
  CDS (1)..(2031)
atgactcaagtcgcaaagaaaatcttggtaacgtgcgcgctgccttacgctaatggttcgattcacctcggtcatatgcttgaacacgttcaggccgatatctgggttcgttaccagcgaatgcgcggcaaccaggttcactttatctgtgcggacgacgcccacggcacgccaatcatgctgaaagcgcagcagatgggaattgcgccagaacagatgattgcggcaatgagtcaggaacatcaacaggactttgccggcttcaatatcagttatgacaactaccactctacgcatagcgaagagaaccgtgagctgtcaggtctgatttatggtcgtctgaaagagaacggttttattaaaaaccgcacgatttctcagttgtacgatccagagaaaggtatgttcctgccggatcgtttcgttaaaggcacctgcccgaaatgtaaggctgccgatcaatatggcgataactgtgaagtctgtggcgcaacctacagcacaacggagctgatcgaaccgaagtccgcggtttctggtgcgacgccggagatgcgtgaatcagaacacttcttcttcgatctgcccgctttcagcgacatgctgcaagcctggacgcgttctggtgcattgcaggagcaagtcgccaacaagatgcaggagtggttcgattcgggtctgcaacagtgggatattacccgcgatgcgccgtatttcggttttgaagtccctgatgcgccgggcaaatatttttacgtctggctggatgcgccaatcggctacatgggctcgttcaaaaacttgtgcgacaaacgtggcgatctgaatttcgatgatttctggaagaaagactcagacgcggatttgtatcacttcatcggtaaagacatcgtttatttccacagcctgttctggccggccatgttggaaggcagcggtttccgtaagccaacgaatctgttcgtgcatggctatgtcacggtcaacggtgccaagatgtctaaatcacgcggcaccttcattaaagcgggcacctatctgcaacatttggatgccgattgcctgcgctattactacgccgcaaaactgtcttctcgcattgatgatatcgacctcaatctggaagatttcgtccagcgcgtgaatgctgacatcgtaaacaaggttgtgaatctggcatcgcgtaatgcgggtttcatcagcaaacgctttgacggcaaactggcggacaaattggcagacgctgagctgtacaaaaccttcaccgatgccggcgccagcattgcggaggcctacagcagtcgtgagtccgggcgtgccattcgtgagatcatggcactggcggatatcgccaaccgctatgttgacgaacaagcgccttgggtggtggcgaaagtagaaggtcgggatgccgatctgcaagccatttgctcaatgggtatcaacctgtttcgcgtcttgatgacgtacctgaagccagttctgcctgcgctgacgcaacgcacagaagcatttttgaacacggaactgagctgggatgctatcaccaccccgctgctaagccatcaggtcaatccattcaaagcactgttcaatcgcatcgatctggataaagtcagcgcaatggttgatgcgtctaaagaagacatggtcacagcgcaaaacgtcgtatcgggcccgttggcagacaacccagtgcaagacactattaactttgacgattttgccaaagtcgatatgcgcattgcgctgattaagcaggccgagcttgttgacggttctgacaagctattacgtctgacgttggatttgggcggcgaaacgcgccaggtcttctctggcattcgtgaggcttatcccgatccggctaagctggaaggccgtttaaccgtgatggtcgccaatctggcaccgcgtaaaatgcgcttcggcatatcagaaggtatggtgatggctgcgggtcctggcgggaaagatatcttcctgttgagcccagacagcggcgctcaacctggtatgcaggtcaaataa

SEQ ID NO: 24954 - protein, 676 aa, Erwinia carotovora
MTQVAKKILVTCALPYANGSIHLGHMLEHVQADIWVRYQRMRGNQVHFICADDAHGTPIMLKAQQMGIAPEQMIAAMSQEHQQDFAGFNISYDNYHSTHSEENRELSGLIYGRLKENGFIKNRTISQLYDPEKGMFLPDRFVKGTCPKCKAADQYGDNCEVCGATYSTTELIEPKSAVSGATPEMRESEHFFFDLPAFSDMLQAWTRSGALQEQVANKMQEWFDSGLQQWDITRDAPYFGFEVPDAPGKYFYVWLDAPIGYMGSFKNLCDKRGDLNFDDFWKKDSDADLYHFIGKDIVYFHSLFWPAMLEGSGFRKPTNLFVHGYVTVNGAKMSKSRGTFIKAGTYLQHLDADCLRYYYAAKLSSRIDDIDLNLEDFVQRVNADIVNKVVNLASRNAGFISKRFDGKLADKLADAELYKTFTDAGASIAEAYSSRESGRAIREIMALADIANRYVDEQAPWVVAKVEGRDADLQAICSMGINLFRVLMTYLKPVLPALTQRTEAFLNTELSWDAITTPLLSHQVNPFKALFNRIDLDKVSAMVDASKEDMVTAQNVVSGPLADNPVQDTINFDDFAKVDMRIALIKQAELVDGSDKLLRLTLDLGGETRQVFSGIREAYPDPAKLEGRLTVMVANLAPRKMRFGISEGMVMAAGPGGKDIFLLSPDSGAQPGMQVK

SEQ ID NO: 24955 - DNA, 1928 bp, Xenopus tropicalis
  CDS (128)..(1714)
ggaaggtctgtggctggtgcctgacgcaatcgctggctacaaggaagaaaatctcctgctgtagcaacacgtgtaccggatttgtctgcggtctctgtggtttaatacatttatccagtgaggcaaaatgggtgacggcttaacacctgaggggaaggcacagctcatcacacgaaatctccaggaggtccttggagaggacaaaatgaaggaaatcctgaaagagagacctctgcggatatactggggcacagcaaccacaggaaaaccacatgtggcttattttgttcctatgtccaagatcgcagacttcctgaaagctggttgtgaggtgaccatcctgtttgcagacctgcatgcatatttagataatatgaaagcaccttgggatctgctggagcttcgaaccagatactatgagcaggttatccaggccatgctacagagcattggagttccacttgagaggttgcgattcattcgaggaacagaatttcaactcagcaaagagtacactctggatgtatacagactgtcttctgtagttactcagcatgatgctaagaaagctggagctgaggtagtaaaacaagtggaacacccgctgctcagtgggcttctgtacccagggttgcaggctctggatgaggaatacttgaaggtagatgctcaatttggaggagttgaccaaaggaaaatcttcacatttgctgaaaagtaccttccagctctcggttatgcaaaacgtattcacctgatgaatcctatggttccaggactcactggggctaaaatgagctcctctgaggaggaatccaaaattgatctcctggactctcctgcagatgtgaaaaaaaaattaaagaaggctttctgtgagcctgggaatatagaaaacaatggggttttaagctttgtcaggcatgtcctctttcccctaaaatcagaatttgtggttctacgtgatgagaaatttggaggaaataaaacttacacagattttgaaacactagagaaagattttactgaacagcttgttcatcctggggatctgaaggcctcagtggagaaagctttgaacaagttgttagatccaatcagagaaaagtttaacagcccagaaatgaagaaactgagtaatgatgcatatcctggtgccagcaaacaaaagacagtgcctaaaggttccactaaaaactctgggcctgaggagatcgatccttctcttttagatctgcgggttgggaagattctcagtgtgaggcagcatccagatgcagacagcctgtatgtggagtcagtggacgtgggtgaggaaaatccacgttgtgtggtcagcgggcttgtgcaatatgttccctctgaccaactgctgggccgctcagtagttttgctgtgcaacttaaaaccacagaagatgcgaggaatcgagtcccagggcatgctgctttgcgcatctacggaaggggaacaaaaacaagtggaaccacttgaccctcctacaggttctgctccaggtgagcggatctatattgagggatatgagaatggagaaccagagggagagctcaaacctaagaagaaagtatttgagaagttgcaggttgacttcaggatttcagatgatttatgtgctcagtggaaagggaagaattttctgaccaaactgggatctgttacctgtaaaactctgcgaggtggtagtattagttgagcatgcttcctccagaacattgtattgtgctcctgtttgtcttcacctccatagcagaatcacacagctggacccaggcagcaggggataatccatccactatttatataatcttcggttgcacattacctgctttttaggggcaatgtcgaggtgaaaaactgtaatgttggtataaaataaagttcagtaccaaaaaaaaaaaaaaaaaaaa

SEQ ID NO: 24956 - protein, 528 aa, Xenopus tropicalis
MGDGLTPEGKAQLITRNLQEVLGEDKMKEILKERPLRIYWGTATTGKPHVAYFVPMSKIADFLKAGCEVTILFADLHAYLDNMKAPWDLLELRTRYYEQVIQAMLQSIGVPLERLRFIRGTEFQLSKEYTLDVYRLSSVVTQHDAKKAGAEVVKQVEHPLLSGLLYPGLQALDEEYLKVDAQFGGVDQRKIFTFAEKYLPALGYAKRIHLMNPMVPGLTGAKMSSSEEESKIDLLDSPADVKKKLKKAFCEPGNIENNGVLSFVRHVLFPLKSEFVVLRDEKFGGNKTYTDFETLEKDFTEQLVHPGDLKASVEKALNKLLDPIREKFNSPEMKKLSNDAYPGASKQKTVPKGSTKNSGPEEIDPSLLDLRVGKILSVRQHPDADSLYVESVDVGEENPRCVVSGLVQYVPSDQLLGRSVVLLCNLKPQKMRGIESQGMLLCASTEGEQKQVEPLDPPTGSAPGERIYIEGYENGEPEGELKPKKKVFEKLQVDFRISDDLCAQWKGKNFLTKLGSVTCKTLRGGSIS

SEQ ID NO: 24957 - DNA, 2058 bp, Acinetobacter sp
  CDS (1)..(2058)
atgcgtaaaattttagtcaccaacgccctcccttatgccaatggacccatccatatgggccacttactcggttatatccaagcagatatttgggttcgtgccatgcgtgcaatgggccatgatgtgacctacgtatgtgcggatgatgctcatggtacggcaatcatgttacgtgccgaagccaatggaatctcgccagaaaagcaaattgccaatgtacaacaagaacatatccgcgattttgacggatttggtgtacatttcgatcattacgactcgactcacagcgctgaaaacaaagtacgttctgaagatatttacctaaaaaaccgtgaagcaggcaatattgccgttcgcccgattacccagcttttcgatcctgaaaaacaaatgtttttgtcagatcgttttattaaaggcacttgcccaaaatgtaaagcagaagaccagtatggcgatgcatgtgaagtatgcggcactacttacaatgccaccgaattactgaatccgcgttcgactttgagcggtgcaacacccgttgaaaaatcgtcagatcattacttctttaagttacccaactttggtgaatacttacaaaaatggacacgtgacgaaggccgtttgccggtatcgattgccaacaagctagatgaatggtttgaagcaggtttagccgactgggatatttcacgcgatgcgccgtattttggttttgaaattccagatgcacccaacaagtatttttacgtgtgggtcgatgcgccaattggctatatgtcgagctttgaaaactacatcaaagccaagcgcccagagctcaactttgacgattactggaaaaaagatagccaaaacgaagtctatcacttcattgggaaagacattgtctacttccatgcgctgttctggccagcgatgcttgaaggtgccaactaccgtacaccaagtggtttattcgttaatggcttcctgacggtcaatggtcagaaaatgtcgaaatcacgcggtacatttattaaagcagaaacctatttacagcacctgaatccagaatacctgcgctactactttgcatcgaaactttcggacaaagtggaagattcagatttgaatctggatgattttgtacaaaaagtaaattctgatttggtcggtaaagtggtcaacattgccagccgctgtgccaaatttatcaatagcagctttaacaataccctctctgcaaactgtgcagaaccagaactggtacaaagctttatcgatgcaggcgactctattgcacaagcctacgaggcgcgtgagtttagcgctgcaattcgtgaaattatggcactggccgacaaagccaaccaatatatcgatgagaaaaaaccgtgggcgcttgcgaagcaagagggtcaagaacaacaagttcataacgtttgctcagtcgggattaacttattccgtcagcttgcgatttacctgtctcctgtgctgccaacacttgctgctcaagttcaggctttcttacaacttgaaagctttgattttgcatcacgtcagcaaatcttgcttgcacacgaaattgcacagttccaaccactcatgcaacgtgtagatccgaaagctgtggctgcgatggtcgatgcatctaaagattcgttggctgctacagcggaagcaccaaaagcggaaaagaaaaaagagaagaaagtcgagaagaaacctgaaccaaaagtaggtgaagctgaaattattggtattgaagactttataaaagttgaccttcgtgtagcgcttgtgcaagaggctgcgacagttgaaggctcagacaaactgcttcaattgactttagatgtcggcgaagctgaaccgcgcaatgtctttagcgggattcgtgagttttatcagcctgaagatttaaaaggcaaactggtggtgatggtagcgaaccttgcaccacgtaaaatgcgttttggtatttctaacggtatggttttagctgcgggtaatggcgacggtgtttgggtaatttcaccagacagcggtgcaaaaccgggcgataaggtgtcttaa

SEQ ID NO: 24958 - protein, 685 aa, Acinetobacter sp
MRKILVTNALPYANGPIHMGHLLGYIQADIWVRAMRAMGHDVTYVCADDAHGTAIMLRAEANGISPEKQIANVQQEHIRDFDGFGVHFDHYDSTHSAENKVRSEDIYLKNREAGNIAVRPITQLFDPEKQMFLSDRFIKGTCPKCKAEDQYGDACEVCGTTYNATELLNPRSTLSGATPVEKSSDHYFFKLPNFGEYLQKWTRDEGRLPVSIANKLDEWFEAGLADWDISRDAPYFGFEIPDAPNKYFYVWVDAPIGYMSSFENYIKAKRPELNFDDYWKKDSQNEVYHFIGKDIVYFHALFWPAMLEGANYRTPSGLFVNGFLTVNGQKMSKSRGTFIKAETYLQHLNPEYLRYYFASKLSDKVEDSDLNLDDFVQKVNSDLVGKVVNIASRCAKFINSSFNNTLSANCAEPELVQSFIDAGDSIAQAYEAREFSAAIREIMALADKANQYIDEKKPWALAKQEGQEQQVHNVCSVGINLFRQLAIYLSPVLPTLAAQVQAFLQLESFDFASRQQILLAHEIAQFQPLMQRVDPKAVAAMVDASKDSLAATAEAPKAEKKKEKKVEKKPEPKVGEAEIIGIEDFIKVDLRVALVQEAATVEGSDKLLQLTLDVGEAEPRNVFSGIREFYQPEDLKGKLVVMVANLAPRKMRFGISNGMVLAAGNGDGVWVISPDSGAKPGDKVS

SEQ ID NO: 24959 - DNA, 1131 bp, Candida glabrata CBS138
  CDS (1)..(1131)
atgtctgatctagttgctaagtttaagggtttatctgttgctgattctacagctcaactaagtcgtgagcaatctgctttggttgctcaatgggagtctattctaaagactggtcaattgcaagccaacttgaacaatttgaacttgcaattgagagataacagtttcattgctgctacttctcagccaacagttcacgatgttgaattgttcgaagccactttgccagttatcaaggaactagtttccagttctaaggacattaagggtactttgggtagctacagacacattattagatgggttgactacttgcaagctttgttgcaattgtctaaggaccaaactttggaatttgaccgtaacatcgaattgccaagagaagttattgagaagccaaagaagaaggatgatgctaagaaggatgacggtaagaaggatgataagaaggatgacaagaagaaggctaacgatggtgacaagaagcaaagaggtaagccagatgaggagactttgaagaagttgagagaagaagccaaggcgaagaaggccgctaaaaaggctgcacaagcacaacaacaaaaggaaacaaaggctccagagaaggtattgccatctgtcattgacttccgtgtcggtttcattcaaaaggctattaagcacccagatgctgacagtttgtacgtctccactatcgatgttggtgatgaggaaggtccaagaactgtttgttctggtctagtcaagcacttcccactagaggccatgcaggaacgttatgttgttgctgtctgtaacttgaagccagtcaacatgagaggtgtaaagtctaccgctatggttttgtgtggttctaatgctgaggataaggttgaatttgttgaaccaccaaagggctccaaggcaggtgacaaagttttcttcgaaggtttcggcgctgaagatccattgaagcaattgaaccctaagaagaagctgtgggagcaattgcaaccacatttcagcactaacgaaaacttggaagttatcttcaaggatgaagaagataaggaacatccagttagaaaattgactaatgctaagggtgaagaattcaaagttgctaccatcgttaatgctaatgtccgttaa

SEQ ID NO: 24960 - protein, 376 aa, Candida glabrata CBS138
MSDLVAKFKGLSVADSTAQLSREQSALVAQWESILKTGQLQANLNNLNLQLRDNSFIAATSQPTVHDVELFEATLPVIKELVSSSKDIKGTLGSYRHIIRWVDYLQALLQLSKDQTLEFDRNIELPREVIEKPKKKDDAKKDDGKKDDKKDDKKKANDGDKKQRGKPDEETLKKLREEAKAKKAAKKAAQAQQQKETKAPEKVLPSVIDFRVGFIQKAIKHPDADSLYVSTIDVGDEEGPRTVCSGLVKHFPLEAMQERYVVAVCNLKPVNMRGVKSTAMVLCGSNAEDKVEFVEPPKGSKAGDKVFFEGFGAEDPLKQLNPKKKLWEQLQPHFSTNENLEVIFKDEEDKEHPVRKLTNAKGEEFKVATIVNANVR

SEQ ID NO: 24961 - DNA, 327 bp, Picrophilus torridus
  CDS (1)..(327)
atggatcagatagatatagaccattttcataccatagatctcagggttgcaagggtcatagaatgcgaaaaggttgagaaatcaagatctttattaagaattattcttgaccttggcgatgagagaaagcaaatagtatcaagcatagcggattattacaaaccagaggatattattggaaggaatcttattataataaacaatttaaagcctgcaaaatttatgggcatagaaagccaggggatgctccttgcggccgaggatgaatccggggtttcgctgctgacaacggataaagacgtaaagcctggcacgagggttcattaa

SEQ ID NO: 24962 - protein, 108 aa, Picrophilus torridus
MDQIDIDHFHTIDLRVARVIECEKVEKSRSLLRIILDLGDERKQIVSSIADYYKPEDIIGRNLIIINNLKPAKFMGIESQGMLLAAEDESGVSLLTTDKDVKPGTRVH

SEQ ID NO: 24963 - DNA, 354 bp, Photobacterium profundum
  CDS (1)..(354)
atggaatatgctccaataaaagaacttattgcattcagtgattttgaaaagctggatatacgagtggggacaataacagctgtttcagaagttgaaaaatctaaaaaattgatgaagttgactgtggactttggtgatcatgttcgttcaattcttgctggcataaaacaagaacgcgaaaatccatttgaaattgaaggtaagcaagctctttttgttgtaaatcttcctgagcaaaaaatggcaggagaagtatctcaaggaatgttgtttgatattggctatgcagacaaattgactccttgtttagcaatgccagaaacgccaatgccaaacggtagtagagcaggttaa

SEQ ID NO: 24964 - protein, 117 aa, Photobacterium profundum
MEYAPIKELIAFSDFEKLDIRVGTITAVSEVEKSKKLMKLTVDFGDHVRSILAGIKQERENPFEIEGKQALFVVNLPEQKMAGEVSQGMLFDIGYADKLTPCLAMPETPMPNGSRAG

SEQ ID NO: 24965 - DNA, 2043 bp, Photobacterium profundum
  CDS (1)..(2043)
atggctgcgaacccaagaaaaattctggtgacctgcgccctaccgtacgctaacggttctatccaccttggccacatgcttgagcatgtacaagcggatatttgggtgcgctatcagcgccttcgtggtaacgaagtacactttatctgtgcagacgacgcacacggtactccaatcatgcttaaggcccagcagatgggtatggaacctgagcaaatgattgaagaagtaagcaaagagcaccaagctgattttgcaggcttcgatattagctttgataactatcacagtactcacagtgacgaaaaccgtgagctagcatcatttgtttatactcagttaaaagacaaaggttatattactaaccgtactatttctcagctatttgatcctgagaaagaaatgttcttacctgaccgtttcgttaaaggcacatgccctaaatgtaaagcggaagaccagtacggtgataactgcgataattgtggcgaaacatatagcccaacagatcttatcgatccgaaatcagcagtatctggcgcaacaccaatcatgaaagattctgagcacttcttctttgacttaccacagttcgaagacatgcttaaagcgtggacaaaatcaggtgcactacaaactgaaacctcaaataaaatgcaagagtggtttgagtctggtcttcatcagtgggatatctcacgtgatgcaccttacttcggttttgaaatcccaggtgaaactagcaaatacttctacgtatggctagatgcaccaatcggctacatgggttcattcaagaacttatgtgataagcgcgacgatcttgattttgacgaattctggaagaaagacagcacgacagagctttatcattttattggtaaagacattgtgtacttccacagcctattctggcctgcaatgcttgaaggcgcaggtttccgtaaaccaaacaatgtatttgtacatggttacgtaacagtaaacggcgcgaaaatgtcgaagtcgaaaggtacctttattaaagcaggtacttaccttgaacacttagatcctgaatgtctacgttactactacgctgccaagctaaatagccgtattgatgatttagatcttaaccttgaagactttacacaacgtgtaaacagcgatgtcgtaaacaaaatcgttaaccttgcttcacgtaatgcgggtttcattactaagcgttttgacggtaagttatctgaaacattcgcagaacctgagctttatgctgagtttgccaatgctgcagaccgtattgctgaactttacgaaacacgcgaatttagccgtgctatccgtgaaattacagcacttgctgataaagcaaaccagtacattgatgaaaaagcaccttgggttgttgctaagcaagaaggtaaagatcaagaattacaagatatctgttctgtgggtatcaacttattccgcgttctgatcacttacttaaagccagtaatgccattgcttactgaacgtactgaagcattcttaaacgaaacacttacatgggaaggtgtggcacagccattaactaaccacgaagtgactaagtttaaagcgctatttactcgtattgatcctaagcatgttgaagcgatggttgaagcctctaaagaggatgcggcagcagcgcaagtactgatcgaagcagcaaagccgacgggccctcttattgatgagccaatcgaagctgaaattgaattcgatgactttgctaaggttgatatgcgaatcgcgaaaattatatcgtgcgaagcagtgccaaaggctaataagctactgaagttccagctggacatcggtggtgaaatgcgccaagtattctcaggtatcaaatcagcatacacaccagaagagcttgttggtaagcacactgtaatggttgctaaccttaagcctcgtaaaatgaaatttggtatgtctgaaggcatgatcctagcagcaggacctggtggcaaagatctttggatcttagaaccacacgaaggtgctcagcctggtatgcgtgttatgtaa

SEQ ID NO: 24966 - protein, 680 aa, Photobacterium profundum
MAANPRKILVTCALPYANGSIHLGHMLEHVQADIWVRYQRLRGNEVHFICADDAHGTPIMLKAQQMGMEPEQMIEEVSKEHQADFAGFDISFDNYHSTHSDENRELASFVYTQLKDKGYITNRTISQLFDPEKEMFLPDRFVKGTCPKCKAEDQYGDNCDNCGETYSPTDLIDPKSAVSGATPIMKDSEHFFFDLPQFEDMLKAWTKSGALQTETSNKMQEWFESGLHQWDISRDAPYFGFEIPGETSKYFYVWLDAPIGYMGSFKNLCDKRDDLDFDEFWKKDSTTELYHFIGKDIVYFHSLFWPAMLEGAGFRKPNNVFVHGYVTVNGAKMSKSKGTFIKAGTYLEHLDPECLRYYYAAKLNSRIDDLDLNLEDFTQRVNSDVVNKIVNLASRNAGFITKRFDGKLSETFAEPELYAEFANAADRIAELYETREFSRAIREITALADKANQYIDEKAPWVVAKQEGKDQELQDICSVGINLFRVLITYLKPVMPLLTERTEAFLNETLTWEGVAQPLTNHEVTKFKALFTRIDPKHVEAMVEASKEDAAAAQVLIEAAKPTGPLIDEPIEAEIEFDDFAKVDMRIAKIISCEAVPKANKLLKFQLDIGGEMRQVFSGIKSAYTPEELVGKHTVMVANLKPRKMKFGMSEGMILAAGPGGKDLWILEPHEGAQPGMRVM

SEQ ID NO: 24967 - DNA, 1992 bp, Methanococcus maripaludis
  CDS (1)..(1992)
atgaggcatttagttacaactgcactggcatatacgaatggaccccttcatcttgggcacgcgagaagtacctacattccagcagacatctttacacgatatttaaaactaaaaggcgaagaagtcatccatgttggcggaacagacaatcacggggttcctattacactaactgctgaaaaagaaggtgtaaaaccgattgatattgttgataggtaccacaatgcaataaaagcggaccttgacagtttaaacatttgttttgataattttggaaggacacacagcgatatacacatcgaaactgctcaggaattctattcaaaattaaaagaaaatggatatatctacgaaaaagaaattgaacagttttactgtgaaaaatgtgacatgtaccttgcagacaggtacgttgaaggaatctgcccattttgtgaaggcgaagcaagaggggaccactgtgaggtttgcggaagacaccttgaaccaacagaacttgtaaatccttactgtatacactgtaattcaaaacctgaaatcaaaagaactacccactatttctttaaattaagtgcaatgcaggattctttaaaagaatacattgaaaattctccagaaatgccggaacacgtaaaaaatatggctttaagatggattgaggaacttcacgactgggacgtttcaagaaacataaaatggggagttccaattcccggatgtgatgatcaggtgatgtacgtctggattgaagctccaattggatatgtatcatttacaaaacagcttggagacatctggaaaagctactggcttgaaaatacagatgattcgaaaatatcccactttattggaaaggacattacagtacaccacgcagtattttggccgggaattttaaaaggaatcggcggatacaaaatgccaaacgcagttgttagcggcggttacttaactcttgaaaataaaaaaatgagtacaagtaaaaactgggttgtatgggttaaagattttgttgaaaactttagttctgactatttaagatatttctttatgataaatgctccattaaatagagataccgacttttcatgggacgatttccaaaaaaggattaatactgaattaattgatattatcggaaactttacacacagaactttagtatttacagaacgtaaatttggcagtactccgattgtggacttaaaccagttaaaagacgaagataaaaagttaatttcaaaatgtgacgatacagaaaaacttgttgattcattaattagggaatacaactttaaagatgcattaatggaaattattcatttggcaaaagaaggaaacggttacttccagggaatggcgccatgggcaattaaaaatgaagaaagattaaaagaggtaatgtacacatgttctgttgttttaaagtacataatttaccttttaagttcattcatgcctgaaaaaacggctcttcttttagaatacatgaacgaagaactcgatttaaaagttaggggaaatcctcttaaaaaaccgaaagttatatttaccaaggtaagcgatgaagatatttcgagaatgaaagaaaacctcatgaaagctacgaaaaaggccgaaacaaaatcagacgaaaagtctaaaaaagtaaaatctggtgaaaaaatggatattattgacattgattactttggaaacattgatttgagagttggacagattttagaagtcgaagaagttccaagatcaaaaaaactctacaaaattatcgctgatttgggcgacgaaaaaagacagattgtttctggattaataggagcatatgatgcagaagaacttgttggaaaaaaagtaataataatctgtaacttaaaacctgcaaaattatgcggtgttgagtcacaaggaatgcttttagcagcagaggatgacagtattgtaagtttgttatcacttgatagggatcttccggttggaagcaaaatccactaa

SEQ ID NO: 24968 - protein, 663 aa, Methanococcus maripaludis
MRHLVTTALAYTNGPLHLGHARSTYIPADIFTRYLKLKGEEVIHVGGTDNHGVPITLTAEKEGVKPIDIVDRYHNAIKADLDSLNICFDNFGRTHSDIHIETAQEFYSKLKENGYIYEKEIEQFYCEKCDMYLADRYVEGICPFCEGEARGDHCEVCGRHLEPTELVNPYCIHCNSKPEIKRTTHYFFKLSAMQDSLKEYIENSPEMPEHVKNMALRWIEELHDWDVSRNIKWGVPIPGCDDQVMYVWIEAPIGYVSFTKQLGDIWKSYWLENTDDSKISHFIGKDITVHHAVFWPGILKGIGGYKMPNAVVSGGYLTLENKKMSTSKNWVVWVKDFVENFSSDYLRYFFMINAPLNRDTDFSWDDFQKRINTELIDIIGNFTHRTLVFTERKFGSTPIVDLNQLKDEDKKLISKCDDTEKLVDSLIREYNFKDALMEIIHLAKEGNGYFQGMAPWAIKNEERLKEVMYTCSVVLKYIIYLLSSFMPEKTALLLEYMNEELDLKVRGNPLKKPKVIFTKVSDEDISRMKENLMKATKKAETKSDEKSKKVKSGEKMDIIDIDYFGNIDLRVGQILEVEEVPRSKKLYKIIADLGDEKRQIVSGLIGAYDAEELVGKKVIIICNLKPAKLCGVESQGMLLAAEDDSIVSLLSLDRDLPVGSKIH

SEQ ID NO: 24969 - DNA, 2097 bp, Parachlamydia sp
  CDS (1)..(2097)
atgttcaaaaacctgtgcgataagataatgacccaaaaaattttgattacttctgctcttccctatgcgaatggacctctgcattttggacatattgcaggggcttacctcccagctgactgttatgcacgttttcaaagattaatgaaaaaagatgttctttacatttgtggatccgatgaatatggcattgcgatcaccttaagtgctgatttagctggtagaacacctcaagaacatgttgatctttttcatcacattaatcaaagttttttcgagcaactccaaatttcttttgatcattattctcgtacgacctggaaaggacatgtagagcctacccatcagttctttaatgacttattgcagaatggatatattgaagaacgcacgaccgaccaactctattctgaaaaagatcagaaatttcttgcagatcgttatgtcgtgggaacgtgtcctcgttgtggttttgaaaatgcaaggggggatgagtgtccttgttgtggtgcaagctatgaagctacagaacttaaaaaccctcgttctaaactcacagatgcttccttgattttgcgaccgactaaacactggtttttacttcttgaaaaatttaaaaaacctttaatggagtggttggaaactaaaaactggaagccaaatgtaattaattttattaggggatacatcgatcatctccatgccagagcaatcacaagagatatgaaatggggaatttctgttcctcttcctgattcagaaggaaaagtcctttatgtctggtttgatgcacctataggctatatttcggcgactaaagagtgggctttattaagaggggaagaaaagctttgggaaaaatattggttggatccagaaactaagcttgtcaattttattggaaaagataatatcccttttcatgcctccattttccctgctatgatcatgggacaaaatcagccttataaactagtggacgaactgccagccaatgaattttataatttagaagggaagcaatttagtaaatcagatggatggtatattgatttagaagactttttcaagcattataccagcgatcaaattcgctatgctattgcttccaacgctcctgaaacatctgatagtgaatttacttggaaagactttcaactacgctgcaacagtgatttgctagggaagtacggaaatttggttaatagggttttagtgttcattcacaatcagtgtcagggaaaagttccggagtctggagttttagaagaacaagatcgaaaatttttaaaaaatattcaagatttggtcgatcaagcagctgccagttattcgacttttaaagttcgaaaagcgagccaaattatgatggagttatcccaattaggaaatgtttattttgatagtaaaaagccttggcaagacgctaaaaatgattatacaaagggcagaatgcatacaacgctgaattgttgtatggagtgtttaaaggcgcttgcgctgatttcttttcccataattcccacggcagcttcaaaagtttggcaatttcttggatttcaaacaccgctcgaacaagaagattggaatcgcgttaaaatagaaaagcttccgcttaaccaaaagattttaactccccaaatcctttttcaacgggttgaaaatgaggctgttgaaagagaaattcttaaattgcaacagttatctcttacaaaagaaaaaaaatctacaccacaatctactcagatatctatttcagaaaatattcttcttaaaccattagtagatattgaagattttcgaaaattagatttaagagtcggcaagatcatccaggcaaatcctgtaccgaaaagtaaaaaactttttcaattacttgtagacattggaattgagaaaagaatagttgtagctggagttgccgaattttataaagtagaagatttgattgggaaaaacgttgtagttgtagcgaatttaaagcctgctaatttgatgggagtgactagtcaaggaatgctacttgcagctaagggagaaggaaatttaaaacttatttctatcgaggatgttgctcctggaagtcttgtcagttaa

SEQ ID NO: 24970 - protein, 698 aa, Parachlamydia sp
MFKNLCDKIMTQKILITSALPYANGPLHFGHIAGAYLPADCYARFQRLMKKDVLYICGSDEYGIAITLSADLAGRTPQEHVDLFHHINQSFFEQLQISFDHYSRTTWKGHVEPTHQFFNDLLQNGYIEERTTDQLYSEKDQKFLADRYVVGTCPRCGFENARGDECPCCGASYEATELKNPRSKLTDASLILRPTKHWFLLLEKFKKPLMEWLETKNWKPNVINFIRGYIDHLHARAITRDMKWGISVPLPDSEGKVLYVWFDAPIGYISATKEWALLRGEEKLWEKYWLDPETKLVNFIGKDNIPFHASIFPAMIMGQNQPYKLVDELPANEFYNLEGKQFSKSDGWYIDLEDFFKHYTSDQIRYAIASNAPETSDSEFTWKDFQLRCNSDLLGKYGNLVNRVLVFIHNQCQGKVPESGVLEEQDRKFLKNIQDLVDQAAASYSTFKVRKASQIMMELSQLGNVYFDSKKPWQDAKNDYTKGRMHTTLNCCMECLKALALISFPIIPTAASKVWQFLGFQTPLEQEDWNRVKIEKLPLNQKILTPQILFQRVENEAVEREILKLQQLSLTKEKKSTPQSTQISISENILLKPLVDIEDFRKLDLRVGKIIQANPVPKSKKLFQLLVDIGIEKRIVVAGVAEFYKVEDLIGKNVVVVANLKPANLMGVTSQGMLLAAKGEGNLKLISIEDVAPGSLVS

SEQ ID NO: 24971 - DNA, 2064 bp, Bdellovibrio bacteriovorus
  CDS (1)..(2064)
atgaacgacaaacgcaagattctgatcacctgtgctcttccctacgcaaacggatacattcacctgggtcacctggtggaatatcttcaggccgacttctgggcccgttttcagaatatgcgtggcaacgaatgcgtcttcatttgcgcagatgacactcacggcaccccgatcatggtgaaagcccgcgaactgggcatcactccggaagctttgatcgcacaaagctataaagaacacacccaggactttgctgatttccaggttcagttctcgcactttggttccaccaattcggaagaaaaccgcctgctttgtgagtacttctacaaaaaaatgcaggaaggcaaccacacccgcagccagccgattcagcagatgtactgtaatcacgacaaaatgttcctgccggaccgcttcgtaaagggcacctgtcctaagtgcggcgccaaggaacagtacggtgattcctgtgatgtgtgtgcttcgacttactccccgagcgacatgaaggacgttcactgttcgctttgcgggacagctccggtgatgaaagattccgagagcatcttcttcaaactgaacgacttcaaacagtacctggaagaatggatccctaaacactgctcccctgaaatctccaaaaagatgctggaatggttcaacgaggacctgaaggatctggatatttcccgtgatgagccttatttcggcttcgcgattccgggcaccaacaataaaaaattcttctatgtgtgggtggatgctcccatgggctacatgtccaccaccgagcaatgggcgaaatcccagggcaaaaccctgaaagacatctggcaggacccaagccgtgaaatttatcatttcattggcaaagacattgcccgcttccacaccatcttctggccggcattcctgaaggctgcggaattccgctcgcctaatcaggtgttcgtgcacggtcacttgatggttaatggcgagaaaatgtccaagtccaaagggacgttcatcgccgcaagaacgtatctgaaccatctgaacccggaatatcttcgttattactattccaccaagctgtcgagctctgtggacgatatcgatttaaatctggaagacttcaccaaccgtgtgaattccgagcttgtgggtaaaatcacaaatctgggttcccgtggtggccagatgctgaaaaagaaaatggacggcaaaatgagcgtgccggatgctgaaggcaaaaaactgattgagcacgctcaaaaaacggctgaatccatcgccgctcattatgaagcccgcgactttgccaaagcattgggtgaaatccgtggcctggctgatgacgccaataagtactttgacgaaaaagctccttggaaaaccctggaagctgatccagaaggcaccaagcaggttatcaccaccactctgaacatgttccgaatgcttgcgatttacctgaagccggtcttgccattctatagccaaaaggtggcaaaacttttgggtgaaaaagactatgtgtggtctgatctgaacacggttcttaccaaccgtgaaatcaatgactatgaacatctggcaacccgtattgaggctgacaaagtcaaagccatggtcgaggaaggtcgtaagatcaacgaagagattcaagcggcgaaaaaagcggcttccaccgcaaaaccagcggcggctccggcccctgctgcagctgcgacagcgggcgatcgcccggctgaaatcgaatttgctgattttgacaaagtggatctgcgtatcggtcaggtcattgaagctgaagaaatcaaggaagctgacaaacttttgcgtcttaagatcgacatcggcgaaggccagatccgccagatcatttccggcatcaaagcggcttataaaccagaacaactggtgggtcgcaaagtgctggtttgtgtaaacttgaaaccacgcaaaatgaagttcggcatgtctgaaggcatggtgttggcggcaggaactggtggcagcgatctgttcgtgctttcggcggatgacggagcccaggtcggccagagagtaaaataa

SEQ ID NO: 24972 - protein, 687 aa, Bdellovibrio bacteriovorus
MNDKRKILITCALPYANGYIHLGHLVEYLQADFWARFQNMRGNECVFICADDTHGTPIMVKARELGITPEALIAQSYKEHTQDFADFQVQFSHFGSTNSEENRLLCEYFYKKMQEGNHTRSQPIQQMYCNHDKMFLPDRFVKGTCPKCGAKEQYGDSCDVCASTYSPSDMKDVHCSLCGTAPVMKDSESIFFKLNDFKQYLEEWIPKHCSPEISKKMLEWFNEDLKDLDISRDEPYFGFAIPGTNNKKFFYVWVDAPMGYMSTTEQWAKSQGKTLKDIWQDPSREIYHFIGKDIARFHTIFWPAFLKAAEFRSPNQVFVHGHLMVNGEKMSKSKGTFIAARTYLNHLNPEYLRYYYSTKLSSSVDDIDLNLEDFTNRVNSELVGKITNLGSRGGQMLKKKMDGKMSVPDAEGKKLIEHAQKTAESIAAHYEARDFAKALGEIRGLADDANKYFDEKAPWKTLEADPEGTKQVITTTLNMFRMLAIYLKPVLPFYSQKVAKLLGEKDYVWSDLNTVLTNREINDYEHLATRIEADKVKAMVEEGRKINEEIQAAKKAASTAKPAAAPAPAAAATAGDRPAEIEFADFDKVDLRIGQVIEAEEIKEADKLLRLKIDIGEGQIRQIISGIKAAYKPEQLVGRKVLVCVNLKPRKMKFGMSEGMVLAAGTGGSDLFVLSADDGAQVGQRVK

SEQ ID NO: 24973 - DNA, 2217 bp, Brachydanio rerio
  CDS (65)..(1654)
ttcaaccggaacagcctgtcaccggcacacacgtttctcagcgaccaccgaagcagcagacatcatgggagagcagctgagtcctgatgagaagttccagctcatcaccagaaaccttcaggaggttcttggtgaggagaggttgaaggagatcctgaaggagcgggaactgaaggtttactggggaacagcgactacaggcaaaccccatgttgcttactttgtccccatgtcaaaaattgctgacttcctgaaggcgggctgtgaggtgaccatcctctttgctgatctccatgcttatctggataacatgaaggctccctgggagctgctggagctccgggtgaagtattatgagcaggtcatcaaggccatgttggagagcattggagttcctcttgacaaactcaaatttgtcaaaggcacagattatcagctcagcagagaatacactctggatgtttaccgactgtcatccatggtcactgaacacgatgcaaagaaagcaggggcagaggtggtcaaacaggttgagcatcctcttctcagtggtctgctgtatcctggactacaggcactggatgaggaatacctaaaagtagatgctcagtttggtggtgtggaccagaggaagatcttcacattagctgagaagtacctgccttcccttgggtacaccaaacgtagccacttgatgaacccaatggttccaggactgactgggagcaagatgagctcctcagaggaggaatccaagattgacctgctagacaagaaccaagatgtgaagaagaagctgaagaaggcgttctgtgagcctggaaatgtggagaataatggagttctgtcttttgtcaaacacgtgcttttccctctgcactcagagtttgtgattaaaagagatccaaagtttggaggtgacaaagtctacacagattttgaggaagtggagaaggactttgctgcagagcaaattcatccaggtgacctgaaggcttcagtagaattggctcttaacaaactgttggaccctatcaggaagaagtttgagagccctgagttgaaaaaactgacatcatctgcttacccagaaccatctaaaaacaaaggaggagcaaagggcaaccctaaacaaaccacagatgacgatgaggtcatcccatccagattagacatcagagtgggaaaagtcatcagtgtagaaaagcatccagatgcagactcactatatttagagaagattgatgtgggtgaagaacagccgcggactgtagtgagtggactggtggcttatatcacagaggaacagcttcaggaccgactcgttgtgctgctctgcaacttaaagccccagaagatgagggggattgaatctcaagcaatggtgctttgtgcttcaatcgaaggagagcccaggaaagtggagcctttggatccaccagaaggatctgcagcaggagatcgtgtttacgtagagggctatgaatctggcaaaccagacgatgaattgaaaccaaagaaaaaggtgtttgagaagttacaggttgatctgaagatctccggcgagtttgttgcacaatggaaagagcaaaatctgatgaccaaacttggacgaatcacctgcaaaacacttaaaggtggaaatatcagctagaatatccacactatttttctcaagctccagtgggagagttttcatgacagccgtaatccacataacatctacactgtgtatatcactcatcataggcatcaaaaactgaactaatagttcaccattactgcagaagaatgcataggagtattgtctgtcctttacattgcatgtaatggcgtccaagatgatttatgcattaagtactgcagtaaacatgctaatatgcattagtgataaatggggaatcttgcaggagctcatctgttatcttaaaactcaggttttcctgtggtgccatgtctgttgatcagtgcttataatgatcagtgtgacaatgtacaaactattatttaaccttcaaagtaaacggttcagatgtgggacaatttacagtatataaacagcaaaatgttatggtgaatattttaagattagttgttcccagaaaacagatagaatttcagataacgtaacattcagatttaatgttaaccagactcactcaaataaaggatgattcataacttgaaaaaaaaaaaaaaaaaaaaaaaaaaaaaaaa

SEQ ID NO: 24974 - protein, 529 aa, Brachydanio rerio
MGEQLSPDEKFQLITRNLQEVLGEERLKEILKERELKVYWGTATTGKPHVAYFVPMSKIADFLKAGCEVTILFADLHAYLDNMKAPWELLELRVKYYEQVIKAMLESIGVPLDKLKFVKGTDYQLSREYTLDVYRLSSMVTEHDAKKAGAEVVKQVEHPLLSGLLYPGLQALDEEYLKVDAQFGGVDQRKIFTLAEKYLPSLGYTKRSHLMNPMVPGLTGSKMSSSEEESKIDLLDKNQDVKKKLKKAFCEPGNVENNGVLSFVKHVLFPLHSEFVIKRDPKFGGDKVYTDFEEVEKDFAAEQIHPGDLKASVELALNKLLDPIRKKFESPELKKLTSSAYPEPSKNKGGAKGNPKQTTDDDEVIPSRLDIRVGKVISVEKHPDADSLYLEKIDVGEEQPRTVVSGLVAYITEEQLQDRLVVLLCNLKPQKMRGIESQAMVLCASIEGEPRKVEPLDPPEGSAAGDRVYVEGYESGKPDDELKPKKKVFEKLQVDLKISGEFVAQWKEQNLMTKLGRITCKTLKGGNIS

SEQ ID NO: 24975 - DNA, 2106 bp, uncultured bacterium
  CDS (1)..(2106)
atgccccgtcagctcttcgtcacgacagccctgccttacgccaacggccacttccacatcggccacatcatggaatacatccaggccgacatctgggtgcgcttccagcgccaacaggggcaccgagttcacttcgtgggggccgacgacgcccatggcgcccccatcatgatcgcggccgaaaaggctggcaagacgccgcaacagtttgttgccgacatcgcggcgggccgcaagccttacctcgatggcttccacatcgccttcgaccactggtcgtccaccgacagcccggaaaaccattcgctggccaaagagatctacgtggccctgcgcgatgcgggcttgatcaccgtgcgcccggtcgagcagttcttcgaccctgaaaaaagcatgttcctgcccgaccgcttcatcaagggcgagtgccccaagtgcggcgcgaaggaccagtatggtgattcgtgcgaggtgtgcggcgcggtctatgcgcccacggatctgaagaacccctattcggccctgagcggcgccacgccggtgcgcaagagcagcgaccactatttcttcaagctgtccgacccgcgctgcgccgagttcctcgaagcctggacacaggacggcaagctgcagtccgaagtcggcaacaagatccgcgagtggttcaccaaggacgagaacggtgaggggggcctgagcgattgggacatcagccgcgacgcgccttacttcggcatccagatccctgacctgcccgaaggctcgccggccaagtatttctacgtgtggctggacgcgccggtcggctacctggcgtcgctgaagagctacttcgctgcgggcggccccaaggcgcgttatggcgaggcgcgcagcttcgacgagttcatcgccgaccctgcggtcgaacaggtgcacttcatcggcaaggacatcacctacttccacaccctgttctggcccgcgatgctgaagttcagcggccgcaagctgccttcgcaggtgaacgtgcacggccacctcaccgtgggcggcgagaagatgagcaagagccgcggcaccggcctcgatcccatcaagtacctgaagctgggcatgaaccccgaatggctgcgctactacatcgccgccaagctcaacagcaaggtcgaagatgtcgacttcaaccccgaggacttcgtggcgcgcgtcaacagcgacctggtgggcaagtacgtcaacatcgccagccgctgctcgaccttcatccacaaatacttcgagggcaagctggcccacctggacgcgcccgacgaaggcaagctccaggagatgatcccgctgcaggccgtgaccagccgcgaggcccagatcgccgatgcgctggacaagcgcgagttcggcaaggccttgcgcgacatcatggccgccgccgacgagatcaaccagtacttcgacaccgccaagccctgggagctggccaaggacagcgcgcagcacacgcccaacagcgcgctgcacgaggtgctgtcggcctgcatcgaaggcttcaagtatttgacgctgttcctgtcgcccatcctgccagacgtgagcggccgcgccttccacttcctgggcttcgaccagccactggactgggccgggcgcgccaagccggtcaccaccatccgcaagtacgagcacctgttgacgcgcgtcgatcccaagctgctggatgccctgttcgagccgcccgcaccgcccgtggtcgaagcacccaagcctggtggtgaagagatcgcgccggtgatcaccatcgacgatttcgccaaggtcgacctgcgcatcgccaagatcgtgaacgccgagcacgtcgaaggatccgacaagctgctgcgcctgaccctggacgtgggcgaaggccgcacgcgcaatgtgttcagcggcatcaagtcggcctacaagcctgaagacctggtcggcaagctgaccgtgatggtggccaacctggcgccgcgcaagatgaagttcggcgtcagcgaaggcatggtgctggccggctcgcatgccgatgagaaggcgaacccgggcatccacgtgctggagcctttccccggcgcccagcccggcatgcgcgtgcgctga

SEQ ID NO: 24976 - protein, 701 aa, uncultured bacterium
MPRQLFVTTALPYANGHFHIGHIMEYIQADIWVRFQRQQGHRVHFVGADDAHGAPIMIAAEKAGKTPQQFVADIAAGRKPYLDGFHIAFDHWSSTDSPENHSLAKEIYVALRDAGLITVRPVEQFFDPEKSMFLPDRFIKGECPKCGAKDQYGDSCEVCGAVYAPTDLKNPYSALSGATPVRKSSDHYFFKLSDPRCAEFLEAWTQDGKLQSEVGNKIREWFTKDENGEGGLSDWDISRDAPYFGIQIPDLPEGSPAKYFYVWLDAPVGYLASLKSYFAAGGPKARYGEARSFDEFIADPAVEQVHFIGKDITYFHTLFWPAMLKFSGRKLPSQVNVHGHLTVGGEKMSKSRGTGLDPIKYLKLGMNPEWLRYYIAAKLNSKVEDVDFNPEDFVARVNSDLVGKYVNIASRCSTFIHKYFEGKLAHLDAPDEGKLQEMIPLQAVTSREAQIADALDKREFGKALRDIMAAADEINQYFDTAKPWELAKDSAQHTPNSALHEVLSACIEGFKYLTLFLSPILPDVSGRAFHFLGFDQPLDWAGRAKPVTTIRKYEHLLTRVDPKLLDALFEPPAPPVVEAPKPGGEEIAPVITIDDFAKVDLRIAKIVNAEHVEGSDKLLRLTLDVGEGRTRNVFSGIKSAYKPEDLVGKLTVMVANLAPRKMKFGVSEGMVLAGSHADEKANPGIHVLEPFPGAQPGMRVR

SEQ ID NO: 24977 - DNA, 1998 bp, Listeria monocytogenes
  CDS (1)..(1998)
atgttgcctgaagagaaaaatacgttttatattaccacaccaatctattatccaagcggaaaagcgcatatcggccatgcttatacgactgttgcgggggacgcgatggctcgttataaacgcttaaaaggatatgatgtgttttacttaactggaacagatgagcacggtcaaaaaatccaagcaaaagcgaaagaacgcggaatttctgaacaagaatacgtggatgaaatcgcagaaggtttccaagaactttggaaaaaactagaaatttctaatacggattttattcgtacaacacaagaccgtcataaaacatcggttgaaaaaatctttgaacaacttttagaacaaggcgacatttacttaggtgaatacgaaggttggtactctgtttctgatgaagaatactttacagaaacacagttagaagaagtatataaagatgaaaatggtaaagtaatcggcggaaaagccccaagtggcaatgaagtcgaactagtgaaagaagaatcctacttcttccgtatgagcaaatatgcggaccgtttagtagaatattataattcccatccagaatttatccttcctgaatctagaaaaaatgaaatgattaataatttcatcaaacctggtttggaagatttagctgtatctagaacaacttttgattggggtattaaagttcctggcaatccaaaacacgttgtttatgtatggattgacgcgctttctaactatattactgcgcttgggtataatacggacaatgacacgaaattccaaaaatactggcctgctgatgtacaaatcgttgggaaagaaatcgttcgtttccacacgatttattggccaattatgctgatggcactagacttaccacttccaaaaatggtgttcggccacggctggattctaatgaaagatggtaaaatgtctaaatccaaagggaatgtagtagatccttatatgctgattgaccgctacggcctagatgcgcttcgttattacttattacgcgaagttccatttggttcagatggtttatttacaccggaagactttgttgatcgtgtgaactttgatcttgccaacgatttaggaaacttacttaatcgtacagtagcaatgattaataagtactttgatggcgaaattccggcttatcaaggcaatgtaacagaattcgatcaaaccttagtggatttcaaaaacaatgtggtgaaggaatatgaaggtagcatggatcacatgcaattctctgtagctttaaaccaactgtggtcactaatttctcgtacaaataaatatatcgatgaaaccgctccatggacacttgccaaagacgaagataaacgcacagaacttgcgagcgtaatgactcatttagcagaaaacttacgtattatcgcagtacttttgcaaccattcttaacaagaactccaggcgaaatcttcttacaactaggtttacaagaagaaaacttgaaaaaatgggatagcatctatggatacggtgaaattccagctggcacaacagtggtgaaaaaaggtacgccaattttcccaagacttgaggcagaagtagaagttacttatatccaagatgaaatgaaaggctctgcgccagctcctgccaaagaagcggcggaagttgaagcgcttgaaacaccgcaaatcggcattgaagatttcgataaaatcgatcttcgtgttgcagaagtaaaacaagtagataaagtgaaaaaagcagataaacttctttgtttccaattagacttaggggaaggaaaactgcgccaagtgctttcaggcattgcagaattctatcaaccagaagaactaatcggcaaaaaagttatcgtcgtttctaacttaaaacctgtaaaacttcgcggactaatgagtgaaggaatgatactctcaggcgaaaaagatggtaagctaagtgtaatcgaagcaagtagcgcacttccaaatggtgcaaaagtaaaatag

SEQ ID NO: 24978 - protein, 665 aa, Listeria monocytogenes
MLPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNFDLANDLGNLLNRTVAMINKYFDGEIPAYQGNVTEFDQTLVDFKNNVVKEYEGSMDHMQFSVALNQLWSLISRTNKYIDETAPWTLAKDEDKRTELASVMTHLAENLRIIAVLLQPFLTRTPGEIFLQLGLQEENLKKWDSIYGYGEIPAGTTVVKKGTPIFPRLEAEVEVTYIQDEMKGSAPAPAKEAAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEASSALPNGAKVK

SEQ ID NO: 24979 - DNA, 1992 bp, Desulfovibrio vulgaris
  CDS (1)..(1992)
atggaccgcttctatgtaacgacacccatctactatgtgaacgccaagccccacctcgggcatgcctatacgaccatcgtcgccgacagtatgcgccggttccagcgccttcttggcaaggacacctatttcctcaccgggacggacgaacacggcgacaagatagtgcaggcagccgaaaaggccggagtttcacccaaggatttcgtcgacggcgtgagcgggcagtttcgtgacctgtggccgcatcttggtgtcgaatatgaccagttcatccgcaccaccgacccggaacacaagaaggtcgtgcaggcgttcctgcagcgggtgtacgatagcggcgacatctatttcggcgagtacggcgggcactactgctacggctgcgaacgcttctacaccgaaaaggagctcgagaacggcctgtgcccgcagcatcaggtgaagccggagtacatcgccgagaagaactacttcttccgcatgtccaagtatcaggggtggctgaagcagcacatcctggacaaccccgatttcatccggcccgaacgctatcgtaacgaagtgctctccatgctggacagcggggcgctcgaggacctctgcatatcacgccccaagtcgcgcctcacatggggcatcgaacttccgttcgacaccgattatgtgtgctacgtgtggttcgacgcgcttctcaactacgtgtcggcactggggtggcccgacggtgaccgtttcgccaactactggcccggagtgcagcatctcgtggccaaggacatcctcaagccgcacgccgtgttctggcctacgatgctgaaggcggcggggcttgaaccgtacaacaatctcaatgtccacggttactggctggtgcgcgacaccaagatgtccaagtcgcttggcaacgtcgtaagtccgctggagatgatcgaccgttacggcctcaacgccttcaggtattttctcctgcgcgagatgcacttcggcagcgacgcgagtttctccgaggaggcactcgtgggacgcctcaacgccgacctcgccaacgaccttggcaatctctacagccgggtgctgtccatgacggcgaagtacttcggcggggtcgtacccgcacccggcgcctataccgaagaggacgagaccctgcgggcactcgctgccgaggcccagcgtaatttctgcaacctcttcggtcgtgtgcgcttctccaatgcccttgaatcgctgtgggaactcgtgcgtgccctcaacaagtacgtagacagcgccgcaccctggacgctcttcaagcagggcgacaccaagcgacttggcacggtcatgtacaccttgctcgaatccatgcgcaaggtggcggtgcacctgcttcccgtcatgcccgaggctgcgacatcgatgctggcgcagcttggtctcgaggtgaacgtcgacgcagtcgaccttggcaacgaggccgaaacatggggcggcttgcagcccggcaccacggtcgccggggcatcgaacctgttcccgagggttgaactcgtgcgggagaaggatgagcctgccgaggtggcttcctcaaagggcaagtccgccgacggtgccggcacggcgaagaacgccaagcctgccgctgttgcgcctgcgcctgctgcttctcccgcggaggatgccggagtgatcgacttcgaagacttccagaaggtcgacatccgcatgggaaccgtggtggcagtcgagcgtcatcccaacgccgacaagttgctgcgggtcgaagtcgacctcggcgaggagaagccacggcagattgtggcggggcttgccgcctacttctctcctgaacagttgcaggggcgtcaggtcgctgtggttgccaacctcgctccgcgcaagctgcgcgggctggaatcgcaggggatgatccttgccgtccgtcagggtgaggggatggaactcgtgtctgtttccggcccggtctcccccggcagcaaagtgtcgtag

SEQ ID NO: 24980 - protein, 663 aa, Desulfovibrio vulgaris
MDRFYVTTPIYYVNAKPHLGHAYTTIVADSMRRFQRLLGKDTYFLTGTDEHGDKIVQAAEKAGVSPKDFVDGVSGQFRDLWPHLGVEYDQFIRTTDPEHKKVVQAFLQRVYDSGDIYFGEYGGHYCYGCERFYTEKELENGLCPQHQVKPEYIAEKNYFFRMSKYQGWLKQHILDNPDFIRPERYRNEVLSMLDSGALEDLCISRPKSRLTWGIELPFDTDYVCYVWFDALLNYVSALGWPDGDRFANYWPGVQHLVAKDILKPHAVFWPTMLKAAGLEPYNNLNVHGYWLVRDTKMSKSLGNVVSPLEMIDRYGLNAFRYFLLREMHFGSDASFSEEALVGRLNADLANDLGNLYSRVLSMTAKYFGGVVPAPGAYTEEDETLRALAAEAQRNFCNLFGRVRFSNALESLWELVRALNKYVDSAAPWTLFKQGDTKRLGTVMYTLLESMRKVAVHLLPVMPEAATSMLAQLGLEVNVDAVDLGNEAETWGGLQPGTTVAGASNLFPRVELVREKDEPAEVASSKGKSADGAGTAKNAKPAAVAPAPAASPAEDAGVIDFEDFQKVDIRMGTVVAVERHPNADKLLRVEVDLGEEKPRQIVAGLAAYFSPEQLQGRQVAVVANLAPRKLRGLESQGMILAVRQGEGMELVSVSGPVSPGSKVS

SEQ ID NO: 24981 - DNA, 330 bp, Thermus thermophilus
  CDS (1)..(330)
atgacccctctggaagctttccagatccttgatctgcgggtggggcgggtcctccgggcggagccccacgagaaggcgcgcaagcccagctacaagctctgggtggacctcgggcccctcggggtgaagcagagctcggcccagatcacggacctctaccgccccgaggacctggtgggccggctcgtggtctgcgccgtgaaccttggggccaagcgggtggcgggcttcctctccgaggtcctggtcctcggggtccccgacgaggcggggcgggtggtcctcctcgccccggaccgggaggtgcccctggggggaaaggtgttctaa

SEQ ID NO: 24982 - protein, 109 aa, Thermus thermophilus
MTPLEAFQILDLRVGRVLRAEPHEKARKPSYKLWVDLGPLGVKQSSAQITDLYRPEDLVGRLVVCAVNLGAKRVAGFLSEVLVLGVPDEAGRVVLLAPDREVPLGGKVF

SEQ ID NO: 24983 - DNA, 2382 bp, Treponema denticola
  CDS (1)..(2382)
atgaaacgaaaattagtaacctcggctttgccctatgtaaacaattttccccatttgggaaatttaattcaagtattatccgctgatgtatttgcgcgcttttgccgcttaaaagaatatgaaaccctttatatttgcggcaccgacgaatacggaaccgccaccgagacaaaggctctcgaagaaaaaaagagccccgaagagctatgctcattctatcatgcaattcatgctgaaatatataattggtttaatattgccttcgactattttggaagaacttctacgcctcagcagaccgaaataactcagggtatttttaatgacctcgataaaaacggctacattaccgagcatactatagaacagctttactgcccctcctgtaagcgctttttggccgaccgctatgtattgggtacctgtccttcatgttcctatgacggagcaaggggcgaccagtgcgagcattgcggaaaacttttagatcccaccgatttaaaagaaccccgttgttcttcttgcggggcagctcccgaagtgcgctctacaacccatctttatataaaccttcccaaaatcgtaccggagtacgaaaagtggatgcctaagacggcagaggagggaagatggtcaaacaatgcccttcaaatgtcaaaaagctggcttagggacggccttcaagaaagggctataacaagggaccttaaatggggaatccccgtgcccaaaaaaggctttgaagacaaggttttttatgtatggttcgatgctccaatcggctatatttcgataacaaagtgctgggctgaccttgccggaaaggattggaaggcatggtggcttgatcaaaatgatgtagagctttttcagtttatcggaaaagataatattccattccatacggtaatcttcccctgttctctcataggttccggaaaaaattggacaaaactctttcatatgtcaggcaccgagtaccttaattacgagaacggaaaattttcaaagtctaagggagtgggcgttttcggaaacgatgccaaagaatccggtatccctgccgatatgtggaggttctacatcttttataaccgccccgaaaagaacgacacccagtttacatggaaggattttcaggagagggtaaacagcgagcttatcggaaacctctgcaatcttgtaaacaggacagccacctttattcaccgttattatgatggcaaaataccccaagttgacggagcaaaatccggtcgggaggatataaagagtatggtaaaatctttaagggaggccgcctctgcaagcttcaaaaagataacggagctttcggattgggcagagcttagagattccttccatgaagcctttgccctctcttcagttgcaaacaaggcctttcaagatggagagccttggaaaaggcgcgaaaccgatcctgaatatgccgaagcccttatgtccgagctttgctatcttataaaggatattttaattttaattcatccctatatgccccaatacgccgatcaggccgcaggctttttcggccaaaagatttggtcgggaaatatctttgacggtaaggccccgcaatttaataagccggaaggttcattcctttcatggaaaaatttaggcgaaagggaagggcttaaaacggtagaaaaccccgtaatcatctttaagacccttgacaacaaggtcatcgatgcctatcgtgaacgttattcgggaagtcaaaaggacagaaaaaaatcggaaaaaggctgttcagcttgtaaggacagcggttcttcaaagtccgatgcagcagcttcttctgcaaagccggaagttaaactctctccggccgagcttttttcaaaaaagattgccttaaaaaccgccaagattatatccgtcgaaaggcatcccgatgccgacaaactctacatcgaaaaacttgatgacggctccggcgaagaaagaacaatcctttcaggtcttgtgccctttttgaaggaagacgaaatattgggaaaaaccgtcataattgccgataacctaaaaccacgaaaaatgcgcggtatcgaatcgaaggggatgcttttggcggcaagctggtatgatgaagaagaaaaagaacatgtcgagcttcttcaagccccatgggctgctcccggaacgcctgtaattcttgaaggcgatgccgatatttcagaccctgaggccgtaaaagccttttacgcacaaaaaccggcagcgatagacgcagacaccttctttgccgctcccatattgatagaagattacattcctaaaattgagggtaaaaagctcttggttgccggaaaagaaatgaagcttgaaaaggtaaaaaccggagaagcaggctag

SEQ ID NO: 24984 - protein, 793 aa, Treponema denticola
MKRKLVTSALPYVNNFPHLGNLIQVLSADVFARFCRLKEYETLYICGTDEYGTATETKALEEKKSPEELCSFYHAIHAEIYNWFNIAFDYFGRTSTPQQTEITQGIFNDLDKNGYITEHTIEQLYCPSCKRFLADRYVLGTCPSCSYDGARGDQCEHCGKLLDPTDLKEPRCSSCGAAPEVRSTTHLYINLPKIVPEYEKWMPKTAEEGRWSNNALQMSKSWLRDGLQERAITRDLKWGIPVPKKGFEDKVFYVWFDAPIGYISITKCWADLAGKDWKAWWLDQNDVELFQFIGKDNIPFHTVIFPCSLIGSGKNWTKLFHMSGTEYLNYENGKFSKSKGVGVFGNDAKESGIPADMWRFYIFYNRPEKNDTQFTWKDFQERVNSELIGNLCNLVNRTATFIHRYYDGKIPQVDGAKSGREDIKSMVKSLREAASASFKKITELSDWAELRDSFHEAFALSSVANKAFQDGEPWKRRETDPEYAEALMSELCYLIKDILILIHPYMPQYADQAAGFFGQKIWSGNIFDGKAPQFNKPEGSFLSWKNLGEREGLKTVENPVIIFKTLDNKVIDAYRERYSGSQKDRKKSEKGCSACKDSGSSKSDAAASSAKPEVKLSPAELFSKKIALKTAKIISVERHPDADKLYIEKLDDGSGEERTILSGLVPFLKEDEILGKTVIIADNLKPRKMRGIESKGMLLAASWYDEEEKEHVELLQAPWAAPGTPVILEGDADISDPEAVKAFYAQKPAAIDADTFFAAPILIEDYIPKIEGKKLLVAGKEMKLEKVKTGEAG

SEQ ID NO: 24985 - DNA, 2331 bp, Nanoarchaeum equitans
  CDS (1)..(2331)
atgcgtatcctagttactgcggctttgccatattcgaatgggccaatccatttgggccatatcgctggggcttatctgccagcagatatattttatagattcgtaaaactaaaaggatataatgcattgtacatatgtgggtctgaccaatatggatcgcctatcgaattaaacgcaataaaactaaacatagatccaaaggactatgcttcattctatagaaaaatacaagaagagattttcaaaaaatttaacataaaatttgatatatattcaggaacggccgaatccaatatacatcctataatagtaaaggaattctttttatcattatttagtgcaggccttttaatagaaaaagaacaagaattgccatatgatcctaaaataaaaagatttttaccggatcgatttgttgtagggcaatgtccctattgtgggtatgaaaaagcctatggggatcaatgtgaaaaatgtggtagactattagagcctaaagagttaattaatcctaaaagtgccataactggagaaaaagtaattttcaaaaagacgagacatttgtttttcaatattccaaaattaaaagataaactaaaacaatacattgaatctaaaaaggatgtatggaatgattttacatacagttggtctttagcattattggataactttaaagaaagggcaataactagagataacaaatggggcgtaaaagttcccgctaaggagatgttagaaatattaaaaaaagctctaaaagaaggaaaaaccccaaaagatttcggtttattaattgatagtactaacgaaaaagatttagaaaatcatataaaagaatacgaaaacaaggttttatatgtatggtttgatgcgcccatagggtatatatcttttacttttgagacttctcctgaatatagatattattgggacgaaaaagaaaaaccttatatagtgcattttattgggaaagacaatattcctttccatacaatattttggcctgcattaataattgggcgaaatttgggatataaaaatataaaccatatattagatttcgatatagctttgccttaccaagtatttggtaatccttatctaaactattatggcaaaaaattctcaaaaagcaaaaggtggggggtatttttggataacatagataaaatagatatagatatagactatttcagattctatttagcctacattcatacagtgtctaaagatatgtctttcgaatgggaccaattcaaagaagtaataaacaaagaattagtcgataacattggcaattttatccatagggttttaacctttatatacaatagatttaatggtattcccccaaaaatagagcatctagacgacaaagataaagaacttttagataaaataaagcaattacccgaaaaagtgtttaactttatatggaagggcgaaattggaaatgccttaagagagatcgttaatacctctaatttggctaacaaatatttccaagaaaaagagccatggaaaactaatgatccaaatactattgctattgctttcgaagcagtaaaaacctttataattctgttatatccatttattccggaaaaggccaaactattagcgtctatagctaatatagatataaaatgggatttcaatcaaaaagtagaaaaaataaacaaaccatttatcgttttccacaaattaagcgataaccaaatagaaatggcaaagcaaatcttaaccaatccaaaagaatatgatttgggtaaaaagaaagttataggtgttttaagatatgaagatgagttatataaaatagaattagaatgtgacgacaacccatgggtttgtctaaaaagagagttagataaaagaaaaataaaatacatatatgatacagttaaaggggatgtacccccacatataatagatggcaatacttatatatatttattgccggcattagagaaacccaatttagaaaaggcagaagaagaatatggcttagttagctatttggattttgctaaactagacatgagagttggtaaaattatagatgtgcaagaccacccaaatgcggataagctttatataataaaagtaagccttggcaataaacaaaaaaccttagttgggggactaaagcaatattataaaaaagaagagctaataggaaagtacgtagttttaataaataacttaaagcctaaacaattaagaggaataacatcagaaggaatgctattagctgcagacgatggtaaagaggtagcattattaatgccggacaaaccaattagtttaggttcaaaagttcgttaa

SEQ ID NO: 24986 - protein, 776 aa, Nanoarchaeum equitans
MRILVTAALPYSNGPIHLGHIAGAYLPADIFYRFVKLKGYNALYICGSDQYGSPIELNAIKLNIDPKDYASFYRKIQEEIFKKFNIKFDIYSGTAESNIHPIIVKEFFLSLFSAGLLIEKEQELPYDPKIKRFLPDRFVVGQCPYCGYEKAYGDQCEKCGRLLEPKELINPKSAITGEKVIFKKTRHLFFNIPKLKDKLKQYIESKKDVWNDFTYSWSLALLDNFKERAITRDNKWGVKVPAKEMLEILKKALKEGKTPKDFGLLIDSTNEKDLENHIKEYENKVLYVWFDAPIGYISFTFETSPEYRYYWDEKEKPYIVHFIGKDNIPFHTIFWPALIIGRNLGYKNINHILDFDIALPYQVFGNPYLNYYGKKFSKSKRWGVFLDNIDKIDIDIDYFRFYLAYIHTVSKDMSFEWDQFKEVINKELVDNIGNFIHRVLTFIYNRFNGIPPKIEHLDDKDKELLDKIKQLPEKVFNFIWKGEIGNALREIVNTSNLANKYFQEKEPWKTNDPNTIAIAFEAVKTFIILLYPFIPEKAKLLASIANIDIKWDFNQKVEKINKPFIVFHKLSDNQIEMAKQILTNPKEYDLGKKKVIGVLRYEDELYKIELECDDNPWVCLKRELDKRKIKYIYDTVKGDVPPHIIDGNTYIYLLPALEKPNLEKAEEEYGLVSYLDFAKLDMRVGKIIDVQDHPNADKLYIIKVSLGNKQKTLVGGLKQYYKKEELIGKYVVLINNLKPKQLRGITSEGMLLAADDGKEVALLMPDKPISLGSKVR

SEQ ID NO: 24987 - DNA, 615 bp, Ashbya gossypii
  CDS (1)..(615)
atgaacttgtgtttccgtactcttcccaaattgatggctcggtcaatgaccaccgttccatctggacaattgccttactctcttgctgatatacggattggaaaagtgctcagcgtacgcgagcacccagagtcctacaagatgtatattacgcaagtatcattcggtgggcttgggacaaaacagatatgcacaggtttgagagatcatgtaccgacctccgagatgcaagattcactagtggtcgtgttgaacaacattaagaaatgcaaacttcggggagaagttagcgaagcgatgattctctgcgcggaatactcacctcaagaatcaaagccatccgtgcagctcctacaaccagcgatctcttcaccagaattctgcggcgcacgggtgcttgtcggcgatttgctggggaaggaggtagccccgacatgcaggaggatcaagcccgctgagtgggaagagctttcttcccgcctttatgtggacaatagcggcagagtagtgctgcaatcagaagggaaggagctgcccctttatgtcagagataatatcggctcattgcactacataatggccagcagcatgcctacaggaagtcaagtaagataa

SEQ ID NO: 24988 - protein, 204 aa, Ashbya gossypii
MNLCFRTLPKLMARSMTTVPSGQLPYSLADIRIGKVLSVREHPESYKMYITQVSFGGLGTKQICTGLRDHVPTSEMQDSLVVVLNNIKKCKLRGEVSEAMILCAEYSPQESKPSVQLLQPAISSPEFCGARVLVGDLLGKEVAPTCRRIKPAEWEELSSRLYVDNSGRVVLQSEGKELPLYVRDNIGSLHYIMASSMPTGSQVR

SEQ ID NO: 24989 - DNA, 1116 bp, Ashbya gossypii
  CDS (1)..(1116)
atgccagatctagtcagcaagtttgagtcattatcactaaccgtgccagagcgggggccggagcaggctgcgtacgaggcgcaatggcggtcggtgctgcagaccgggcaggtgcaggccaagctgggcgagctgaacctgtttctgcgggaccactcgttcgtcgcgggcacggagcgcccgctgcgcgtagacgcggagctgttcgaggcagtgctgccggtgacgcgggaggtgctggctgcgtcgaaggacgtgcgggagcagtgcggcaagcaccgccacgtgatcaggtgggccaagtacctgcaggagcttctggacgttcctgaggcggagcgggtgctggtggacgaggcgatggagttgccgcgggaggtgatcgagaagaagaagaaggaggcgaagggtgaggtggcggcggcccctgccggcggcaagggcaaggcggaggacaaggcggagggcaaggcggcgcgcggcaagccggacgaggcgacgttggcgcggctgcgtgaggaggcgaaggccaagaaggccgcgaagaaggcagcaggcgctcagcagcagcagcagcaggcggccgcgccggccaagacgtcgcccggcatgatcgactttcgcgttgggttcatccagaaggcgatcaagcaccccgacgcagacgcgctgtacgtgtcgacgatcgacctaggcgagccagagggcccgcggacagtgtgctccgggcttgcgaagcacattccgctggaggagatgcagcagcgccacgtggtggtggtgtgcaacctgaagcccgtcaacatgcggggcatcaagtctgcggctatggtgctgtgcggctcgagtgacgggaaggtcgagctggtcatcccgcccgccaacagtgcggcgggcgacaaggtgttcttcgagggctacggcgacgaggagccgctcaagcagctcaaccccaagaagaagatctgggagcaggaacagccgcatttcacgactaccgcggacctcgaggtcgcctacaaggacgacagcgacgcggtgcctttgagaaagctaactaacgcccggggcgagaccttcaaggtgtcgtcgcttgcgcacgcccacgtcagctga

SEQ ID NO: 24990 - protein, 371 aa, Ashbya gossypii
MPDLVSKFESLSLTVPERGPEQAAYEAQWRSVLQTGQVQAKLGELNLFLRDHSFVAGTERPLRVDAELFEAVLPVTREVLAASKDVREQCGKHRHVIRWAKYLQELLDVPEAERVLVDEAMELPREVIEKKKKEAKGEVAAAPAGGKGKAEDKAEGKAARGKPDEATLARLREEAKAKKAAKKAAGAQQQQQQAAAPAKTSPGMIDFRVGFIQKAIKHPDADALYVSTIDLGEPEGPRTVCSGLAKHIPLEEMQQRHVVVVCNLKPVNMRGIKSAAMVLCGSSDGKVELVIPPANSAAGDKVFFEGYGDEEPLKQLNPKKKIWEQEQPHFTTTADLEVAYKDDSDAVPLRKLTNARGETFKVSSLAHAHVS

SEQ ID NO: 24991 - DNA, 1950 bp, Wolinella succinogenes
  CDS (1)..(1950)
atgaaccccaagagctttatcaccacccccatctactatgtcaatgacattccccatatcggacacgcctacaccacaatgattggcgattctttggctcactactacagactcattgggcatgagaccttctttctcacgggcaccgacgagcatggccaaaagatcgaacagagcgcccaaaaaaagggtaaaactcctcaagcctacgccgatgagatcagtggcgccttcaagtccctttgggatcgctttgagattagctacgaccacttcatccgcaccaccgatgctaaacacaaacagggcgtacagaaggcctttttgaagatgtttgagaagggcgatatttacaaaggcgaatacgaggggcactactgcgtgagctgtgagaccttcttcaccaagcgccaacttgtagatgacctctactgtcctgagtgcggcaaagagacgagcttggtgaaagaggagagctacttctttgctctctctagatatcaagaaaagctcctcgcatggtataaagagaatcctgactgcatcctccccaagcctaaaaaaaacgaggtaatgcgctttgtcgaatcagggttggatgacctctccatcacacgcactagctttgattggggggtgaagctcccccaggaaatgaatgctcccaagcatgtcatgtatgtatggctcgatgccctgctcaactatgtcaccgcccttggctatggagatgatgagaaacggatggatttttggcctgcgagagtgcatttggtggggaaggatatcttgcgattccatgcaatctattggcctgccttcttaatgagccttgatcttcctcttcccaagcatgttgcagcgcatggatggtggacgcgcaatggagccaagatgagcaaaagcgtgggcaatgtgatcaatcctcaagaggtggcagacgcctatggggtggagcccttccgctacttcatgcttcgcgaagtcccctttgggcaagatggtgacttcagccaaaaagccctcatcgatcgtctcaactctgatttgagcaacgatttagggaatcttctcaaccgtctaggcggaatgagcggcaaatattttgactatcaaatcacctccaaagaggtcaccacttttcacgccaaagagctgcaagaggccgaactgattctcgattcgcttcatggctacatccaagagatgcaaccccatcgctatctcgaagagctttggaaaatcttcaccatcgccaacaccgccattgccatgcatgagccatggaagctgatgaaggagggcaaagaatcccaagccatggcgctagtggcactcatcgccaatcttctcgccaaagccaccctcatgctctcccccatcatgccaaagagcgccgctaaaatcgctcaagccctgaatctagagatatccacagccagctatgagcggctcatcatccaaaaagcgcttttggaagagttcaccttcactcctaccccgcccctctttcccaagatcgaagagcctctcatgaagagcgacaccatgatcacccaagccacctcaagcgccccgctcgccaaagaggagaaagtcgccacacctcaagggttggctgagaactgcatctctatcgaggagtttttcaaagtggagctcaaaattggcacgattttaagcgctgaggcggtcgagaagagcgatcgactccttaaactctccgtggatgtaggcgaatcagagcctcgtcagattgtcgcaggaatcagagccttctacacccctgaatcactcattggcactcaagcttgcgtggtttgcaacctcaaacccgccaaattgatgggattaatgagccaagggatgttactcgccgccaaagatgaggaggggctctgcctccttcgacccgagaagcgccgaaagagcggaagcaaggtgagctaa

SEQ ID NO: 24992 - protein, 649 aa, Wolinella succinogenes
MNPKSFITTPIYYVNDIPHIGHAYTTMIGDSLAHYYRLIGHETFFLTGTDEHGQKIEQSAQKKGKTPQAYADEISGAFKSLWDRFEISYDHFIRTTDAKHKQGVQKAFLKMFEKGDIYKGEYEGHYCVSCETFFTKRQLVDDLYCPECGKETSLVKEESYFFALSRYQEKLLAWYKENPDCILPKPKKNEVMRFVESGLDDLSITRTSFDWGVKLPQEMNAPKHVMYVWLDALLNYVTALGYGDDEKRMDFWPARVHLVGKDILRFHAIYWPAFLMSLDLPLPKHVAAHGWWTRNGAKMSKSVGNVINPQEVADAYGVEPFRYFMLREVPFGQDGDFSQKALIDRLNSDLSNDLGNLLNRLGGMSGKYFDYQITSKEVTTFHAKELQEAELILDSLHGYIQEMQPHRYLEELWKIFTIANTAIAMHEPWKLMKEGKESQAMALVALIANLLAKATLMLSPIMPKSAAKIAQALNLEISTASYERLIIQKALLEEFTFTPTPPLFPKIEEPLMKSDTMITQATSSAPLAKEEKVATPQGLAENCISIEEFFKVELKIGTILSAEAVEKSDRLLKLSVDVGESEPRQIVAGIRAFYTPESLIGTQACVVCNLKPAKLMGLMSQGMLLAAKDEEGLCLLRPEKRRKSGSKVS

SEQ ID NO: 24993 - DNA, 2043 bp, Porphyromonas gingivalis
  CDS (1)..(2043)
atggatagacaattcaagcgaactcttattactacggccctcccgtatgccaacgggcctgtacatatcggacacttggccggtgtctacgttccggccgatatatatgcacgctatctgcgattgcgtggcagagactgcctgctgatcggcggttcggacgaacacggtgtacccatcgccctgaaagccaaagccgagggatgcactccgcaggaggtggtagaccgataccacgaactgatcaagcgttcgttcgaggggctgggtatctctttcgacatatactcacgtaccacaagcgacatacatcgtcgtacggcaagtgagtttttcaagaccctgtatgaaaagggtgagttcgtggagcagacgagtgagcagtattatgacgaagaagccaagcaattcctggccgatcgttatatcatcggtacctgtccgcactgtagcaatgatcgggcttacggcgaccagtgcgaagcctgcggcacctcactcaatgctaccgatctgatcgatccgcggagtacgatctcgggtagtgctcccgtgctgcgcgagacgaaacactggtatctacctctggacaagcatgagcctttcctgaaagagtggatccttgatggacataaggagtggaagagcaacgtctacggccagtgcaagagttggctggatatggggctgcaaccccgtgccgtgagccgcgatttggactggggtatccccgtgccggtggagggtgccgaaggaaaagtattgtatgtctggttcgatgctccgataggctatatctccaataccaaagagctgtgtcccgatagttgggagacgtggtggaagtcggaagatacccgtcttgttcattttatcggtaaggataatatcgtattccactgtatcgttttcccggccatgctccgtgccgaaggttcgtttatcctgcctgacaatgtgcctgccaacgagtttctcaacctcgaaggagataagatttccaccagtcggaactgggccgtctggctgcatgaatacctcgaagagttcccgggcaagcaggatgtactgcgctatgtgctcacggccaacgctcctgagacgaaggacaacgacttcacgtggcgcgactttcaggctcgcaacaacaatgaactggtagccatattcggcaatttcgtgaaccgggcattggtccttactcataaatacttcgatggagctgtcccgcccaaaggcgagctgacggattgcgacagccgcacgatagaggagtttgcagccgtgaagcaggccttggagcatcagttggatacgttccacttccgcgaagcactgaaagaagcgatgaatctggcacgtataggcaataaatatctggccgatacggaaccttggaagctggcaaaaacggatatgaaccgtgtggctacgatcctcaatctgtctctgcagataacggccaatctggctatcgccttcgaaccgttcctgcctttctcctcggcaaaactcatgtcgatgctctccaccgactgtcctttcggctgggatcgtttgggtagtacggatctcttacccgaaggacacgtcttgggcaatcccgaattgctcttcgaaaagctggaggacagtgtgatagatgcacagattcagaaattgcaggataccaagctggccaacgaaaaggctgcccatcaggctgctccgatagccgaagacattgcattcgaggactttctcaagctggacatccgtgtgggcaccgtgctggagtgtgagaaagtgcccaaagcggacaagctcttgcgttttcgtatcgatgatggtctgagtggccggacgatcgtttcgggtattgccaaacactatgctccggaagagctggtaggcaagcaggtatgctttatcgccaatttgccgccgcgcaagctgaaaggtatcgagtccgagggcatgattctttcggcagaggatgcggatggttcgctcagggtcattatgccggcggctgaagttgctgcaggtagtcaggtgaaatag

SEQ ID NO: 24994 - protein, 680 aa, Porphyromonas gingivalis
MDRQFKRTLITTALPYANGPVHIGHLAGVYVPADIYARYLRLRGRDCLLIGGSDEHGVPIALKAKAEGCTPQEVVDRYHELIKRSFEGLGISFDIYSRTTSDIHRRTASEFFKTLYEKGEFVEQTSEQYYDEEAKQFLADRYIIGTCPHCSNDRAYGDQCEACGTSLNATDLIDPRSTISGSAPVLRETKHWYLPLDKHEPFLKEWILDGHKEWKSNVYGQCKSWLDMGLQPRAVSRDLDWGIPVPVEGAEGKVLYVWFDAPIGYISNTKELCPDSWETWWKSEDTRLVHFIGKDNIVFHCIVFPAMLRAEGSFILPDNVPANEFLNLEGDKISTSRNWAVWLHEYLEEFPGKQDVLRYVLTANAPETKDNDFTWRDFQARNNNELVAIFGNFVNRALVLTHKYFDGAVPPKGELTDCDSRTIEEFAAVKQALEHQLDTFHFREALKEAMNLARIGNKYLADTEPWKLAKTDMNRVATILNLSLQITANLAIAFEPFLPFSSAKLMSMLSTDCPFGWDRLGSTDLLPEGHVLGNPELLFEKLEDSVIDAQIQKLQDTKLANEKAAHQAAPIAEDIAFEDFLKLDIRVGTVLECEKVPKADKLLRFRIDDGLSGRTIVSGIAKHYAPEELVGKQVCFIANLPPRKLKGIESEGMILSAEDADGSLRVIMPAAEVAAGSQVK

SEQ ID NO: 24995 - DNA, 336 bp, Photorhabdus luminescens
  CDS (1)..(336)
atggaaaagatcgaatggactgactttgagaaagtcgacatgcgggttggcacaattatttcagtagaattgaatcctcaagccagcaaacctgcctataaattacaaattgatcttggcgaattgggcgttaaaagctcaagtgcccagataacggtgcattatacacctgaacaattaattggccgtcaggttctttgtgtgtgcaattttccaccaaagcggattgctggtgtcaaatcggaagtattgctgaccggcagtgtggatgaaaatggtgcggtggtgatcgcagaatttactcttcctgtcccaaatggtcataagttattgtaa

SEQ ID NO: 24996 - protein, 111 aa, Photorhabdus luminescens
MEKIEWTDFEKVDMRVGTIISVELNPQASKPAYKLQIDLGELGVKSSSAQITVHYTPEQLIGRQVLCVCNFPPKRIAGVKSEVLLTGSVDENGAVVIAEFTLPVPNGHKLL

SEQ ID NO: 24997 - DNA, 2028 bp, Photorhabdus luminescens
  CDS (1)..(2028)
atgtctcaagtcgcaaaaaaattattggtgacgtgcgcgttgccatatgctaacggtccaatccatctcggtcacatgctggaacatatccaagcagatatttgggtccgttttcagcgaatgcgcggcaaagaggttcactttatctgtgccgatgacgctcatggaaccccaatcatgctgaaagctcagcaaatgggtattgctcctgaagagatgatcgcaacggtgaaccaagagcatcatcaggattttactggcttttcagtgagctatgataactatcactctacgcatagcgaagagaaccaaacgttatcaaccaaaatctatctcgaactgaaaaaaaacggtcatattaagaatcgtactatttctcagttatatgatcctgagaaaaatatgtttctgccggatcgctttgttaaaggtagctgcccgaaatgtaaggcagaagatcagtatggcgataactgtgaagtttgcggttcaacctacagcccaactgaactaatcaacccacgttctgctgtctccggcgcgacgccagaaatgcgtgaaacagagcacttcttcttcgatctgcccgcattcagtgacatgctgcaagcttggacccgctccggtgccttacaggagcaagttgctaacaaaatgcaggaatggtttgaatccggtttacaacagtgggatatcacccgtgacgccccctatttcggttttgaaattcctgatgcgccgggcaaatatttctatgtctggctggatgcgcctatcggctatatgggttctttccaaaacctatgtgataaacgcggaaatctgaactttgatgagttctgggcaaaagattccaccgctgatctgtatcattttatcggtaaagacattgtttatttccacagcctgttctggccggccatgttggaaggcagcggttatcgtaagccaaccaacgtgtttgttcatggctatgtcaccgtcaacggtgcgaagatgtccaaatcccgtggtacttttattaaagccagcacttatttggatcatctggatgcagactgtttgcgttattactatgcagccaaactctcggctcgcattgatgatatcgatctgaatctggaagattttgttcaacgtgttaacagcgatatcgttaataaagttgttaacctggcctcccgtaatgccggcttcattaataaacgctttaacggcaagctggcggataaactggctgatccggcgctttaccaacagtttattgatggggcaaaggtgattgcagaagagtttaataaccgcgaattcagcaaagcaatccgtgaaatcatggcactggctgatttggcaaaccgttatgtggatgagcaagcaccgtgggtggtggcaaaagaagaaggccgtgatgccgatcttcaagctatctgttcaatgggcatcaacctgttccgcgttttgatgactttcctgaaacccgttttgccaagtctggcagaacgcgcagaagcgttcttaaatacagaactcacctggcatggtattgaacagccgctgctggatcatcaagtttctgcctttaaggccctgttcaatcgcattgatatggataaagtggacgctatggttgtggcatctaaagagagcatcaacacaccacaaaaagtcagcggtccactggcagaagatccaattcaggacaccattacctttgatgattttgccaaagttgatatgcgcgtcgcccttattaaacaggctgattttgtcgaaggctcagataagttgctgaaactgatgctggatcttggtggcgaaactcgccaggtattttcgggtattcgctccagttatcctgatccaaaagcactggaaggccgtttaaccattatggttgctaatctggcaccacgcaaaatgcgctttggtatttcggaagggatggttatggccgccggacctggcggaaaagatatctttttactcagccctgacagcggcgcccaacccggtatgcaagtgaaataa

SEQ ID NO: 24998 - protein, 675 aa, Photorhabdus luminescens
MSQVAKKLLVTCALPYANGPIHLGHMLEHIQADIWVRFQRMRGKEVHFICADDAHGTPIMLKAQQMGIAPEEMIATVNQEHHQDFTGFSVSYDNYHSTHSEENQTLSTKIYLELKKNGHIKNRTISQLYDPEKNMFLPDRFVKGSCPKCKAEDQYGDNCEVCGSTYSPTELINPRSAVSGATPEMRETEHFFFDLPAFSDMLQAWTRSGALQEQVANKMQEWFESGLQQWDITRDAPYFGFEIPDAPGKYFYVWLDAPIGYMGSFQNLCDKRGNLNFDEFWAKDSTADLYHFIGKDIVYFHSLFWPAMLEGSGYRKPTNVFVHGYVTVNGAKMSKSRGTFIKASTYLDHLDADCLRYYYAAKLSARIDDIDLNLEDFVQRVNSDIVNKVVNLASRNAGFINKRFNGKLADKLADPALYQQFIDGAKVIAEEFNNREFSKAIREIMALADLANRYVDEQAPWVVAKEEGRDADLQAICSMGINLFRVLMTFLKPVLPSLAERAEAFLNTELTWHGIEQPLLDHQVSAFKALFNRIDMDKVDAMVVASKESINTPQKVSGPLAEDPIQDTITFDDFAKVDMRVALIKQADFVEGSDKLLKLMLDLGGETRQVFSGIRSSYPDPKALEGRLTIMVANLAPRKMRFGISEGMVMAAGPGGKDIFLLSPDSGAQPGMQVK

SEQ ID NO: 24999 - DNA, 2070 bp, Chromobacterium violaceum
  CDS (1)..(2070)
atgatccgaatgaccaaacgcaagattctggtgaccagcgcgctgccttacgccaacgcggggctgcacctgggccacatgctggagcagattcagaccgacatctgggtgcgcttccagaagatgcgcggacacgaatgctactatgtgtgcgccgacgatacccacggcgcgcccatcatgctggccgccgagaagcgcggcatcactcccgaacagctggtgaacgaggtgcgcgagctgcacgtcgccgattcgcagggcttcctgatcggccatgacaactactacagcaccaacagtccggaaaacaaggcgctggccgagcaggtgtacctggcgctgaaggccgacgacaagatcgcctgccgcaccatcgagcagctgttcgatccggaaaagcagatgttcctgccagaccgcttcgtcaagggcgaatgtccgaagtgttccgccaaggaccagtacggcgacaactgtgaagtctgcggcgccacctacgccccgaccgagctgaagaacccttactcggcggtgtccggcgccaagccggtgctgaaaacctccgagcacttcttcttccgtctgggcgaatgcgccgacttcctcaaggcctggaccagcggcgccagccgccgcgccgacggcgcggtgcagccgcacctgcagccagagtcgctgaacaagatgaacgagtggataggcggcggcctgcaggactgggacatcagccgcgacgcgccttacttcggcttcgagatccccggcgcgccgggcaagtacttctatgtgtggctggacgcgccgatcggctacatggccagcttcaagaacctgtgcgagcggctgaacctgaacttcgacgagtggttcgccaaggatagccagaccgagatgtaccacttcatcggcaaggacatcctgtacttccacgcgctgttctggccggcgatgctgaactactccggcctgcgcgcgccgaccggcgtgttcgcccacggcttcctgaccgtggacggccagaagatgtccaagtcgcgcggaaccttcatccaggccaagagctacctggactgcggcctgaatccggagtggatgcgctactacatcgccgccaagctgaacggccgcatcgaggacatcgacctcaacctgaacgacttcgtcgcgcgggtgaactccgacctggtcggcaagttcgtcaacatcgccagccgctccgccggcttcatcgccaagcgcttcgacggcatgctggccgcccaggtgtccgacggcgagatcctggccaagctgcaggccgcggccgaggagctggccgccgcctacgaagcgcgcgagtacgcgaaggcgctgcgcgacgtgatggcgctggccgacatcgtcaacggctacgtggacgccaacaagccttgggagctggccaagcaggaaggccaggacgcgcgcctgcaggacgtctgcaccgtgctggtcaacgccttccgcctgctggccatctacctgaagccggtgctgcccaagctggccgaaggcgtggaagccttcctggacgtggcgccgttgtcctggcacgacgcggaaaccctgctgctgggcaagaagatcaatgcctaccagcacctgatgcagcgcatcgacccggcgctgatcgacaaactgatagaagcgaacaaacagaatatgcaagctatccaagacgcgccggcagccgccgcgcacgagccgctggccgaaaccatcaagatcgacgacttcgccaaggtcgacctgcgcgtcggcaaggtgctggaatgcaatttcgtcgaaggctcggacaaactgctgcagttcaaggtggatctgggcttcgagacccgcaacatcttctccggcatccgcaaggcgtatcaggagccggaaaagctggtcggccgccatgtgatcgtggtcgccaacctggccgagcgcaaaatgcgcttcggcgtgtcgcagggcatgatcgtctgcgcgtccggcgtggacgacagcgaaggcctgttcctgctggatgtggacgccggcgtgaagcctggcatgcgcgtaggctga

SEQ ID NO: 25000 - protein, 689 aa, Chromobacterium violaceum
MIRMTKRKILVTSALPYANAGLHLGHMLEQIQTDIWVRFQKMRGHECYYVCADDTHGAPIMLAAEKRGITPEQLVNEVRELHVADSQGFLIGHDNYYSTNSPENKALAEQVYLALKADDKIACRTIEQLFDPEKQMFLPDRFVKGECPKCSAKDQYGDNCEVCGATYAPTELKNPYSAVSGAKPVLKTSEHFFFRLGECADFLKAWTSGASRRADGAVQPHLQPESLNKMNEWIGGGLQDWDISRDAPYFGFEIPGAPGKYFYVWLDAPIGYMASFKNLCERLNLNFDEWFAKDSQTEMYHFIGKDILYFHALFWPAMLNYSGLRAPTGVFAHGFLTVDGQKMSKSRGTFIQAKSYLDCGLNPEWMRYYIAAKLNGRIEDIDLNLNDFVARVNSDLVGKFVNIASRSAGFIAKRFDGMLAAQVSDGEILAKLQAAAEELAAAYEAREYAKALRDVMALADIVNGYVDANKPWELAKQEGQDARLQDVCTVLVNAFRLLAIYLKPVLPKLAEGVEAFLDVAPLSWHDAETLLLGKKINAYQHLMQRIDPALIDKLIEANKQNMQAIQDAPAAAAHEPLAETIKIDDFAKVDLRVGKVLECNFVEGSDKLLQFKVDLGFETRNIFSGIRKAYQEPEKLVGRHVIVVANLAERKMRFGVSQGMIVCASGVDDSEGLFLLDVDAGVKPGMRVG

SEQ ID NO: 25001 - DNA, 1629 bp, Anopheles gambiae str
  CDS (1)..(1629)
atggcttccacactaacgccggaggagaaggagcatctcatcacccgcaacctgcaggaggtgctgggtcaggataatcttcgcgcggttctgaaagagcgcgatcttaaaatatactggggtacggccacgactggcaaaccacacatcgcttactttgtccccatgtccaaggtggccgactttttgaaagccggctgtgaggtaacgatcctgtttgcagatctgcacgcctatctggacaacatgaaggcgccgtggtcgctgctcaaggaacgcaccaagtactacgaggcggttatcaaggcgatgcttacctcgctcggagtgccgctggacaagctgaagttcgtgtgcggcacggactatcaactgtcgaaggagtacacgctggatgtgtaccggttgtcctcggtcgtgacgcagcacgacgccaagaaggcgggagcggaggtggtgaagcaggtggagcatccgctgatgtcgggcatcctgtacccgggcctgcaggcgctggacgaggagtatctgaaggtggacgcccagttcggtggggtggatcagcgcaaaattttcaccttcgccgagaaatacctgccgcagctgggttacgccaagcgtattcatcttatgaatccgatgatcccgggactggccggcggcaagatgtcgtccagtgaggaggactcaaaaatcgacctgctcgacagtgcggcgaaggtgaagagcaagatcaagaaagcgttctgtgagccgggcaacattgaggacaatgggctgctaaagttcgtgaagcacgtcgtgtatccgatgttcaaggagggcgaagcattcacggtccaccgcaaaccggactttggtggcgatctcgtgtttgccgagtacgaacagctggaggcttgctttgccgcccaggagctgcacccgggcgacttgaaggcagccgtcgaagtgtacatcaaccggctgctggaaccgatccgcaagtcgttcgacacggattactaccgcgagctgaccgaacgcgcctatccggcaccggtgaaggtgcaggcaggaaagcaggccggtggtggcaaagcgcaaccagcagctgccggtgcgggcacaaatgctactgcggcggtcggtgaaaatacgcccgataagctggagctgaaggtcggccagatcatggacgctgtgaagcatccggacgccgacagtctttgcgtgctgacggtggacattggtggcggcgagcggaaggcgatcgtgagcaatttgatggctcactacacgctagagcagctgcgcgaccggttcgtggtggtgctgaccaacatgaaggcatcgaaaattcgcggcgttgagagcgaaggcttggtgctgtatgcggcaggagcggaaaagtgtgaagctttggccgtaccggagggttcgaaggtgggcgaacgcatcattgtggaagggttcgacaatacgggcaacccggtcccggcgctgaacccgaagaagaaggtgtgggacaagattcaggcggagctgcacaccggcacggacggacaggcactgtggaaggagttttcgctgatgacgctgaacggggatcgggtaacgagcacgctggcaggatgtagcatcaagtag

SEQ ID NO: 25002 - protein, 542 aa, Anopheles gambiae str
MASTLTPEEKEHLITRNLQEVLGQDNLRAVLKERDLKIYWGTATTGKPHIAYFVPMSKVADFLKAGCEVTILFADLHAYLDNMKAPWSLLKERTKYYEAVIKAMLTSLGVPLDKLKFVCGTDYQLSKEYTLDVYRLSSVVTQHDAKKAGAEVVKQVEHPLMSGILYPGLQALDEEYLKVDAQFGGVDQRKIFTFAEKYLPQLGYAKRIHLMNPMIPGLAGGKMSSSEEDSKIDLLDSAAKVKSKIKKAFCEPGNIEDNGLLKFVKHVVYPMFKEGEAFTVHRKPDFGGDLVFAEYEQLEACFAAQELHPGDLKAAVEVYINRLLEPIRKSFDTDYYRELTERAYPAPVKVQAGKQAGGGKAQPAAAGAGTNATAAVGENTPDKLELKVGQIMDAVKHPDADSLCVLTVDIGGGERKAIVSNLMAHYTLEQLRDRFVVVLTNMKASKIRGVESEGLVLYAAGAEKCEALAVPEGSKVGERIIVEGFDNTGNPVPALNPKKKVWDKIQAELHTGTDGQALWKEFSLMTLNGDRVTSTLAGCSIK

SEQ ID NO: 25003 - DNA, 339 bp, Rhodopirellula baltica
  CDS (1)..(339)
atgtcgctcatcacttggcaagaattcgaaaacgttgacgtgcgcgtgggcacaatcacgctggtcgaggactttccagaggcccgcaagcccgcgtacaaaatcactgtcgattttggcgaggagctggggaccaaacgaaccagcgcccagatcacggtgcactacaccaaagaagaattgctcggacgccagatcctcggcgtggtcaatttcccgcccaagcagattggaccgatcacgtctgagtttttgctcacaggactgtaccgtgaagatggatcagtcattctcgcggttccggacaaagcaatgcccaacggtgccaaactcggctga

SEQ ID NO: 25004 - protein, 112 aa, Rhodopirellula baltica
MSLITWQEFENVDVRVGTITLVEDFPEARKPAYKITVDFGEELGTKRTSAQITVHYTKEELLGRQILGVVNFPPKQIGPITSEFLLTGLYREDGSVILAVPDKAMPNGAKLG

SEQ ID NO: 25005 - DNA, 1932 bp, Helicobacter hepaticus
  CDS (1)..(1932)
atgagtcaaaaaatcctcataacctcccctatttattatgtgaatgatattcctcatattgggcacgcttatacaaccattttatgtgatatgcttaaaaaattttatcaactacaaggcaacgatgtaaagtttctcacaggcacagatgaacacggacaaaaaattgaacaatccgcacaaaagcatagcctagaccctcaatcttatgctgataaaattagtataagattcaaagagttgtggaatgaatttaatatagattatgatatttttgtgcgcaccacagataatatgcattgtctaagtgtacaaaaagcctttgaaataatgtatgctaaaggtgatatttacaaggggagctatgagggacattattgtatttcgtgtgagactttctttactcaaaagcaacttaatgaaaataacgcttgtcctgattgtggcaagcctacacagattgtgcaagaagaaagttatttttttgccctaagtaaatatcaaaataaacttttggattggtataaatctcaccctgatttcattttaccacaatttcgccaaaatgaaattatcaaatttgtaaatgaaggacttaatgacctctccattacgcgcacaagctttgaatggggtgtgccactcccgcataatcccgtgcgtaaagatgacaaaaaacacgtgatgtatgtgtggcttgatgcacttttaagctacttaagccctctgggttatctttcagatagtgcaaaaatgccttattgggagaatgcaatacactttgttggtaaggatattttgcgattccacgcagtgtattggttagcatttttaatgagccttgagctacctttgccacagcacatttatgcgcacggctggtggacaaaagatggaacaaaaatgagcaaaagcattggcaatgtgattaatccaaaagaagttgcaaatgcctatggtatagaatctttgcgatattttttgcttagagaaatgccatttggacaagatggagactttagccaaaaagcctttattgagcgcattaacgctgaactaggtaatgatgtaggcaatttgcttaatcgccttattggtatgagtgagaaatattttgcgctccaagtcgattctgtgcaagtggaaatgttttttgcccctgaactcaatgagcttaaaaatatcattgcccaagcacaagaaaaaatgctctctatgcagccacaccgctatgttgaagagctgtggaaagcttttggactgggcaatagtgtcattaccaaatatgaaccttggaacctcatcaagtctcatcaaacagataaggcaatggctttgctcggcttgattgctaatattttagcccaaagtagccttttactctatccgattatgcctcaaagtgcgtgtaaaatcgccaacacgctcaattttgatattaatgcacaaaattatgaaaaacttattaaacaaggacagcttcttgcctcttttaaactcaataaaattcctccacttttccctcgtatagaatctcctttacttgcagaatctcctaccaataccaaggaagattctcaaaacaaacatacacctgaaaaaacaggacttattgatattaaagattttagcaaaattgatatacgcgtaggaacaatcatagaatgcactcccatagaaaaaagtgaaaaactcctaaaattaatggtagatattggtgaatctaagccacgtcagattctttcaggtatcgctcaatactatacccctcaatctcttataaataaacaaatatgcttgataatcaacctcaaaccagccaaacttatgggagaaatcagcgagggaatgatacttgctagtaaagataaaaacggcttgtctttgcttggtgtagataatccacgaatcaatggaagtccgataagttaa

SEQ ID NO: 25006 - protein, 643 aa, Helicobacter hepaticus
MSQKILITSPIYYVNDIPHIGHAYTTILCDMLKKFYQLQGNDVKFLTGTDEHGQKIEQSAQKHSLDPQSYADKISIRFKELWNEFNIDYDIFVRTTDNMHCLSVQKAFEIMYAKGDIYKGSYEGHYCISCETFFTQKQLNENNACPDCGKPTQIVQEESYFFALSKYQNKLLDWYKSHPDFILPQFRQNEIIKFVNEGLNDLSITRTSFEWGVPLPHNPVRKDDKKHVMYVWLDALLSYLSPLGYLSDSAKMPYWENAIHFVGKDILRFHAVYWLAFLMSLELPLPQHIYAHGWWTKDGTKMSKSIGNVINPKEVANAYGIESLRYFLLREMPFGQDGDFSQKAFIERINAELGNDVGNLLNRLIGMSEKYFALQVDSVQVEMFFAPELNELKNIIAQAQEKMLSMQPHRYVEELWKAFGLGNSVITKYEPWNLIKSHQTDKAMALLGLIANILAQSSLLLYPIMPQSACKIANTLNFDINAQNYEKLIKQGQLLASFKLNKIPPLFPRIESPLLAESPTNTKEDSQNKHTPEKTGLIDIKDFSKIDIRVGTIIECTPIEKSEKLLKLMVDIGESKPRQILSGIAQYYTPQSLINKQICLIINLKPAKLMGEISEGMILASKDKNGLSLLGVDNPRINGSPIS

SEQ ID NO: 25007 - DNA, 2055 bp, Haemophilus ducreyi
  CDS (1)..(2055)
atgtcgaataaaagaaaaatgttggttacttgtgcattaccctatgccaatggcgccattcacttaggccatatgttagaacatatacaagcagatatttgggttcgttttcaacggatgagaggccaccaagtttattttgtctgtgcagatgatgcccatggcacccccattatgctaaatgctgccaaacaaggcatcaccccagaacaactcattgccaaagccaaagccgatcatatagccgattttcaaagttttaacattagcttcgataattaccattctacacacagtgaagaaaatcgaaacattaccaccgcaatgtataaaacattacgggataaaggcctcattaaaacgcgtgtcatttcgcaactattcgatccagaaaaacagatgtttttacctgatcgctttgtgaaaggcacctgcccaaaatgccaagctgaagatcaatatggtgataactgtgaagtctgtgcgtctacatatagtcctatggatttaattaacccacattctgttgtatccggtgctacgcctattgtcaaacaatctgaacatttcttttttgacttacccaactttgaagcaatgttaaaaacttggacgcattcaggttcattacaacctcaaattgctaataaaatgcaagaatggtttgaaagtggcttacaacaatgggatatcagccgtgatgcgccttattttggtttcccgattccagacactgaaaataaattcttctatgtatggttagacgcaccaatcggttatatggcttcattcaaaaatctgtgtgatcgaaccggtttaaattatgaagaattttggcaaaaagaaagtaaaactgaactttatcactttatcggcaaagatatcgtctacttccatagtttattttggcctgctatgctagaaggctgtgatcagcgtaaaccaaccaatatattcgcacatggctatgtcaccgtcgatggtgtcaaaatgtcaaaatcacgtggtacttttattcaagcaagcacttacttaaaacatattgatccagaatgtttacgttattactacgccgccaaactaaatgaacggattgaagatttagatctaaatcttgacgattttgtacaacgtgttaacagtgatattgttaataaattagtcaatcttgcctcacgtaatgcaagttttattacgaaacggtttgctggcaacttagcagataaattagaagatgaagccctctttgcagaatttgtagcacaagctagcaacatcgccgatcattatgaagcaagagaatacaataaagctattcgcttaattatggacttatgtgataaagccaataaatatgttgatgataaagcaccgtgggtaatcgctaaacaagcagatcgtgaagctgaattgcatgcagtttgctcaatgggcattgaattattccgtattttaatcagctatttaaaacccgttctaccacaattagcaacgcgtgcagaagcatttttacaaactgaactacgttgggataatattgctagtccattactaaatcaaaacgttgcaccctttaaatctctcttctcacgcttagagaaaaaacaaattgatcgcgtgattgaagaaactaaagccctattctcaacacaacctaaaacagaacaaccacaagtagcatcaacaatgaacgataatcaacaacaaaatattgaacccatcgcagcagaaatcagcattgatgattttgccaaactagatttacgtgttgccaaagtaatccaatgtgaagctgtaccagaatcaaataaactattaaaattccaattagatttaggagatcaccaacggcaagttctctccggcattaaagcggcttatagcaaaccggaagaattaaatggtcgctttgtaattatggttgccaacttagcaccacgcaaaatgaaatttggtttatccgaaggaatgattctatcggcaggaacagggggcgcagacttgttcttactttcaggcgactgtggcattcgcccaggcatgcaagtaaaataa

SEQ ID NO: 25008 - protein, 684 aa, Haemophilus ducreyi
MSNKRKMLVTCALPYANGAIHLGHMLEHIQADIWVRFQRMRGHQVYFVCADDAHGTPIMLNAAKQGITPEQLIAKAKADHIADFQSFNISFDNYHSTHSEENRNITTAMYKTLRDKGLIKTRVISQLFDPEKQMFLPDRFVKGTCPKCQAEDQYGDNCEVCASTYSPMDLINPHSVVSGATPIVKQSEHFFFDLPNFEAMLKTWTHSGSLQPQIANKMQEWFESGLQQWDISRDAPYFGFPIPDTENKFFYVWLDAPIGYMASFKNLCDRTGLNYEEFWQKESKTELYHFIGKDIVYFHSLFWPAMLEGCDQRKPTNIFAHGYVTVDGVKMSKSRGTFIQASTYLKHIDPECLRYYYAAKLNERIEDLDLNLDDFVQRVNSDIVNKLVNLASRNASFITKRFAGNLADKLEDEALFAEFVAQASNIADHYEAREYNKAIRLIMDLCDKANKYVDDKAPWVIAKQADREAELHAVCSMGIELFRILISYLKPVLPQLATRAEAFLQTELRWDNIASPLLNQNVAPFKSLFSRLEKKQIDRVIEETKALFSTQPKTEQPQVASTMNDNQQQNIEPIAAEISIDDFAKLDLRVAKVIQCEAVPESNKLLKFQLDLGDHQRQVLSGIKAAYSKPEELNGRFVIMVANLAPRKMKFGLSEGMILSAGTGGADLFLLSGDCGIRPGMQVK

SEQ ID NO: 25009 - DNA, 339 bp, Bordetella parapertussis
  CDS (1)..(339)
atgcaactcatagactggacggatttcgccaaggtcgaactgcgggtcggccgcatcgtgcaggccttgccgtttcccgaggcccgcaagccggcctatatcctgcacgtggacttcggcgccgagatcggcgtgaagaagtccagcgcgcaggtcacgcacctctatcagcccgagacgctgctgggcagactggtggtcgccgtggtcaattttccgaagaagcagatcggcccgctgcagtcggaatgcctggtcaccggcttccataacgcgcagggcgaagtcgcgctgtgcgtgcccgaccgcgacgtcccgctgggcaccaagctgctctag

SEQ ID NO: 25010 - protein, 112 aa, Bordetella parapertussis
MQLIDWTDFAKVELRVGRIVQALPFPEARKPAYILHVDFGAEIGVKKSSAQVTHLYQPETLLGRLVVAVVNFPKKQIGPLQSECLVTGFHNAQGEVALCVPDRDVPLGTKLL

SEQ ID NO: 25011 - DNA, 342 bp, Bordetella bronchiseptica
  CDS (1)..(342)
atgcaactcatagactggacggatttcgccaaggtcgaactgcgggtcggccgcatcgtgcaggccttgccgtttcccgaggcccgcaagccggcctcctatatcctgcacgtggacttcggcgccgagatcggcgtgaagaagtccagcgcgcaggtcacgcacctctatcagcccgagacgctgctgggcagactggtggtcgccgtggtcaattttccgaagaagcagatcggcccgctgcagtcggaatgcctggtcaccggcttccataacgcgcagggcgaagtcgcgctgtgcgtgcccgaccgcgacgtcccgctgggcaccaagctgctctag

SEQ ID NO: 25012 - protein, 113 aa, Bordetella bronchiseptica
MQLIDWTDFAKVELRVGRIVQALPFPEARKPASYILHVDFGAEIGVKKSSAQVTHLYQPETLLGRLVVAVVNFPKKQIGPLQSECLVTGFHNAQGEVALCVPDRDVPLGTKLL

SEQ ID NO: 25013 - DNA, 2079 bp, Bordetella bronchiseptica
  CDS (1)..(2079)
atgtcacgcacgctcttcgtcaccactgccctgccctacgccaacggatcgttccacatcggccacatcatggagtacatccaggccgacatctgggtccgttcgatgcgcatggcgggccacacggtgcatttcgtgggtgccgacgacgcgcacggcgcgccgatcatgctcaaggccgaaaaggaaggcatcacgccgcaggcgctggtggcccgctacgccgccgagcggccgcgctacctggacggcttccatatccgcttcgaccactggcacagcaccgatacgcccgagaacgtggcgctctcgcaggaaatctatcgcgcgctcaagagcgagggactgatcgagacgcgctcgatcgagcagttctacgacccggtcaagggcatgttcctggccgaccgctacatcaagggcgaatgcccgcgctgccacgccaaggaccagtacggcgattcgtgtgaagtgtgcggcgccgtgtatgcgcccaccgagctgatcaacccctattcggccctgaccggcgccgcgccggtactgaagtcgtccgatcacttcttcttcaagctgtccgatccgcgctgcgtcgagttcctgcagcaatggaccaccggcgccaaccgccagggcgtcaagcacctgcaggccgaagtgcaggccaagacgcgcgaatggctgggcggcgacgacggcgaggccaagctgggcgactgggatatctcgcgcgacgccccctatttcggcatcgagattcccgacgcgccgggcaagtatttctatgtctggctggacgcgccggtgggctacctggcctcgctgaaatcctattgcgcggtcaagggcctggacttcgacgcgctgctcgacccggccggcccgaccgagcaggtgcacttcatcggcaaggacatcatttacttccacgcgctgttctggccggcgatgctgaagttcgccgggcgcaagacgcccgaccagctgaatgtgcacggtttcatcaccgtcagcggcgagaagatgtccaagagccgcggcaccggcatctcgccgctgcgctacctggaaatcggcatggacgccgaatggctgcgctactacatggcggccaagctgaacgcgcgcgtcgaggacatggacttcaaccccgaagacttcgtggcgcgcgtcaacagcgacctggtgggcaagtacgtcaacatcgccagccgcgccgccgccttcattacccgccacttcgacggcgaactggcgtacgacggcgacacggacgcgctggcggccgagttcgcgcagcaggccgaatcgatccgcgccgccttcgaggcgcgcgagtacaaccgcgcggtgcgcgaaatcatggcccatgccgaccgcatcaaccaggcgttcgacgcggcgcagccctgggtgatggccaagggcatcggcgccgccgacgcggccacgcgcgcccgcctgcaggacatctgctcgcgcgcgctggccggcttcaaggccctgtcggtgatgctggcgccggtgctgcccgcgctggccagccgcgtggcgcgcgagctgttcggcgcgaacgccgacttcgcctggggcgacgcgcaacagctgccgcagcgggtggcgccgttcaagcacctgatgcagcgcgtcgatcccaagctgctggacgacctgttcgagccgcccgccgccgaagccagcgcgccggccgccctgccgggcggcgaggccctggccgacaccatcaccatcgacgacttcgccaagatcgacctgcgcatcgcgcgcatcgtcaattgcgaagaagtggaaggctcgaccaagctgctgcgcctgaccctggacgtgggcgagggacgccatcgcaatgtgttctcgggcatcaagtcggcctaccagccgcaggacctggtcggcaagctgacggtgctggtggccaacctggcgccgcgcaagatgaagttcggcgtgtccgagggcatggtgctggccgccagccacgccgacgagaaggccgaacccgggatctacgtgctcgaaccctggccgggcgcccagcccggcatgcgggtgcgctga

SEQ ID NO: 25014 - protein, 692 aa, Bordetella bronchiseptica
MSRTLFVTTALPYANGSFHIGHIMEYIQADIWVRSMRMAGHTVHFVGADDAHGAPIMLKAEKEGITPQALVARYAAERPRYLDGFHIRFDHWHSTDTPENVALSQEIYRALKSEGLIETRSIEQFYDPVKGMFLADRYIKGECPRCHAKDQYGDSCEVCGAVYAPTELINPYSALTGAAPVLKSSDHFFFKLSDPRCVEFLQQWTTGANRQGVKHLQAEVQAKTREWLGGDDGEAKLGDWDISRDAPYFGIEIPDAPGKYFYVWLDAPVGYLASLKSYCAVKGLDFDALLDPAGPTEQVHFIGKDIIYFHALFWPAMLKFAGRKTPDQLNVHGFITVSGEKMSKSRGTGISPLRYLEIGMDAEWLRYYMAAKLNARVEDMDFNPEDFVARVNSDLVGKYVNIASRAAAFITRHFDGELAYDGDTDALAAEFAQQAESIRAAFEAREYNRAVREIMAHADRINQAFDAAQPWVMAKGIGAADAATRARLQDICSRALAGFKALSVMLAPVLPALASRVARELFGANADFAWGDAQQLPQRVAPFKHLMQRVDPKLLDDLFEPPAAEASAPAALPGGEALADTITIDDFAKIDLRIARIVNCEEVEGSTKLLRLTLDVGEGRHRNVFSGIKSAYQPQDLVGKLTVLVANLAPRKMKFGVSEGMVLAASHADEKAEPGIYVLEPWPGAQPGMRVR

SEQ ID NO: 25015 - DNA, 759 bp, Oryza sativa
  CDS (1)..(759)
atggcgttcgcctcatgcggccgcctcctcgccccctcctcgtcttcatccctccccgccctgccaagaacccggggcagcgtcgccgccagcggcaagcatcccgtctcgttcttggcggcggcgagatccgcctccgtcctctgctactgctccgacgccaccgtcgcgccggccccgcaggcggcggccgcggagggggaaggggaggagggggagaagaaggcggaggttccccccgtggaggaggtggcggcgctgctggacatccgggtggggcgggtggtgaaggcgtggcggcacccggaggcggacacgctgtacgtggaggaggtcgacgtcggcgaggagcagccgcgcaccatctgcagcggcctcgtcaactacctccccatcgaccagctccaggacagcaatgtgattgttcttgcgaacctcaaaccgaggaacatgcgggggataaagtcaaacggcatgcttatggctgcatctgatgcttctcatgaaaatgtcgaattgcttacccctcctgaaggatctgttccaggtgaaagggtatggtttggtactgaagatggaaaggatcgccaatcagaagctgcttcaccaaatcaggttcaaaaaaagaagatttgggaatcagttcagcctcatcttaggacatcagaaaactgcacagcatttcttggcgagcacccgatgcgtacctcagcgggtgtggttttctgcaaaactttgcagggtgcaagagtgtcataa

SEQ ID NO: 25016 - protein, 252 aa, Oryza sativa
MAFASCGRLLAPSSSSSLPALPRTRGSVAASGKHPVSFLAAARSASVLCYCSDATVAPAPQAAAAEGEGEEGEKKAEVPPVEEVAALLDIRVGRVVKAWRHPEADTLYVEEVDVGEEQPRTICSGLVNYLPIDQLQDSNVIVLANLKPRNMRGIKSNGMLMAASDASHENVELLTPPEGSVPGERVWFGTEDGKDRQSEAASPNQVQKKKIWESVQPHLRTSENCTAFLGEHPMRTSAGVVFCKTLQGARVS

SEQ ID NO: 25017 - DNA, 2053 bp, Xenopus laevis
  CDS (259)..(1845)
ctagccgctaccgctaccgataactattgggccatcattagttcctttaagatcgattcgctctcgctccttcgctgtactgatctaagcagcgggcaatgcactcgcagccatagctgtagattgccgagcacattgagtggaatgtttctggcttctgactgacgcaatcagtggcaacaaggaagcaaatctactgcagcaacacgtgtaccggatttgtctctgtgatttaatacacatatccagcaaggcaaaatgggtgacagcttaacacttgaagggaaggcacagctcatcacacggaatcttcaggagctccttggagaggacaaaatgaaggaaatcctgaaagagagacctctgcggatatactggggcacagcaaccacaggaaaaccacatgtggcttattttgttcctatgtccaagatcgcagacttcctgaaggctggttgtgaggtgaccatcctgtttgcagacctgcatgcatatttagataatatgaaagcaccttgggatctgctggagctcagaacaagatactatgagcaagtcatccaggctatgctacagagcatcggagtcccgcttgagaggttacgctttattcggggaacagaatttcagctcagcaaagagtacactctggatgtatacagactgtcttctgtagttactcagcatgatgctaagaaagctggagctgaggtagtaaaacaagtggaacacccgctgctcagtgggcttctgtacccagggttgcaggctctggatgaggaatacttgaaggtagacgcccagtttggaggagttgaccaaaggaaaatcttcacatttgcagaaaagtaccttccggctcttggttatgcaaaacgtattcaccttatgaatcctatggtgccaggactcacaggggctaaaatgagctcctctgaggaggaatccaaaattgatctcctggactctcctgcagatgtgaaaaaaaagttaaagaaggcgttctgtgagcctgggaatgtagaaaacaatggggttttaagctttgtcagacatgtcctctttcctctaaaatcggaatttgtggttcttcgggatgagaaatttggaggaaataaaacttacactgattttgaaacactggaaaaagactttgctgaagagctggttcatcccggtgatctgaaggcctcagttgagaaagctctgaataagctattgcaccctatcagagaaaagtttaatagccctgaaatgaagaaattgagtaatgatgcataccctgatgccagcaaacagaagtctgtgcctaaaggatctactaaaaactctggaactgaggagatcgatccttctcttctagatttgcgagttgggaagattctcagtgtgagccagcacccagatgcagacagcctgtatgtggagtcagtggatgtaggtgaggcgaatccacgctgtgtagtcagcgggctggtgcaatatgttccttctgaccaactgctgggccgctcagtggttttgctgtgcaacttaaagccacagaagatgagaggaatcgagtcacagggcatgctgctttgcgcatccacggaaggggaacaaaaacaagtggaaccacttgaccctccttcaggttctgctcctggtgagcgcatctatattgagggatatgagaatggagagccagagggagagctcaaacctaagaagaaagtatttgagaagttgcaggttgacttcaggatttcagatgatttatgcgctcaatggaaagggaagaattttctgaccaaactggggtctgtaacctgtaaaactctgcgaggcggtagcattggttgagcatgttttttttttttatcatgctccgattcatcttcactaccaaaacagaatcacattgctggatcccagacaacaaggggtttatcgtcccactatttatataatcttcggttgcacgtgacctgctctagggtcaacgtagaggtgaaaaaattgtaattctggtatgaaataaagttgtataccatcaaaaaaaaaaaaaaaa

SEQ ID NO: 25018 - protein, 528 aa, Xenopus laevis
MGDSLTLEGKAQLITRNLQELLGEDKMKEILKERPLRIYWGTATTGKPHVAYFVPMSKIADFLKAGCEVTILFADLHAYLDNMKAPWDLLELRTRYYEQVIQAMLQSIGVPLERLRFIRGTEFQLSKEYTLDVYRLSSVVTQHDAKKAGAEVVKQVEHPLLSGLLYPGLQALDEEYLKVDAQFGGVDQRKIFTFAEKYLPALGYAKRIHLMNPMVPGLTGAKMSSSEEESKIDLLDSPADVKKKLKKAFCEPGNVENNGVLSFVRHVLFPLKSEFVVLRDEKFGGNKTYTDFETLEKDFAEELVHPGDLKASVEKALNKLLHPIREKFNSPEMKKLSNDAYPDASKQKSVPKGSTKNSGTEEIDPSLLDLRVGKILSVSQHPDADSLYVESVDVGEANPRCVVSGLVQYVPSDQLLGRSVVLLCNLKPQKMRGIESQGMLLCASTEGEQKQVEPLDPPSGSAPGERIYIEGYENGEPEGELKPKKKVFEKLQVDFRISDDLCAQWKGKNFLTKLGSVTCKTLRGGSIG

SEQ ID NO: 25019 - DNA, 2121 bp, Nitrosomonas europaea
  CDS (1)..(2121)
atgactatacgcaatatcctggtaacttccgcattgccttatgccaatggcagcattcatctcggacatctggttgagtatatccagaccgatatctgggtgcgtttccagaaaatgcaggggcataccgtctattatgtttgtgcggatgatactcacggcacgcccgtcatgctgcgtgccgaaaaggaaggaatttcgcctgaagcgctgattgcacgcgttcatgcggaacatctgcgtgattttaccggctttcatattgctttcgaccagtattacagtacgcattccgatgagacacgctactatgccgaggatatttaccgcaaattgaaagaagcgggactgattgccgtgcgtgcaatcgaacagctttatgatccgatcaaaaacctgtttctgccggatcgttttgtcaaaggtgaatgtcccaaatgtggtgcagccgaacaatacggagattcctgcgaggcttgtggtgcggcctatacgccgaccgaactgaagaatccctattctgccgtttccggtgcaactcccgtcagaaaaacttcagagcatttcttcttcaaattgtccgatagccgctgtgcggattttctgcgtcgctggacgcatgaagggaatcacctgcaggcagaagcagccaacaaaatggcggaatggctgggtgaagcaggagagaacaaactttccgactgggatatttcgcgtgatgctccttatttcggcttcgaaatccccggtgaaaccggcaagtatttttacgtctggctggatgcgcccattggttacatgggcagcttcaaaaaactctgtgcccggaagggaattgatttcgacgcgtactggaaaaaggattccacaaccgagctttatcatttcatcggtaaggatattctttatttccatgcacttttctggccagcgatgctggagaacgcgggctaccggacacccacacagatttttgctcacggttttctgactgtgaacggtgaaaaaatgagtaaatcacgcggtacgttcattaccgcggaaagctatctggaacaggggctgaacccggaatggctgcgctactactatgccgccaagctgaatggcagtatggaagatatcgacctcaacctggatgatttcgtcgcgcgcgtcaattctgatctggtgggcaaatacatcaacatcgccagccggtgtgcgggattcatcagcaagcggtttggcggcaagctggtgagtggtgaggattaccgtctgctgcagcaaatggtggatgaacattttgccggctggcagccgggggtgatcgaggctgcttatgaagcacgtgatttttctgcagcagtacgccatatcatgcgacgcgcagatgaagtcaatgagctgattcatgagctcgccccctgggagattgccagagatgaaacgcgggagcgggagctgcaccgtgcctgcagcttgggcatccagatgttttatctgctttcctgttatctgaagccgatcctgccgcgcactgccgcacaaattgaggatttcctcaatctgggtgaattgagctggcagaagcagcaggccgggcaacctttatccgatacactgctgccgcccggccatgtgatcaacccctatcagcacctcatgacccgtatcgatccaaagcagattactgcactgattacggccaatcaacaaaccatgcagcaaacgatgaatacagaaactgaatcacactccccgcaacgacatggtcaggcgcaacagcatcccgttgctccgattgcggaaaccatttcaatcgaagatttcgtcaaaatcgatctgcgcattgcccgtattgtggatgcgcaacatgtcccgggtgctgacaaattgctgcaactgacactggatatcggctctgaacagcgtactgtcttcgccggcatcaaatctgcttatgatccggaacagctcaaagggcgtctgacggtcatggtcgccaatcttgctccacgcaaaatgaaattcggattatccgaaggcatggtgctggctgcaagtggtgaaaacggaggagggcctttcctgctcgccccggatagcggtgcacaaccgggtatgcgagtgaaatag

SEQ ID NO: 25020 - protein, 706 aa, Nitrosomonas europaea
MTIRNILVTSALPYANGSIHLGHLVEYIQTDIWVRFQKMQGHTVYYVCADDTHGTPVMLRAEKEGISPEALIARVHAEHLRDFTGFHIAFDQYYSTHSDETRYYAEDIYRKLKEAGLIAVRAIEQLYDPIKNLFLPDRFVKGECPKCGAAEQYGDSCEACGAAYTPTELKNPYSAVSGATPVRKTSEHFFFKLSDSRCADFLRRWTHEGNHLQAEAANKMAEWLGEAGENKLSDWDISRDAPYFGFEIPGETGKYFYVWLDAPIGYMGSFKKLCARKGIDFDAYWKKDSTTELYHFIGKDILYFHALFWPAMLENAGYRTPTQIFAHGFLTVNGEKMSKSRGTFITAESYLEQGLNPEWLRYYYAAKLNGSMEDIDLNLDDFVARVNSDLVGKYINIASRCAGFISKRFGGKLVSGEDYRLLQQMVDEHFAGWQPGVIEAAYEARDFSAAVRHIMRRADEVNELIHELAPWEIARDETRERELHRACSLGIQMFYLLSCYLKPILPRTAAQIEDFLNLGELSWQKQQAGQPLSDTLLPPGHVINPYQHLMTRIDPKQITALITANQQTMQQTMNTETESHSPQRHGQAQQHPVAPIAETISIEDFVKIDLRIARIVDAQHVPGADKLLQLTLDIGSEQRTVFAGIKSAYDPEQLKGRLTVMVANLAPRKMKFGLSEGMVLAASGENGGGPFLLAPDSGAQPGMRVK

SEQ ID NO: 25021 - DNA, 2043 bp, Shigella flexneri
  CDS (1)..(2043)
atgcctactatgactcaagtcgcgaagaaaattctggtgacgtgcgcactgccgtacgctaacggctcaatccacctcggccatatgctggagcacatccaggctgatgtctgggtccgttaccagcgaatgcgcggccacgaggtcaacttcatctgcgccgacgatgcccacggtacaccgatcatgctgaaagctcagcagctcggtatcaccccggagcagatgattggcgaaatgagtcaggagcatcagactgatttcgcaggctttaacatcagctatgacaactatcactcgacgcacagcgaagagaaccgccagttgtcagaacttatctactctcgcctgaaagaaaacggttttattaaaaaccgcaccatctctcagctgtacgatccggaaaaaggcatgttcctgccggaccgttttgtgaaaggcacctgcccgaaatgtaaatccccggatcaatacggcgataactgcgaagtctgcggcgcgacctacagcccgactgaattgatcgagccgaaatcggtggtttctggtgctacaccagtgatgcgtgattctgaacacttcttctttgatctgccctctttcagcgaaatgctgcaggcatggacccgcagcggtgcgttgcaggagcaggtggcaaacaaaatgcaggagtggtttgaatccggcctgcaacagtgggatatctcccgcgacgcgccatactttggttttgaaattccgaacgcaccgggcaaatatttctacgtctggctggacgcaccgattggctacatgggttctttcaagaatctgtgcgacaagcgcggcgacagcgtaagcttcgatgaatactggaagaaagactccaccgccgagctgtaccacttcatcggtaaagatatcgtttacttccacagcctgttctggcctgccatgctggaaggcagcaacttccgcaagccgaccaacctgtttgttcatggctatgtgacggtgaacggcgcgaagatgtccaagtctcgcggcacctttattaaagccagcacctggctgaatcattttgacgctgacagcctgcgttactactacactgcgaaactctcttcgcgcattgatgatatcgatctcaacctggaagatttcgttcagcgtgtgaatgccgatatcgtgaacaaagtggttaacctggcctcccgtaatgcgggctttatcaacaagcgttttgacggtgtgctggcaagcgagctggctgaccctgagctgtacaaaacctttaccgatgccgctgaagtgattggtgaagcgtgggaaagccgtgaatttggtaaagcagtgcgcgaaatcatggcactggctgacctggctaaccgctatgtcgacgagcaggctccgtgggtagtcgcaaaacaggaaggtcgcgatgctgacctgcaggcgatttgctcaatgggcatcaacctgttccgcgtgctgatgacttacctgaagcctgtactgccgaaactgaccgagcgtgcagaagccttcctcaatacggaactgacctgggatggtatccagcaaccgctgctgggccacaaagtgaatccgttcaaggcgctgtataaccgcatcgatatgaaacaggttgaagctctggtggaagcctctaaagaagaagtgaaagccactaccgcgccagttactggcccactggcagatgatccgattcaggaaaccatcacctttgacgacttcgccaaagttgacctgcgcgtggcgctgatcgaaaacgcagagtttgttgaaggttctgacaaactgctgcgcctgacgctggatctcggcggtgaaaaacgcaatgtcttctccggtattcgttctgcttacccggatccgcaggcactgattggtcgtcacaccattatggtggctaacctggcaccacgtaaaatgcgcttcggtatctctgaaggcatggtgatggctgccggtcctggcgggaaagatattttcctgctaagcccggatgccggtgctaaaccgggtcatcaggtgaaataa

SEQ ID NO: 25022 - protein, 680 aa, Shigella flexneri
MPTMTQVAKKILVTCALPYANGSIHLGHMLEHIQADVWVRYQRMRGHEVNFICADDAHGTPIMLKAQQLGITPEQMIGEMSQEHQTDFAGFNISYDNYHSTHSEENRQLSELIYSRLKENGFIKNRTISQLYDPEKGMFLPDRFVKGTCPKCKSPDQYGDNCEVCGATYSPTELIEPKSVVSGATPVMRDSEHFFFDLPSFSEMLQAWTRSGALQEQVANKMQEWFESGLQQWDISRDAPYFGFEIPNAPGKYFYVWLDAPIGYMGSFKNLCDKRGDSVSFDEYWKKDSTAELYHFIGKDIVYFHSLFWPAMLEGSNFRKPTNLFVHGYVTVNGAKMSKSRGTFIKASTWLNHFDADSLRYYYTAKLSSRIDDIDLNLEDFVQRVNADIVNKVVNLASRNAGFINKRFDGVLASELADPELYKTFTDAAEVIGEAWESREFGKAVREIMALADLANRYVDEQAPWVVAKQEGRDADLQAICSMGINLFRVLMTYLKPVLPKLTERAEAFLNTELTWDGIQQPLLGHKVNPFKALYNRIDMKQVEALVEASKEEVKATTAPVTGPLADDPIQETITFDDFAKVDLRVALIENAEFVEGSDKLLRLTLDLGGEKRNVFSGIRSAYPDPQALIGRHTIMVANLAPRKMRFGISEGMVMAAGPGGKDIFLLSPDAGAKPGHQVK

SEQ ID NO: 25023 - DNA, 333 bp, Vibrio vulnificus
  CDS (1)..(333)
atggaaacgatcgcttacgctgatttcgccaagctggaaattcgtactgggaaaattattgaagttgcccgtcatgcgaatgcagacaaactctatatcgtacaaattgatgtcggcgagaaaacgctgcaaaccgtcactagcctagtgccgtactacagcgaagaagagctgatgggcaaacaagtggtggtgttgtgcaaccttgccaaagcgaaaatgcgtggagaaacctcagagtgcatgttgttgtgcgcagaaacggacgatgaaagcgaaagtgttctcttaacgccagaaagagcgatgccgacgggtgtgagaattgtttag

SEQ ID NO: 25024 - protein, 110 aa, Vibrio vulnificus
METIAYADFAKLEIRTGKIIEVARHANADKLYIVQIDVGEKTLQTVTSLVPYYSEEELMGKQVVVLCNLAKAKMRGETSECMLLCAETDDESESVLLTPERAMPTGVRIV

SEQ ID NO: 25025 - DNA, 333 bp, Vibrio parahaemolyticus
  CDS (1)..(333)
atggaaactatcgcttactctgattttgccaaactggaaattcgtaccggaaaaatcattgaagtggctcgtcatcacaatgcagacaagctgtatattgtgcagattgatattggtgaaaaaacactgcaaaccgtaaccagtttagtgccttattacaccgaggaagagttgatgggcaaacaagtggtcgtgttgtgtaatcttgccaaagccaaaatgcgcggtgaaacctctgaatgtatgttgttatgcgcagaaacggatgatgaatccgaaagtgtgttgctaacgccagaaagagcgatgccgaccggggtgagaattgtttaa

SEQ ID NO: 25026 - protein, 110 aa, Vibrio parahaemolyticus
METIAYSDFAKLEIRTGKIIEVARHHNADKLYIVQIDIGEKTLQTVTSLVPYYTEEELMGKQVVVLCNLAKAKMRGETSECMLLCAETDDESESVLLTPERAMPTGVRIV

SEQ ID NO: 25027 - DNA, 2040 bp, Bacteroides thetaiotaomicron
  CDS (1)..(2040)
atggaaaagaaattcaagagaaccaccgtcacatcggcactgccgtatgcgaacggacctgtacacatcggtcacctggccggcgtatatgtaccggcagatatctatgtgcgctatctgcgactgaagaaagaagatgtattgtttatcggaggttcggacgaacacggagtacctatcacgattcgtgcaaagaaagaaggagtcactccgcaggatgtagtagaccgttaccactatctgatcaagaaatcgttcgaagaattcggcgtttcgttcgatgtatacagccgcaccacttcgaagacgcatcatgagctggcttcggatttctttaagacgctatacaacaaaggagagtttatcgaaaaaacatccgaacaatattacgacgaagaagcgaaaacattcctcgccgaccgctacatcaccggtgagtgtcctcactgccattcggaaggtgcctatggcgaccaatgcgagaaatgcggaacctccctgtcgcccaccgatctgatcaacccgaagagcgccatcagcggcagcaaacctgtgatgaaggagaccaagcactggtatcttcccctcgacaaacacgaaggatggttgcgccaatggattctggaagaccacaaggaatggcgccccaacgtatacggacagtgcaagagctggctcgacatgggattgcagccgcgtgccgtcagccgtgacctcgactggggtatccctgtgcccgtagaaggtgcggaaggaaaggtgctgtacgtgtggttcgatgctcctatcggatacatttccaataccaaggaattgcttcccgacagttgggagacatggtggaaagaccccgaaacgcgtctgctccacttcatcggaaaggacaatatcgtattccactgcatcgtattccccgccatgctgaaagcggaaggaagctatatcctgccggacaacgtgccgagcaacgaattcctgaatctggaaggagacaagatttcgacttcccgcaactgggcggtatggctgcacgaatatctggaagacttccccggcaaacaggacgtactccgctacgtactgaccgccaatgctccggaaacgaaggacaacgacttcacatggaaagacttccaggcacgcaacaacaatgagctggtagccgtatacggcaacttcgtgaaccgtgcaatggtgttgactcagaaatacttcgacagcaaagtacccgcctgcgcagaactgacggattacgacaaagaaaccctgaaagaatttgccaacgtaaaggcagaagtagaaaagctgctcgacgtattcaaattccgcgacgcgcagaaagaggcgatgaacctggcacgcatcggcaacaaataccttgccgacaccgaaccctggaaactggcaaagaccgacatggaacgtgtaggcaccatcctgaacatctctctgcaactggttgccaaccttgccatcgctttcgaaccgttcctgcctttcagctcggagaaactccgcaagatgctgaacatggaaagcttcgaatggtcggaactgggaaggaacgacctgctcccggtaggacatcagctgaacaagccggaactgctgttcgaaaaaatagaagacagcgtaatcgaggcacaggtacagaagttgctcgacacgaagaaggccaacgaagaagccaactataaggcaaacccgattcgtccgaacatcgaatttgatgatttcacgaaactcgacatccgtgttggtaccatccttgaatgtcagaaagtgccgaaagccgacaagctgctgcaattcaagattgacgacggactggaaacacgtactatcgtatcgggcatcgcaaagcactaccagccggaagaactggtaggcaaacaggtttgctttatcgccaatctcgcaccgcgcaagctgaaaggtatcgtcagcgaaggtatgattctgagtgccgaaaacaacgacggtagcctggcagttatcatgcctcagaaagaggtgaagccgggcagcgaagtgaaataa

SEQ ID NO: 25028 - protein, 679 aa, Bacteroides thetaiotaomicron
MEKKFKRTTVTSALPYANGPVHIGHLAGVYVPADIYVRYLRLKKEDVLFIGGSDEHGVPITIRAKKEGVTPQDVVDRYHYLIKKSFEEFGVSFDVYSRTTSKTHHELASDFFKTLYNKGEFIEKTSEQYYDEEAKTFLADRYITGECPHCHSEGAYGDQCEKCGTSLSPTDLINPKSAISGSKPVMKETKHWYLPLDKHEGWLRQWILEDHKEWRPNVYGQCKSWLDMGLQPRAVSRDLDWGIPVPVEGAEGKVLYVWFDAPIGYISNTKELLPDSWETWWKDPETRLLHFIGKDNIVFHCIVFPAMLKAEGSYILPDNVPSNEFLNLEGDKISTSRNWAVWLHEYLEDFPGKQDVLRYVLTANAPETKDNDFTWKDFQARNNNELVAVYGNFVNRAMVLTQKYFDSKVPACAELTDYDKETLKEFANVKAEVEKLLDVFKFRDAQKEAMNLARIGNKYLADTEPWKLAKTDMERVGTILNISLQLVANLAIAFEPFLPFSSEKLRKMLNMESFEWSELGRNDLLPVGHQLNKPELLFEKIEDSVIEAQVQKLLDTKKANEEANYKANPIRPNIEFDDFTKLDIRVGTILECQKVPKADKLLQFKIDDGLETRTIVSGIAKHYQPEELVGKQVCFIANLAPRKLKGIVSEGMILSAENNDGSLAVIMPQKEVKPGSEVK

SEQ ID NO: 25029 - DNA, 1983 bp, Vibrio vulnificus
  CDS (1)..(1983)
atgcttgagcatatccaagcggacatttgggttcgttaccaacgcctacgcggcaacattgtaaacttcatctgtgctgacgacgctcacggcacgccaattatgcttaaagcgcaacagatgggtatgtctccagaagagatgattgctgcggtgagcatcgagcaccaaaaagatttcgctggctttgatattagtttcgataactatcacagcacgcattccgatgagaaccgtgagctggcgtctcacatttatctgcaactgaaaaaaaatggctttatttcaagccgtactatttctcagttgttcgaccctgaaaaagagatgttcctacccgatcgtttcgtgaagggaacgtgtccgaagtgtaagtctgaagatcaatacggcgacaactgcgatgcttgtggcgaaacctacagcccaacagaattgatcaatccaaaatctgccgtctcaggcgcaacgccagtgatgaaagattcagagcacttcttcttcgacctgcctcagtttgaaagcatgctaaaagagtggactcgctctggctctctgcaaactgaaaccgcaaataaaatgcaagaatggtttgagtctggtctgcagcagtgggatatctcacgtgatgcaccttacttcggttttgaaattccaggcgaaaaagacaagtttttctacgtttggctagatgcgccaatcggctacatgggttcattcaaaaacctatgtgataagcgtgatgatcttgattttgatgaatactggaataaagacagtaaaacagaactttaccacttcatcggtaaagacatcgtttacttccacagcctgttctggccagcaatgctagacggctctggcttccgtaagccaaacaacgtttttgttcacggctacgtaaccgtaaatggtgcgaagatgtcgaagtctaaaggtacattcgtgaaagcgagcacttaccttgagcaccttgatccagagtgtctgcgttactactacgcagcgaagctaaacagccgcattgatgacctagaccttaaccttgaagactttactcagcgcgtaaacgctgacgtcgtaaacaagattgttaacctagcatcgcgtaatgcgggcttcattgcgaaacgctttgaaggcaagctcgctgaaaacttcgtcgagccagagctttacaacgaatttgttgccgcagcagaccgtattgctgaactttacgaagcgcgtgagttcggtcgtgcgatccgtgaactcaccgcgttggcggacaaagctaaccaatacgttgatgaaaaagcgccttgggttgtggcaaaacaagaaggcaaagatcaggaacttcaggaaatctgttctgttggtattaacctgttccgcgttctaatgacttacttgaagccagttatgcctgctcttgcagctcgcactgaagccttcttgaatgaagagctaacctgggaaggtgttgctcagccattaacagcacacgaaattactgcgtttaaagcgctattcaatcgtatcgatccgaaaaacatcgaagccatgattgaagcatcaaaagaagatgcggcggctgaaatggcggcaaaagagaaagcagaagcctctaatgcagctcaagagaccgagctaagcaaagatcccattgccgaagaaattgagtttgatgacttcgcgaaagtggaccttcgtattgccaaaatcgtttcttgtgaatcggtgccaaaagctgacaaactgttgaaattccaattggatatcggcggtgaaatgcgtcaagtcttctctggtatcaaagcggcgtacaatcctgaagatcttgtcggcaagtacacagtggttgtggcaaacttgaaaccacgtaagatgaagtttggtatgtctgagggcatgatcctagcggcaggccctggtggcaaagatctttggatccttgaaccacatgaaggcgcgcagccaggcatgcgcgtgatgtaa

SEQ ID NO: 25030 - protein, 660 aa, Vibrio vulnificus
MLEHIQADIWVRYQRLRGNIVNFICADDAHGTPIMLKAQQMGMSPEEMIAAVSIEHQKDFAGFDISFDNYHSTHSDENRELASHIYLQLKKNGFISSRTISQLFDPEKEMFLPDRFVKGTCPKCKSEDQYGDNCDACGETYSPTELINPKSAVSGATPVMKDSEHFFFDLPQFESMLKEWTRSGSLQTETANKMQEWFESGLQQWDISRDAPYFGFEIPGEKDKFFYVWLDAPIGYMGSFKNLCDKRDDLDFDEYWNKDSKTELYHFIGKDIVYFHSLFWPAMLDGSGFRKPNNVFVHGYVTVNGAKMSKSKGTFVKASTYLEHLDPECLRYYYAAKLNSRIDDLDLNLEDFTQRVNADVVNKIVNLASRNAGFIAKRFEGKLAENFVEPELYNEFVAAADRIAELYEAREFGRAIRELTALADKANQYVDEKAPWVVAKQEGKDQELQEICSVGINLFRVLMTYLKPVMPALAARTEAFLNEELTWEGVAQPLTAHEITAFKALFNRIDPKNIEAMIEASKEDAAAEMAAKEKAEASNAAQETELSKDPIAEEIEFDDFAKVDLRIAKIVSCESVPKADKLLKFQLDIGGEMRQVFSGIKAAYNPEDLVGKYTVVVANLKPRKMKFGMSEGMILAAGPGGKDLWILEPHEGAQPGMRVM

SEQ ID NO: 25031 - DNA, 333 bp, Vibrio vulnificus
  CDS (1)..(333)
atggaaacgatcgcttacgctgatttcgccaagctggaaattcgtactgggaaaattattgaagtcgcccgtcatgcgaatgcagacaaactctatatcgtacaaattgatgttggtgagaaaacgctgcaaaccgtcactagcctcgtgccgtactacagcgaagaagagctgatgggcaaacaagtggtggtgttgtgcaaccttgccaaagcgaaaatgcgtggagaaacctcagaatgcatgttgttgtgcgcagaaacggacgatgaaagcgaaagtgttctcttaacgccagaaagagcgatgccgacgggtgtgagggttgtttaa

SEQ ID NO: 25032 - protein, 110 aa, Vibrio vulnificus
METIAYADFAKLEIRTGKIIEVARHANADKLYIVQIDVGEKTLQTVTSLVPYYSEEELMGKQVVVLCNLAKAKMRGETSECMLLCAETDDESESVLLTPERAMPTGVRVV

SEQ ID NO: 25033 - DNA, 2010 bp, Streptococcus mutans
  CDS (1)..(2010)
atgactgaaaaacaaccattttacattacgacaccgatttattacccgtctgggaaactccatattggctctgcctatacaaccattgcttgtgatgtcttggctcgctataagcgtatgatgaatcatgacgttttttatttgactggacttgatgagcacggtcaaaagattcagcaaaagtctgaagaagctggtatcacaccgcaggcgtatgtggacggtatggcggttggtgttaaggaattgtggaagctccttgacatctcttatgataagtttatccgcacgacagatgattaccatgaaaaagttgtggctgatgtttttgaaaaattgctagcgcagggagatatttacttgggtgaatactcaggttggtattctgtttctgacgaggaatttttcactgaaagccaattagaggaaatcttccgtgatgaagacggtaaagttatcggtgggattgcaccatcaggtcacgaagtggaatgggtttcagaagaatcctatttcctccgtctcagtaactatgctgatcgtctagtagattttttccatgctcatcctgattttatccagccagatggtcgtatgaatgaaatcatcaagaactttattgagcccggtttagaagatttagcagtttcgcgtacctcatttacttggggcgttaaagtaccttcaaatcctaagcacgtggtttacgtatggattgatgcccttctcaactatgcaacagctcttggttacggtcaagatgcccatgccaactttgataaattctggaatggtacagtcttccacatggttggcaaagacattctgcgcttccactctatttattggccaatcctgctcatgatgcttgatttaaagatgccagaacgtctgattgctcatggttggtttgtcatgaaagatggtaagatgtccaagtctaaaggaaatgtcgtttacccagaaatgttggttgaacgctacggacttgatccgcttcgctattatctcatgcgtagtcttccagtcggttctgatggcacttttacgccagaagattatgttggtcgtatcaactatgaacttgccaatgaccttggtaatctcctcaaccgtaccgttgccatgattaacaagtattttggtggtgagattcctgcttatgtggaaaatgtgacggattttgatgctgatttggcagcagtagttgctgataatttggcacaataccacaaacaaatgaatgctgtggattatccacgcgcccttgaaacggtttggaacatcatttcgcgtaccaacaagtacattgacgaaactactccttgggtattggctaaggataaagctaaacgtgatgatttagcagcggttatggcacatttggcagccagcctgcgcgtggtggctcacctcattcagccatttatgatgaccacatcaaatgccatcatggaacagcttggtttggccggtcaatttgatttagaaggtcttgaacttgcaggacttccgacgggtgtcaaagtgattgccaaaggcacgccaatcttcccgcgtcttgatatggatgaagaaattgcttacatcaaagaacaaatgggtgacaactctgcgattgcccaagaggaagaaaaagaatggaacccaacaacagttgagctcaaaaacgagaagaaggctattaaatttgacgattttgacaagttggaaatccgtgtggctgaggtcaaggaagtgtctaaagtgaagggttctgacaagcttcttaagttccgcttggacgcaggggatggcgaagatcgccaaattctgtctggcatcgccaaatattatccaaatgagctagacttggttggtaaaaaactccaaattgttgccaaccttaaaccacgtaagatgatgggcttggtcagtcaaggtatgattctttcagctgaacatgctgatgggaaacttaccgtattgacggtagattcttcagtaccgaatggtagtcagattgggtag

SEQ ID NO: 25034 - protein, 669 aa, Streptococcus mutans
MTEKQPFYITTPIYYPSGKLHIGSAYTTIACDVLARYKRMMNHDVFYLTGLDEHGQKIQQKSEEAGITPQAYVDGMAVGVKELWKLLDISYDKFIRTTDDYHEKVVADVFEKLLAQGDIYLGEYSGWYSVSDEEFFTESQLEEIFRDEDGKVIGGIAPSGHEVEWVSEESYFLRLSNYADRLVDFFHAHPDFIQPDGRMNEIIKNFIEPGLEDLAVSRTSFTWGVKVPSNPKHVVYVWIDALLNYATALGYGQDAHANFDKFWNGTVFHMVGKDILRFHSIYWPILLMMLDLKMPERLIAHGWFVMKDGKMSKSKGNVVYPEMLVERYGLDPLRYYLMRSLPVGSDGTFTPEDYVGRINYELANDLGNLLNRTVAMINKYFGGEIPAYVENVTDFDADLAAVVADNLAQYHKQMNAVDYPRALETVWNIISRTNKYIDETTPWVLAKDKAKRDDLAAVMAHLAASLRVVAHLIQPFMMTTSNAIMEQLGLAGQFDLEGLELAGLPTGVKVIAKGTPIFPRLDMDEEIAYIKEQMGDNSAIAQEEEKEWNPTTVELKNEKKAIKFDDFDKLEIRVAEVKEVSKVKGSDKLLKFRLDAGDGEDRQILSGIAKYYPNELDLVGKKLQIVANLKPRKMMGLVSQGMILSAEHADGKLTVLTVDSSVPNGSQIG

SEQ ID NO: 25035 - DNA, 1998 bp, Streptococcus agalactiae
  CDS (1)..(1998)
atgacagaaaaaaaatcattttacattactaccccaatttattacccatcaggtaaattgcacatcggttctgcctatacaacgatagcatgtgatgttttggcacgttacaaacgcatgatgggctttgatgttcagtatttgactggtcttgatgagcatggtcagaaaattcaacaaaaggctgaagaagcaggcattacaccacaggaatatgttgatggcatggctgaaagtgtcaaaacattatgggaacttttagatatttcctatgacaaattcatccgtacaacagatacttaccatgaagaagcggttgctaaaatttttgaacaattgttggcacaaggggacatctatcttggtgagtataccggatggtattctgtttcagatgaagaattttttactgaaagccaattagcagaagtttatcgtgacgaaaacggtaatatgattggtggtgttgcgccatctggtcatgaagttgaaaaagtttctgaagaatcttatttcttccgcatgagcaaatatgcagatcgtttaaaagcgtactacgctgagcatccagaatttattcagccagatggtcgtatgaatgaaatgcttaaaaactttatagaaccaggtttagaagatttagcagtgtctcgtacaacttacacatggggagttcaggtaccatcaaatccaaaacatgttatttatgtctggattgatgctttgatgaactatatttctgctcttggttatggttggtctgacgatctcagtcaatatcataaattttggccagcagacattcatatgattggtaaagatattcttcgtttccactctatttattggcctatcatgttgatggcgctggatttgccattaccaaaacgtctagttgctcatggttggtttgtgatgcaagatggtaaaatgtctaaatcaaaagggaatgtcgtttatccagaaatgttagtagagcgttttggtcttgatccactccgttattatctcatgcgttcattgcctgttggttcagacggaacttttacgccagaagattatgttggacgtattaactatgaacttgctaatgatttaggaaaccttctcaaccgcactattgctatggttaacaagtatttcgatggagaagtaccaaggtttgctgttgcaactgactttgatgccgatttagcttctgttgcgacagatagtattgaaaactatcataaacaaatggaagcggtggatttcccacgtgcccttgaagctgtatggaatcttatttcacgaactaacaaatatattgatgaaacagcaccgtgggtacttgcaaaagacgaaacagatcgtgataagttagcagctgtaatgagtcatttagttgctagtctacgtgttgttgctcacctcattcaaccgttcatgatggaaacttccgatgccattatggaacaacttggtttaggggcaacattcgatcttgaaaaattgacttttgctgatctaccagaaggtgttcgagttgttgcaaaaggttcaccaattttcccaaggttggatatggaagacgaaattacttatatcaaagaacaaatgaatgctggaaaagcaccagtggaaaaggagtgggttcctgaagaagttgaattgacatcaagcaaaggtcaaatcaagtttgaggattttgacgctgttgaaatccgcgttgcagaagtaattgaagttgagaaagtggaaggttctgataaacttcttcgtttccgtctagatgctggtgatgagggccatcgtcaaatcttatcagggattgcaaaattttacccaaatgaacaagagttagtagggaaaaaactccaaattgttgctaacctcaaaccacgtaaaatgatgaaaaaatatgtcagtcaaggcatgattctctcagcagaacatgatggtaaattgacagtgttgacggtcgattcagcagtggcaaatggatcaattattggttag

SEQ ID NO: 25036 - protein, 665 aa, Streptococcus agalactiae
MTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 25037 - DNA, 2031 bp, Shewanella oneidensis
  CDS (1)..(2031)
atggcaacttcacaacgtaaaattctcgtgaccagcgcacttccctatgcgaacggaccgattcatttaggtcatatgctggaatacatccagacggatatctggtcgcgttatcaaaagcttcgtggacatgagtgccactatatttgtgccgatgacgcccacggcacaccgatcatgcttaaagcccagcaattaggcatggcgcctgaagaaatgatcgcgcaagtcaacaaagagcatcagcaggatttcgccgattttaatatcgccttcgataattatcacagcacccacagtgaagagaaccgcgtgctggcgagcgatatttacttaaaactgcgcgcaaacggctatatcaaaagcaagagcatttctcagctatttgaccctgaacagtcgatgttcttgccggaccgcttcgtaaaaggcacctgccctaagtgtaaatcgcccgatcaatatggcgataactgtgatgcctgcggcgcgacctacagcccaacggagctgattaaccccaaatcggccgtctctggcgcgacgcctgtgatgaaggacactgagcacttcttcttcgacttacctgccttcgaagacatgctaaaagagtggactcgctccggcgcactgcaaaccgaaatggccaacaaactcgacgaatggttcgagcaaggcctgcagcagtgggatatcacccgtgatgcaccttactttggctttgagatccctgatgcaccgggcaaatacttctacgtgtggttagatgcgcctatcggttacatgggttcattcaaaaatctgtgtgacaaacgcccagagctaagcttcgatgaattttgggcgaaggattctaaagccgaggtttaccactttatcggtaaagacattgtctacttccacagcctgttttggccagcaatgctttatggctctggttatcgtcagccaaatagcgtttacgcccacggctatgtgacagtcaatggcgctaagatgtccaaatctaagggcacctttattaaggctcgcacttacttagatcacttagatcctgaatatttacgttactactatgcggccaaactcagtagccgtatcgacgatttagatctgaatttagaagatttcgcccagcgcgtgaactcagatctagtcggtaagctagtgaatttagcctcgcgcaccgcaggttttatcactaagcggttcgatggcaaactcgcgaaaattactgataccacgctaaccgaggtatttttagccaagcaagaacaaatcgctgagttctatgaaacccgcgaatacggtaaagcgatgcgtgaaatcatggcactagcagacatcgccaacggttttgtcgccgatgctgcgccttggcaaatggtgaaacatgacgatcaacaggaagcggcccaccaagtgtgctcgaacgccctgaacctgttccgcattttggtgacgtacttaaaacctgtgttaccacgcttagcacaagacgttgaagccttcttccaacagacgttaacttgggatgggttaggccaagatatggctggccatgaaattgcgccatttaaagccatgatgcaacgtgttgagttggacaaagtcaatgctatggtggctgactctaaggaaaacctgcaagccacaaccgagccggaagcacctaaaggcccattagcgaccgatccaattagcgacactatcaactatgaagatttcgctaaaatcgatctgcgaattgcgcgtattgtcaaagctgaacatgtagccgaagccgacaaactgttaaaactacaattggatatcggtggcgaaacccgtcaggtgtttgcagggatcaaatcggcctactcgccagaggatctcgaaggcaagctgacggtgatggttgccaaccttgcaccgcgtaaaatgcgttttggcatgtcagaaggcatggtactggcagcaggccctggtggtagcgatttgtggattttagaaccccatgaaggcgcacagcctggtatgcgggtgaagtaa

SEQ ID NO: 25038 - protein, 676 aa, Shewanella oneidensis
MATSQRKILVTSALPYANGPIHLGHMLEYIQTDIWSRYQKLRGHECHYICADDAHGTPIMLKAQQLGMAPEEMIAQVNKEHQQDFADFNIAFDNYHSTHSEENRVLASDIYLKLRANGYIKSKSISQLFDPEQSMFLPDRFVKGTCPKCKSPDQYGDNCDACGATYSPTELINPKSAVSGATPVMKDTEHFFFDLPAFEDMLKEWTRSGALQTEMANKLDEWFEQGLQQWDITRDAPYFGFEIPDAPGKYFYVWLDAPIGYMGSFKNLCDKRPELSFDEFWAKDSKAEVYHFIGKDIVYFHSLFWPAMLYGSGYRQPNSVYAHGYVTVNGAKMSKSKGTFIKARTYLDHLDPEYLRYYYAAKLSSRIDDLDLNLEDFAQRVNSDLVGKLVNLASRTAGFITKRFDGKLAKITDTTLTEVFLAKQEQIAEFYETREYGKAMREIMALADIANGFVADAAPWQMVKHDDQQEAAHQVCSNALNLFRILVTYLKPVLPRLAQDVEAFFQQTLTWDGLGQDMAGHEIAPFKAMMQRVELDKVNAMVADSKENLQATTEPEAPKGPLATDPISDTINYEDFAKIDLRIARIVKAEHVAEADKLLKLQLDIGGETRQVFAGIKSAYSPEDLEGKLTVMVANLAPRKMRFGMSEGMVLAAGPGGSDLWILEPHEGAQPGMRVK

SEQ ID NO: 25039 - DNA, 2148 bp, Leptospira interrogans
  CDS (1)..(2148)
atgaactcttcttcatctcatagaaatatactagttacttcggctcttccttatgcaaacggtccgattcatttaggtcacgtattagaaggaattcaaacagacatttgggttcgatttcaaaaggcaattggaaacgaatgttattttttctgtgcagacgacacgcatggaacccccgtaatgttagcggcgcgtaaggaagggattactcccgaacaacttatcgaaagagtaggacaagaacattatagagatctaacttctttcggaattgaatatgatcattatgattccacacattcgaaagcgaatcaagaaatttccaaagatatttatctgaaactaaaatccaaaggtcatatctcgagaagaagtatagaacagtcatactgcgaaacagataaaatgtttcttccagatcgttttatcaaaggcacttgccccaattgtaaatccaaagatcaatatggagataattgcgaagtttgcggcgccacttatagccctaaagatttgatcgattctcactgctctttatgcggaacttctccagtggttaaaaactcggatcatatattttttaaattgggagattttcataaaaaagacgaaaaatcgacttcattggaaacgatcaatccatcccatctaaaaactgattttgatttacaatcctggatagaaacgagcggggttgtttccgaatcagaaggtgttaaaaagaaactgaaagaatggttcgatgcaggactacaagattgggatatttccagagacggcccctatttcggttttgaaatcccagatgaaacaaataaatatttttacgtttggttagatgctcctataggttatatggcttcttccaaaaacttttttgaaaagaattttccaaacgaaccgaacaagtttgattccttttggaaaaacaaaaactcagagatcgttcactttatcggtaaggatatattatactttcatactttattttggccagctatgttagaaggtagcgattatagagctccttctaaagttcacgttcacggttttatcggtgtcaacggtgaaaaaatgtccaaatcaagaggaacgtttatcaaagcagaaacgtttgtaaaatatctagaccctgaacatcttcgtttttatttagcctctaaattaggccctggaatggatgacattgacctttcctttgaagacttcattaacaaggtgaattccgatctcgtagggaatttgatcaattccgtttccagggtttctactactattttagacgcattagacagaacattaggagtcgtttccaaagaaggtcttgctctaatagaagaaatcttatatcaaactgtaaaattcggcccaggcgaagactcaattcaaaatattataaaatacgcatacgatcaaagaaattacgctaaagttttgagagaaattacacgtcttggagatagggtaaaccgttatgtcaacgacaatgctccatggaaactcatcaaagaaaatccggaaaaagcaagagaagttgtaactgtaaccttaaacgcaagccgatttcttgcgatttacctttaccctgtggttcctaaaatttcagaacagatttacaagctactgaatttacaggattctccttcgtttaaggatttagataaaaacagaatattagaaaatatcaaagtattaccttacgaaatgatttctaaacgagtagatgaaaaggcgatcaaagctatgttagaagaaaataaacaatcagaacattctaaaaaagtagaaacttccgaaaatccagttccagaagaacgacttgaaatttcaatagacgacctttctaaagtagaattgagagtgggtcaaattgtggaagccggcccggtagacggcgcagataagctcgtaaacgtaaaagtggatctaggtgaattaggaatcaaaaatgtttttgccggaattaaagtcgcttatcaaccggaaaatttaaaaggtctaaaggttgtggtcgttgccaatctcaaacctagaaaaatgaagttcgggatttccgaagcgatgttgctcgcttccggtgaaggtgaatctttaagtttatttatacctcataaggacgctaaaccgggagatcgattaaaataa

SEQ ID NO: 25040 - protein, 715 aa, Leptospira interrogans
MNSSSSHRNILVTSALPYANGPIHLGHVLEGIQTDIWVRFQKAIGNECYFFCADDTHGTPVMLAARKEGITPEQLIERVGQEHYRDLTSFGIEYDHYDSTHSKANQEISKDIYLKLKSKGHISRRSIEQSYCETDKMFLPDRFIKGTCPNCKSKDQYGDNCEVCGATYSPKDLIDSHCSLCGTSPVVKNSDHIFFKLGDFHKKDEKSTSLETINPSHLKTDFDLQSWIETSGVVSESEGVKKKLKEWFDAGLQDWDISRDGPYFGFEIPDETNKYFYVWLDAPIGYMASSKNFFEKNFPNEPNKFDSFWKNKNSEIVHFIGKDILYFHTLFWPAMLEGSDYRAPSKVHVHGFIGVNGEKMSKSRGTFIKAETFVKYLDPEHLRFYLASKLGPGMDDIDLSFEDFINKVNSDLVGNLINSVSRVSTTILDALDRTLGVVSKEGLALIEEILYQTVKFGPGEDSIQNIIKYAYDQRNYAKVLREITRLGDRVNRYVNDNAPWKLIKENPEKAREVVTVTLNASRFLAIYLYPVVPKISEQIYKLLNLQDSPSFKDLDKNRILENIKVLPYEMISKRVDEKAIKAMLEENKQSEHSKKVETSENPVPEERLEISIDDLSKVELRVGQIVEAGPVDGADKLVNVKVDLGELGIKNVFAGIKVAYQPENLKGLKVVVVANLKPRKMKFGISEAMLLASGEGESLSLFIPHKDAKPGDRLK

SEQ ID NO: 25041 - DNA, 1209 bp, Plasmodium falciparum
  CDS (1)..(1209)
atgtgcgttttaacattagtaaaagatgatattaaatcagatattttaaaactggttcttgattatataaaggttacagttgtacaagataatgaaaatgtaaaattaccagaaatatgttacgataagaaaataacactgcaatataagaacaaaacatacaaggatctcttttgtaccttatatgccttaattgatatatacgattgttatagtgagctttttaatgaagatgaagggaaagttagtgagaacgaagaatttatttttcatttagctagtgataaatacatattaaaacagtctgatatgaagcatttaaatgacttgttatgtgagaagtcttatattatatctaataaacatgcatccatagttgatatattttatttttgtgcaattcacaagttattagatgaaatggctgtaaaagaaagaatcgaattttcatatatttatagatggtatttacatattcaagaaacactcttagctaattttagtacattgaaaaaattaattgttaaagatagtttagaaaacttattaaataataaaactacaaacaatgctcctgaacataagaacaattttgtttccaaagaatccaaagaaaataaatcacaaaataacgaaagtccaaaaaataaaaagaaggatgtacaaaataagaataatgcaccaaataaaaaagtagaagaaaccaaaaagttagatgatatctcacgattgaatgtactagttggatatgtagaacaagttgaaatacatccagatgccgatacgttatattgtttaaaaattaatcttggtgaagataaacctagagatatatgtagcggattacgtaataagaaaaacgctgaagatttacttaacaaatatgttttagttttagctaacttaaaagaaaaatctttaagaggaaaaaaaagtcatggaatggttttatgtggttcttttgatgaaaaagtagaattacttgttccaccaaatggtgtaaaaataggagaaagaatcttatttcataatatggaccctaatgttataccagataaaaatcttagttctgataaagaaaaaaatcctttcttccatattcaaccacatcttatattaaaagatggtgtggctcattataaggataccaaatggatatcatcccaaggtgatattacttgtgttttaaatcaaggaacaatatcataa

SEQ ID NO: 25042 - protein, 402 aa, Plasmodium falciparum
MCVLTLVKDDIKSDILKLVLDYIKVTVVQDNENVKLPEICYDKKITLQYKNKTYKDLFCTLYALIDIYDCYSELFNEDEGKVSENEEFIFHLASDKYILKQSDMKHLNDLLCEKSYIISNKHASIVDIFYFCAIHKLLDEMAVKERIEFSYIYRWYLHIQETLLANFSTLKKLIVKDSLENLLNNKTTNNAPEHKNNFVSKESKENKSQNNESPKNKKKDVQNKNNAPNKKVEETKKLDDISRLNVLVGYVEQVEIHPDADTLYCLKINLGEDKPRDICSGLRNKKNAEDLLNKYVLVLANLKEKSLRGKKSHGMVLCGSFDEKVELLVPPNGVKIGERILFHNMDPNVIPDKNLSSDKEKNPFFHIQPHLILKDGVAHYKDTKWISSQGDITCVLNQGTIS

SEQ ID NO: 25043 - DNA, 330 bp, Thermoanaerobacter tengcongensis
  CDS (1)..(330)
atggccacatatgaagattttttaaaacttgacatacgcgtgggaagaataattgaagtggaagatttcccaaaagctaaaaaaccagcctacaagttaaaaatagactttggagagctgggcgtaaaaacctccagcgctcaaataacaaagctctacaaaaaagaagacttgtacaaccgcttagtagtctgtgttgtcaatttccctccgaaaaaaattgcagacttcgtttcagaagtattagttttgggcgttgacgataaagaggaaaacgtcgttttacttcagccagaaagagaagtaaaagtaggaaataaagtttattaa

SEQ ID NO: 25044 - protein, 109 aa, Thermoanaerobacter tengcongensis
MATYEDFLKLDIRVGRIIEVEDFPKAKKPAYKLKIDFGELGVKTSSAQITKLYKKEDLYNRLVVCVVNFPPKKIADFVSEVLVLGVDDKEENVVLLQPEREVKVGNKVY

SEQ ID NO: 25045 - DNA, 1230 bp, Oryza sativa
  CDS (1)..(1230)
atggcggcggcggcggcggacttcgcggcgagcaagcgggccatggcctacgcgctctgcaagcacctcagcctcgatccgaatacaatatccagtacaagtattgaagagagtgatattgccaccctgttctcacatattgtgaaatcgagtgaagatgaggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtgagtcatcttggtgaaaacgagttgcagaaatatccacatgtattgcggtggatggactatatccagaacatcgttgattttggcacaacagtacaaaaggttaacttgaccaaatctgtcttcgatccaccttctcatccaaagaaggcagataaaggtgacactgatccaagttcaaagaaagttgtttcaggacagaagaatgtgggcaaatcggatgcaaatgttgattccaagaaagctgcaccagagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacagcctcttggttgaggagatagatttgggagatggcaatgtgcatcaagttgttagtgggcttgccaagttcttcagcccagaggaacttgttaatcggcatgttgtattaatcacgaatgtgaagcctgggaagctgcgagacgtaatgtctgccggattggtcttgtgtgcttcaaatcaagatcatacagttgtagagccattgattcctccagaaggagctaagcctggagagcgtatttcatttgcagggtttgatgggaagccagaagatgttcttaatccgaagaagaaacagctcgacaagatcacaccggatcttcacactgatggaaatggaattgcaacataccgaggggtacccttcactacatctgctggtccatgtagatcttctgttcctaatgcgagcattaagtga

SEQ ID NO: 25046 - protein, 409 aa, Oryza sativa
MAAAAADFAASKRAMAYALCKHLSLDPNTISSTSIEESDIATLFSHIVKSSEDEVLKWVEFSSNFVGKCGEQHALLGNLNQDLSQKSVLLGNGFKPSVADIVVFATIQVFVSHLGENELQKYPHVLRWMDYIQNIVDFGTTVQKVNLTKSVFDPPSHPKKADKGDTDPSSKKVVSGQKNVGKSDANVDSKKAAPENKAPENKANPTPAKNNKPSGDKKKAQEKSAGKPNEGVADKAPQKTAEKDSECNVSILNIQVGLIRKAWKHPSADSLLVEEIDLGDGNVHQVVSGLAKFFSPEELVNRHVVLITNVKPGKLRDVMSAGLVLCASNQDHTVVEPLIPPEGAKPGERISFAGFDGKPEDVLNPKKKQLDKITPDLHTDGNGIATYRGVPFTTSAGPCRSSVPNASIK

SEQ ID NO: 25047 - DNA, 858 bp, Encephalitozoon cuniculi GB
  CDS (1)..(858)
atgaggttcgagttttcgagcgggtttgaagacctggcattcgttctgaagtgcctcaatggcaatgctgagctggaaagggtggacaagggagtgaggcttctttgcgatggtgtaagccatgaaggtctggatgatgtactggctgccctgtacagaatctacgagccaaatcatgatcacaggagcataagggaaacaaagagactgagggaaagtccggagacaagaaagatagaggtaagcatatcgagcctgacttcgttttatggactgtactgcctgatgatcacgcagggtacattaagaaacaaactgttcattgaccagatggtagagaagatcatgccatctgtgagactagaccccgactttcaattgctggatattcaggctggagagatagtaagtatcggagatgttcagggccttgacaagctttattccgaagacgttgttgcgagggaaagaatacaggtgctgagtgggctaagagagcatgtggcaaaagaagagatgctaggaaacaaattcctctttgttacaaacataaagcctgccaagttcaagggacaggtttccgaggggatgattctgtgtgtaaagggaccagatggaaagatcgaaccgattaggatgccaggggaaattgagaacgggtctagactagagcttgaggggtttgagacacctattagtgactttagttctggtaagatcgacatgaggaggagcgggtatataaacgctcttggatcattcaaagttgttggccattttcttactttcaagggaagtaaagttacttgcagaggaaagtatatcaaaaccaacatatcggatgggccaatgagctga

SEQ ID NO: 25048 - protein, 285 aa, Encephalitozoon cuniculi GB
MRFEFSSGFEDLAFVLKCLNGNAELERVDKGVRLLCDGVSHEGLDDVLAALYRIYEPNHDHRSIRETKRLRESPETRKIEVSISSLTSFYGLYCLMITQGTLRNKLFIDQMVEKIMPSVRLDPDFQLLDIQAGEIVSIGDVQGLDKLYSEDVVARERIQVLSGLREHVAKEEMLGNKFLFVTNIKPAKFKGQVSEGMILCVKGPDGKIEPIRMPGEIENGSRLELEGFETPISDFSSGKIDMRRSGYINALGSFKVVGHFLTFKGSKVTCRGKYIKTNISDGPMS

SEQ ID NO: 25049 - DNA, 330 bp, Pyrococcus furiosus
  CDS (1)..(330)
atggagttatatgacgtttcagaattttggaagtttgatatgagagttggaaaggtaataaaggcagaaaagttaaagagaactaggaaattgataaagttggttgttgattttggaaaagaaacgagaacaatagtaactggaatagcagatcaatataaccccaaagatttagaagggaagaaatttatttttgttctaaacttaaaaccaaaagaattctctggagttaaaagtgaaggaatgctaatagtggcagaagaagaaaatggaaaagtttacttacttcctgttccagaagaagttccggtaggaacaaaagtttggtag

SEQ ID NO: 25050 - protein, 109 aa, Pyrococcus furiosus
MELYDVSEFWKFDMRVGKVIKAEKLKRTRKLIKLVVDFGKETRTIVTGIADQYNPKDLEGKKFIFVLNLKPKEFSGVKSEGMLIVAEEENGKVYLLPVPEEVPVGTKVW

SEQ ID NO: 25051 - DNA, 327 bp, Pyrobaculum aerophilum
  CDS (1)..(327)
atgtcgttagtttcattggaggactttaagcggctggatatacgtattggcaaagtggtagaggcgaccagagttgaggggtcgaggaaattaataaagctaattgtcgacctaggcgcggagaagaggcaggtaatcgccggcctggccgagttttacaggccggaggacctcgtggggaagtacgtagtcgtgctggctaacttacagcctaagaaaataatgggcttggagagccaggggatgatactggccacgtgtgacaaaccggtgttgctcagtattgagaaggggggagatgaacatgtgggcgagcgggtctgttaa

SEQ ID NO: 25052 - protein, 108 aa, Pyrobaculum aerophilum
MSLVSLEDFKRLDIRIGKVVEATRVEGSRKLIKLIVDLGAEKRQVIAGLAEFYRPEDLVGKYVVVLANLQPKKIMGLESQGMILATCDKPVLLSIEKGGDEHVGERVC

SEQ ID NO: 25053 - DNA, 342 bp, Sulfolobus tokodaii
  CDS (1)..(342)
atgagtgaaattacaatagacgactttgcaaaattagatttaagagtaggaattgtaaagtcagctgagaggatagaaggaactagattactaaaattaatcgttgatttaggcagtgaatctaggcagattatttctggtatagctgaattttacacgccagaagaattagtgggaaaaagagtcatactcatagctaatttaaagcctaaaaaaataagaggatttgaaagtcagggaatgatattagctgctggttgtaaagaagatgaggagaaaggaataaaacctagaatacttacagtagatggggaagttcccgcaggaacaaaagtatgttaa

SEQ ID NO: 25054 - protein, 113 aa, Sulfolobus tokodaii
MSEITIDDFAKLDLRVGIVKSAERIEGTRLLKLIVDLGSESRQIISGIAEFYTPEELVGKRVILIANLKPKKIRGFESQGMILAAGCKEDEEKGIKPRILTVDGEVPAGTKVC

SEQ ID NO: 25055 - DNA, 324 bp, Thermoplasma volcanium
  CDS (1)..(324)
atggaagttgatatcaattactttcgaacgcttgatatcagagctgcgaaggttgtttcatgcgaaaaggtcgaaaagtctaggagtctgttgaggatagttgtagatcttggcgatcaacagaaacaaataatatctagcatagcagattattataatccatcagatcttataggaaaaacaataataattctgaacaatttgaaaccggctaaattcatggggcttgaaagccagggtatgctattggcagtagataacgaagaaggcgtcaagctccttactgtagacggagaagttaaacctgggtcaaaggtgtcttaa

SEQ ID NO: 25056 - protein, 107 aa, Thermoplasma volcanium
MEVDINYFRTLDIRAAKVVSCEKVEKSRSLLRIVVDLGDQQKQIISSIADYYNPSDLIGKTIIILNNLKPAKFMGLESQGMLLAVDNEEGVKLLTVDGEVKPGSKVS

SEQ ID NO: 25057 - DNA, 1032 bp, Drosophila melanogaster
  CDS (2)..(973)
aatgctgcgtagagctgccacgactgtgggatccgcatgtaaaaattacggccagaattgctcaaaattcgcgagaaacaaaagaacaatggccgatctgcagcagattgcaagcaacaacgagcgcgccgaggcgctgatcaactccattgaagccgagatttccggcatccagcagcaacttgtggagcgccagaagcaggagctgatcaaggagaacgctgcactggccaaggaagttgaggcggctttggcccagctggtgcagctggagctgcgaaatggcaagaaacagattccggtgcctggagcccggggtttctgcaccagtgcggccccagtagttatgccggcagaggctggacctgctaccgctgcacccgctgccccggctcctaagccggccaaggagcccaaggaaaagaagtccaaggagaagaaaccggccgccgagaagcccgccgccgctccggaggctcccgtcgacgtcggtcgcctggatttacgcgtgggcaagattgtggaggtgggtcgccatcccgacgccgacagcttgtatctggagaagatcgactgcggcgaggcggctccacgcaccgtggtgtccggtctggtgaagttcgtgcccctggaagagatgcagaaccgtctggtagtggtcatgtgtaacctgaagccggccaaaatgcgcggcgtcacctcggaggctatggtcatgtgcgcatctacaccggaaaaagtggaagtgctcagtccgcccgccggagctgttcccggcgacctggttcactgcgagggctatccgcgccagccagacgcccagctcaaccccaagaagaagatctttgagtcgtgcgccccggatctgaagaccaacggcgaactggttgcctgctacaagggcgccgctctccatgttcctggcaagggcaacgtggtggcccaaaccctgaagaacgtcaatgtgaagtgagccaataaacgaaactaaagctttgagccaataaacgaaacatcaccgcctgcacacca

SEQ ID NO: 25058 - protein, 323 aa, Drosophila melanogaster
MLRRAATTVGSACKNYGQNCSKFARNKRTMADLQQIASNNERAEALINSIEAEISGIQQQLVERQKQELIKENAALAKEVEAALAQLVQLELRNGKKQIPVPGARGFCTSAAPVVMPAEAGPATAAPAAPAPKPAKEPKEKKSKEKKPAAEKPAAAPEAPVDVGRLDLRVGKIVEVGRHPDADSLYLEKIDCGEAAPRTVVSGLVKFVPLEEMQNRLVVVMCNLKPAKMRGVTSEAMVMCASTPEKVEVLSPPAGAVPGDLVHCEGYPRQPDAQLNPKKKIFESCAPDLKTNGELVACYKGAALHVPGKGNVVAQTLKNVNVK

SEQ ID NO: 25059 - DNA, 1726 bp, Drosophila melanogaster
  CDS (52)..(1629)
ctttttgtgatttcgcagcgcacgcgaaaatctgataaattccctaaaaaaatggtcggaataacgcccgcagagaagaaagcgctgataacgcgcaatctgcaggagacgctcggcgatgacaagctgaccaagatcctggcggagcgcgatctaaagatctactggggaacggcgacgacgggcaagccacatgtcgcctatttcgtgcccatgtcgaagattgccgatttcctgaaggcaggatgcgaagtgaccatcctgttcgccgatctccacgcctatctggacaacatgaaggcaccgtggtctctcctggagctgcgaaccaagtactacgaacaggtcatcaaggccatgttgagctccatcggcgttccgctggagaaactgaagttcgtcaagggcagcgactatcagctgtccaaggagtacaccctggatgtatacaagctcagctccgtggtcacgcaacacgatgccaagaaggcgggcgcagaggtggtcaaacaggtggagtacccactgctctccggtttgctttatcctggtctgcaggctctggacgaggagtacctcaaggtggacgcacaattcggtggcgtggatcagcgcaagatctttaccttctcagagaagtatctgccgcagttgggctacgaaaagcgcattcacttcatgaatcccatggttcccggcttggctggtggcaagatgtcctcttccgaggaggactcaaagatcgatcttctggactccccggccaacgtgaagaagaagctgaagaaggctttctgtgagccgggaaacattgccgacaacggcctgctgtccttcgtgaagcacgtcctgttctcgctgttcaaggaaggcgaaggcttcgaggttaaccgcgaggcggagcatggcggcgatgttaccttcctgaaatacgaggatctggagaagtactacgcggaggacaaactgcacccgggtgacctgaaggccaccgtggagaagtacatcaaccgactgctagatcccattcgaaaggcctttgaaaacccagaactgcaaaaactgagtgctgctgcttatccaccgcctgccaaggtgaaggcaggagctgctcccgctgctggagctgacgaagatgcaccccatcgcctggatatccgcgtgggcaaggtcgtcgaggtggcccgtcatccagatgccgatactctatatgtgctgaagatagacttggctgaggcgcaacccagaacgattattagtggcctggtgaagtttgtcaccgaggaggagctgaaccagcgattggtggcggttctttgcaacctgaagccgtccaagatgcgcggcatcttgtccgagggcatggttctgtgcacctccaacgctgaccacacggtggtggagcctattgtgctgccagccactgctactgctggcagtcgcctctccttcgagggattcagtggcacgcccgatgagcagcttaatcccaagaagaaggtgtgggagaaactctccgccgacttcaagacgaacagcgatggactggccgtgtggaaggacaacttcctgctgacgcccgagggcgaaaagctttccagcaagctggccaactgctccattaaataaaactttcaacgccaacctacctgagccgtgtaatacttacaactaagccgaatgttcacaaaacagaaattgctgctaatttattgattcctcttcg

SEQ ID NO: 25060 - protein, 525 aa, Drosophila melanogaster
MVGITPAEKKALITRNLQETLGDDKLTKILAERDLKIYWGTATTGKPHVAYFVPMSKIADFLKAGCEVTILFADLHAYLDNMKAPWSLLELRTKYYEQVIKAMLSSIGVPLEKLKFVKGSDYQLSKEYTLDVYKLSSVVTQHDAKKAGAEVVKQVEYPLLSGLLYPGLQALDEEYLKVDAQFGGVDQRKIFTFSEKYLPQLGYEKRIHFMNPMVPGLAGGKMSSSEEDSKIDLLDSPANVKKKLKKAFCEPGNIADNGLLSFVKHVLFSLFKEGEGFEVNREAEHGGDVTFLKYEDLEKYYAEDKLHPGDLKATVEKYINRLLDPIRKAFENPELQKLSAAAYPPPAKVKAGAAPAAGADEDAPHRLDIRVGKVVEVARHPDADTLYVLKIDLAEAQPRTIISGLVKFVTEEELNQRLVAVLCNLKPSKMRGILSEGMVLCTSNADHTVVEPIVLPATATAGSRLSFEGFSGTPDEQLNPKKKVWEKLSADFKTNSDGLAVWKDNFLLTPEGEKLSSKLANCSIK

SEQ ID NO: 25061 - DNA, 1254 bp, Cricetulus griseus
  CDS (84)..(1163)
gagagagagaaatggaaaaatgagagcgtagtgtggcccaagaagaggacgagcgcaggaagcgcgcggccgctgtggggtggatgtgtgaagttttcaggcgtttaccggggacagcccccgggtcctctccccccgcccccgccacgcaccggctgaggctgctcgggagggagctgcgggttcgccgcttcatgattttctgccgattctgggcaaagatggccaccaatgatgctgttctgaagagactagagcagaagggtgcagaggctgaccagatcattgagtatctcaagcagcaggttgctcttctcaaggagaaagcagttttacaggcaactttgagagaagaaaagaaacttcgagttgaaaatgctaaactgaaaaaagaaatagaagaactaaagcaagagctaattcaggcagaaattcagaatggagtgaagcaaattccagtgccagtccaatctgatactccagtgcaagctagctctgcagtttctacaagtgtgatacagtctacatcggtatcaaccatctcttgtagtataaaagaacacagtaaaggagggggagaagaaaagaaggtaaaagagaaaactgataagaaaggagagaaaaaggagaagaaactgcagtcagcagcaccaagtgctgactcgaagccagtagatgtttctcgtctggatcttcgaattggtcgtattgttactgtcaaaaagcacccggatgcagactcactgtatgtagaagaagtggatgtgggggaggcagccccaaggacagtcatcagtggactggtgaatcatgttcctctagaccagatgcaaaatcgaatggtggttttactttgtaatctgaagcctgcaaaaatgcggggaatactgtctcaagcaatggtgatgtgtgctagttcaccagagaaagtggaaattctggcccctcccaatggatctgttcctggagacagaattacttttgatgctttccctggagagcctgacaaggagctgaaccctaagaagaagatctgggagcagatccaacctgacctgcacaccaatgctgagtgtgtggccacatacaaggggtctccctttgaggtgaaggggaagggagtttgcagggcccaaaccatggccaatagtggcattaaataagtactctgttactgaaggccatggagaaaccttagtaacaataaagaggagtatattgtcacacacacatcaaaaaaaaaaaaaaaaaaaa

SEQ ID NO: 25062 - protein, 359 aa, Cricetulus griseus
MCEVFRRLPGTAPGSSPPAPATHRLRLLGRELRVRRFMIFCRFWAKMATNDAVLKRLEQKGAEADQIIEYLKQQVALLKEKAVLQATLREEKKLRVENAKLKKEIEELKQELIQAEIQNGVKQIPVPVQSDTPVQASSAVSTSVIQSTSVSTISCSIKEHSKGGGEEKKVKEKTDKKGEKKEKKLQSAAPSADSKPVDVSRLDLRIGRIVTVKKHPDADSLYVEEVDVGEAAPRTVISGLVNHVPLDQMQNRMVVLLCNLKPAKMRGILSQAMVMCASSPEKVEILAPPNGSVPGDRITFDAFPGEPDKELNPKKKIWEQIQPDLHTNAECVATYKGSPFEVKGKGVCRAQTMANSGIK

SEQ ID NO: 25063 - DNA, 2010 bp, Bacillus anthracis
  CDS (28)..(2010)
atgaggttattcgggaggttcaaaacaatgacagaggaaaacaaatccttttatattactaccccaatttattatccaagtggaaaattacacattggacatgcttatacaacagtagcaggagatgcgatggcacgatataagtgcatgcaaggatataatgttcattatttaacaggaactgatgagcatggacagaagatccaaaagaaagcagaagaattaaacgttacaccacaagcatatgtggataacatcgttgcaggaattaaagaactttgggaaaagatggatatctcttatgatgattttattcgtacaacggaagatcgtcataaagatgttgttgaaaaaatcttcaagcaactagtagatcaaggtgatatttatcttgatgaatatgaaggttggtattctgtacaagatgagacattctatacggagcatcaattagtagatccaattatggaaggtgacaaagtagttggaggaaaaagtccagatagtggtcatgatgtagaacttgttcgtgaagaatcgtatttctttagaatgggtaaatatgtcgacagactattaaaattctatgaagataatccacatttcattcagccagagtctcgtaagaatgaaatgattaataacttcattaaaccaggcttagaagatttagcagtttctcgtacttcatttgactggggagttcgtgttccaggtaatccgaaacacgttatttacgtatgggttgacgcactatctaactacattacagcattaggctatggaacagaaaatgaagagatgtataagaagttctggccggcagatgtgcatttagttggaaaagaaatcgttcgtttccatacaatttattggccaatcattttaatggcattagatttacctcttccgaaaaaagtctttgctcacggttggattttaatgaaggatggaaagatgagtaagtcaaaaggaaatgtagtagatccagttatattaatcgatcgttacggattagatgcattacgttattacttacttcgtgaagttccattcggatctgatggcgtattcacaccagaaggatttgtggagcgtattaatttcgatttagcaaatgacttaggtaacttattaaatcgtacagtagctatgattgataagtactttaacggagaaatccctgcatttaaagcaaatgtaacggaatttgatgaaacgttagtaacatttgcgaaagatacattgaaaaaagttgaagaagcaatggagaatatggaattctctgtagctctaagctcaatttggcaattggttagccgtacgaataaatatattgatgaaacacaaccatgggtattagcgaaagatgaggatgatcgtgaaaagttggcgtctgtaatggctcatttagcagaagtacttcgtcaaacgggtattatgcttatgccattcttaacagtagcaccaagcaaaatgtttgctcagcttggccttactgatgaagcacatacatcttggggaagcctatctacaatcggctgtattccagctggaacaaaagtagaaaaaggacaaccaattttccctcgtttagaaatggacgtggaagtggcgtacattaaagaacaaatgaaagcctctgctcctaaagtagaagagaaaaaagaagaagaaccgaaggcagaagaaattacaattgatgatttctttaaagtagaattgcgtgtagctgaagtactatctgctgaacctgtaaaaaaggcagataagttgttgaaaattcaactagacttaggtacagaaaagcgtcaagttgtttctggaattgcaaaattctattcgccagaagacctaaaaggtaaaaaggttatttgtgtaacaaatttaaaacctgtaaaattacgcggtgaattatcgcaaggtatgattttagcgggtgaagagaatggtgtattgtcattagcatctattgaccaaaatataccaaatggtacaaaaatcaagtag

SEQ ID NO: 25064 - protein, 660 aa, Bacillus anthracis
MTEENKSFYITTPIYYPSGKLHIGHAYTTVAGDAMARYKCMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVILIDRYGLDALRYYLLREVPFGSDGVFTPEGFVERINFDLANDLGNLLNRTVAMIDKYFNGEIPAFKANVTEFDETLVTFAKDTLKKVEEAMENMEFSVALSSIWQLVSRTNKYIDETQPWVLAKDEDDREKLASVMAHLAEVLRQTGIMLMPFLTVAPSKMFAQLGLTDEAHTSWGSLSTIGCIPAGTKVEKGQPIFPRLEMDVEVAYIKEQMKASAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNIPNGTKIK

SEQ ID NO: 25065 - DNA, 1983 bp, Bacillus cereus
  CDS (1)..(1983)
atgacagaggaaaataagtccttttatattactaccccaatttattatccaagtggaaaattacacattggacatgcttatacgacagtagcaggagatgcgatggcacgatataagcgtatgcaaggttataatgtgcattatttaacaggaactgatgaacatggacagaagatccaaaagaaagcagaagagttaaatattacgccacaggcatatgttgataacattgttgcaggaattaaagagctttgggagaagatgaatatttcttatgatgattttattcgtacaactgaagatcgtcataaagatgttgtcgaaaaaatctttaaacaattagtagatcaaggtgacatttatcttgatgaatatgaaggttggtattctgtacaagatgagacgttctatacagagcaccaattagtagatccaattatggaaggcgacaaagtagttggaggaaaaagcccagatagtggtcatgatgtagaacttgttcgtgaagaatcttatttctttagaatgggtaaatatgtcgacagactattaaagttctatgaagataatccacatttcattcagccggagtctcgtaaaaatgaaatgattaataattttattaaaccgggattagaagatttagcagtttctcgtacttcatttgactggggagttcgtgttcctggtaacccaaaacacgttatttacgtatgggttgacgcattatctaactatattacggcgttaggttatggaacagcaaatgaagagaaatataaaaaattctggcctgcagatgtgcatttagttgggaaagaaattgttcgtttccatacaatttattggccgataattttaatggcattagatttacctcttccgaagaaagtctttgctcatggctggattttaatgaaagatggaaagatgagtaagtcaaaaggaaacgtagtagatccagttacattaatcgatcgttacggattagatgcattacgttattacctacttcgtgaagttccatttggatctgatggcgtatttacaccagaaggatttgtggagcgtattaatttcgacttagcaaatgacttaggtaatttattaaatcgtacagtagctatgattgataagtactttagcggagaaatccctgcatttaaagcaaatgtgacggaatttgatgaaacgttagtagcgtttgcacaagatactttgaaaaaagtagaagaagcaatggagaatatggagttctctgtagcgttaggatctatttggcaactagttagtcgtacgaataaatatattgatgaaacacaaccatgggtattagcaaaagatgagaatgatcgtgaaaagttagcctctgtaatggctcatttagcagaagtacttcgtcaaacaggtattatgcttatgccattcttaacagtagcaccaagcaagatgtttgctcagcttggccttactgatgaagctcataaatcttgggaaagtctatctacaattggctgcattccagctggaacaaaagtagaaaaaggaaacccaattttccctcgtttagaaatggaagtggaagtagagtacattaaagaacaaatgaaaagctctgctcctaaagtagaagagaaaaaagaagaagaaccgaaggcagaagaaattacaattgatgatttctttaaagtagaattacgcgtagctgaagtactatctgctgaacctgtgaaaaaagcagacaagctgttaaaaattcaactagacttaggtacagaaaagcgtcaagttgtttctggaattgcaaaattctattcgccggaagacttaaaaggtaaaaaggttatttgtgtaacaaacttaaaacctgtaaaattacgcggtgaattatcgcaaggtatgattttagcgggtgaagagaatggcgtattgtcattagcatcaattgaccaaaatctaccaaatggtacaaaaatcaagtaa

SEQ ID NO: 25066 - protein, 660 aa, Bacillus cereus
MTEENKSFYITTPIYYPSGKLHIGHAYTTVAGDAMARYKRMQGYNVHYLTGTDEHGQKIQKKAEELNITPQAYVDNIVAGIKELWEKMNISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTANEEKYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFSGEIPAFKANVTEFDETLVAFAQDTLKKVEEAMENMEFSVALGSIWQLVSRTNKYIDETQPWVLAKDENDREKLASVMAHLAEVLRQTGIMLMPFLTVAPSKMFAQLGLTDEAHKSWESLSTIGCIPAGTKVEKGNPIFPRLEMEVEVEYIKEQMKSSAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 25067 - DNA, 2112 bp, Chlorobium tepidum
  CDS (1)..(2112)
atgactcatatacccaaaagaactctcgttaccaccgctcttccatatgccaacggcccggtgcacctcggccacctcgccggggtctatctgcccgccgatatttatgttcgctacaagcgcctctgcggccacgacgtgatccatatcggtggctcggatgagcacggcgtgccgattaccattaccgccgacaaggagggcatttcgccgcaggaagtggtggatcgctaccacacaatgaatgctgaggcatttgcgaagtgcggcatttcgtttgattactacgggcgcaccagtgggccggttcatcaccagaccgctcgtgagtttttcttggaaatcgagaaaaaggggatttttgtcaagaaaaccgaaaagcagttcttcgatccgaaggcggggcgcttcctctccgaccgctacatcaccggcacctgcccggtctgcaaaacgcccggcgcgaacggcgaccagtgcgagcagtgcggcacgcacctcagcccgaccgagctgatcgatccgaagagcaagctctccgacgctacgccggagctgcgcgaaaccctgcactggtacttcccgcttgggcgctaccagaagcagctcgaagcctttgttgaacggcacaccggtgactggcgctctaacgttgtcaactactcacgcacgtggctcaaccagggcctcgccgaccgtgcgatcacccgcgatctcgcttggggcatctcgctgccgctcgactccgaagaggcgaaaggcaaggtgctttatgtctggttcgacgccgtgcttggctacatttcatttacgaaagagtgggctgaaaagcagggcgacgccgaactctggcggcgctactggcaggatccggagacgcgcatcatcaacttcatcggcaaggataacgtcgtgttccacacgctgatgttcccggcgattctgatggcctggaacgaggggcgcagcgaggggcgctacgagctggccgacaatgttccggcctccgagttcatgaacttcgaggggcgcaagttctcaaagtcgcgcaactatgcagtttatctcggcgagtttctcgaacgcttcccggcggacacgttgcgctacagcatcgcgatgaactacccggagaacaaggataccgacttcagctggagtgacttccagaaccgcaccaacggcgagctggccgacacgctcggcaacttcatcaagcgttcgatcgactttaccaactcgcgcttcggcggccaggtgccagcggacatagaccttgaagcgtgggacagcctcggcatcgactggctggcgagtttcggcaaactcgaagcggcctacgacggcttccacttccgtgaagcaaccgcacagacgatggagatcgcgcgtttcgccaatcgctttctcaccgagagcgagccgtggaaagtcattaaggtcgatccggaagcggcggggcgcacgatggccgtgtcgctgaatctttgccacacgctcgcgctgctcttctggccgattgtgcccgaaaccgccaaccgcatttggaagatgctcggtttcgagggcacgattgacgaactcgttgaacccggcaaccctgtctggcgtcaggcgctcgaaccggggctgaagaagggacacaagctgcttggttcgtccgaaattcttttctcgaagatcgaggacaaggacatcgagccagagatgaagaagatcgaggcgctgctggccgaggcggagcagcgtgaagccgccaagcagcccgtgccgatgacctttaagcctgagatcaccttcgacgacttccagaagatcgatctgcgtgtggcaaaagtggtcgcctgcgagccggtcaaaaaggccaacaaactgctcaagctgcaattgcaggtcggctcggagcagcgccaggtgctttcgggcatcgcgcagtactttacgcccgagcagatggtgggcaagaatgtcgtgctggtggccaatctcgctgaccgcaccatgcggggcgagctgtcgcagggcatgatcctcactgtcgagggcgccgatggccgcctttttctgctcgaaccgcagggcgaaggaataaatgggaactctgtcagttaa

SEQ ID NO: 25068 - protein, 703 aa, Chlorobium tepidum
MTHIPKRTLVTTALPYANGPVHLGHLAGVYLPADIYVRYKRLCGHDVIHIGGSDEHGVPITITADKEGISPQEVVDRYHTMNAEAFAKCGISFDYYGRTSGPVHHQTAREFFLEIEKKGIFVKKTEKQFFDPKAGRFLSDRYITGTCPVCKTPGANGDQCEQCGTHLSPTELIDPKSKLSDATPELRETLHWYFPLGRYQKQLEAFVERHTGDWRSNVVNYSRTWLNQGLADRAITRDLAWGISLPLDSEEAKGKVLYVWFDAVLGYISFTKEWAEKQGDAELWRRYWQDPETRIINFIGKDNVVFHTLMFPAILMAWNEGRSEGRYELADNVPASEFMNFEGRKFSKSRNYAVYLGEFLERFPADTLRYSIAMNYPENKDTDFSWSDFQNRTNGELADTLGNFIKRSIDFTNSRFGGQVPADIDLEAWDSLGIDWLASFGKLEAAYDGFHFREATAQTMEIARFANRFLTESEPWKVIKVDPEAAGRTMAVSLNLCHTLALLFWPIVPETANRIWKMLGFEGTIDELVEPGNPVWRQALEPGLKKGHKLLGSSEILFSKIEDKDIEPEMKKIEALLAEAEQREAAKQPVPMTFKPEITFDDFQKIDLRVAKVVACEPVKKANKLLKLQLQVGSEQRQVLSGIAQYFTPEQMVGKNVVLVANLADRTMRGELSQGMILTVEGADGRLFLLEPQGEGINGNSVS

SEQ ID NO: 25069 - DNA, 1938 bp, Clostridium perfringens
  CDS (1)..(1938)
atgtgtaaaaaaccatattatattacaacgcctatttattacccatcaacaaatctacacataggtaatacttatacaactgtagctgctgatgctatagcaagattcaaaagacttacaggtcacgaagtgatgttcttaacaggaacagatgagcatggtcaaaaaatagaaagaatagctaatgaaaaaggaattactccaaaagagcacgttgacgaaatagttgcagggattaaagatctttggaaaatgatgaacataagctatgacaagtttataagaacaactgatgattatcatgtgaaagctgttcaagagattttcaaaaagttatatgatcaaggagatatatataaagattcttatgaaggtctttactgtactccatgtgaatcattctggacagaaactcaattagtaaatggaaactgtcctgattgtggaagaccagttgaaaaagctaaggaagaagcttacttctttaaaatgagcaaatatgctgatagattaattcagtatatagaagagcatccagatttcattcaaccagaatcaagaaagaatgaaatgttaaataacttcttaagaccaggattacaagatctttgtgtttcaagaacaagctttacttggggaatacctgtaagctttgatgagaagcatgttatatatgtttggatagatgcattatcaaactacataactgctttaggatatggtcaagaaaaccaagagttatacaaaaagttctggccagctgatgttcacttaataggaaaagatattttaagattccatacaatttactggccaataatgttaatggctttaggattagaattacctaagcaagtatttggtcacggatggttacttgttgatggaggaaaaatgtcaaaatcaaaaggtaacgttgttgatccagtagttttagttaacatgtttggagctgacgctgtaagatactacttattaagagaaataccatttggttcagatggattattcaacaatgaaatatttataaagaaagtaaatacagacttagctaatgacttaggtaacttattatcaagaacaatagctatggtttataaatactttggtggagttattcaagcaccaacatgtaaagaacctattgatgatgagttaataaacttagctttatctactccaggaaaagttgaagctagcatagatgcattaaagattccagaagctttagaaagtatatggactttaataagcagagctaacaaatatatagatgaaacaactccttggatacttgctaaggatgaagaaaagaaagaaagactaggaacagttttatataacttattagaaactttaagatttgtttcagtaatgatttcaccattcttaacagaaacaagtgtaaaaataaatgctcaattaaacactaaagttacaacttgggaaagtttaaaagagtttaatggaacagttgcaggagataaagtagttaagggtgatgttatattcccaagaatagatgttgaggaaaaattagcagaacttgaagctttaaaaccagctccagttaaaccagctaacgaagagttagttgaaaatccaataaaagaagaaataactatagatgactttgacaagatagatttaagagttgttaaagtattagaatgtgaaccagttaaaaaagctaaaaagttattaaaacttaaggttgatttaggtggagaagaaagacaggttatttcaggaatagcacaatactataaaccagaagagttagttggaaagtatgtagtattagttgctaacttaaaaccagttaaattaagaggagaattatctcaaggtatgatacttgcagcagcaccttcagatgattcagaacttctattagttaacccaggagaaatgttaactggaagccaagtaagatag

SEQ ID NO: 25070 - protein, 645 aa, Clostridium perfringens
MCKKPYYITTPIYYPSTNLHIGNTYTTVAADAIARFKRLTGHEVMFLTGTDEHGQKIERIANEKGITPKEHVDEIVAGIKDLWKMMNISYDKFIRTTDDYHVKAVQEIFKKLYDQGDIYKDSYEGLYCTPCESFWTETQLVNGNCPDCGRPVEKAKEEAYFFKMSKYADRLIQYIEEHPDFIQPESRKNEMLNNFLRPGLQDLCVSRTSFTWGIPVSFDEKHVIYVWIDALSNYITALGYGQENQELYKKFWPADVHLIGKDILRFHTIYWPIMLMALGLELPKQVFGHGWLLVDGGKMSKSKGNVVDPVVLVNMFGADAVRYYLLREIPFGSDGLFNNEIFIKKVNTDLANDLGNLLSRTIAMVYKYFGGVIQAPTCKEPIDDELINLALSTPGKVEASIDALKIPEALESIWTLISRANKYIDETTPWILAKDEEKKERLGTVLYNLLETLRFVSVMISPFLTETSVKINAQLNTKVTTWESLKEFNGTVAGDKVVKGDVIFPRIDVEEKLAELEALKPAPVKPANEELVENPIKEEITIDDFDKIDLRVVKVLECEPVKKAKKLLKLKVDLGGEERQVISGIAQYYKPEELVGKYVVLVANLKPVKLRGELSQGMILAAAPSDDSELLLVNPGEMLTGSQVR

SEQ ID NO: 25071 - DNA, 1926 bp, Clostridium tetani
  CDS (1)..(1926)
atgaataaaaaaactttttacattactacaccaatatactatccatcagctaaattgcatattgggaatacttatactacagttgcagcagatgcattagctaggtttaaacgattaactgggcatgatgtattattcttaactggaacagatgaacatgggcaaaagattcagagggtagcggaagaaaagggattaaaacctaaagagtatttagataatatggttgacagcataaaagaattatggaaatcaatgaatataagctacgataaatttataagaactacagatgattatcatatagaatctgtacaaaaaatattcaaaaagttatacgaacaaggagatatatacaagggtgaatatgaaggatggtattgtacaccttgtgaatctttctggacagaatcacaactagatgatcacaattgtcctgattgtggaaggcctgtagaaaagacaaaggaagaagcatatttcttcaagatgtctaaatatgcagatagactaattaaatatatagaagaaaatccccattttatacaaccagaatcaagaaaaaatgaaatgttaaataattttttaaaaccagggttgcaagatttatgtatttcaagaacctcatttgactggggtatacctgtaagctttgataataagcatgttatatatgtttggatagatgctttatctaactatataacagcattaggatacaatagtgataatcaagaactattagaaaagttttggccagcaaatgtacatttagttggaaaagatatattaagattccatacaatatattggcctattatgcttatggcattgggaattgaactaccaaagcaagtatttggtcatggatggcttttagttgatggtggaaaaatgtctaaatcaaaagggaatgttgtggatccagttgttttagtagatcattttggtgaagatacagttagatattatcttttaagagaaatcccatttggatcagatggattatttaataacgaattattcataaagaaaataaattctgatttagcaaatgacttaggaaacttactttcaagaactgtagctatggtacaaaaatatttcaacgggataatgccagcacctatagccaaagaacctattgacgatgaacttataaatttagctttagatactagagaaaaagttgaaaataatatggaaaaattaaaaataccagaagtattagatgagatttggacacttataggaagagcaaataaatatatagatgaaacgactccttggatacttgctaaagatgaagataaaaaggacagactaggaactgtattatataatctatcagaaactttgagaatcatttcagttcttatatctgcattcataccaaagactagcgaaagaataaatgaacaattaaatgtagatttaactacttgggatagtatagcttcctttgatggcactaaggctggtacaaaagtagtaaaaggtgatgcattattcccaagaatagatgtagaagctaaaattgaagaacttaatagtctaaaagagaagaaggaaaagaaagaaattaaacctataaaagaagaaataactatagacgattttgataaaattgacttaagagtagtaaaggtaatttcttgtgagccagtaaaaggtgcaaagaaacttttaaaattaaaagtggatttaggtggagaagaaagacaagtaatttcaggaattgctcaatattataaaccagaagaactagtaggtaagtctgtggttttagttgcaaatttaaagccagcaaaattaagaggagaattatcccaaggaatgatattagcagctgctacagatgatgatagtaagttatttactgtgagtattccaggtgaactaccaacaggaagtcaagttagataa

SEQ ID NO: 25072 - protein, 641 aa, Clostridium tetani
MNKKTFYITTPIYYPSAKLHIGNTYTTVAADALARFKRLTGHDVLFLTGTDEHGQKIQRVAEEKGLKPKEYLDNMVDSIKELWKSMNISYDKFIRTTDDYHIESVQKIFKKLYEQGDIYKGEYEGWYCTPCESFWTESQLDDHNCPDCGRPVEKTKEEAYFFKMSKYADRLIKYIEENPHFIQPESRKNEMLNNFLKPGLQDLCISRTSFDWGIPVSFDNKHVIYVWIDALSNYITALGYNSDNQELLEKFWPANVHLVGKDILRFHTIYWPIMLMALGIELPKQVFGHGWLLVDGGKMSKSKGNVVDPVVLVDHFGEDTVRYYLLREIPFGSDGLFNNELFIKKINSDLANDLGNLLSRTVAMVQKYFNGIMPAPIAKEPIDDELINLALDTREKVENNMEKLKIPEVLDEIWTLIGRANKYIDETTPWILAKDEDKKDRLGTVLYNLSETLRIISVLISAFIPKTSERINEQLNVDLTTWDSIASFDGTKAGTKVVKGDALFPRIDVEAKIEELNSLKEKKEKKEIKPIKEEITIDDFDKIDLRVVKVISCEPVKGAKKLLKLKVDLGGEERQVISGIAQYYKPEELVGKSVVLVANLKPAKLRGELSQGMILAAATDDDSKLFTVSIPGELPTGSQVR

SEQ ID NO: 25073 - DNA, 2034 bp, Enterococcus faecalis
  CDS (25)..(2034)
atgactaaaggaggttttttctgtatgtcacagaaagaaacattttatattaccaccccaatttattacccaagtgggaagttacatattgggaattcatatacaacaatcgcctgcgatgcaatggcccgttacaagcgtttaatgggttttgatgtattttatttaacaggtgtggatgaacacggccaaaaaattgaaaaaaaagctgctgagttgaatgtgacaccaaaagagtacgttgataaaatggcagcagatgttcaaaaattatggaaaacattagatatcagctatgataaatttattcggacaacggatgattatcacatggcagccgtgcaacaaatttttgatcgtttagtagaacaaggagatatctaccttggagaatatgaaggttggtattcagtttctgatgaagaatttttcactgaaacacaattagctgaagtatatcgtgacgatgaaggcaatgtcattggtgggaaagcaccaagtggtcacgaagtcgaattagttaaagaagaatcctatttcttccgcatgagtaaatatgcggatcgcttggtacaatattacgaagaacatccagaatttattcaaccagaatctcgtaaaaatgagatgctaaataacttcatcaaaccaggattggaagatttagccgtttcaagaacgactttctcttggggaattccattaaaaaatgatccaaaacatgtggtttacgtatggattgatgcgttatcaaactatattacagcactaggttatggctcagaagatgattcattattccaaaaatattggcctgcgaacgtgcaaatggttgggaaagaaatcgtgcgtttccatacgatttattggccaattatgttaatggccttggatttaccattaccgaaaaaagtctttggacatggttggttattgatgaaagacggaaaaatgtctaaatctaaaggaaatgttgtttaccctgaaatgttagtagaacgctacggtctagatgcgttacgttattatttattacgagcaattccatttggtagtgatggcgtctttacaccagaagatttcgtttctcgcttaaattatgatttagctaatgacttaggaaacttgttgaatcgaacaattgcgatgattaataaatattgtgatggcaaagtaccagcctatgcttcaaaagttaccccatttgatagtgaactatcgacaactgcggcgaatgttattggaaaatatcatgaagcaatggaaaaaatggaatttaacacggccattgcagaaatctggacgctagtttctcgtgccaataaatatattgatgaaacagcgccttgggtattggctaaagaagaagagaaacgcaacgaattagaaagtgtcatgatccatttagcggaaagcttacgaattgtggcaatcttattgcaaccagtcatgacagaaacaccagggaaaattttcgaacaattaggcttagatccagaaacaatgaacatggaaaatattcattttggtgagttcccaacagacgtaacagtaacaagtaaaggaacacctattttcccacgtttagaaattgaaacagaagtaacgtatattcaaaagaaaatgtcccaaagcgaaagtgctacagaagaggatattaaatggaatccagaagaaacaacgttggtttcaacgaaagaaaaacaaattaagtacgatgatttcgataaagtggaattaaaagttgccgaagttattgactgtaaaaaagtcaaaggagcagataaattattgcaattccgtttagatgctggagatgaaaaccatcgtcaaattctttcaggtattgctgaattttatccagatccagctgcgctaattggcaaaaaagtagtcattgtggctaacttaaaaccaagaaaaatgcgtggtcaaattagccaaggaatgattctttcagctgaatcaccagaagggaaacttcaaattgttgaagcaccaaaagaaatgccaaatggtgcaggaatcgcatag

SEQ ID NO: 25074 - protein, 669 aa, Enterococcus faecalis
MSQKETFYITTPIYYPSGKLHIGNSYTTIACDAMARYKRLMGFDVFYLTGVDEHGQKIEKKAAELNVTPKEYVDKMAADVQKLWKTLDISYDKFIRTTDDYHMAAVQQIFDRLVEQGDIYLGEYEGWYSVSDEEFFTETQLAEVYRDDEGNVIGGKAPSGHEVELVKEESYFFRMSKYADRLVQYYEEHPEFIQPESRKNEMLNNFIKPGLEDLAVSRTTFSWGIPLKNDPKHVVYVWIDALSNYITALGYGSEDDSLFQKYWPANVQMVGKEIVRFHTIYWPIMLMALDLPLPKKVFGHGWLLMKDGKMSKSKGNVVYPEMLVERYGLDALRYYLLRAIPFGSDGVFTPEDFVSRLNYDLANDLGNLLNRTIAMINKYCDGKVPAYASKVTPFDSELSTTAANVIGKYHEAMEKMEFNTAIAEIWTLVSRANKYIDETAPWVLAKEEEKRNELESVMIHLAESLRIVAILLQPVMTETPGKIFEQLGLDPETMNMENIHFGEFPTDVTVTSKGTPIFPRLEIETEVTYIQKKMSQSESATEEDIKWNPEETTLVSTKEKQIKYDDFDKVELKVAEVIDCKKVKGADKLLQFRLDAGDENHRQILSGIAEFYPDPAALIGKKVVIVANLKPRKMRGQISQGMILSAESPEGKLQIVEAPKEMPNGAGIA

SEQ ID NO: 25075 - DNA, 1911 bp, Fusobacterium nucleatum
  CDS (1)..(1911)
atgaaaaagaatttttttgtaagtacaccaatatattatgtaaatggtgatcctcatgtaggaagtgcatatacaacaatagcagcagatgttataaatagatacaataaagccatgggaatggatacgcattttgtaacaggacttgatgaacatgggcaaaaagtggaacaagctgctaaacaaaacggttttactccacaagcctggacagataaaatgactcctaattttaaaaatatgtgggctgctttagatataaaatatgatgattttataagaacaacagaagatagacataaaaaagcagtaaaaagaattttagatattgttaatgcaaaaggtgatatatacaaaggggagtatgaaggaaaatattgtgtttcttgtgaaactttcttccctgaaaatcaattaaatggaagcaataaatgccctgattgtggaaaagatcttacagttttaaaagaagaatcttatttctttaaaatgtcaaagtatgcagatgctttattaaaacatatagatgaacaccctgattttatattgcctcattctcgtagaaatgaagtaatttcttttattaagcaaggtttacaagatttatctatatcaagaaacacattttcttggggaatcccaatagattttgcacctggtcatattacctatgtttggtttgatgctttaacaaactatattacatcagctgggtttgaaaatgatgagaataagtttgataaattttggaataattcaagagtagttcatttaataggaaaagatataataagattccatgctattatttggccttgtatgcttttgtcagctggaattaaactaccagatagtatagttgcacatggttggtggacatcagaaggagaaaagatgtcaaaatcaagaggtaatgttgtaaatccttatgatgaaattaaaaaatatggagtagatgcttttagatattatcttttaagagaggctaactttggaactgatggagattattctacaaaaggtataataggaagattaaattcagatttggcaaatgacttagggaatttattaaatagaacattaggaatgtataaaaaatattttaatggaacaatagtttcatcttcaactgttgaaccaattgatgatgaaattaaatctatgtttaatgatgtagttaaagatgttgaaaaatatatgtatctatttgaattttcaagagcattagaaactatttggaaatttatttcaagattaaataaatatatagatgaaactatgccttggactttagcaaaaaatgaagctaaaaaggctagacttgctgctgttatgaatattttatgtgaaggactatataaaatagcatttttaatagctccatatatgccagagtctgctcaaaaaatttcaaatcaattaggtatagacaaagatataactaatttaaaatttgatgatataaaagaatggagtatttttaaggaaggacataagcttggagaagcaagcccaatatttccaagaattgaaattgaaaaggaagaaatagttgaaactaaaaaagaattaaaaattgaaaatccagtagatattaaagaatttaataaaattgaaattaaagttgttgaaattttagatgttgataaggttgaaggagcagataaacttcttaaatttaaagtttttgatggagaatttgaaagacagataatttcaggacttgcaaaattctatccggattttaaaaaattaattagtgaaaaagttttagcagttgttaacttaaaattcactaaattaaaaggtgaaatatcacaaggaatgttacttacaacagaagataaaaatggagtttctttaataaaaattgataaaactgttgaagcaggagcgattgttagttaa

SEQ ID NO: 25076 - protein, 636 aa, Fusobacterium nucleatum
MKKNFFVSTPIYYVNGDPHVGSAYTTIAADVINRYNKAMGMDTHFVTGLDEHGQKVEQAAKQNGFTPQAWTDKMTPNFKNMWAALDIKYDDFIRTTEDRHKKAVKRILDIVNAKGDIYKGEYEGKYCVSCETFFPENQLNGSNKCPDCGKDLTVLKEESYFFKMSKYADALLKHIDEHPDFILPHSRRNEVISFIKQGLQDLSISRNTFSWGIPIDFAPGHITYVWFDALTNYITSAGFENDENKFDKFWNNSRVVHLIGKDIIRFHAIIWPCMLLSAGIKLPDSIVAHGWWTSEGEKMSKSRGNVVNPYDEIKKYGVDAFRYYLLREANFGTDGDYSTKGIIGRLNSDLANDLGNLLNRTLGMYKKYFNGTIVSSSTVEPIDDEIKSMFNDVVKDVEKYMYLFEFSRALETIWKFISRLNKYIDETMPWTLAKNEAKKARLAAVMNILCEGLYKIAFLIAPYMPESAQKISNQLGIDKDITNLKFDDIKEWSIFKEGHKLGEASPIFPRIEIEKEEIVETKKELKIENPVDIKEFNKIEIKVVEILDVDKVEGADKLLKFKVFDGEFERQIISGLAKFYPDFKKLISEKVLAVVNLKFTKLKGEISQGMLLTTEDKNGVSLIKIDKTVEAGAIVS

SEQ ID NO: 25077 - DNA, 2052 bp, Lactobacillus plantarum
  CDS (1)..(2052)
atggcagaaacaaaaccaacttattatattacgacgccgatctactatccttcggggaagttgcacatcggtaattcatacacgacaattgcgtgtgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatgacaagtttattcggaccaccgatgattatcatgaacgcgcggtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagccaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactctgaagacttgtttaacaagttctggcctgccgatgttcaaatggttggtaaagaaatcgtgcgcttccatacgatttactggccaattattttgcatgcactcgggttaccattacctaagaaggtttttggtcatggttggttattgatgaaggacggcaagatgtccaagtctaagggtaacgtgatttatcctgaaacattggttgaacgttacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattaccagcattcaaagccggtgtgactgaatttgacgctgacttagaagccacagctgccacgactattaagaacttcaacgcttgcatggacagcctgcatttatcggatgcgctggctgaagtgtggaagttggtcagtcggacgaacaagtatattgatgaaacggcaccttggcaattagctaagagtgacgatgcgaatgatgctgataagttagccagtgtgatggcccatttagcagctagtttgcgggtgattgctagtttgatcagtccggtcatgacgcatgcacctaaggaaatctttacccaattagggttggacccagcaactttagcaattgccgacttacaactggctgatttgccggctggcgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcaattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaaccggaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggatcattgatttcgtaa

SEQ ID NO: 25078 - protein, 683 aa, Lactobacillus plantarum
MAETKPTYYITTPIYYPSGKLHIGNSYTTIACDTLARYKRAMGYDVYFLTGTDEHGLKIEEKAEKLNTDPKSYVDGMAKQIKDLWQLLEISNDKFIRTTDDYHERAVQEIFDRLLKNGDIYLGEYEGWYSVDDEEYFTETQLAEVFRDDNGKVIGGKAPSGHEVELVKEQSYFFKMSKYADWLLDYYQSHPDFIEPANRMTEMINNFIKPGLEDLAVSRTSFTWGVPVKSDPKHVVYVWIDALTNYITALGYATGDSEDLFNKFWPADVQMVGKEIVRFHTIYWPIILHALGLPLPKKVFGHGWLLMKDGKMSKSKGNVIYPETLVERYGLDALRYYLVKAMPYGNDGLFTPEDFVARVNYDLANDLGNLLNRTIAMINKYEDGQLPAFKAGVTEFDADLEATAATTIKNFNACMDSLHLSDALAEVWKLVSRTNKYIDETAPWQLAKSDDANDADKLASVMAHLAASLRVIASLISPVMTHAPKEIFTQLGLDPATLAIADLQLADLPAGAQVVAKGTPIFPRVDMDAEVEFLKGKMTKSDKQKGRKAMENAKHEAEVEQGWNPAETNLNLTKPAITIDDFDKVELKVAEVITVQKLKGADKLLQFRLDAGDADHRQILSGIAKWYPEPEELIGKKVIIVGNLKPRKLRGEMSQGMLLSAEHDGQVQLITVPDNMVNGSLIS

SEQ ID NO: 25079 - DNA, 2139 bp, Methanosarcina acetivorans
  CDS (1)..(2139)
atggagataagaatgtcagactcatccagtaaacccgtacttgtcacctgcggcctgccttatgccaacggcaaggcccatatagggcatctccgaacctatgtgcccgccgatatttttgcccgttccctgcggaaggaagggagggaagttacctttgtctgcggctcggatacccacggcactccaattgtcgtaaacgccgaggagctggggatcacccctaaagaacttgtagagatctatcataagcactttgacgaaactttcaagcagctcggagtttactttgatgctttcgggacaaccgatgaccctgaaaatcataaccggactctggatattgtaaacaggctgattgaaaaggactatgtgtacccgaaaattatagaaatagcctactgccctgcatgtaaccgcttccttcctgaccgctatgtggaaggagcctgcccgcactgtggcgaaacagcccggggtgatgaatgcgaccagggatgcggaaaacaccttgagcccggagaacttcagaaccctgtatgcactatctgcggaggacctgcagagtaccggcatcaggaacacttctttttcaaactttccgagttcggcgactacctgatggattacctttcaaacgacctgggaggcaccaccaatgctcgaaactacgcacttggctgggtaaaacagggacttacggactggtgcatcacaaggaacctggaatggggagttagatttccgggacatgaagaccttgtggtttacgtctgggtagacgctcccataggatacatcgcttttaccgaggaatgggctgcacaggcaggagactcctgggaaaagttctggaagggagaaggggaaatcgtccactttatcgggggggacattacctaccaccactgcatcttctggcctgccatgcttaacggggcggactattccgtgcctacggctgttgtagcctcaggtatggttaaaatcgaagacaaaaagttttccaagactcgtggctatgttgtctgggtaggggaagactatcttgaccacggcttccatcccgacctcctgaggtattaccttgcaagctacacctcccataccaaggaacttaacttctcctggcgcgtgctccaggaaaagatcaacgccgaactggtggccgtactcggcaacttcctgtacaggaccatgctctttgctttcaagaactatggagaagtccccgaaggaaaactcgaacctgaagtaagcgcagaaatcgaagaagccctgaaagaagtaaaagaggcaatggctgagtacgagtttaagaaagccgtggattctgccatggcccttgcgtctttcgggaacacatacttccagtcccacgagccctggaaactaataaaagaagacagatccgcatgtggacaggttatctataattgcctccacctggcaaaagccctgagcctcatattcgaacccgtgctcccgcagaccatggaaacagcctggaaagggctcgggcaggaaagcgatatccatgcctcacggtacgaagaagcccttgtgcccctgaaggcaggcacaaaacttgcaaagcctgagcttctctttaccaaactcgaagacgacaggatcggagagatggaagagattgcaaaccagagggtgaaagccgcaaacgcaaaaaaatccgcagcaaagggaggcgagaaagagccttctaagtctgaagggatggggccttcggaagaggcaaaagtagccgaaaaggcggcaaaagctgaagaaaaggtgccaatcgaaacccttccccagattgagtatgaagactttgccaagcttgacatcagggtagggaaggtgctctttgtcgaacctgtaaagaagtccagaaaactcctgagggttgaagtggatatcggagaagaaaagccaaggcagcttgtagcaggcatggcttcgtactacacttccgaagagctcgtaggcaaatatgtagttgtgcttgccaaccttaaacccgccaaactttgcggggttgagtcaaacggcatgatgctcgcagccgatgacggcggggcgattgtagcagctcttatgccggacaaagaaatcaagccgggttccagaattaggtaa

SEQ ID NO: 25080 - protein, 712 aa, Methanosarcina acetivorans
MEIRMSDSSSKPVLVTCGLPYANGKAHIGHLRTYVPADIFARSLRKEGREVTFVCGSDTHGTPIVVNAEELGITPKELVEIYHKHFDETFKQLGVYFDAFGTTDDPENHNRTLDIVNRLIEKDYVYPKIIEIAYCPACNRFLPDRYVEGACPHCGETARGDECDQGCGKHLEPGELQNPVCTICGGPAEYRHQEHFFFKLSEFGDYLMDYLSNDLGGTTNARNYALGWVKQGLTDWCITRNLEWGVRFPGHEDLVVYVWVDAPIGYIAFTEEWAAQAGDSWEKFWKGEGEIVHFIGGDITYHHCIFWPAMLNGADYSVPTAVVASGMVKIEDKKFSKTRGYVVWVGEDYLDHGFHPDLLRYYLASYTSHTKELNFSWRVLQEKINAELVAVLGNFLYRTMLFAFKNYGEVPEGKLEPEVSAEIEEALKEVKEAMAEYEFKKAVDSAMALASFGNTYFQSHEPWKLIKEDRSACGQVIYNCLHLAKALSLIFEPVLPQTMETAWKGLGQESDIHASRYEEALVPLKAGTKLAKPELLFTKLEDDRIGEMEEIANQRVKAANAKKSAAKGGEKEPSKSEGMGPSEEAKVAEKAAKAEEKVPIETLPQIEYEDFAKLDIRVGKVLFVEPVKKSRKLLRVEVDIGEEKPRQLVAGMASYYTSEELVGKYVVVLANLKPAKLCGVESNGMMLAADDGGAIVAALMPDKEIKPGSRIR

SEQ ID NO: 25081 - DNA, 2007 bp, Methanopyrus kandleri
  CDS (1)..(2007)
atggggaaggtactcgtaactacggccttggcgtacaccaacggcccactccacatcggccacgttaggagcacgtacctccccgccgatgtgtacacgaggttcctcaagatgcgtggtatcgacgctatacatatcggcgggactgacaaccacggggtcccgatagcgctacaggccgagctcgaggggaaggatcccgaggagatcgtggaaaaataccacgagatgatcaaagaggacttagagcgattgaacatccacttcgacgagttctcatgcacctgccgcgagttcaatcctgaccacgtggatatgacacaatggtttttcaagaggttgtacgaagcggggtacatagaggagagggaggtcgaacaactctactgtcctgagtgcgaaaggccccttccggacaggtacgtcgaaggagtatgcccctactgcggtgctgaaggtgcccgaggcgaccattgcgaggcctgcggtcgctacctggagcccgtacaactcgaagagccgaggtgtgtcatctgtggatcgaagccagaggtccggcgcactatgcacctgttcttcaagcttagcgaattcgaagaagatctgaagaagtggttagagtccaacgacaatctgcctaagaacgtgcgtaattatgccatccaatgggttcgtgaaggactcaaggattgggatatagtgcgtgatctagactggggagtacccgttcccctggaaggatacgaagataaggtgttttatgtttggttcgatgctcctataggatacgtaacgttcacgaaacaatactgtgatagggtaggtcaagactggaaagactactggtttagtgaagatacgaaaatagttcacttcatcggtaaggacataatagtccatcacgccctgttctggccggccatgctcatgggcgtcggagcgactctcccatacactatcgtggctggcgagtatttgaccttagaaggagaaaagatgagtacaagtcgtggttgggtagtgtgggtcaaagacttcaccaagctgttccctgcggatctgctacgatactacctcatagtggtgagcccgctcaccagggatgcggatttctcgtggggagacttccgggaccgtgtgaacaacgaattagtggctaacttaggtaactttgtgtatcgcacgctatcgtttatttatagattcttagacggaaacgttcccgaagccgagactgaccaggagatagtcgataagataaaagaaactcaccagcgtgtgacggaacatctggagaagttccgattcagggaggcgctcacagaggtattacgtctatctaagtttgggaatgagtacttccaagaacacgagccgtggaaacttaaggatgaagatccagagcgttgtgccgaagttctacgtgggtgcgctagaattgtgaaagcgctagctgtaatgttagccccgttccttccggatagtgcggagaagatttggcagagtcttggttacgaagactccgtacatgacgtcgattgggaagaagccttggaggacgtagagactaaggagataccggagcccgagcccattttcccgaaggtaacggaggaggaccttgagaaagctaaggcgttactgccggaagaatcaggagagtccgaagggcaggacgacgagtacgtatcgctcgaggaattcaatcgattagacctgcgggtaggcaagatcaaagaagcggaacgtgtcgagggctctgatcgactcatcaagctccggatcgatatcggagatcgtaccgtaacagcagtagccggactgtatcctacgtatgagccagaggagctcgtcggacgtaaggtggttgtactagccaacatccaacccaaagagatgttcggcgtacggtcggaagcgatgatcctggccgttggggacgaacccgcattgttgactatcgacgagagtaagagggaagtggagcccggagagcggatcagatga

SEQ ID NO: 25082 - protein, 668 aa, Methanopyrus kandleri
MGKVLVTTALAYTNGPLHIGHVRSTYLPADVYTRFLKMRGIDAIHIGGTDNHGVPIALQAELEGKDPEEIVEKYHEMIKEDLERLNIHFDEFSCTCREFNPDHVDMTQWFFKRLYEAGYIEEREVEQLYCPECERPLPDRYVEGVCPYCGAEGARGDHCEACGRYLEPVQLEEPRCVICGSKPEVRRTMHLFFKLSEFEEDLKKWLESNDNLPKNVRNYAIQWVREGLKDWDIVRDLDWGVPVPLEGYEDKVFYVWFDAPIGYVTFTKQYCDRVGQDWKDYWFSEDTKIVHFIGKDIIVHHALFWPAMLMGVGATLPYTIVAGEYLTLEGEKMSTSRGWVVWVKDFTKLFPADLLRYYLIVVSPLTRDADFSWGDFRDRVNNELVANLGNFVYRTLSFIYRFLDGNVPEAETDQEIVDKIKETHQRVTEHLEKFRFREALTEVLRLSKFGNEYFQEHEPWKLKDEDPERCAEVLRGCARIVKALAVMLAPFLPDSAEKIWQSLGYEDSVHDVDWEEALEDVETKEIPEPEPIFPKVTEEDLEKAKALLPEESGESEGQDDEYVSLEEFNRLDLRVGKIKEAERVEGSDRLIKLRIDIGDRTVTAVAGLYPTYEPEELVGRKVVVLANIQPKEMFGVRSEAMILAVGDEPALLTIDESKREVEPGERIR

SEQ ID NO: 25083 - DNA, 2148 bp, Methanosarcina mazei
  CDS (1)..(2148)
atggagataagaatgtcaaaatcatccagtaaacccgtacttgtcacatgcggcctgccctatgccaatggcaaggcacatatcgggcatctccggacctatgtgcccgctgatatttatgcccgttccctgaaaaaagaggggagggaagtaacctttgtttgtggctcggacacccatggaacccctattgtcgtaaacgccgaagaactgggaattaccccaacagaacttgtagaaatatatcacaaacactttgacgaaactttcaagcagcttggaatttattttgatgctttcgggacaacggatgatcctgaaaaccacaaccggacccacgacatagtgagcaggctgattgaaaaaggatatgtctacccgaaaattatagaaatcgcctactgtccggcatgcaaccgcttccttcctgaccgttatgtagaaggagcctgccctcactgcggagaaactgccagaggagatgaatgcgaccagggctgcggaaaacatcttgagcccggggagcttcagaaccctgtatgtaccatctgcggaggccctgcagagtaccgccagcaggaacacttctttttcaagctttccgagttcagcaactacctgatggattacctctcaaaagacctcggagggaccacaaatgccatcaactacgcacgcggctgggtaaagcaggggcttacggactggtgcattacacggaaccttgagtggggagttaaattcccgggacacgaagaccttgtggtttatgtctgggtggacgctccgataggttatatcgcttttaccgaggaatgggctgcacaggcaggagactcctgggaaaagttctggaagggagacggggaaatagtccactttataggaggggacataacctatcaccattgcatcttctggcctgccatgcttaaaggcgcagattactccgtgccaacagcagttgtagcttcagggatggtaaaaatcgaagacaggaagttctcgaaaaccagaggctatgtagtctgggttggggaagactatcttgaccacggcttccatcccgaccttctcaggtattaccttgcaagctatacctcccacaccaaggaactgaacttctcctggcgcgtgcttcaggaaaagatcaatgccgaactggttgcagttctcggaaacttcctttacaggaccatgctctttgctttcaagaactacggagaagtcccggaaggtgaagtagagcctgaaatccggaaagagatagaaaaagctctcgtagaggtcaaagctgcaatggaagagtacgagttcaagaaagcagtggactctgccatggctcttgcatctttcggtaacacttatttccagtcccatgaaccctggaaactgataaaagaagacagggatgcatgcggacaggtcgtctataactgcctgcacctggcaaaagccctgagcctgatatttgaacccgttatcccacagacaatggagaaagcctggaaagggctagggcacgagagcgacatacatgccgcactttatgaagagacccttgtgcccctgaaagcaggcacaaaacttgcaaaacctgaaatcctctttaccaagctcgaagatgacaggataggagagatggaagagattgcaaaccagcgtgtagcagccgcaaatgcaaagagaaacggagtaaaaggaggcgaaaaagagccttcaaagtccgaaggaatgggaccctctgaagcatcaaaagcatccgaaaaaacagtagatgttgcaacagcagaagagaaagtacaggtagaaacccttccagtgatcgattacgaggactttgcaaaacttgacataagggtaggaaaagtactcctcgtcgaacctgtgaaaaagtcaaaaaagctcctgaggattgaagtggatataggagaggaaaagcccaggcagcttgttgcaggcatggcttcatattacactccagaagagcttgtaggcaaatccgtaatcgtactcgccaacctgaaacctgccaaactctgtggagttgagtcaaacggtatgatgcttgcagccgatgacggcggagcaattgtggcagccctgatgccggataaagagattaagtcgggttcaaggataaggtaa

SEQ ID NO: 25084 - protein, 715 aa, Methanosarcina mazei
MEIRMSKSSSKPVLVTCGLPYANGKAHIGHLRTYVPADIYARSLKKEGREVTFVCGSDTHGTPIVVNAEELGITPTELVEIYHKHFDETFKQLGIYFDAFGTTDDPENHNRTHDIVSRLIEKGYVYPKIIEIAYCPACNRFLPDRYVEGACPHCGETARGDECDQGCGKHLEPGELQNPVCTICGGPAEYRQQEHFFFKLSEFSNYLMDYLSKDLGGTTNAINYARGWVKQGLTDWCITRNLEWGVKFPGHEDLVVYVWVDAPIGYIAFTEEWAAQAGDSWEKFWKGDGEIVHFIGGDITYHHCIFWPAMLKGADYSVPTAVVASGMVKIEDRKFSKTRGYVVWVGEDYLDHGFHPDLLRYYLASYTSHTKELNFSWRVLQEKINAELVAVLGNFLYRTMLFAFKNYGEVPEGEVEPEIRKEIEKALVEVKAAMEEYEFKKAVDSAMALASFGNTYFQSHEPWKLIKEDRDACGQVVYNCLHLAKALSLIFEPVIPQTMEKAWKGLGHESDIHAALYEETLVPLKAGTKLAKPEILFTKLEDDRIGEMEEIANQRVAAANAKRNGVKGGEKEPSKSEGMGPSEASKASEKTVDVATAEEKVQVETLPVIDYEDFAKLDIRVGKVLLVEPVKKSKKLLRIEVDIGEEKPRQLVAGMASYYTPEELVGKSVIVLANLKPAKLCGVESNGMMLAADDGGAIVAALMPDKEIKSGSRIR

SEQ ID NO: 25085 - DNA, 2022 bp, Oceanobacillus iheyensis
  CDS (1)..(2022)
atggcaagagaaaatgcattttatataaccacgccaatatactatcctagtggaaaattacatattggaaatgcgtacacgacaatcgcttgtgatgtaatggcacgttataaacgcatgcgtggattcgatgttttttatttaacaggtagtgatgagcatggacaaaaaatcgaacaaaaagcgaaagagatgaatatttctccgaaagcctatgtagatgatatggctgaaggaatgaaaaagttatggaatacattagaaattagtaatgataagtttattcgcacaacggaagaacaacataaaaaagtagtagccgatatatttgaacgattcttagaacaaggtgatatttacttagatgaatatgaaggatggtattcggttcctgatgaaacattctatactgaaacacagttagaggatgtagaaagagatgacgacggtaatgttattggtggtaaatctccagatagtggacatccagtcgaattaattaaagaagaatcctatttcttccggatgagtaaatatgccgatcgtttgttgaaattttatgaagacaacccggaatttattcaaccagaatctcgaaaaaatgaaatgattaataactttattaaaccaggtttagaggacctagccgtttctcgtacaacattcagctggggtgtacaagttccgagtaacccaaaacacgttgtatacgtctggattgatgcgcttaccaactatatcacagcattaggttatggctcagaagacacatccctttatgacaagttttggccagcggatgtgcatatggttggaaaagagattgtacgattccatacgatttattggccgattatgctaatggctctagacttacctttaccaaaaaaagtctttgcacatggctggcttttaatgaaggatggaaaaatgtcgaaatcaaaagggaatgtcgtatatcctgaaatgcttgtcgaacgttatggtctagatgctttacgttactacctcatgcgtgaagttgcctttggaagcgatggcgtctttacaccggaagattttatttctcgtgtaaattatgacctagcaaatgacctcggaaacttattaaatcggacagtggcgatgattaataagtattttgatggaaaggttcctgaatttaaaggggaagtaacaagttttgatggcgagttacaaacaaccgcaaataatgcagtcaaagaatatgagaaacatatggaaggcatgcaatttagcgatgcattaaaacaagtgtggattttaatttcgagagcaaacaaatatattgatgaaacagaaccttggatagtagcaaaagatgaaggtcgcagaaatgaattagcaagtgtcatggttcatttagcggaaagtttacatgcagccgcgctaatgttacaaccattcctaactcatgcaccgaagaaaatcgcagagcaacttggtctaggagaagaatatgggctagattggggtacaatcggttttggcaatttcccagaaaatacaaccgtggttaagaaaggcacaccaatcttccctcgtcttgatttggatgaagaagctgcttatattcgtgatcaaatggcgaatggtgcaaacgcagcttcttcagaagatgagacgggcgactgggaccctaatgagacagaccttgtctctgaaaaagaaaaacagattaaatatgatgtgtttgataaggttgaactaaaagtagctgaagtgaaagactgtagtaaagtagagggcgcagataaactattaaaattccgattagatgctggagataatggagatcgacaaatactttccggcatcgctgaatattattcggaaccagagcaattaattggcaaaaaagttgtcatcgtcgctaatttgaagccacgtaaaatgcgtggagaaattagtcaaggtatgatattatcagcggaatacgacggcaaactacaaattgtagaagcaccaagtgaagcgcctaacggttcgtcaatttcttaa

SEQ ID NO: 25086 - protein, 673 aa, Oceanobacillus iheyensis
MARENAFYITTPIYYPSGKLHIGNAYTTIACDVMARYKRMRGFDVFYLTGSDEHGQKIEQKAKEMNISPKAYVDDMAEGMKKLWNTLEISNDKFIRTTEEQHKKVVADIFERFLEQGDIYLDEYEGWYSVPDETFYTETQLEDVERDDDGNVIGGKSPDSGHPVELIKEESYFFRMSKYADRLLKFYEDNPEFIQPESRKNEMINNFIKPGLEDLAVSRTTFSWGVQVPSNPKHVVYVWIDALTNYITALGYGSEDTSLYDKFWPADVHMVGKEIVRFHTIYWPIMLMALDLPLPKKVFAHGWLLMKDGKMSKSKGNVVYPEMLVERYGLDALRYYLMREVAFGSDGVFTPEDFISRVNYDLANDLGNLLNRTVAMINKYFDGKVPEFKGEVTSFDGELQTTANNAVKEYEKHMEGMQFSDALKQVWILISRANKYIDETEPWIVAKDEGRRNELASVMVHLAESLHAAALMLQPFLTHAPKKIAEQLGLGEEYGLDWGTIGFGNFPENTTVVKKGTPIFPRLDLDEEAAYIRDQMANGANAASSEDETGDWDPNETDLVSEKEKQIKYDVFDKVELKVAEVKDCSKVEGADKLLKFRLDAGDNGDRQILSGIAEYYSEPEQLIGKKVVIVANLKPRKMRGEISQGMILSAEYDGKLQIVEAPSEAPNGSSIS

SEQ ID NO: 25087 - DNA, 2850 bp, Oryza sativa
  CDS (44)..(2458)
gtccctcttttctccccaaccctaaacctccttcgtctaccccatggcgtcgccgccgccgccgccgccgcctccgaagctgccggtccccggccgccgcaacatcctcgtcaccagcgcgctgccctacgtcaacaacgtccctcacctcgggaacatcatcggctgcgtgctcagcgccgacgtattcgcgcgctactgccggctgcggggctacaacgtcatctacatatgcggcaccgacgagtacgggacggccaccgagaccaaggccatggaggagaagtgctcgcccaaggagatctgcgacaagtatcatgctgtccatagtgaggtttacaaatggtttgacataaagtttgacaagtttggacggacatcctctccccaacagactgaagtctgccaagcaattttccaaaagttgatggaaaacaattggctcacagaaaacaccatgcagcagctgtactgtgatacttgccaacgatttttagcggataggctcgtggaggggaaatgtccaactgaaggctgtaattatgaggcggcgcgaggtgatcagtgtgaaaactgcagcaaattgttgaatccaactgagctaattgatcccaagtgtaaggtctgtaagaatactccacgtgtccgtgacacagatcacttattccttgagcttcctcttttgagcgacaagttggtaaactatatcaatgaaacttctgtagctggtatgtggagtcaaaatgctattcaggcaacaaacgcatggctgaaggaaggtttgaagccacgctgtatcacccgagatctcaagtggggtgttcctgttccacatgagaaatataaggacaaggtgttctatgtttggtttgatgcaccgattggctatgtatctatcacagcttcctatacacctgattgggagaaatggtggaaggatcctgataacgtagaattgtttcagttcatgggtaaagataatgtgccatttcacacggtcatgttcccttctacattacttggaactggcgaaaagtggacaatgatgaagaccataagtgtgactgaatatttgaactacgaagcaggaaaattctccaagagccatggtattggagtctttggtaatgacgcgaaggatacaaatatacctcctgaagtgtggcgttactacttgcttacaaatcgtcctgaggtatcagatacactatttacttgggctgatttgcaagccaaattaaacagtgagttgttgaacaacttggggaatttcatcaaccgtgtgctcagttttgttgcaaaaccagcaggagccggatatgattccatcgtacctgatgctcctaacgctgagtcgcatccactgacaaaggcacttgctgagaaaactaataaatgggttgaacaatatcttgaagcaatggaaaaggttaaattgaaacaaggactgaagagcgctatgggcatttctagtgatggaaatgcatatctgcaagagagccagttttggaaactttataaggaagatccagcagcctgtgctgttgtaatgaaaacttcagttggtgtggtctatctccttgcctgtttgctggagcctttcatgccttcattttccaatgaagtgttgctgcaattaaatatgacccctgaagaaagcttgtctttctgtgacgataaaggagaaatcgccaaggcaaaaagaccttgggattttgtatcagcaggccacaaaataggaaagccttcacctctatttaaagaactgaaagatgaagaagtagagtccttcaggaataaatttgcaggcagccaagctgagaggagctcaaaagcacaagctgatgctgaagctaagaaggttgctgacaagctcaagggcacaaaattatctgatggaggtcaaaagaaggaacagaaaaaacaatcaggtggttcaaaatcaaagaatgcagaggtggatgtcacggtggcaaagttggatattcgagtggggcttatcaggaaagcacagaagcatccagatgctgattcgctgtatgtagaggagattgatgttggagaggaagcaccaagaacagttgttagcggccttgtcaaattcatccctcttgaagaaatgcagaaccggaaagtgtgtgttctctgcaatctgaaaccagtggcgatgcgcggtataaaatcacatgcaatggttctggctgcatcaaatgaggaccatacaaaggttgagctggttgagccaccagaatccgcagcggttggggagagggtgacctttgctgggtactctggagagcctgaggcgtctctcaacgcaaagagcaagacgtgggagaagctatcagctgacctgcacagcaacggcgagctcgtggcgtgctacaaggatgtacccttcacaacttcagctggagtttgcaaggtgaagtcgatagcgagtggagaaattcgctagcttggcgacgccctaacggtggggatatactcgagtgacttgtttgactgatttttatcggaattgctgctgtttctttatgatgaaaattttgatcctgccatttgaaaggtcttgtatttgacaactgccagtatcaagtattgtccgcatttgtgtcatcgtgattatgaagacgcatggataaccgtttgtttcccttgtaatgttgtagacttcttgtagtaaccttttacaattcgtcgtacccctcatgtcttcaatcgtgtcgtcgtgtgcgttggacgtgtcaggagcacagttgggctgaatatgtgctgattggccacgttccaaaccaggccaggcctgtttattcccaaacaaaaattattcaccttgtcaaaaaaaaa

SEQ ID NO: 25088 - protein, 804 aa, Oryza sativa
MASPPPPPPPPKLPVPGRRNILVTSALPYVNNVPHLGNIIGCVLSADVFARYCRLRGYNVIYICGTDEYGTATETKAMEEKCSPKEICDKYHAVHSEVYKWFDIKFDKFGRTSSPQQTEVCQAIFQKLMENNWLTENTMQQLYCDTCQRFLADRLVEGKCPTEGCNYEAARGDQCENCSKLLNPTELIDPKCKVCKNTPRVRDTDHLFLELPLLSDKLVNYINETSVAGMWSQNAIQATNAWLKEGLKPRCITRDLKWGVPVPHEKYKDKVFYVWFDAPIGYVSITASYTPDWEKWWKDPDNVELFQFMGKDNVPFHTVMFPSTLLGTGEKWTMMKTISVTEYLNYEAGKFSKSHGIGVFGNDAKDTNIPPEVWRYYLLTNRPEVSDTLFTWADLQAKLNSELLNNLGNFINRVLSFVAKPAGAGYDSIVPDAPNAESHPLTKALAEKTNKWVEQYLEAMEKVKLKQGLKSAMGISSDGNAYLQESQFWKLYKEDPAACAVVMKTSVGVVYLLACLLEPFMPSFSNEVLLQLNMTPEESLSFCDDKGEIAKAKRPWDFVSAGHKIGKPSPLFKELKDEEVESFRNKFAGSQAERSSKAQADAEAKKVADKLKGTKLSDGGQKKEQKKQSGGSKSKNAEVDVTVAKLDIRVGLIRKAQKHPDADSLYVEEIDVGEEAPRTVVSGLVKFIPLEEMQNRKVCVLCNLKPVAMRGIKSHAMVLAASNEDHTKVELVEPPESAAVGERVTFAGYSGEPEASLNAKSKTWEKLSADLHSNGELVACYKDVPFTTSAGVCKVKSIASGEIR

SEQ ID NO: 25089 - DNA, 2049 bp, Pasteurella multocida
  CDS (1)..(2049)
atggcaaattcggcacgcgatattttggtcacttgcgccttaccttatgcaaatggtgcaattcatttagggcatttattagaacatattcaagcagatatttgggtgcgtttccaacgtatgcgtgggcataaagtgcattttatttgtgcagatgatgcgcatggcacaccaatcatgttaaatgcggataaattaggtattacaccagaagcattaattgctcgctcgaaagcggatcatgtggcggattttgaaggctttaatattagctatgataattatcattccactcacagcccagaaaatgaagccttaacagcagaaatgtataaaaaattacgtgctaatggctttattaaaagtcgtacgatttcacaattattcgatccagaaaaaggcatgtttttacctgatcgttttgttaaagggacttgcccaaaatgtaaagcagaagatcaatatggtgataactgtgaggtctgttcatccacttatagcccaacggaattaattaatccgcgttctgtggtttctggtgctactcccgtattaaaagaatcggagcatttcttctttgatttacctgcgtttgaaggcatgttaaaagcgtggatcaaatccggttcattacaacctgaaattgccaacaaaatgcaagaatggtttgagtcgggtttacaacaatgggatatttcccgtgatgcgccgtatttcggctttaaaattccggatacagaagataaatatttctatgtctggttagatgccccaattggatatatggcatcgtttaaaaatttgtgtgataaaacaggcttaaattttgacgatttctggaaaaaagacagctcggcagagctttatcacttcatcggtaaagatatcgtgtatttccacagtttattttggccggcgatgttagacggttgcgatttacgcaaaccaactaacgtgtttgcccatggttatgtgactgtaaatggggtgaaaatgtcaaaatctcgtggcacttttattcaagcgtccacctacttacgtcatttagcgccagaatatttacgttattactatgcggcaaaattgaataaccgtattgaagatttagacttaaatttggaagactttgtacaacgtttaaatgcggatgtggtgaataaatttgtcaatctggcttcacgcagtgccggttttatcacgaagcgttttgatggcaaattatcagctgagattgctgaacctgaattattggcagaatttgtggaaaaagccgcgcaaattgcgacttattatgaagaacgcgaattcggtaaagtcgtgcgtgaagtgatgcaattggcggataaagcgaataaatacattgatgacaaagcgccatgggtgatggcgaaagaagagggacgtgaggcggaattacaagctgtttgttcaatggcattgcaattattccgcgtcttagccatttatttaaaaccagtgattccacaaattattgcgcgtgcggaagccttcttacaggatgagttaacgtgggaaagcttaaatcgcccgctattaaatcacgcaattttaccgtttaaagcgttagcacagcgtttagacccaaaacagattgaggcaattgtgaacgaaaccaaagaacaatttgtagcccagcaggcattagagcaaaaaaattcagcaaaagcagaacccgctagccaagtggaaccaatcgcagagacgatcagcattgaagatttcgcgaaattagatttacgtgtggcgaaagtgatgaaatgtgaagcggtgccagaatcaaacaaactcttacgttttgagttagacttaggtgatcatacgcgtcaggtgttctctgggattaaagaagcatataacaatcctgcggaattagaagggcgttttgtggtggtgattgccaaccttgcaccacgtaaaatgcgttttggcgtatcagaagggatgattttaagtgcggggacaggtggagctgacttgttcttattgaatgccgatcaaggtgttaaacctggtatgcaggtaaaataa

SEQ ID NO: 25090 - protein, 682 aa, Pasteurella multocida
MANSARDILVTCALPYANGAIHLGHLLEHIQADIWVRFQRMRGHKVHFICADDAHGTPIMLNADKLGITPEALIARSKADHVADFEGFNISYDNYHSTHSPENEALTAEMYKKLRANGFIKSRTISQLFDPEKGMFLPDRFVKGTCPKCKAEDQYGDNCEVCSSTYSPTELINPRSVVSGATPVLKESEHFFFDLPAFEGMLKAWIKSGSLQPEIANKMQEWFESGLQQWDISRDAPYFGFKIPDTEDKYFYVWLDAPIGYMASFKNLCDKTGLNFDDFWKKDSSAELYHFIGKDIVYFHSLFWPAMLDGCDLRKPTNVFAHGYVTVNGVKMSKSRGTFIQASTYLRHLAPEYLRYYYAAKLNNRIEDLDLNLEDFVQRLNADVVNKFVNLASRSAGFITKRFDGKLSAEIAEPELLAEFVEKAAQIATYYEEREFGKVVREVMQLADKANKYIDDKAPWVMAKEEGREAELQAVCSMALQLFRVLAIYLKPVIPQIIARAEAFLQDELTWESLNRPLLNHAILPFKALAQRLDPKQIEAIVNETKEQFVAQQALEQKNSAKAEPASQVEPIAETISIEDFAKLDLRVAKVMKCEAVPESNKLLRFELDLGDHTRQVFSGIKEAYNNPAELEGRFVVVIANLAPRKMRFGVSEGMILSAGTGGADLFLLNADQGVKPGMQVK

SEQ ID NO: 25091 - DNA, 2175 bp, Pyrococcus furiosus
  CDS (1)..(2175)
atggtaagatatatggttacagccgctttaccgtatgctaatggaccaattcatgcggggcatttagccggagcttatttgccagctgatatttttgtaagatatctaaggctcaaaggagaagatgttgtgttcatatgtgggactgatgaacatggaactccaatttcttttagagcattaaatgagaagagaagtcccagggaaattgttgatgagtttcatgaacacataaaaacagcatttcagagggtcaagataagctttgattactttggaagaacggagcttccagttcactataggctaagtcaagaattcttcctgaaagctttagaaaatggctatcttgtgaagaaagtaacaaaacaagcatattgtgagcacgacaaaagatttcttccagatagattcgttattgggacatgtccatactgtggagcagaaaaccaaagaggagatcagtgtgaggtatgtgggagacctcttacgcctgaaattctaatagaacctagatgtgccttctgtaagaatccaataacctttagagaatccactcattactacataaaaatgcaggagtttgaagagaaacttaaagagtggataaaggagaaagattggaagccaaatgtaaagaatatggtgctgggatggatagaagaaggattggaagaaagagctataacgagagatctagattggggaattccagttcctttggatgaagaagacatgaagaataaagtgctgtacgtttggtttgaagctcctattggatatatttcacttacgatagaatacttcaagagaatcggaaaaccaaatgagtggaagaaatactggttgaatttagatggtcaaactagggttatccactttattggaaaagacaacataccattccacgcgatattctggccggcatttctcatggcctatggaaagtataaggatgaagaagttgaggcagaatggaatcttccctatgatatcccagcaaatgagtatttaacactagaaggaaagaagttctcaacaagcagaaactgggctatatggattcatgaattccttgatgtcttcccggcagattatcttaggtattatttgacctcaataatgcctgaaactagagattcagactttagctttgcagagttcaagacaaagatcaatgaggagcttgtcaatgttcttggcaactttgtgtacagagcgctaaccttcgttaacagatacttcgatggaatagttcctgaaagaggagagctagatgaattggataggcaagccttagaggaaattgaaaaaacgtttgaagaagttggcaagcttataagggagtacagatttaaagatgccttaaagaaggttatgaatctagcaggttttggcaacagatactttgattacaaagagccatggaagacaataaaggaggataaaacaagaacaggcactacaattaacatttccctacaaatagtgaaggccctgggaatattattagaacccttccttcccgatgcaagcgaaaagatatggcatttcctaaacctagaggaagttaaaacgtggagatttacagagctcccagctggacataaagtgagaaagcctgaaatattgttcaagaaagcatccgatgaccagataatttactttatccttaactacatgggaaggaacaatccagacgctgcaagagaattgctcgaaaagtattacaaacttgaagatgtggagaaagttgcaatagaaaaatttggagaagaggacggaagattcatgcttaagaaaatatttaaagagaaatacaagggagaaaaaaagggtgagcaaaaaatgcaatacgtaagctttgaggagttttcaaagattgatcttaggataggaaagatcgttgaagttcaagaccatccaaatgcagataagctttatgtggtaaaggtagatcttggaggggagattagaactctagttgcaggactcaaaaagtactataaaccagaagagttgctaaacagatatgttgttatagtggcgaacttagaacctaagaagctaagaggagttgagagccaaggaatgctactagccgcggatgatggtgagaaagttgcactgttaatgccagataaggaagtaaagctgggagcaaaagttaggtag

SEQ ID NO: 25092 - protein, 724 aa, Pyrococcus furiosus
MVRYMVTAALPYANGPIHAGHLAGAYLPADIFVRYLRLKGEDVVFICGTDEHGTPISFRALNEKRSPREIVDEFHEHIKTAFQRVKISFDYFGRTELPVHYRLSQEFFLKALENGYLVKKVTKQAYCEHDKRFLPDRFVIGTCPYCGAENQRGDQCEVCGRPLTPEILIEPRCAFCKNPITFRESTHYYIKMQEFEEKLKEWIKEKDWKPNVKNMVLGWIEEGLEERAITRDLDWGIPVPLDEEDMKNKVLYVWFEAPIGYISLTIEYFKRIGKPNEWKKYWLNLDGQTRVIHFIGKDNIPFHAIFWPAFLMAYGKYKDEEVEAEWNLPYDIPANEYLTLEGKKFSTSRNWAIWIHEFLDVFPADYLRYYLTSIMPETRDSDFSFAEFKTKINEELVNVLGNFVYRALTFVNRYFDGIVPERGELDELDRQALEEIEKTFEEVGKLIREYRFKDALKKVMNLAGFGNRYFDYKEPWKTIKEDKTRTGTTINISLQIVKALGILLEPFLPDASEKIWHFLNLEEVKTWRFTELPAGHKVRKPEILFKKASDDQIIYFILNYMGRNNPDAARELLEKYYKLEDVEKVAIEKFGEEDGRFMLKKIFKEKYKGEKKGEQKMQYVSFEEFSKIDLRIGKIVEVQDHPNADKLYVVKVDLGGEIRTLVAGLKKYYKPEELLNRYVVIVANLEPKKLRGVESQGMLLAADDGEKVALLMPDKEVKLGAKVR

SEQ ID NO: 25093 - DNA, 2067 bp, Ralstonia solanacearum
  CDS (1)..(2067)
atgtccgaacgtcgcatcctcgtcacatccgccctgccctatgccaacgggccgatccacatcggccacatggtcgagtacatccagaccgacatctgggtgcgcttccagcgcatgcgcggccacgaaacctactacgtgggcgccgacgacacgcatggcacacccgtcatgctgcgcgccgaaaaggaaggcatcaccccgcgccagctgatcgagcgcgtctggacggagcacaagcgcgacttcgacaacttcctggtctcgttcgacaactactacagcaccgactccgacgagaaccgcgagctgtgcgagcgcgtctatctcaagctcaaggaggcgggcctgatcgacgtgcgcgaggtcgagcagttctatgacccggtcaaggagatgttcctgccggaccgcttcatcaagggcgagtgcccgaagtgcggcgccaaggaccagtacggcgattcctgcgaggtgtgcggcgcgacctaccagccgaccgacctgaagaacccgtattcggtggtgtcgggcgccacgccggtgcgcaagtcttccgaacactacttcttcaagctgtccgacccgcgctgcgagaccttcctgcgcgattgggtgggcgacctggcccagcccgaagccaccaacaagatgcgcgaatggctgggtgacgaaggcgaatcgacgctgtcggactgggacatttcgcgcgatgcgccgtacttcggcttcgagatcccgggcgcgccgggcaagtatttctacgtgtggctggatgcgccggtcggttactacgccagcttcaagaacctgtgcggcaagctgggactcgacttcgatgcgtgggtgtccacgcactcgaccgccgagcagtaccacttcatcggcaaggacatcctgtacttccacacgctgttctggccggcgatgctgcagttctcgggccaccgcacgcccaccaacgtgttcgcgcacggcttcctgacggtggacggcgccaagatgagcaagtcgcgcggcaccttcatcaccgcgcagagctatatcgacacgggcctgaacccggaatggctacgctactacttcgccgccaagctcaacgccacgatggaagacctggacctgaacctggacgacttcatcgcacgcgtgaacagcgacctggtcggcaagttcgtcaacatcgccagccgctcggcgggtttcctggtcaagcgcttcgagggccgcgtgaacgatgccgcgctggccaacccgctgatggtccaactgcgcgaagccgcgccgcagatcgccgacctgtatgagaagcgcgaatacagcaaggccctgcgcacagtgatggagctggccgacgccgtgaacgcctacgtcgacaccgagaagccgtgggacctggccaaggacgaagcccagcgcgacaagctgcatgccgcgtgctcggtggcgctggaagccttccgcctgctggcggtctatctcaagccgatcctgccgagcacggtcgctcgcatcgaggcgttcctgaacatcgagccgctgaactggcgcgcgatcgacgcgcagctgtcgtcggcgcgaccgatccagccgtattcgcacctgatgacgcgcgtggacaagaagcaggtcgatgcactgctggaggccaaccgccagtcgctgcaggccacggtggatgcggtcccggccgccaacggcacgcctgccgtcgaaccgatggccgagaccatcgccatcgacgatttcgccaagatcgacctgcgcgtggccaagatcgtcgcctgccagcgcgtggagggctccaacaagctgctgcagctgacgctggacgtgggcgaaggcaagacgcgcaacgtcttctccggcatccagtcggcctatgcgccggaagacctggtcggcaagctgacggtgatggtggccaacctggcgccgcgcaagatgaagttcggcatgtcggagggcatggtgctggccgcctcggccgccgacgaaaaggcccagccgggcctgtacatccttgagccgcacgcgggcgccgtgcctggcatgcgcgtccgttaa

SEQ ID NO: 25094 - protein, 688 aa, Ralstonia solanacearum
MSERRILVTSALPYANGPIHIGHMVEYIQTDIWVRFQRMRGHETYYVGADDTHGTPVMLRAEKEGITPRQLIERVWTEHKRDFDNFLVSFDNYYSTDSDENRELCERVYLKLKEAGLIDVREVEQFYDPVKEMFLPDRFIKGECPKCGAKDQYGDSCEVCGATYQPTDLKNPYSVVSGATPVRKSSEHYFFKLSDPRCETFLRDWVGDLAQPEATNKMREWLGDEGESTLSDWDISRDAPYFGFEIPGAPGKYFYVWLDAPVGYYASFKNLCGKLGLDFDAWVSTHSTAEQYHFIGKDILYFHTLFWPAMLQFSGHRTPTNVFAHGFLTVDGAKMSKSRGTFITAQSYIDTGLNPEWLRYYFAAKLNATMEDLDLNLDDFIARVNSDLVGKFVNIASRSAGFLVKRFEGRVNDAALANPLMVQLREAAPQIADLYEKREYSKALRTVMELADAVNAYVDTEKPWDLAKDEAQRDKLHAACSVALEAFRLLAVYLKPILPSTVARIEAFLNIEPLNWRAIDAQLSSARPIQPYSHLMTRVDKKQVDALLEANRQSLQATVDAVPAANGTPAVEPMAETIAIDDFAKIDLRVAKIVACQRVEGSNKLLQLTLDVGEGKTRNVFSGIQSAYAPEDLVGKLTVMVANLAPRKMKFGMSEGMVLAASAADEKAQPGLYILEPHAGAVPGMRVR

SEQ ID NO: 25095 - DNA, 2034 bp, Salmonella typhi
  CDS (1)..(2034)
atgactcaagtcgcgaagaaaattctggtaacgtgcgcgctgccgtacgccaacggctctatccacctcggccatatgctggagcacatccaggctgatgtctgggtccgttaccagcgaatgcgcggccatgaggttaacttcatctgtgccgatgacgctcatggcacgccgatcatgctgaaagcgcagcagcttggtattacaccggagcaaatgatcggtgaaatgagccaggagcaccagaccgatttcgccggttttaatattagctacgacaactaccactcaacgcacagcgacgagaatcgcgagctgtccgagctgatttatacgcgcctgaaagagaacggttttattaagaaccgcaccatctctcaactctacgatccggaaaaaggcatgttcctgccggatcgatttgtgaaaggcacctgcccgaaatgtaaatccgcggaccagtacggcgataactgtgaagtctgcggcgcaacttacagcccgaccgaacttatcgagccgaaatccgtggtgtccggcgcgacgccggtaatgcgtgactccgagcactttttctttgacctgccgtcattcagcgaaatgttgcaggcgtggacccgcagcggcgcgctgcaggagcaggtggcgaacaaaatgcaggagtggtttgaatccggcctccagcagtgggacatttcccgcgacgcgccgtattttggtttcgaaatcccgaacgcgccgggcaaatatttctacgtctggctggacgcgccgattggctatatgggctccttcaaaaatctgtgcgataagcgcggtgacacgaccagttttgatgagtactggaaaaaagactccgacgccgagctgtatcactttatcggcaaagacatcgtctatttccacagcctgttctggcctgccatgctggaaggcagccacttccgtaagccgaccaacctgttcgttcacggttacgtgacggtgaacggcgcgaagatgtctaagtctcgcggcacctttattaaggccagcacctggctgaaacactttgacgccgacagcctgcgctactactacaccgcgaagctttcttcacgcattgatgacatcgacctgaacctggaagactttgtccagcgcgtcaatgccgatatcgtcaataaagtagtcaacctggcatcccgtaacgccggttttatcaataagcgtttcgacggcgtgctggcggctgaactggccgatccgcaattgtacaaaacctttactgacgccgctgcggtgattggcgaagcatgggaaagccgtgaattcggtaaagctatccgtgagattatggcgctggccgacgtcgctaaccgttatgttgacgagcaagcgccgtgggtggtggctaaacaggaaggccgcgacgctgacctgcaggccatttgctcgatgggcatcaacctgttccgcgtgctgatgacgtatctgaaaccggtactgccgacgctttctgaacgcgttgaagccttcctgaacagcgaactgaactgggatgccatcgaacagccgctgctcagtcacaaggtcaacacctttaaggcgctctacaatcgcatcgacatgaagcaagttgaagcgctggttgaagcgtctaaagaagaggtgaaagccgcagccgcgccggttaccggcccgttagccgacttcccgattcaggaaaccatcacctttgacgatttcgccaaaattgacctgcgcgtagcattgattgaaaacgctgagttcgtagatggttctgacaaattgctgcgtctgacgctggatctgggcggcgagaagcgtaacgtcttctccggcattcgttccgcctacccggacccgcaggcgctgatcggccgccagacggtaatggtcgccaacctcgcgccgcgcaaaatgcgctttggcgtctccgagggaatggtgatggccgcaggacctggcgggaaagatatcttcctgttaagccctgatgacggcgcgaagcctggccaacaggtgaaataa

SEQ ID NO: 25096 - protein, 677 aa, Salmonella typhi
MTQVAKKILVTCALPYANGSIHLGHMLEHIQADVWVRYQRMRGHEVNFICADDAHGTPIMLKAQQLGITPEQMIGEMSQEHQTDFAGFNISYDNYHSTHSDENRELSELIYTRLKENGFIKNRTISQLYDPEKGMFLPDRFVKGTCPKCKSADQYGDNCEVCGATYSPTELIEPKSVVSGATPVMRDSEHFFFDLPSFSEMLQAWTRSGALQEQVANKMQEWFESGLQQWDISRDAPYFGFEIPNAPGKYFYVWLDAPIGYMGSFKNLCDKRGDTTSFDEYWKKDSDAELYHFIGKDIVYFHSLFWPAMLEGSHFRKPTNLFVHGYVTVNGAKMSKSRGTFIKASTWLKHFDADSLRYYYTAKLSSRIDDIDLNLEDFVQRVNADIVNKVVNLASRNAGFINKRFDGVLAAELADPQLYKTFTDAAAVIGEAWESREFGKAIREIMALADVANRYVDEQAPWVVAKQEGRDADLQAICSMGINLFRVLMTYLKPVLPTLSERVEAFLNSELNWDAIEQPLLSHKVNTFKALYNRIDMKQVEALVEASKEEVKAAAAPVTGPLADFPIQETITFDDFAKIDLRVALIENAEFVDGSDKLLRLTLDLGGEKRNVFSGIRSAYPDPQALIGRQTVMVANLAPRKMRFGVSEGMVMAAGPGGKDIFLLSPDDGAKPGQQVK

SEQ ID NO: 25097 - DNA, 1971 bp, Staphylococcus epidermidis
  CDS (1)..(1971)
atggctaaagatacattttatataacaaccccaatatactatccgagcgggaacctacacatcggtcatgcatactctacagtcgcaggcgacgtgatagctcgctataaaagaatgcaaggctatgatgttcgttatttaactggcactgatgagcacggtcaaaaaatccaagaaaaagctcaaaaagctggcaaaacagaactagaatacttagatgaaatgatttcaggtattaaaaacttatggagtaaacttgagatttctaatgatgattttattcgaactacagaagagcgtcataagcaagtcgttgagaaagtgtttgagcgattattaaaacaaggtgacatttatttaggtgaatacgaaggttggtattctgttcctgatgaaacatattatacagagtcacaacttgttgaccctgtttatgaaaacggcaaaattgtaggtggtaaaagtcctgattctggtcacgaagtcgaacttgtaaaagaagaaagctatttcttcaacattaataaatatacagaccgcttattagaattttacgatgaaaatccagactttatacaaccaccatctagaaaaaatgaaatgattaataactttatcaaaccaggtttagaagatttagcagtatcacgtacatcattcgattggggtgtacgtgtaccatctaatcctaaacatgttgtatacgtgtggattgatgcacttgttaattatatttcttcattaggttatctatctgatgatgaaacattatttaataaatattggccagcagacatacacttgatggctaaagaaattgtacgtttccactctattatatggccaatattgttaatggcgttggatttaccacttcctaaaaaagtttttgcacacggttggattttaatgaaagatggtaaaatgagtaaatctaaaggtaatgtcgtagatcctaatgtattaattgatcgttatggtcttgatgcgacacgttattacttaatgcgtgaattaccgtttggttctgatggcgtatttacaccggaagcctttgttgaaagaacaaattacgatcttgcgaatgatttaggtaatctagtgaatcgtactatctctatgataaacaaatatttccacggcgaattacctgcataccaaggtccaaaacatgaattggatgaaaaaatggaagcgatggcgcttgaaactgttaaatcattcaatgataatatggaaagtttacaattttctgttgctttatcaacagtatggaaatttattagtcgtacaaacaaatatattgatgaaactcaaccttgggttcttgcaaaagatgaaaatcaacgtgagatgcttggtaatgtaatggcacatcttgtcgagaacattcgtttcgctacaatcttattacaaccattcttgacgcatgcacctagagagatatttaagcaacttaatattaacaatccggatttacatcaattagatagtctgcaacaatatggtatgttgtcagaggcaattactgtaactgaaaagccaacaccaattttcccaagattagacactgaagcagaaattgcttatatcaaagaatcaatgcaaccacctaaatcaataaaacagtctgatgaacccggtaaagagcaaattgatatcaaagattttgataaagttgaaatcaaagcagcaaccattattgatgcggaaaatgtaaaaaaatcggagaaactattaaaaataaaagttgaattagataatgaacaacgtcaaatagtatctggtatagctaagttttatcgtccggaagacattattggtaaaaaagttgcagttgttactaatttaaaaccagctaaattgatgggacaaaaatccgaaggtatgattttgtcagctgaaaaagatggcgtacttaccttgataagcttgcctagcgcaattccaaatggtgcagtaattaaatag

SEQ ID NO: 25098 - protein, 656 aa, Staphylococcus epidermidis
MAKDTFYITTPIYYPSGNLHIGHAYSTVAGDVIARYKRMQGYDVRYLTGTDEHGQKIQEKAQKAGKTELEYLDEMISGIKNLWSKLEISNDDFIRTTEERHKQVVEKVFERLLKQGDIYLGEYEGWYSVPDETYYTESQLVDPVYENGKIVGGKSPDSGHEVELVKEESYFFNINKYTDRLLEFYDENPDFIQPPSRKNEMINNFIKPGLEDLAVSRTSFDWGVRVPSNPKHVVYVWIDALVNYISSLGYLSDDETLFNKYWPADIHLMAKEIVRFHSIIWPILLMALDLPLPKKVFAHGWILMKDGKMSKSKGNVVDPNVLIDRYGLDATRYYLMRELPFGSDGVFTPEAFVERTNYDLANDLGNLVNRTISMINKYFHGELPAYQGPKHELDEKMEAMALETVKSFNDNMESLQFSVALSTVWKFISRTNKYIDETQPWVLAKDENQREMLGNVMAHLVENIRFATILLQPFLTHAPREIFKQLNINNPDLHQLDSLQQYGMLSEAITVTEKPTPIFPRLDTEAEIAYIKESMQPPKSIKQSDEPGKEQIDIKDFDKVEIKAATIIDAENVKKSEKLLKIKVELDNEQRQIVSGIAKFYRPEDIIGKKVAVVTNLKPAKLMGQKSEGMILSAEKDGVLTLISLPSAIPNGAVIK

SEQ ID NO: 25099 - DNA, 2001 bp, Streptococcus pyogenes
  CDS (4)..(2001)
atgatgaaaaaaccattttacattacgacacccatttattacccatctgggaaattacacattggttctgcctatacaactattgcttgtgatgtcttggcacgctacaagcgcctgatgggccatgaggtcttttacctcacaggactagatgaacacggacaaaagattcaaaccaaggcaaaagaagctggtattacacctcaaacctacgttgataacatggcaaaggatgtcaaagccctttggcaattgctagatatttcctatgacacatttatccggacaacggacgattaccacgaagaggtcgttgctgctgtctttgaaaaattgctggcgcaagatgacatttaccttggcgaatactctggttggtattctgtctctgatgaggaatttttcactgaaagccaattaaaagaagtctttagagatgaagacggtcaggttattggagggattgccccatcaggtcatgaggtcgagtgggtctctgaagaatcctacttcctacgccttagcaaatacgatgatcgtcttgtggccttctttaaagagcgacctgactttatccaaccagatggtcgtatgaatgaaatggtgaaaaactttatcgagccaggcctagaagatttggctgttagccgtactacctttacatggggtgtacctgttccatcagacccaaaacacgtggtttatgtctggatcgatgccctcttaaactacgcgacagctcttggttatcgtcaagctaatcacgctaactttgataagttttggaatggaacggttttccacatggttggaaaagatatcttgcgttttcatagcatctactggccaattttactcatgatgcttgatttaccaatgccagaccgcttaattgcccatggttggtttgtcatgaaagacggtaaaatgtctaaatcaaaaggcaatgtggtctatccagaaatgttagttgagcgctttggacttgatcctcttcgttattacctcatgcgttctttgccagttggttcagacgggacctttacccctgaagattatgtgggtcgtatcaactatgagttagccaacgaccttggcaatttattgaaccgtaccgttgccatgatcaacaagtattttgacggcacggtgccagcttatgttgacaatggaactgcctttgatgctgacttaagtcaactgattgatgctcagctagcagactaccataagcacatggaagcggtggactacccacgcgccttggaggctgtttggaccatcatcgctcgtaccaacaaatacatcgatgaaaccgctccttgggtgctcgctaaagaagatggtgacaaagctcaactagccagtgtcatggcacacttagcagccagcttgcgtctggtcgctcatgtgatccaaccctttatgatggaaacatcagctgctatcatggcccagcttggtttggaacctgtttctgatttgtcaacacttgctctagcagattttcctgccaatacaaaggttgttgccaaagggacaccgattttcccacgtcttgacatggaagctgagattgactacatcaaagcccaaatgggtgacagctcagctatttcccaagaaaaagaatgggtccctgaagaggttgcgctcaaatctgaaaaagacgtcatcacatttgaaacctttgatgctgtggaaatccgtgtggcagaagtcaaggaagtgtcaaaagtggaaggttcagaaaaattgctgcgctttagagtagatgcaggagacgggcaagaccgtcaaatcttgtcaggtattgccaaattttaccccaacgaacaagaattagtgggtaaaaaactacaaattgttgctaacctgaaaccgcgtaaaatgatgaaaaaatacatcagtcaagggatgattctatcagcagagcatggagatcagctaacggtcttaaccgttgattcctctgttccaaatggaagtatcattggctag

SEQ ID NO: 25100 - protein, 665 aa, Streptococcus pyogenes
MKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYDDRLVAFFKERPDFIQPDGRMNEMVKNFIEPGLEDLAVSRTTFTWGVPVPSDPKHVVYVWIDALLNYATALGYRQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRLVAHVIQPFMMETSAAIMAQLGLEPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKFYPNEQELVGKKLQIVANLKPRKMMKKYISQGMILSAEHGDQLTVLTVDSSVPNGSIIG

SEQ ID NO: 25101 - DNA, 1917 bp, Thermoanaerobacter tengcongensis
  CDS (1)..(1917)
atgaaaaagactttttacatcaccactcctatatattaccccagtgacaagctacatattggccattcttacactactgtggctgctgacgcaatggcaaggttcaaaagattgacagggtatgacgtgatgtttttgacaggtacagacgagcacgggcagaaaattcagaggatagccagagaaaaaggcatgtctccaaaagaatatgtggacggcattgtggaatggataaaagatttatggaaaacaatggatataagttatgaccattttattaggacaactgatgcctatcacgaagaaatagtgcaaaagatattcatgaagttgtacgagcagggggatatatataagggagaatacgagggatggtattgcactccttgcgagtctttctggacagaaagccagcttgtggatggaaaatgtcctgactgcggaagacccgttgaaagggttacagaggaagggtatttcttcagactttcagcttatggagataagcttttgaagtactatgaggagcatccagattttatacagccagagtccaggcgaaatgaaatgataaactttataaaggctggattggaggacttatttgtctcaaggagcacttttgactggggaataaaagtgccttttgaccctaagcacgtcatatacgtttggatagatgctctttctaactatatcactgcattaggatatatgacagaaaatgatgagaaatttaaaaagtattggcctgcagatgtgcacctcgttggtaaggaaattgtgaggttccacacgataatatggcctgctatgctcatggctttaggacttcctcttcctaaaaaggtgtttgggcatggatggttgattttagaaggaggtaaaatgtcaaaatccaaagggaatgtagtggaccccaaggaactagtggacaggtacggagtagatgctataaggtatttcctcttaagagaagttccctttggtgctgacggcgtattttcaaacgaagctttaataaacaggataaattccgatttggcaaatgatttgggcaatcttttaagtagaactgtcacaatgattgagaaatactttgatggagtgttgcctaaaccttcttctcaagaagaaatagatgaagacctcataaatgtagcgcaaaatttaccacagaaagtagaagaatacatggacaagttgcaattctccaacgccttaatagagatatggaaattagtgtcaagagctaataagtacattgatgagactatgccgtgggtgctagcaaaagatgaatctaaaagaggcagactgggtacagttttatacaatctggcagaatctttaaggttcataggaattttgatatctccttttatgcccaatactcctaaaaagatgtttgaacaattagggattacggaagatttgactacatgggaaagcttaaaatttgggcttttgaaggaaggcacaagggtgaagagaggagaaatcctgttccccagaatagatgttgagaaagaactggcatctcttgaaaagaaaactgaagaaaaaacaaaagaaacaaaagaagagaagatagattatatcacgatagaagatttttcaaaagttcaactgagagttgctgaaattttagaagctgagaaagtagaaggttcagacaagctcattaaaatgaagcttaaagtcggggaagagataaggcagattgtaggaggaattggcaaatattacagtccagaagagctaataggcaagaagataataattgtatataatttacagccgagaaagctcatggggattgaatcccaggggatgctattggcggccactaatgaagggaaaatggcgctgttgacggtagacaaagacatagaaagcggttctaaaataagctga

SEQ ID NO: 25102 - protein, 638 aa, Thermoanaerobacter tengcongensis
MKKTFYITTPIYYPSDKLHIGHSYTTVAADAMARFKRLTGYDVMFLTGTDEHGQKIQRIAREKGMSPKEYVDGIVEWIKDLWKTMDISYDHFIRTTDAYHEEIVQKIFMKLYEQGDIYKGEYEGWYCTPCESFWTESQLVDGKCPDCGRPVERVTEEGYFFRLSAYGDKLLKYYEEHPDFIQPESRRNEMINFIKAGLEDLFVSRSTFDWGIKVPFDPKHVIYVWIDALSNYITALGYMTENDEKFKKYWPADVHLVGKEIVRFHTIIWPAMLMALGLPLPKKVFGHGWLILEGGKMSKSKGNVVDPKELVDRYGVDAIRYFLLREVPFGADGVFSNEALINRINSDLANDLGNLLSRTVTMIEKYFDGVLPKPSSQEEIDEDLINVAQNLPQKVEEYMDKLQFSNALIEIWKLVSRANKYIDETMPWVLAKDESKRGRLGTVLYNLAESLRFIGILISPFMPNTPKKMFEQLGITEDLTTWESLKFGLLKEGTRVKRGEILFPRIDVEKELASLEKKTEEKTKETKEEKIDYITIEDFSKVQLRVAEILEAEKVEGSDKLIKMKLKVGEEIRQIVGGIGKYYSPEELIGKKIIIVYNLQPRKLMGIESQGMLLAATNEGKMALLTVDKDIESGSKIS

SEQ ID NO: 25103 - DNA, 2196 bp, Vibrio cholerae
  CDS (145)..(2196)
ttgcccatgctaccaccgctcaaagagcaactgaaccccgaaaaagataggggaatcaactgttgcgcgccttggcgtgactgcgtgcttagggtagtattatcgcttcaatttggtctctatcaagaaaagcgaatattaagtatggcaaacgatccaagaaaacttctggtaacttgtgccctgccttacgcgaacggttcaatccaccttggtcatatgcttgagcatatccaagctgacatttgggttcgttatcagcgtctgcgtggcaatacagtaaacttcatctgtgcggatgatgcgcacggcacacctatcatgctgaaagcacagcaaatgggtatgacaccagaagcgatgatcgagatggtgagcgaagagcaccaacgtgactttgctggcttcgatattagctttgataactaccacagcacgcacagcgatgaaaaccgcgagctggcttcgcacatctatctgcaactgaaaaagaacggctttatttcaagccgcaccatttctcagctgttcgatcctgaaaaagagatgttcttgccggatcgtttcgtaaaaggcacttgcccgaaatgtaaatcggaagaccagtacggcgacaactgtgacgcgtgtggtgagacttacagcccgactgagctgatcaatccaaaatccgccgtctctggtgcgacgccagtgatgaaagattctgagcactttttctttgacctgcctcagtttgaaagcatgctcaaagagtggacacgttcaggctctctgcaatcagaaaccgccaacaaaatgcaagagtggtttgaaggcggcttgcagcagtgggatatttcccgcgatgcaccgtactttggttttgaaatcccgggcgagaaagacaaattcttctacgtatggcttgatgccccgattggttacatgggttcattcaaaaacctgtgcgacaagcgtggcgatttggactttaacgaatactggaataaagacagcaaaaccgagctttaccatttcatcggtaaagacatcgtttatttccacagcttgttctggcctgccatgctcgatggctctggtttccgtaaaccgaccaacgtgtttgtgcatggttatgtgaccgtcaatggcgcgaaaatgtctaagtcgaaaggtacgtttgtgaaagccagcacttacctgaatcacttggatccagagtgtctgcgttactactacgcggcaaaactgaataaccgcattgatgatctcgatttgaacctcgaagacttcacccaacgtgtgaatgcggatgtggtgaacaagatcgtaaaccttgcgtcacgtaatgcaggtttcatcactaaacgttttgatggcaagctgtctgcacactttgcggagcctgagctgtacgctgaatttgctggcgcagccgatcgtattgctgagctgtttgaagcacgtgagtttggtcgtgccatccgtgaaattactgcattggcagataaagccaaccagtatgtggatgaaaaagccccttgggttgtcgcgaaacaagaaggccaagaccaagcactgcaagacatctgtacggtaggcattaacctattccgcgtactgatgacttacctcaagccagtgatgcctgcgttggcagagcgtactgaagctttccttaaccaagaattgacttgggaaggcgtggcaactccgctaacggatcatgcggtaacgccattcaaagcactgttcaaccgtatcgatccgaaacaggttgaagctatgattgaggcgtcgaaagccgaggcggcagccgaaaaagccgcagcagatgccgcaaaaccaaagagcgcagaaaccgagctgagcaaagaccccctagcggcggagattgagtttgatgattttgcgaaagtggatctgcggattgcgaagattctttcttgtgaagcggtcgagaaatcggacaagctgctcaagtttgaactcgatatcggcggtgaaacccgtcaagtcttctctggcattaagtctgcctaccaaccagaagatctgattggtaaatacactgtcgtcgtagcaaacctcaaaccgcgtaagatgaagtttggtatgtctgaaggcatgatcctcgccgcaggccctggcggtagcgacctgtggttacttgaaccccatcaaggcgctcaagcgggtatgcgtgtgatgtaa

SEQ ID NO: 25104 - protein, 683 aa, Vibrio cholerae
MANDPRKLLVTCALPYANGSIHLGHMLEHIQADIWVRYQRLRGNTVNFICADDAHGTPIMLKAQQMGMTPEAMIEMVSEEHQRDFAGFDISFDNYHSTHSDENRELASHIYLQLKKNGFISSRTISQLFDPEKEMFLPDRFVKGTCPKCKSEDQYGDNCDACGETYSPTELINPKSAVSGATPVMKDSEHFFFDLPQFESMLKEWTRSGSLQSETANKMQEWFEGGLQQWDISRDAPYFGFEIPGEKDKFFYVWLDAPIGYMGSFKNLCDKRGDLDFNEYWNKDSKTELYHFIGKDIVYFHSLFWPAMLDGSGFRKPTNVFVHGYVTVNGAKMSKSKGTFVKASTYLNHLDPECLRYYYAAKLNNRIDDLDLNLEDFTQRVNADVVNKIVNLASRNAGFITKRFDGKLSAHFAEPELYAEFAGAADRIAELFEAREFGRAIREITALADKANQYVDEKAPWVVAKQEGQDQALQDICTVGINLFRVLMTYLKPVMPALAERTEAFLNQELTWEGVATPLTDHAVTPFKALFNRIDPKQVEAMIEASKAEAAAEKAAADAAKPKSAETELSKDPLAAEIEFDDFAKVDLRIAKILSCEAVEKSDKLLKFELDIGGETRQVFSGIKSAYQPEDLIGKYTVVVANLKPRKMKFGMSEGMILAAGPGGSDLWLLEPHQGAQAGMRVM

SEQ ID NO: 25105 - DNA, 2031 bp, Vibrio parahaemolyticus
  CDS (1)..(2031)
atgcttgtaacttgtgcccttccgtacgctaacggttcgatccaccttggccatatgcttgagcatatccaagcggacatttgggttcgttaccaacgcctacgcggcaacactgtaaacttcatctgtgctgacgatgctcacggcacgccaatcatgcttaaagcgcaacagatgggtattactccagaagagatgattgccgctgttagcgaagagcaccaaaaagacttcgctggctttgatatcagctttgataactaccacagcacgcactcagaagagaaccgcgaactggcatctcacatttacctagagctaaagaaaaacggctttatctctagccgtactatctctcagcttttcgaccctgaaaaagagatgttcctaccggatcgtttcgtaaaaggtacatgtcctaagtgtaagtctgaagatcagtacggtgataactgtgacaactgcggcgagacttacagcccgacagaactgatcaatcctaaatctgcagtttctggtgcgacgccagtaatgaaagattctgagcacttcttctttgacctgcctcagtttgaaagcatgctaaaagagtggactcgctctggttctctgcaatcagaaaccgcgaacaagatgcaagagtggtttgaatctggtctgcaacaatgggatatctcgcgtgacgcaccttactttggcttcgaaatcccaggcgaaaaagacaagttcttctacgtatggctagatgcacctattggctacatgggctcattcaaaaacctatgtaacaaacgtgacgatctagacttcgatgaatactggaacaaagacagtaaaactgaactttaccacttcatcggtaaagacatcgtgtacttccacagcttattctggcctgcaatgcttgaaggttctggcttccgtaaaccaaacaacgtgttcgtacacggctacgtaacggtaaacggcgcgaaaatgtctaagtcgaaaggtacattcgtgaaagcaagcacgtacctcgatcacctagacccagaatgtctacgttactactacgcagcgaaactaaacagccgtattgacgatctagatcttaaccttgaagacttcactcagcgcgttaacgctgacgtagtcaacaagatcgttaacctagcatctcgtaacgcaggcttcatcgctaaacgtttcgaaggcaaactgtctgacaacttcgctgaaccagagctttacaacgaattcgtggcagctgctgaccgtatcgcagagctttttgaagctcgcgaatttggccgtgctatccgtgaaatcacggcactagcagacaaagcaaaccaatacgttgacgagaaagccccttgggttgtagcgaaagaagaaggcaaagatcaggaactacaagaaatctgttctgtaggtatcaacctgttccgcgtactaatgacttacttgaaaccagtaatgccagctcttgctgcacgtactgaagcattcctaaaccaagagctaacttgggaaggcattgctcagccactcactggccacgaaatcactaagttcaaagcgctattcaaccgtatcgatccaaagaacatcgaagcgatgatcgaagcatcgaaagaagacgctgcagcagaaatggcagcgaaagagaaagctgaagcggctaaaacagaaactgagctaagcaaagacccaatcgcggacgagattgagtttgatacttttgctcaagtggatttgcgcatcgctcgcatcatctcttgtgaagaagtgcctaaagcaaacaaactgcttaagttccaactggacatcggtggtgaaactcgtcaagttttctctggcatcaaatcagcctacaaacctgaagagctagaaggcaagctaaccgtaatggtagcgaacctaaaacctcgtaagatgaaattcggtatgtctgaaggcatgatcctagcggcaggccctggtggtagcgacctatggattcttgagccacacgaaggcgctcagcctggcatgcgtgtaatgtaa

SEQ ID NO: 25106 - protein, 676 aa, Vibrio parahaemolyticus
MLVTCALPYANGSIHLGHMLEHIQADIWVRYQRLRGNTVNFICADDAHGTPIMLKAQQMGITPEEMIAAVSEEHQKDFAGFDISFDNYHSTHSEENRELASHIYLELKKNGFISSRTISQLFDPEKEMFLPDRFVKGTCPKCKSEDQYGDNCDNCGETYSPTELINPKSAVSGATPVMKDSEHFFFDLPQFESMLKEWTRSGSLQSETANKMQEWFESGLQQWDISRDAPYFGFEIPGEKDKFFYVWLDAPIGYMGSFKNLCNKRDDLDFDEYWNKDSKTELYHFIGKDIVYFHSLFWPAMLEGSGFRKPNNVFVHGYVTVNGAKMSKSKGTFVKASTYLDHLDPECLRYYYAAKLNSRIDDLDLNLEDFTQRVNADVVNKIVNLASRNAGFIAKRFEGKLSDNFAEPELYNEFVAAADRIAELFEAREFGRAIREITALADKANQYVDEKAPWVVAKEEGKDQELQEICSVGINLFRVLMTYLKPVMPALAARTEAFLNQELTWEGIAQPLTGHEITKFKALFNRIDPKNIEAMIEASKEDAAAEMAAKEKAEAAKTETELSKDPIADEIEFDTFAQVDLRIARIISCEEVPKANKLLKFQLDIGGETRQVFSGIKSAYKPEELEGKLTVMVANLKPRKMKFGMSEGMILAAGPGGSDLWILEPHEGAQPGMRVM

SEQ ID NO: 25107 - DNA, 2085 bp, Xanthomonas axonopodis
  CDS (1)..(2085)
atgacccgcaccgcactcgtcaccactgccctgccgtatgccaacggcccgctgcatctcggccacttggtcggctacatccaggccgatatctgggtgcgcgcgcgccggttgcgcggcgacaagacctggttcgtctgtgccgacgacacccatggcacgccgatcatgctggctgccgagaaggccggggtgaccccggaagccttcatcgccaacgtccaggccagccacgagcgcgatttcgcggcgttcggcgtgaccttcgaccactacgattcgaccaattcgccggtcaatcgcgagctcaccgaagccttctacgccaagctggaggccgccggccatatcagccggcgctcggtggcgcagttctacgatacggccaagggcatgttcctgccggaccgctacatcaagggcatctgccccaactgcggcagccccgaccagtacggcgacaactgcgaagtgtgcggcgccacctatgcgccgaccgagctgaaggaaccgaagtcggtgatttcaggcgccaccccggaactgcgcgattcggagcatttcttcttcgaagtgggccatttcgacggatttttgcgcgagtggcttgccggcgatgtggcgcttcccggggtcaaggccaagctcaaggaatggctggatgccgagggcggcctgcgcgcctgggacatctcgcgcgatgcgccgtatttcggcttccagattcccggccagccgggcaagtatttctacgtgtggctggatgcgccgatcgggtacctgtgcagcttcaagacgctgtgcgcgcagatgggcgaaaatttcgaagcgcatcttgtcgccggcacccagaccgagctgcatcacttcatcggcaaggacatcgtgaatttccacggcctgttctggccggccgtgctgcacggcaccggccaccgcgcgccgacccgcctgcacgtcaacggctacctcaccgtggacggggccaagatgtccaagtcgcgcggcaccttcgtgatggcgcggaccttcctggatgtcggcctggaaccggaagcgctgcgttactacttcgcggccaagtcctccggcggcgtggacgacctggacctcaacctgggcgatttcatcgcacgcgtgaatgcggacctggtcggcaagttcgtcaacctggccagccgttgcgccggcttcatcggcaagcgcttcgatggcaaactggccgacgccctacccgatgccgcccagtacgaccgcttcgtcgccgccctggcaccgatccgcgaggcctacgaacgcaacgatgccgccagcgcgatccgccagaccatggcgctggccgacgaggccaataaatacatcgacgacaccaagccgtgggtgatcgccaagcaggatggcgccgatgcgcagctgcagtcggtctgcacgcagggcctgaacctgttccgcatcctggtggccgcgctcaagccgatcctgccgcgcacctgcgccgaagccgaagccttcctgtcggcgccgatgaccagttgggaagacgtgatcggcccgctgacggcgcacacgatccagccctataccgccctgtttacccgtatcgaccccaaactgatcgacgccatgaccgacgcttccaaggacaccctcgccgcacctgcaacaccggctaccgcctccaagcctgcaccggccaaggcggacgcaaagcccgctgcagcggcgaatccccaatcccccatcgccactcccggcttcatcggcatggacgatttcgccaagctcgacctgcgcatcggcaaggtgctggcgtgcgaattcgtggaaggctcggacaagttgctgcgcttcgaactggacgccggcgaactgggcacgcggcagatcttctccggcattcgcgccagctatcgcgaaccggaaacgctggtcggccgcagcgtggtgttcattgccaacctggccccgcgcaagatgcgctttggcatcagcgaaggcatgatcttgtcggctggcttcgacggcggcgccctggcgctgctggacgccgacagcggcgcacagccgggcatgccggtcaggtga

SEQ ID NO: 25108 - protein, 694 aa, Xanthomonas axonopodis
MTRTALVTTALPYANGPLHLGHLVGYIQADIWVRARRLRGDKTWFVCADDTHGTPIMLAAEKAGVTPEAFIANVQASHERDFAAFGVTFDHYDSTNSPVNRELTEAFYAKLEAAGHISRRSVAQFYDTAKGMFLPDRYIKGICPNCGSPDQYGDNCEVCGATYAPTELKEPKSVISGATPELRDSEHFFFEVGHFDGFLREWLAGDVALPGVKAKLKEWLDAEGGLRAWDISRDAPYFGFQIPGQPGKYFYVWLDAPIGYLCSFKTLCAQMGENFEAHLVAGTQTELHHFIGKDIVNFHGLFWPAVLHGTGHRAPTRLHVNGYLTVDGAKMSKSRGTFVMARTFLDVGLEPEALRYYFAAKSSGGVDDLDLNLGDFIARVNADLVGKFVNLASRCAGFIGKRFDGKLADALPDAAQYDRFVAALAPIREAYERNDAASAIRQTMALADEANKYIDDTKPWVIAKQDGADAQLQSVCTQGLNLFRILVAALKPILPRTCAEAEAFLSAPMTSWEDVIGPLTAHTIQPYTALFTRIDPKLIDAMTDASKDTLAAPATPATASKPAPAKADAKPAAAANPQSPIATPGFIGMDDFAKLDLRIGKVLACEFVEGSDKLLRFELDAGELGTRQIFSGIRASYREPETLVGRSVVFIANLAPRKMRFGISEGMILSAGFDGGALALLDADSGAQPGMPVR

SEQ ID NO: 25109 - DNA, 2091 bp, Xanthomonas campestris
  CDS (1)..(2091)
atgacccgcaccgcactcgtcactaccgccctgccctatgccaatgggccgctgcatcttggccatctggtcggttatatccaggccgacatctgggtgcgcgcgcgccggttgcgcggcgacaagacctggttcgtctgcgccgatgacacccatggcacgccgatcatgcttgcggccgaaaaggcgggcgtcacgccagaggccttcatcgccaacatccaggccagccatgagcgcgatttcgccgcgttcggggtgaccttcgatcactacgattcgaccaattcgccggtcaatcgcgaactcaccgaagccttctacaccaagctcgaggccgccggccatatcagccgccgctcggtggcgcagttctacgatccggccaagggcatgttcctgccggaccgctacatcaagggcatctgtcccaactgcggcagcgccgaccagtacggcgacaactgcgaagtctgtggcgcgacctatgcgccgaccgagctgaaagagcccaagtcggtgatctccggcgccacgcccgagctgcgcgattcggagcactttttcttcgaagtcggccatttcgacggcttcctgcgggagtggctggatggcgacgtggcattgccgggcgtcaaggccaagctcaaggaatggctggatgccgaaggcggcctgcgcgcgtgggacatctcgcgcgacgcgccgtatttcggtttccagattcccggccagcccggcaagtatttctacgtctggctggacgcgccgatcggctacctgtgcagcttcaagaccctgtgcgcgcagatgggcgaagacttccaggcgcatctggcggccggcacgcagaccgaactgcaccacttcatcggcaaggacatcgtcaatttccacggcctgttctggccggcggtgctgcatggcaccggccaccgcgcgccaacccggctgcacgtcaacggctacctgatggtggacggcgccaagatgtccaagtcgcgcggcaccttcgtgatggcgcggacgttcctggatgtcggcctggagccggaggcgctgcgctattacttcgcggctaaatcctccggtggcgtcgacgacctggacctcaacctgggcgatttcgttgcgcgggtgaacgcggacctggtcggcaaattcgtcaacctggccagccgctgcgccggcttcatcggcaagcgcttcgacggcaagctggccgacgcgctgcccgatccggcgcagtacgcgcgctttgtcgaggcactggcgccgattcgcgaagcctacgagcgcaacgacccggccagtgcaatccgccagaccatggcgctggccgacgaggccaacaagtacatcgacgacaccaagccgtgggtgatcgccaagcaggaaggcgccgacgcgcaactgcaatcggtgtgcacgcagggcctgaacctgttccgcctgctggtggccgcgctcaagccgatcctgccgcgtaccgccgccgaggccgaggccttcctgtcggcaccgatgaccagttgggaggacgtgagccgcccgctcacttgccatgtcatccagccctacaccgccctgttcacccgcattgaccccaaattgatcgacgccatgaccgacgcttccaaagacacgatggccgcacctgcggcaccggctgcaaccaccgccagcgctgaaaaggtggccaaaatcgatgcaaaagcggctacgccggccaatccccccgcctccgtcgcgaatccaggtcttattggcatggacgatttcgccaagctcgatctgcgcatcggcaaggtgctggtgtgcgaagcggtggaaggctcggacaagctgctgcgcttcgaactggatgccggcgagctgggcaagcgccagatcttctcgggcatccgcgccagctacggcgagccggaaacgctggtcggccgcagcgtggtgttcatcgccaacctggccccgcgcaagatgcgcttcggcatcagcgaaggcatgatcctctcggccggcttcgacggcggcgccctcgcgctgctggacgccgatgcgggcgcacagccggggatgccggtacggtga

SEQ ID NO: 25110 - protein, 696 aa, Xanthomonas campestris
MTRTALVTTALPYANGPLHLGHLVGYIQADIWVRARRLRGDKTWFVCADDTHGTPIMLAAEKAGVTPEAFIANIQASHERDFAAFGVTFDHYDSTNSPVNRELTEAFYTKLEAAGHISRRSVAQFYDPAKGMFLPDRYIKGICPNCGSADQYGDNCEVCGATYAPTELKEPKSVISGATPELRDSEHFFFEVGHFDGFLREWLDGDVALPGVKAKLKEWLDAEGGLRAWDISRDAPYFGFQIPGQPGKYFYVWLDAPIGYLCSFKTLCAQMGEDFQAHLAAGTQTELHHFIGKDIVNFHGLFWPAVLHGTGHRAPTRLHVNGYLMVDGAKMSKSRGTFVMARTFLDVGLEPEALRYYFAAKSSGGVDDLDLNLGDFVARVNADLVGKFVNLASRCAGFIGKRFDGKLADALPDPAQYARFVEALAPIREAYERNDPASAIRQTMALADEANKYIDDTKPWVIAKQEGADAQLQSVCTQGLNLFRLLVAALKPILPRTAAEAEAFLSAPMTSWEDVSRPLTCHVIQPYTALFTRIDPKLIDAMTDASKDTMAAPAAPAATTASAEKVAKIDAKAATPANPPASVANPGLIGMDDFAKLDLRIGKVLVCEAVEGSDKLLRFELDAGELGKRQIFSGIRASYGEPETLVGRSVVFIANLAPRKMRFGISEGMILSAGFDGGALALLDADAGAQPGMPVR

SEQ ID NO: 25111 - DNA, 2109 bp, Xylella fastidiosa
  CDS (1)..(2109)
atgcgatactcgcaccccctggtaccactctccttcatgaccacagcacttgtcaccaccgccctgccttacgccaatggtccactgcacctcggccatctggtcggctacattcaagctgacatctgggtacgcgcacggcgcctgggaggacacaacacctggtttgtttgcgccgacgacacccacggcaccccgatcatgctggccgcagaaaaagcgggcatgccgccggaagcctttatcgccaccacccaagccagccatgaacgcgactttgcggccttcaacgtcgcttttgaccactacgactccacacattcccccgtcaaccgccacctgaccgaacagtcttacctcacactcaaacaggccggacatatcacatgccgctcggtcgcccaattttacgacccggccaaaggcatgttcctccccgaccgctacgtcaaaggaacctgtccaaactgcggcgccaccgaccaatatggggacaactgcgaagcatgcggtgccacctatgaccccacagaactcaaaaacccatactcggtgatctccggcgcgaccccagaactgcgcgactcagaacacttcttttttgaagtggctcacttcgacaccttcctacgccattggctgagcggcgatgtcgccttgcctagcgtcaaaaacaaactcaaagaatggctggatgccaaaggcggcctacgcccctgggacatctcccgcgatgccccctacttcggcttcaaaatccccgaccaaccaggcaagtacttctacgtgtggctggatgcaccgatcggctacttatgcagcttcaaaaccttatgcacacgcattggcgaagacttcgacacacacctacgcagcggcaccacgacagaattgcatcactttatcgggaaagacatcgtcaacttccacgccctgttttggccggcagtcctgcacggcaccggccaccgcgcccccacccgactccatgtcaacggctacctgactgtggacggtgccaaaatgtccaaatcgcgcggcaccttcatcatggcgcgcacctaccttgatgctggcttggaaccagacgcactacgctactacttcgccgccaaatcctccggagacgtcgacgacctggaccttaacctgagtgacttcgttgcacgcgtcaacgccgacctagtcggtaaactcgtcaacctagccagccgctgcgcaagtttcattggcacgcgttttaacggacaactcgccgacaccctgccagaccgcatccaatatgatcgattcgttgcagcactgacccccatccgtgacgcctacgaacgcaacgacaccgccagcgcgatccgtcaaaccatgcagctggctgacgaagccaacaaatacattgacgagaccaaaccctggatcatcgccaaacaacaccacgccgacgcgcagctacacgccgtctgcacacaaggattgaacctgtttcgcgtcctgatcaccgcactcaaaccaatcctgccgcacaccagcatccaagcggagacattcctcgctgcaccagtaacggcatggcaagacgtcaaccaaccactgaccggcggccacaccattcaaccctactcccccttattcacccgtatcgacaaaaaaataattgaggtgatgatcaacgcctctaaagacaccctcgcccctccccctgcttcggccaaacaacaaaacgcatccatgtcaaacacagcaccaccacccactgcggaagaaccggaaacaactgctcccaccattggtattgacgacttcgccaaactcgatctacgcatcggcaaagtactcgtgtgcgaatacgttgaagggtcagacaaactactgcgctttgaattggatgctggccccctgggcaagcgccagatcttctcaggaatacgcgccagctacagcaacccagaggcactcattggccgcaacgtcgtgttcatcgccaacctagcaccccgcaaaatgcgctttgggatcagccaagggatgatcctctcagccggcttcgacaacggtacgctggcactactagatgctgacagcagcgcccaacccggcatgccggtgcgttaa

SEQ ID NO: 25112 - protein, 702 aa, Xylella fastidiosa
MRYSHPLVPLSFMTTALVTTALPYANGPLHLGHLVGYIQADIWVRARRLGGHNTWFVCADDTHGTPIMLAAEKAGMPPEAFIATTQASHERDFAAFNVAFDHYDSTHSPVNRHLTEQSYLTLKQAGHITCRSVAQFYDPAKGMFLPDRYVKGTCPNCGATDQYGDNCEACGATYDPTELKNPYSVISGATPELRDSEHFFFEVAHFDTFLRHWLSGDVALPSVKNKLKEWLDAKGGLRPWDISRDAPYFGFKIPDQPGKYFYVWLDAPIGYLCSFKTLCTRIGEDFDTHLRSGTTTELHHFIGKDIVNFHALFWPAVLHGTGHRAPTRLHVNGYLTVDGAKMSKSRGTFIMARTYLDAGLEPDALRYYFAAKSSGDVDDLDLNLSDFVARVNADLVGKLVNLASRCASFIGTRFNGQLADTLPDRIQYDRFVAALTPIRDAYERNDTASAIRQTMQLADEANKYIDETKPWIIAKQHHADAQLHAVCTQGLNLFRVLITALKPILPHTSIQAETFLAAPVTAWQDVNQPLTGGHTIQPYSPLFTRIDKKIIEVMINASKDTLAPPPASAKQQNASMSNTAPPPTAEEPETTAPTIGIDDFAKLDLRIGKVLVCEYVEGSDKLLRFELDAGPLGKRQIFSGIRASYSNPEALIGRNVVFIANLAPRKMRFGISQGMILSAGFDNGTLALLDADSSAQPGMPVR

SEQ ID NO: 25113 - DNA, 1683 bp, Homo sapiens
  CDS (1)..(1587)
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggaca

SEQ ID NO: 25114 - protein, 528 aa, Homo sapiens
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 25115 - DNA, 22 bp, Primer
atggaaaccgtggcttacgctg

SEQ ID NO: 25116 - DNA, 21 bp, Primer
ttatacgacgcgtacgcccgc

SEQ ID NO: 25117 - DNA, 1344 bp, Escherichia coli K12
  CDS (1)..(1344)
atgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaa

SEQ ID NO: 25118 - protein, 447 aa, Escherichia coli K12
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSAASGVPQVENLENKGQ

SEQ ID NO: 25119 - DNA, 1215 bp, Vibrio cholerae
  CDS (1)..(1215)
atgagtaaagtacaagttaaaaaagtagttgtggcatattctggcggtctggacacgtcggtgatcattccatggttaaaagaaaattatgactgtgaagtggtggcgtttgtggctgacgttggtcaaggtgatgaagagctgaaaggcgtagaagccaaagcactctcatcgggtgcctctgaatgttacatcgttgacctgaaagaagaattcgtaaaagagtacatctacccaacgctgaaaactggcgcttactatgaaggtaaatacttactcggtacttccatggcgcgtccggtgattgctaaagcacaagttgaaatcgcgcgtaaagtgggtgcggatgcactggcgcacggttgtactggcaaaggtaacgaccaagtgcgttttgaaggtgcttttgcggcactggctccagatctgcatgtgattgcgccttggcgtgagtgggatctgcgtagccgtgaagcgtgtttggattaccttgccgagcgcaacattccctgtgccgcgtcattaaccaagatctactcgcgtgatgccaacgcatggcacgtttctaccgaaggtggcgttctggaaagcacatggaatgcgccaaacgaagattgctgggtgtggaccgtcgatcctgagcaagcgcctaacgaagcggaatatgtcacgctgcaagtggctcatggcgaagtggtcgctgttgatggtgaagccatgaccccttacaacgctttgctgtacctcaaccaaaaaggtgcaaagcatggtgtaggtcgtatcgacatcgtggaaaaccgtttggtgggtatgaaatctcgcggctgctacgaaaccccgggaggcaccatcatcatggaagcgctgcgcgcggttgagcaactggtgctggataaaacctcattcgaattccgtgaagagctgggtattaaagcgtcacaccttgtttatgatggtcgttggttcacgccactacgtcaggcggtatttgcggcagccgatgagctagcgaaagatgtcaacggtgaagtggtgattaaactgtataaaggccaagccgttgcaacgcaaaaacgttcggctaacagcctctactcagaagatttcgcgacctttggtgccgatgaagtgtatgaccacagccacgcaggcggcttcatccgtctctattcgctgtcaagccgcatccgcgctctgagccaaaacaagcagtaa

SEQ ID NO: 25120 - protein, 404 aa, Vibrio cholerae
MSKVQVKKVVVAYSGGLDTSVIIPWLKENYDCEVVAFVADVGQGDEELKGVEAKALSSGASECYIVDLKEEFVKEYIYPTLKTGAYYEGKYLLGTSMARPVIAKAQVEIARKVGADALAHGCTGKGNDQVRFEGAFAALAPDLHVIAPWREWDLRSREACLDYLAERNIPCAASLTKIYSRDANAWHVSTEGGVLESTWNAPNEDCWVWTVDPEQAPNEAEYVTLQVAHGEVVAVDGEAMTPYNALLYLNQKGAKHGVGRIDIVENRLVGMKSRGCYETPGGTIIMEALRAVEQLVLDKTSFEFREELGIKASHLVYDGRWFTPLRQAVFAAADELAKDVNGEVVIKLYKGQAVATQKRSANSLYSEDFATFGADEVYDHSHAGGFIRLYSLSSRIRALSQNKQ

SEQ ID NO: 25121 - DNA, 1215 bp, Listeria monocytogenes
  CDS (1)..(1215)
atggcgaaagaaaaaatcgtattagcttactcaggtgggttagatacttctgtggcaattcagtggttagtagaatcaggttatgaagttattgcatgttgcttggatgttggtgaaggcaaaaatttagattttattaaagaaaaagccattactgtcggagcaagtgaatcctacacgattgatgcgaaagaagaatttgccgaggattttgcgttaattgctcttcaagcccatgcttattatgaaggaaaatatccacttatttcagctttaagccgtccgttaattgcgaaaaaattagtagaagtcgctcgtcaagaaggcgcttctgctatcgctcatggttgtactggtaaaggaaatgaccaagttcggtttgaagtagcgattcatgcacttgctcctgatttaaaagtcgtttctcctgtccgtgattggaaatggtctagagaagaagaaatcaattacgccaaagaacatgacatccctgtcccaattgatctagataatcccttctcgattgaccaaaacttgtggggtagaagtaatgaatgtggtgtgcttgaaaacccatggacaacaccgccagaggcagcttacgacttaacagtgagtttagaagatgcaccagacacagcagatattgttgaaatcacctttgatgctggtattcctatttctcttaatggagaaaatatgagcctagctaatttaattcttactttaaatgaaattgctggaaaacatggtgttggtagaattgatcatatcgaaaatcgtttagttggtattaaatcacgtgaagtatacgaatgtccggccgcagtcactttgattacagcacataaggaattagaagatttaacctttgttcgtgaagtggcacatttcaaacctatcatcgaacaaaaaatcagtgaaacaatttacaatggcctatggttctctcctttaacagaagcattagttgccttcttaaaatctacacaaaaattcgtgaacggcaccatccgcgtcaaattatttaaaggtcatgccattgtagagggaagaaaatcgccaaattcactttatgatgaaaacttagcaacttacacgtcttccgatacatttgaccaagatgcagcagttggtttcatcaagctttggggattaccaacaaaagtgaacgcagaagttaattcaaaagtgacaataacaaccgaggtgtaa

SEQ ID NO: 25122 - protein, 404 aa, Listeria monocytogenes
MAKEKIVLAYSGGLDTSVAIQWLVESGYEVIACCLDVGEGKNLDFIKEKAITVGASESYTIDAKEEFAEDFALIALQAHAYYEGKYPLISALSRPLIAKKLVEVARQEGASAIAHGCTGKGNDQVRFEVAIHALAPDLKVVSPVRDWKWSREEEINYAKEHDIPVPIDLDNPFSIDQNLWGRSNECGVLENPWTTPPEAAYDLTVSLEDAPDTADIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALVAFLKSTQKFVNGTIRVKLFKGHAIVEGRKSPNSLYDENLATYTSSDTFDQDAAVGFIKLWGLPTKVNAEVNSKVTITTEV

SEQ ID NO: 25123 - DNA, 1224 bp, Agrobacterium tumefaciens
  CDS (1)..(1224)
atggcactcccgaaagacgttaagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgcacgctcgccaagcgtaacctcaacaagtaa

SEQ ID NO: 25124 - protein, 407 aa, Agrobacterium tumefaciens
MALPKDVKKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLRTLAKRNLNK

SEQ ID NO: 25125 - DNA, 1410 bp, Salmonella enterica subsp. enterica serovar Typhi
  CDS (1)..(1410)
atgcataaaaatgcactaaagcagaaaccgatctcattatcagtcaatcaagcagggttctattctatgacgacgattcttaagcatcttccagcaggtcaacgtattggtatcgctttttccggcggtctggacactagcgccgcgctgctgtggatgcgacaaaaaggagctgtcccatatgcctatactgcgaatctgggacaaccggatgaggatgactatgacgccattcctcgtcgcgcaatggagtatggcgcagagaatgcccgcctgattgattgccgcaagcagttggttgcagaagggatcgcagcgattcagtgcggcgctttccataatacgactggcggactgacctatttcaataccacgccgctgggccgtgccgtgaccggcacgatgctggtcgccgcaatgaaagaagacggcgtgaatatctggggcgacggcagcacctataaaggcaacgatattgaacgtttctatcgttacggcctgctgaccaacgccgagctgcagatttacaaaccgtggctggataccgactttatcgatgagctgggcggccgtcatgagatgtctgaatttatgattgcctgcggtttcgactataagatgtcagtcgaaaaagcctactccaccgactccaacatgctcggcgcgacgcacgaagcgaaagatctggagtttcttaactccagcgtcaagatcgtcaacccgattatgggcgtgaagttctgggacgaaagcgtgaagatcccggcagaagaggtgaccgtccgtttcgaacagggacatccagtggcgctgaacggtaaaaccttcagcgatgatgttgagatgatgctggaagcgaaccgcatcggcggacgtcacggcctgggcatgagcgaccagatcgaaaaccgtatcattgaagcgaaaagccgcggtatttatgaagcccccggaatggcactgctgcacatcgcttacgagcgtctgttgaccggtattcacaacgaagacaccattgaacagtatcattctcatggtcgtcagttgggtaaactgctgtatcagggtcgctggttcgactctcaggcgctgatgctgcgtgacggcctgcaacgttgggtcgccagccagattaccggtgaagtgacgttggagctgcgtcgcggcaacgactactccatcctgaacaccgtgtcagacaacctgacctataaggctgagcgtctgaccatggagaaaggcgagtccgtgttctcgccagacgatcgtatcggtcagttgaccatgcgtaatctggacattactgatacccgcgagaaactgttcggctacgcgaaagcgggtctgttaaccgcctcttccgcgaccggtctgccgcaggttgagaatctggaaaacaaagcgaagtaa

SEQ ID NO: 25126 - protein, 469 aa, Salmonella enterica subsp. enterica serovar Typhi
MHKNALKQKPISLSVNQAGFYSMTTILKHLPAGQRIGIAFSGGLDTSAALLWMRQKGAVPYAYTANLGQPDEDDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEFLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHSHGRQLGKLLYQGRWFDSQALMLRDGLQRWVASQITGEVTLELRRGNDYSILNTVSDNLTYKAERLTMEKGESVFSPDDRIGQLTMRNLDITDTREKLFGYAKAGLLTASSATGLPQVENLENKAK

SEQ ID NO: 25127 - DNA, 1368 bp, Yersinia pestis
  CDS (1)..(1368)
atgacaactattcttaaacaccttcctattaatcagcgtgttggtattgctttttccggtggcctggacaccagtgcggcactgctgtggatgcaaaaaaaaggcgccattccttacgcttataccgctaatctgggtcagcctgatgaagaagattacgaggccatcccgcgtaaagcgatggaatacggcgcggaaaaagcccgtctgatcgattgccgtaagcagttggtggcagaaggtatcgccgctattcaatgtggcgcattccataacaccacggcgggtgtcacttatttcaacaccaccccactgggccgtgcggtaaccggcaccatgctggtggcagccatgaaagaagatgatgtaaatatctggggtgacggtagcacttataaaggtaacgatatcgagcgcttctatcgttacggtctgctgaccaacgctgagctgaaaatttacaaaccgtggctggatactgatttcatcgatgaattgggcggccgccatgagatgtcagaatttatgatccaatccggtttcgactacaaaatgtcaaccgagaaagcctactcgaccgactccaatatgttgggtgccacccacgaggccaaggatctggagttcctcaattccagcgttaaaatcgttaacccgattatgggcgtgaaattctgggacgaaaatgtggtggtgaaggccgaagaagtcactgtccgttttgaacgtggttacccggtcgcgctaaatggtgttgtctttgacgatagcgttgagctgatgatggaggctaaccgcatcggtggccgtcacggtctgggtatgagtgatcagattgaaaaccgtatcatcgaagccaaaagccgtggcatctatgaagcccctgggatggcgctgttgcatatcgcctatgagcgcttgctaacaggtattcacaatgaagataccattgagcaatatcatgctaatgggcgggtactgggtcgtctgctatatcaaggccgttggtttgatccacaagcgctgatgctgcgtgactccattcagcgttgggttgccagcgagataaccggtgaagtgacgctggagctgcgtcgtggcaatgattactccatcctgaataccgtgtctgacaatctgacttacaaaccagaacgtttgaccatggagaaaggtgattccgtgttctcaccagatgatcgtatcggccaactgacgatgcgtaatctggacatcaccgatacccgcgagaagttattcaactatgttgagacggggctgttaacctcttctgcggcgacggggttaccacaagtggataacaataatctgtcgtcagggcgtgggttgcaggataagcgtcagtaa

SEQ ID NO: 25128 - protein, 455 aa, Yersinia pestis
MTTILKHLPINQRVGIAFSGGLDTSAALLWMQKKGAIPYAYTANLGQPDEEDYEAIPRKAMEYGAEKARLIDCRKQLVAEGIAAIQCGAFHNTTAGVTYFNTTPLGRAVTGTMLVAAMKEDDVNIWGDGSTYKGNDIERFYRYGLLTNAELKIYKPWLDTDFIDELGGRHEMSEFMIQSGFDYKMSTEKAYSTDSNMLGATHEAKDLEFLNSSVKIVNPIMGVKFWDENVVVKAEEVTVRFERGYPVALNGVVFDDSVELMMEANRIGGRHGLGMSDQIENRIIEAKSRGIYEAPGMALLHIAYERLLTGIHNEDTIEQYHANGRVLGRLLYQGRWFDPQALMLRDSIQRWVASEITGEVTLELRRGNDYSILNTVSDNLTYKPERLTMEKGDSVFSPDDRIGQLTMRNLDITDTREKLFNYVETGLLTSSAATGLPQVDNNNLSSGRGLQDKRQ

SEQ ID NO: 25129 - DNA, 1203 bp, Nostoc sp. PCC 7120
  CDS (1)..(1203)
atgggtcgcgccaaaaaggttgttctggcatattctggtggagtagatacctccgtttgcatcccctatctcaaacaagagtggggagtagaagaggtaattaccctagcagcagatttaggccagggagatgaattagaaccaatccgagaaaaagcactaaaatcaggtgcaagtgaatccctcgtagcggatgtcaaagaaagttttattaaagattatgcttttcccgcgatacaggccaacgccctctacgaaaatcgctatccgctaggaactgctttagcccgtccgttaattgctaagatattggtcgaagctgcggcaaaatacggtgctgatgcgatcgcacatggttgtacaggtaagggtaatgatcaggtgcgctttgatgtctcttgtactgcactcaatcctaatttgaagatcctcgccccggcgcgggaatggggaatgagcagagaagcaaccatcgcctatggtgaaaagtttggcatcccctcacccgtgaaaaagtcttcgccttacagcattgataaaaatttacttggtcgtagtattgaagctggtgcgttggaagatcccaaatttgagccaccagaagaaatctatgaaatgacaaaggcgatcgccgacacccccaatgagccagaatacattgaaataggttttactcaaggtctgccaactacactcaacggtatacctaaagaccctgtagcactcattcaagaactcaatcaggtggtaggaagtcacggtgtcggacgcatcgacatgattgaaaaccgattagtgggaatcaaatcacgagagatttacgaatctccggcaatgttggtgctaattccagcccacagagacctagaaagcctgacattaaccgccgatgttagccactacaaacgaggtattgaagagacctacagccaaatagtttacaacggtctgtggtacagccccctgaaagccgccttagatgcctttattcaaaagacccaagaacgggtgtcaggaactgtcagagtgaaactattcaaaggtaacgccaccatagtcggacgctggagcgatagttcactctacacccccgatttagcaacctacggcgctgaagaccaatttgaccacaaagccgccgaaggcttcatttacgtttggggattaccaactcgtatctgggcgcagcaggatagaggttaa

SEQ ID NO: 25130 - protein, 400 aa, Nostoc sp. PCC 7120
MGRAKKVVLAYSGGVDTSVCIPYLKQEWGVEEVITLAADLGQGDELEPIREKALKSGASESLVADVKESFIKDYAFPAIQANALYENRYPLGTALARPLIAKILVEAAAKYGADAIAHGCTGKGNDQVRFDVSCTALNPNLKILAPAREWGMSREATIAYGEKFGIPSPVKKSSPYSIDKNLLGRSIEAGALEDPKFEPPEEIYEMTKAIADTPNEPEYIEIGFTQGLPTTLNGIPKDPVALIQELNQVVGSHGVGRIDMIENRLVGIKSREIYESPAMLVLIPAHRDLESLTLTADVSHYKRGIEETYSQIVYNGLWYSPLKAALDAFIQKTQERVSGTVRVKLFKGNATIVGRWSDSSLYTPDLATYGAEDQFDHKAAEGFIYVWGLPTRIWAQQDRG

SEQ ID NO: 25131 - DNA, 1215 bp, Listeria innocua
  CDS (1)..(1215)
atgacgaaagaaaaaatcgtattagcttactctggtgggttagatacttctgttgcaattcagtggctagtggaatcaggttatgaagttatcgcatgttgtttagacgttggtgaagggaaaaatttggattttattaaagaaaaagcgattactgtcggtgcaagtgcatcttatacaattgatgccaaggaagaatttgccgaaaactttgctttaatcgcccttcaagctcatgcttattatgaaggaaaatatccacttatttctgctttaagtcgtcctttaatcgcgaaaaaattagtagaagtagctcgtcaagaaggtgcctctgctatcgctcatggttgtactggtaaaggaaatgaccaagttcggtttgaagtagcgatccacgcccttgctcctgatttaaaagtcgtttcccctgtccgggactggaaatggtctagagaagaagaaatcaattacgccaaagaacataacatccccgttccaattgatttagataatcctttctcgattgaccaaaacctttggggtagaagtaacgaatgtggtgtgcttgaaaacccatggacaacgccaccagaagcggcttacgacttaacagttagcttagaagatgcacctgacacggcggatattgtcgaaattacatttgatgccggtattcctatttctcttaatggcgaaaatatgagcctagcaaatttaattcttactttaaacgaaattgctggaaaacatggcgttggtagaattgaccatatcgaaaatcgtttagttggtattaaatcacgtgaagtatacgaatgtcccgccgcagtcactttgattactgcacataaagaattagaagatttaacttttgttcgtgaagtggcacatttcaaacctattattgaacaaaaaatcagcgaaacaatttacaatggcttatggttttcgcctttaacagaagcattaattgccttcttaaaatccacgcaaaaattcgtgaacggtacgattcgcgtaaaactatttaaaggtcatgccatcgtcgaaggaagaaaatcaccgaattcgctttatgatgaaaacttagcgacttatacttcttccgatacattcgaccaagatgcagctgttggtttcatcaagctatttggactaccaacgaaagtgagcgcagaagtcaattcaaaagttacaataacaactgaggtgtaa

SEQ ID NO: 25132 - protein, 404 aa, Listeria innocua
MTKEKIVLAYSGGLDTSVAIQWLVESGYEVIACCLDVGEGKNLDFIKEKAITVGASASYTIDAKEEFAENFALIALQAHAYYEGKYPLISALSRPLIAKKLVEVARQEGASAIAHGCTGKGNDQVRFEVAIHALAPDLKVVSPVRDWKWSREEEINYAKEHNIPVPIDLDNPFSIDQNLWGRSNECGVLENPWTTPPEAAYDLTVSLEDAPDTADIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALIAFLKSTQKFVNGTIRVKLFKGHAIVEGRKSPNSLYDENLATYTSSDTFDQDAAVGFIKLFGLPTKVSAEVNSKVTITTEV

SEQ ID NO: 25133 - DNA, 2317 bp, Saccharomyces cerevisiae
  CDS (762)..(2024)
acactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactcatcttcattggatcagattgatgactgcgtacggcagatagtgtaatctgagcagttgcgagacccagactggcactgtctcaatagtatattaatgggcatacattcgtactcccttgttcttgcccacagttctctctctctttacttcttgtatcttgtctccccattgtgcagcgataaggaacattgttctaatatacacggatacaaaagaaatacacataattgcataaaataatgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaagtccgctagttcatcgcctcaagatagataacgatctcttcctccacctcctatttctgcacactcttgtgatgtaaatacatatgtagacatatgtaagcttttgtataaatagtttaagaaagcatcataccaattttgaatagaagaaaaaatagctaagagcatagccgctcggaataagttgacgtagcgaaaaatcccaatatcgtaaaggaaaaataccttcatgagaacagaacattgaaaagaagaaaaaaaaaactgagcactgcaccattaagtcctcaaag

SEQ ID NO: 25134 - protein, 420 aa, Saccharomyces cerevisiae
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGFLLHPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 25135 - DNA, 1239 bp, Mus musculus (house mouse)
  CDS (1)..(1239)
atgtccagcaagggctctgtggttctggcctacagtggtggcctggacacctcctgcatcctcgtgtggctgaaggaacaaggctatgatgtcatcgcctacctggccaacattggccagaaggaagactttgaggaagccaggaagaaggcgctgaagcttggggccaaaaaggtgttcattgaggatgtgagcaaggaatttgtggaagagttcatctggcctgctgtccagtccagtgcactctacgaggaccgctatctcctgggcacctctctcgccaggccttgcatagctcgcagacaggtggagattgcccagcgtgaaggggccaagtatgtgtctcacggcgccacgggaaaggggaatgaccaggtccgctttgagctcacctgctattcactggcaccccagattaaggtcatcgctccctggaggatgcctgagttttacaaccggttcaagggccgaaatgatctgatggagtatgcaaagcaacacggaatccccatccctgtcacccccaagagcccctggagtatggatgaaaacctcatgcacatcagctatgaggctgggatcctggaaaaccccaagaatcaagcacctccgggtctctacacaaaaactcaggaccctgccaaagcacccaacagcccagatgtccttgagatagaattcaaaaaaggggtccctgtgaaggtgaccaacatcaaagatggcacaacccgcaccacatccctggaactcttcatgtacctgaacgaagttgcgggcaagcacggagtgggtcgcattgacatcgtggagaaccgcttcattggaatgaagtcccgaggtatctacgagaccccagcagggaccatcctttaccacgctcatttagacatagaggccttcacgatggatcgggaagtacgcaaaatcaagcagggcctgggcctcaaattcgcagagctcgtatacacaggtttctggcacagccctgaatgtgaatttgttcgccactgtatccagaagtcccaggagcgggtagaagggaaggtgcaggtgtctgtcttcaagggccaagtgtacatcctcggtcgggagtctccactttcactctacaatgaagagctggtgagcatgaacgtgcagggcgactatgagcccatcgacgccactggcttcatcaatatcaactcgctcaggctgaaggagtaccatcgccttcagagcaaggtcactgccaaatag

SEQ ID NO: 25136 - protein, 412 aa, Mus musculus (house mouse)
MSSKGSVVLAYSGGLDTSCILVWLKEQGYDVIAYLANIGQKEDFEEARKKALKLGAKKVFIEDVSKEFVEEFIWPAVQSSALYEDRYLLGTSLARPCIARRQVEIAQREGAKYVSHGATGKGNDQVRFELTCYSLAPQIKVIAPWRMPEFYNRFKGRNDLMEYAKQHGIPIPVTPKSPWSMDENLMHISYEAGILENPKNQAPPGLYTKTQDPAKAPNSPDVLEIEFKKGVPVKVTNIKDGTTRTTSLELFMYLNEVAGKHGVGRIDIVENRFIGMKSRGIYETPAGTILYHAHLDIEAFTMDREVRKIKQGLGLKFAELVYTGFWHSPECEFVRHCIQKSQERVEGKVQVSVFKGQVYILGRESPLSLYNEELVSMNVQGDYEPIDATGFININSLRLKEYHRLQSKVTAK

SEQ ID NO: 25137 - DNA, 2098 bp, Methanococcus vannielii
  CDS (798)..(1991)
ctgcagaatttgtatcgcaaaatattgataaaaattgtattttggtagatatgggttcaacaacaacagatattatcccaatagttgatggaaaagccgcttcaaataaaacagaccttgaaagactcatgaataatgaattgttatatgtaggatcattaagaactccgctttcatttctttcaaataaaatcatgtttaaagatacaataacaaatgtatcttcagaatattttgcaataaccggtgatatttccttagtattggataaaataactgaaatggattacagttgcgatactcctgatggaaaacccgctgataagagaaacagcttaattaggatttctaaagtactatgttctgatttaaatcaaatatccgcagatgaatcgataaatattgcaatagaatactataaaattttaatagatttaattttagagaacgtaaaaaaggtttctgaaaaatacgggctaaaaaacattgtaataactggacttggtgaagaaatattaaaagatgcattaagtgaactaactaaatcaaacgaatttaatattatttcaataaaagaaagatacggaaaagatgtgtccttagcaacgccgagtttttctgtttcaatactccttaaaaatgaattaaatgctaaacttaatcgttcttaaattttcttaaaactatattttcttaaaactaatttttaatgtaaacttacaaaaagtttataaccatttaactgatatattggtaaaattatttttgataaaaggatttaaacagcaggtggtaatatgcaggaaaaaattgcagttttagcatactctggagggcttgatacaagctgctgcttaaaattacttgaagataagtataattataaagtagtttctgttgcagtcgatgtagggcagcctgaggacgacttaaaagaacctgaagaaaaggcaaagaaacttggtgttttaaagcattatactattgatgcaaaggaagaatttgcagttgactatatttttagggcaataaaggcaaatgcgctttatgaaggttaccccttatcaacggctcttgcaagaccgctgattgctataaaaattgcagaacttgcaaaagaaattggggcggatgcaatttcacacggctgtactggaaaaggaaatgaccaatttagatttgagtccgtaataagaacaaaagcacctgaaattgaaataattgccccggtaagggatttaaaccttacaagaacagaagaaatccaatatgcaaaagaaaaaggaattccaattccagttgatttagaaaaaccatttagtatcgatgaaaacttatggggtagaagtattgaaggcggaattttagaaaacccaatgattgaaactccaaaagagtgttttgcatggactgttgacccgaaaatagcaaaagatgaagaagagtacgtagaaattgaatttaaggcaggggttccagttgcaataaacgggcaaaaatttgatgctattaatgtaataaaagaagcaaataaacttgctgggagaaacggcgttggtagggtagatattatagaagatagggttttaggccttaaatcaagagaaaattatgaatgccccggtgcaattttattaataactgcacataaggcacttgagcaactcgttttatcaagagaagaattagtatttaaagaaatggtggattcaaagtatgcagacttaatttacaaaggactatggcacgaacctttaagacatgatttagatgcatttgtagacaaaacgcaagaaagaatgaatggaatagttcgggcaaaactttacaaaggttctttaagaattgttggaagggaaagcgaatgtgcactttatcaagaaaacatggtttcattcgagaataaggacatggatcagagagaaatcgtaggaatggttaaattccacggacttcaagctgcaatttttgaaagtcttaggaataaataattaatttttttaaaattagggcaaaaaagcccatttttttatcctgttaataatttaaaagaaatatggctaaaatcagagtggtgatactttcaatacaaagttac

SEQ ID NO: 25138 - protein, 397 aa, Methanococcus vannielii
MQEKIAVLAYSGGLDTSCCLKLLEDKYNYKVVSVAVDVGQPEDDLKEPEEKAKKLGVLKHYTIDAKEEFAVDYIFRAIKANALYEGYPLSTALARPLIAIKIAELAKEIGADAISHGCTGKGNDQFRFESVIRTKAPEIEIIAPVRDLNLTRTEEIQYAKEKGIPIPVDLEKPFSIDENLWGRSIEGGILENPMIETPKECFAWTVDPKIAKDEEEYVEIEFKAGVPVAINGQKFDAINVIKEANKLAGRNGVGRVDIIEDRVLGLKSRENYECPGAILLITAHKALEQLVLSREELVFKEMVDSKYADLIYKGLWHEPLRHDLDAFVDKTQERMNGIVRAKLYKGSLRIVGRESECALYQENMVSFENKDMDQREIVGMVKFHGLQAAIFESLRNK

SEQ ID NO: 25139 - DNA, 2171 bp, Streptomyces coelicolor
  CDS (317)..(1780)
ccggccgcgggccttaccttcgacgacgaggacgaggtggtccgccgggccaacgacaccccctgggctcgtcggcacgtcttcaccgagggcctggaccgcgccctgcgtcagcgagcgcctggacgtcggcatggtcggactcaacaccggcctggtctccaatcccgccgcgcccttcggaggcgtcaagcagtcggggctcggccgggagggcggccgggtcgggatcgaggagttcctggagtaccagtacgtggcgctgccgaccgggtgacgtggcgacgccggaagaggctttgcatggtcatgcgtaatgatgcatactcttcctatgtccaaggtcctcacctccctccccaccggcgagcgcgtcggtatcgccttctcgggcggcctcgacacctcggtcgcggtcgcgtggatgcgtgacaagggcgccgtcccctgcacgtacaccgccgacatcggccagtacgacgagcccgacatcgcctcggtgcccgaccgtgccaagacgtacggcgccgaggtcgcgcgcctggtcgactgccggcggcgctggtcgaggaggggctggggcgcgctcacctgcggggcgttccacatccgctcgggcgggcgggcgtacttcaacaccacgccgctgggccgcgccgtcacgggcaccctcctcgtccgggccatgctcgaggacgacgtccagatctggggcgacggctccacgttcaagggcaacgacatcgagcggttctaccggtacggcctgctcgccaacccgcagctgaggatctacaagccctggctggacgcggacttcgtgacggagctcggcgggcgcaaggagatgtcggagtggctggtcgcccacgacttcccctaccgggactccacggagaaggcgtactccaccgacgccaacatctggggcgccactcacgaggccaagacgctggagcacctcgacaccggcgtggagaccgtggagcccatcatgggcgtgcggttctgggacccgtcggtcgagatcgcgcccgaggacgtgaccatcggcttcgaccagggccgcccggtgacgatcaacggcaaggagttcgcctccgcggtcgacctggtcatggaggccacgccgtcggcggccggcacggcgatgggcatgtccgaccagatcgagaaccggatcatcgaggccaagagccgcggcatctacgaggcgcccggcatggctctgctgcacgccgcctacgagcgcctggtcaacgccatccacaacgaggacaccctcgcccagtaccacaccgaggggcggcccctgggccggctgatgtacgagggccgctggctggacccgcagtccctgatgatccgcgagtcgctgcagcgctgggtcggctccgcggtcaccggcgaggtcaccctccggctgcggcgcggcgaggactactcgatcctcgacaccaccggcccggccttcagctaccacccggacaagctctccatggagcgcaccgaggactccgcgttcggcccggtggaccggatcggccagctgaccatgcgcaacctggacatcgccgactcccgcgccaagctggagcagtacgccgggtcccggttcatcggcaccgccaacccgcccatcggcgccgcccaggccgccgcgaccgggctgatcggcgccatgccggagggtggcgcgcaggccatcgcctcccgcggcgaggtctccgccgacgacgagctgctggaccgcgccgcgatggagtccggcacggactgatccatccgccccgtcgtccgggggccccgcaccggcaagggccgctcgacacccgaggcccttctgcgtgccccgtccgttgctccacctcggtgcatgacttgcgtgacttgccgacttggaacggtctgttcaccgcccgcggccgttgttgccagttcacgtgctgcgcaagctgtcgcaagcaacgcaagtcgtttacgtgccaattcccgccccaaccgcgaccgttgacaaaccggtgacgcgctagaaacctgatgacgcactttccgcaaagaatcgactgtcctgctcaattggcgcgcagattcggtgcttccccccaactgccgggccgtcgcgcactccccgactccccacggaacagaggacccccatgagaacggag

SEQ ID NO: 25140 - protein, 487 aa, Streptomyces coelicolor
MMHTLPMSKVLTSLPTGERVGIAFSGGLDTSVAVAWMRDKGAVPCTYTADIGQYDEPDIASVPDRAKTYGAEVARLVDCRRRWSRRGWGALTCGAFHIRSGGRAYFNTTPLGRAVTGTLLVRAMLEDDVQIWGDGSTFKGNDIERFYRYGLLANPQLRIYKPWLDADFVTELGGRKEMSEWLVAHDFPYRDSTEKAYSTDANIWGATHEAKTLEHLDTGVETVEPIMGVRFWDPSVEIAPEDVTIGFDQGRPVTINGKEFASAVDLVMEATPSAAGTAMGMSDQIENRIIEAKSRGIYEAPGMALLHAAYERLVNAIHNEDTLAQYHTEGRPLGRLMYEGRWLDPQSLMIRESLQRWVGSAVTGEVTLRLRRGEDYSILDTTGPAFSYHPDKLSMERTEDSAFGPVDRIGQLTMRNLDIADSRAKLEQYAGSRFIGTANPPIGAAQAAATGLIGAMPEGGAQAIASRGEVSADDELLDRAAMESGTD

SEQ ID NO: 25141 - DNA, 1212 bp, Bacillus subtilis
  CDS (1)..(1212)
atgtcagaacagaaaaaagtcgtattagcatactcaggaggtcttgatacttccgtcgcaataaaatggcttcaggagcaaggatataatgtaatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatctctttgcaggcccacacaatgtatgaaggaaaatacccgcttgtttcggcattatctcgaccgctgatcgcgaaaaaactggttgaaattgcggaaaaagaagatgcacaggcgattgcccacggatgcacagggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgaccaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagaaatcatttacaacggcttatggttctcaccgttaaaagacgcgctgcacgctttcttaaaagaaacgcaaaagcatgtcacaggcattgtccgcgtgaagctgtttaaaggccatgcaattgtagaaggacgtaaatcggaatactctctatatgatgaaaaacttgcaacatatacaaaagacgatgcatttgatcaccatgcagcaatcggatttatcgagctttggggacttccgacaaaagtgaacagcatcgtgaaaaagaaggagcagattaaagcatga

SEQ ID NO: 25142 - protein, 403 aa, Bacillus subtilis
MSEQKKVVLAYSGGLDTSVAIKWLQEQGYNVIACCLDVGEGKDLAFVQQKALEVGATNSYVIDAKEEFAQDYALISLQAHTMYEGKYPLVSALSRPLIAKKLVEIAEKEDAQAIAHGCTGKGNDQVRFEVSIKSLNPDLEVIAPVREWQWSREEEIEYAASRGIPIPINLDSPYSIDQNLWGRANECGILEDPWAAPPEGAYDLTAPLEKTPDTPEVIEIAFEQGVPVSIDGVSYSLSELILKLNEMAGAHGVGRIDHVENRLVGIKSREVYECPGAMTLIKAHKELEDLTLVKEVAHFKPIIEQKMSEIIYNGLWFSPLKDALHAFLKETQKHVTGIVRVKLFKGHAIVEGRKSEYSLYDEKLATYTKDDAFDHHAAIGFIELWGLPTKVNSIVKKKEQIKA

SEQ ID NO: 25143 - DNA, 1206 bp, Aquifex aeolicus
  CDS (1)..(1206)
atgaagaaaaagagggtaattctcgcatactcgggcggactcgacacatccataatagtgagatggctcacggaaaaagggtacgaggtaataacatacaccgcggacgtgggacagggagaagaactctctgaaattcccgaaaaggcaaggagagcgggagcgattgaagccatagtagaggatttaaaagaaacctttgcggaaaattactgccttccaactttgagggcattagccctttacgaagggaagtaccccctcaccgcagccctctcaagacctctcatagcagagaggctcgtttactatgccgaaaagttcaacgcggactacgtagcacacggctcaactgggaagggaaacgatcaggtgaggtttgaactctcagtctgggccctaaaccccgatatagaggttctcgctcccgtgagagaatgggagttcaaatcaagggaagaacaagttgagtacgctcagaggttcaacatccccgttaaagctacgaaagaaaagccatactccatagacaggaacctctggggcgtttccatagagtgcggacccttagaagacccgtggcaagaaccaccgcaagacgcttaccagatcacccaatcccctgaagaggctccggatgaaccagaatacgttaccgtgggttttgaaaaaggaaaacccgtttacctgaacggtgagcgctacgaagagcagtggaaattgatagccaacctaaatgaaatagcgggaagacacggtgtgggaaggatagacatggttgaaaacagactcgtagggataaagagcagggagatatacgaagctcccggagccatggttctctacgaagcatacagggatttactctctttagttcttgacaggtttaccttccactacttcctcacccatattccccacgagtacgcaaagctcgtttacgaaggtctctggttcacccccttgagggaagcgcttgacgcctttacgaataaaatcgccgagttcgcaacgggagaagtaagattaaaactctacaaaggaagtgtaagcgttgttgggagacgttcacccaactccctttacgttgaagagctcgcaacttactcggaaaaggaccaatttgaccaaatagcaggtaagcacttcacaaaggtatggggacttccactgaaggttctgggaagggtgagaaaaggtaaatag

SEQ ID NO: 25144 - protein, 401 aa, Aquifex aeolicus
MKKKRVILAYSGGLDTSIIVRWLTEKGYEVITYTADVGQGEELSEIPEKARRAGAIEAIVEDLKETFAENYCLPTLRALALYEGKYPLTAALSRPLIAERLVYYAEKFNADYVAHGSTGKGNDQVRFELSVWALNPDIEVLAPVREWEFKSREEQVEYAQRFNIPVKATKEKPYSIDRNLWGVSIECGPLEDPWQEPPQDAYQITQSPEEAPDEPEYVTVGFEKGKPVYLNGERYEEQWKLIANLNEIAGRHGVGRIDMVENRLVGIKSREIYEAPGAMVLYEAYRDLLSLVLDRFTFHYFLTHIPHEYAKLVYEGLWFTPLREALDAFTNKIAEFATGEVRLKLYKGSVSVVGRRSPNSLYVEELATYSEKDQFDQIAGKHFTKVWGLPLKVLGRVRKGK

SEQ ID NO: 25145 - DNA, 1206 bp, Staphylococcus aureus
  CDS (1)..(1206)
atgaaagagaaaattgttttagcatattcaggaggactagatacaagtgtggccgttcaatggcttatcgacaaaggatacgacgttgtagcttgttgcctagatgttggtgaaggtaaagatttagacatcgtttataaaaaagctttagatatgggagcagttgaatgtcatattattgatgcaacaaaagaatttagtgatgagtatgtaagttatgcaatcaaaggaaatttaatgtatgaaaatgcatatccattagtttcagctttatcaagaccattaatcgctaaaaaattagtagagattgctgagaaaacaaattcagtaggtattgcacatggttgtactggtaaagggaatgaccaagtacgtttcgaagttgccattaaagcattaaacccatcattgaaagcattcgcacctgtacgtgagtgggcatggagtcgtgaagaagaaatcgattatgcaattaaacataatatccctgtatcaatcaaccatgattcaccttattctatcgatcaaaatctatggggcagagcgaatgaatgtggtattttagaagatccttatgctgcgccaccagaggatgcgttcgatctaacaaatgctttagaagaaacaccagatactgctgatgaaatcattttaacgtttgataaaggcatcccagttcaaattgatggcaaaacatatgaattagacgatttaattttaacgttgaatgcattagctggtaagcatggtatcggaagaattgaccatgtagaaaatagacttgtaggtatcaaatcaagagaaatttatgaggcacctgctgcagaagttattttaaaagcgcataaagcattagaaacgattacgttaactaaagatgtcgcacactttaaaccaatcattgagaagcaatttgctgaacaactatacaatggactttggttctcacctttaactgatagcttgaaattatttattgatagtactcagcaatacgtaagtggtgatgtcagaattaaattattcaaaggtaatgccatcgtgaatggtagaaaatcaccttacacattatatgatgaaaaattagcaacttatacaaaagaagatgcatttaatcaagacgctgctgttggctttatcgatatctatggtttacctactcaagtaaatgcgatgttgcatggaggctatagcaatgagcaataa

SEQ ID NO: 25146 - protein, 401 aa, Staphylococcus aureus
MKEKIVLAYSGGLDTSVAVQWLIDKGYDVVACCLDVGEGKDLDIVYKKALDMGAVECHIIDATKEFSDEYVSYAIKGNLMYENAYPLVSALSRPLIAKKLVEIAEKTNSVGIAHGCTGKGNDQVRFEVAIKALNPSLKAFAPVREWAWSREEEIDYAIKHNIPVSINHDSPYSIDQNLWGRANECGILEDPYAAPPEDAFDLTNALEETPDTADEIILTFDKGIPVQIDGKTYELDDLILTLNALAGKHGIGRIDHVENRLVGIKSREIYEAPAAEVILKAHKALETITLTKDVAHFKPIIEKQFAEQLYNGLWFSPLTDSLKLFIDSTQQYVSGDVRIKLFKGNAIVNGRKSPYTLYDEKLATYTKEDAFNQDAAVGFIDIYGLPTQVNAMLHGGYSNEQ

SEQ ID NO: 25147 - DNA, 1203 bp, Clostridium acetobutylicum
  CDS (1)..(1203)
atgaaagagaaagttgtgttagcttattcaggtggacttgatacgtctgtaacaattccatggcttaaagataattatgatgttgaggtaatagctgtatgtgttaacgtaggacaagaagatgatatggataaagttaaagaaaaagctgtaaatagtggagcggctaaaatatatgttgaagatgttaaagaggaatttgtgactgagtatttatacaatgccataaagtggaatgccacttatgaaggaaaatatcttttgggaacttcctttgctagacctttaattgcaaagaagctagttgaagttgcacataaagaaggagctaaatatatatgtcatggctgtacaggaaaaggaaacgatcaagtgcgttttgaaacggctattgcagcaatggatccctacattaagataattgctccatggagactttggaatatagattcacgagaagcagaaatagattatgcattatcaaaaggagtagaggttccagtaacaaaggagaagatttattccgaggactggaatttatggcatataagtcacgaaggtggggatttggaagatcctaaaaatgagcataaggaagaaatgtataaatgtgttactccacctgaagaagcaaaggatgaaccagcatatataagcatatattttgaaaagggtgtaccatgtaaaataaatggagaagagctagagcctgttaagcttattgaaaaggtaaataaagtggcaggagaaaatggtataggagttgtagatcttgttgagaacagacttgttggaatgaagtccagaggagtatatgagacgccagggggaactcttctttatgaagcacatgctcaacttgagagactaactgtagataaggatgcatatcactataagcaagtacttgcgcttaagtattcagagcttgtatatgatggtttatggtttacgacaacaagagaggcgcttgatgcatttgttgatacagttgaagaaaatgtgacaggtacagtaaagcttaaattatataagggaaatatgaaagtctctagtgttgagtctgaaaatgcattgtatgatgagggaatatcatcttttggggcaagtgatttatatgatcacaaagatgcgcaaggatttataaatttattcagccttccaagcaaaataaaagctatgaagaagttggagaagaaataa

SEQ ID NO: 25148 - protein, 400 aa, Clostridium acetobutylicum
MKEKVVLAYSGGLDTSVTIPWLKDNYDVEVIAVCVNVGQEDDMDKVKEKAVNSGAAKIYVEDVKEEFVTEYLYNAIKWNATYEGKYLLGTSFARPLIAKKLVEVAHKEGAKYICHGCTGKGNDQVRFETAIAAMDPYIKIIAPWRLWNIDSREAEIDYALSKGVEVPVTKEKIYSEDWNLWHISHEGGDLEDPKNEHKEEMYKCVTPPEEAKDEPAYISIYFEKGVPCKINGEELEPVKLIEKVNKVAGENGIGVVDLVENRLVGMKSRGVYETPGGTLLYEAHAQLERLTVDKDAYHYKQVLALKYSELVYDGLWFTTTREALDAFVDTVEENVTGTVKLKLYKGNMKVSSVESENALYDEGISSFGASDLYDHKDAQGFINLFSLPSKIKAMKKLEKK

SEQ ID NO: 25149 - DNA, 1221 bp, Campylobacter jejuni
  CDS (1)..(1221)
atgaaaaatgaagtaaaaaaagtagttttagcgtattctggagggcttgatacgagcattattttaaaatggcttcaagatgagtataattgtgaagttgtaacttttacagcagatattggtcaaggcgaagaactcgaacctgcgagaaaaaaagccctttctttaggcataaaagaagaaaatattttcattaaagatttaagagatgaatttgttaaagattatgtatttcctatgtttagagccaatgcaatttatgaaggagagtatcttttaggaacaagtatagcaagaccactcatagcaaaaactcaagcacaaattgccctgcaaacaggtgctgatgcggtaagtcatggcgccacaggcaaaggaaatgatcaagtgcgttttgaacttggttatcttgcttttagtcccgatttaaaaatcatcgctccatggcgtgagtgggatttaaacagtcgtgaaaaactccttgcttatgcgcaaaaacatggcattgatatttctaagaaaaaaggaaaatccccttattctatggacgcaaatttacttcatatttcttacgaaggacttgttttagaagatcctgcacacgcacctgaagaagatatgtggagatggagtaaaagcccaaaagacgctccaaatgaaagtgaaattatagaacttgatttccaaaaaggagatttagtagcgataaatggagaaaaactaagtcctgcaggacttttaaccaaacttaacgaactaggctgcaaacacggtataggacgccttgatatagtagaaaatcgctatgtaggcatgaaaagccgtggttgttacgaaactccaggcggtactatacttttaaaagcacatagagcgcttgaaagcatcacgcttgatagagaagcagcacacttaaaagatgaactcatgccaaaatacgcgagtttaatttataatggctattggttctcgcctgaaagaatgatgcttcaagccttaatcgatgagtctcaaattcacgccaatggcagagtaaagctcgagctttataaaggcaatgtgatggttataggacgcgaaagtgcgaacgatagcttgtttaacgcagcttattgtacttttgaagaagatgaagtgtataatcaaaaagacgcagcaggctttatcaagcttaatgctttgcgttttatcatcgcaggaaaaaatggaagaaaattttaa

SEQ ID NO: 25150 - protein, 406 aa, Campylobacter jejuni
MKNEVKKVVLAYSGGLDTSIILKWLQDEYNCEVVTFTADIGQGEELEPARKKALSLGIKEENIFIKDLRDEFVKDYVFPMFRANAIYEGEYLLGTSIARPLIAKTQAQIALQTGADAVSHGATGKGNDQVRFELGYLAFSPDLKIIAPWREWDLNSREKLLAYAQKHGIDISKKKGKSPYSMDANLLHISYEGLVLEDPAHAPEEDMWRWSKSPKDAPNESEIIELDFQKGDLVAINGEKLSPAGLLTKLNELGCKHGIGRLDIVENRYVGMKSRGCYETPGGTILLKAHRALESITLDREAAHLKDELMPKYASLIYNGYWFSPERMMLQALIDESQIHANGRVKLELYKGNVMVIGRESANDSLFNAAYCTFEEDEVYNQKDAAGFIKLNALRFIIAGKNGRKF

SEQ ID NO: 25151 - DNA, 1239 bp, Pseudomonas aeruginosa
  CDS (22)..(1239)
cgacccccgtggagtgatggcatggcggatgtgaagaaggtagtcctggcgtattccggcggcctggatacctcggtaattctgaagtggttgcaagatacctataactgcgaagtggtgaccttcaccgccgacctcggccagggcgaggaagtcgaaccggctcgcgccaaggcccgcgcgatgggcgtcaaggaaatctacatcgacgacctgcgcgaagaattcgtccgcgacttcgtctacccgatgttccgcgccaacaccgtctacgaaggcgagtacctgctgggcacctccatcgctcgtccgctgatcgccaagcgcctgatcgagatcgccaacgagaccggcgccgacgccatctcccacggcgccaccggcaagggcaacgaccaggtccgcttcgagctgggcgcctacgcgctgaagcccggcgtcaaggtgatcgcgccctggcgcgagtgggacctgctgtcccgcgagaagctgatggactatgccgagaagcacggcatcccgatcgagcgccacggcaagaagaagtcgccgtactcgatggacgccaacctcctgcatatctcctacgaaggcggcgtgctggaagatacctggaccgagcacgaagaagacatgtggaagtggaccgcttccccggaaaacgcgccggacaccccgacctacatcgagctgacctaccgcaagggcgacatcgtcgccatcgacggcaaggacatgaccccggccgaggtgctcaccgagctgaaccgcgtcggcgggatcaacggcatcggccgcctcgacatcgtcgagaaccgctatgtcggcatgaagtcccgtggctgctacgagacccccggcggcaccatcatgctcaaggcccaccgcgccatcgagtcgatcaccctggaccgcgaagtggcccacctgaaagacgagctgatgcccaagtacgccagcctgatctacaccggctactggtggagcccggagcgcctgatgctgcagcagatgatcgacgcctcgcaggtcaacgtgaacggtgtagtgcgcctgaagctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctga

SEQ ID NO: 25152 - protein, 405 aa, Pseudomonas aeruginosa
MADVKKVVLAYSGGLDTSVILKWLQDTYNCEVVTFTADLGQGEEVEPARAKARAMGVKEIYIDDLREEFVRDFVYPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWKWTASPENAPDTPTYIELTYRKGDIVAIDGKDMTPAEVLTELNRVGGINGIGRLDIVENRYVGMKSRGCYETPGGTIMLKAHRAIESITLDREVAHLKDELMPKYASLIYTGYWWSPERLMLQQMIDASQVNVNGVVRLKLYKGNVVVVGRKSDDSLFDANIATFEEDGGAYNQADAAGFIKLNALRMRIAANKGRTLS

SEQ ID NO: 25153 - DNA, 1230 bp, Bacillus halodurans
  CDS (1)..(1230)
atgagcaaaaagaaagttgtcttagcgtattctgggggattagatacatctgtagccattaagtggcttagcgataaaggatatgatgtcattgccgttggccttgatgtcggtgaaggaaaggatcttgaatttgtaaaggaaaaagcattgaaagtaggcgcgatcgaatcgtatacaattgatgcgaaaaaagaatttgcggaagaatttgttttgccggcattgcaagcacatgcgttgtatgaacaaaaatacccgcttgtttccgccctatctcgtccattgatttcgaaaaagcttgtagaaatcgcggaacaaacaggcgcacaggcagtagcccacggttgtaccggaaaaggaaacgatcaagtgcgctttgaggtatcgatccaagcattaaatccaaacttagaagttttagcccctgtacgtgagtgggcatggtctcgtgatgaagagattgagtacgctaagaaaaacaacattccaattccgattgatttagataatccgtactctgtcgatcaaaacctatggggacgtagcaacgagtgcggaattttagaagatccgtgggcaacacctccagaaggtgcttatgagttaacagtcgcaatcgaggatgctcccgatcaaccagaaattgtggaaattggatttgaaaaaggaatccctgttacgttgaacgggaaaagctatccagtccatgaattgatcctagagttgaatcaaatcgcaggtaagcatggagttggacgaattgatcacgtagaaaatcgcttggtcggtattaagtctcgtgaagtgtacgaatgtcctggagcgatgacactcattaaagctcataaagagttggaggatttaacgttaacaaaagaagtggcccattttaaaccagttgtagagaaaaaaatagcagagctcatttatgaaggtctttggttctcaccacttcaacccgctttgtctgccttcttaaaggaaactcaatccacagtgactggggttgtacgggtaaaactgtttaaagggcacgccattgtagaaggacgtaaatcagagtattccctttataatgaaaagctagccacttacacaccagatgacgaatttgatcataatgcagcggtaggcttcatctccttatggggactaccaacgaaagtgtatagtatggtgaacaaggaaatgaaggaaaagcaagagaagaaggaggttacatcgtga

SEQ ID NO: 25154 - protein, 409 aa, Bacillus halodurans
MSKKKVVLAYSGGLDTSVAIKWLSDKGYDVIAVGLDVGEGKDLEFVKEKALKVGAIESYTIDAKKEFAEEFVLPALQAHALYEQKYPLVSALSRPLISKKLVEIAEQTGAQAVAHGCTGKGNDQVRFEVSIQALNPNLEVLAPVREWAWSRDEEIEYAKKNNIPIPIDLDNPYSVDQNLWGRSNECGILEDPWATPPEGAYELTVAIEDAPDQPEIVEIGFEKGIPVTLNGKSYPVHELILELNQIAGKHGVGRIDHVENRLVGIKSREVYECPGAMTLIKAHKELEDLTLTKEVAHFKPVVEKKIAELIYEGLWFSPLQPALSAFLKETQSTVTGVVRVKLFKGHAIVEGRKSEYSLYNEKLATYTPDDEFDHNAAVGFISLWGLPTKVYSMVNKEMKEKQEKKEVTS

SEQ ID NO: 25155 - DNA, 1191 bp, Halobacterium sp. NRC-1
  CDS (1)..(1191)
atgccatcaggaaccgtcgcgctcgccttctcgggcgggctcgacacgacagtctgtgtcccgctgttgaaagaggagtacggctacgacgacgtgatcggcgtcaccgtcgacgtcgggcagcccgacgccgagttcgcggcggcccgggagaccgccgccgcgctgggcgtcgagcaccacgtcgtcgacgccacggccgagttcgccgcgctgtgtttcgacgccgtgcgggccaacgcgacctaccaggggtatccgctcggcaccgcgcttgcccgcccggtcatcgccgacgccatcctgtcggtggccgaagccgagggctgtgcggcgctggcccacggctgcacggggaagggaaacgaccagttgcgcttcgaggcggtgtggcgcgccagcgaccacgacgtgtgtgcgcccgtccgcgagctcgggttgacccgcgagtgggagatcgagtacgccgccgagcgcgacctcccggtggaggcgggcaacgagggcgagtggagcatcgacacgaacctctggagtcgcagcgtggagggcggccacctggaggagcccgactaccagccgcccgcggacatctacgcgtggaccgacgcgccgagcggtgagacgggcaccgtcgacatcaccttcgaggccggggtgccggttgccgtcgacgggacggcgatggagccggtggcgctcatcgaggcgctgaacgaccgcgcggggagctacggcgtcggccgcacggacatgctcgaagaccgcatgctggggttgaaagtccgcgagaactacgagcatccggccgcgaccacgctgctggcggcccacaaggccttggaggggctcgtgttgacgaaggccgagcgggatttcaccgcggcggtgagccagcagtgggcgcaaaaggcctacgagggggtcgtcgagcatccgctgatggacgcgctgaacgggtatctggacgaaacccagtcggcggtcagtggcacggtgaccatcgccttcgagggcgggcgggcgcgcccgatcgcccgcgagagcgagcacgcggtgtactccgcggacgcggcgtcgttcaacaccgagaccgtggcggggatcgagcaggccgacgccacgggggtcgcgaagtaccacggcttccagtcgcggttggcgaacgcggcgttcgacggcaacaaatga

SEQ ID NO: 25156 - protein, 396 aa, Halobacterium sp. NRC-1
MPSGTVALAFSGGLDTTVCVPLLKEEYGYDDVIGVTVDVGQPDAEFAAARETAAALGVEHHVVDATAEFAALCFDAVRANATYQGYPLGTALARPVIADAILSVAEAEGCAALAHGCTGKGNDQLRFEAVWRASDHDVCAPVRELGLTREWEIEYAAERDLPVEAGNEGEWSIDTNLWSRSVEGGHLEEPDYQPPADIYAWTDAPSGETGTVDITFEAGVPVAVDGTAMEPVALIEALNDRAGSYGVGRTDMLEDRMLGLKVRENYEHPAATTLLAAHKALEGLVLTKAERDFTAAVSQQWAQKAYEGVVEHPLMDALNGYLDETQSAVSGTVTIAFEGGRARPIARESEHAVYSADAASFNTETVAGIEQADATGVAKYHGFQSRLANAAFDGNK

SEQ ID NO: 25157 - DNA, 1221 bp, Sulfolobus solfataricus
  CDS (1)..(1221)
atgatatcaattgtttttaagcttcttctttaccctttttgtgaaatgaaaatagtccttgcatactctggtggacttgatactacagtatcgattagatggctaaaggaaacctttaaggctgagattataacagttactgtagatgttggtcaaaaggacgattttaagaaaatagaagaaagagcgtatatagccggcgcctcaaagcattatacaatagacgctgttaggcaatttgccaacaattacatagcatatgcgataaaattaaatggattatatgaaggagtctatccgttgtcaacggcattggcaagaccattaatagcagaaaaagtagttgaagttgcaaaaaaggaaggagctgaagccgtagctcacggttctacatctaagggaaatgatcaagtgagatttgaccttgcagttaaggcattataccctgacgttaagataatagcaccagctagaatatggaatatgactagagaagacgaaataaaatacgctaaagagaaaggaatacctatcaaggttgaaagtgacaaatacagcatagatgagaatctttggggaagaagtatagaaggagacataatctctgatccttctcttgaagtcccagaagatgcctttgaatggactaaacagatctacaataaaaaggaaatagtctctatagaatttagtaatggagttcctacagctgtgaacggagaaaaaatggaattaaataagttagtagattttctaaatttaaaattcggaagccatggatttggaagggtagaacatatagaaaatagagttgttggatttaagtctagagaggtatatgaagtaccagctgctctaggtctaatttacgctcatattgacttagaaaaaactatctatactccaatggaattaagattcaaaagacacatagatcagttatggtctgatctagtatatcaaggattatggtttgagccactaagagagacattacataaagttgctgatgaaatgaataaatggattagcggagaagcgaaggttgaagttagtaatggttcgttcagaatagtaggtagagaatcagaatattctccatattctgaaaaaattgctagttataacaaaggatggtatccaagcgacgaaatggctaggggatttatagagatttggggaatgcactcactaatagcgagaagagtaaggggactttga

SEQ ID NO: 25158 - protein, 406 aa, Sulfolobus solfataricus
MISIVFKLLLYPFCEMKIVLAYSGGLDTTVSIRWLKETFKAEIITVTVDVGQKDDFKKIEERAYIAGASKHYTIDAVRQFANNYIAYAIKLNGLYEGVYPLSTALARPLIAEKVVEVAKKEGAEAVAHGSTSKGNDQVRFDLAVKALYPDVKIIAPARIWNMTREDEIKYAKEKGIPIKVESDKYSIDENLWGRSIEGDIISDPSLEVPEDAFEWTKQIYNKKEIVSIEFSNGVPTAVNGEKMELNKLVDFLNLKFGSHGFGRVEHIENRVVGFKSREVYEVPAALGLIYAHIDLEKTIYTPMELRFKRHIDQLWSDLVYQGLWFEPLRETLHKVADEMNKWISGEAKVEVSNGSFRIVGRESEYSPYSEKIASYNKGWYPSDEMARGFIEIWGMHSLIARRVRGL

SEQ ID NO: 25159 - DNA, 1173 bp, Archaeoglobus fulgidus
  CDS (1)..(1173)
atgaaggttgtgctgtcatattccggtgggcttgatacgacggtctgcatccctctgcttaaagagaagtacggttttgatgaggttatcacggtcaccgttgacatagggcagcctgaagcggatataaagcaggcagaggagaggggaaagaagtatgcggacaagcactacacaatcgatgcgaaaaaggagtttgttgattccctcttcatgctgatcaaggctaacggcaattacgaaggttacgttttgggaacggctttggctaggccgctgatagccgaaaaggttgttgaagtcgccaagaaggagggggctgaggcggttgctcatggatgcacggggaagggaaacgaccagctcagattcgagaacattttcaggcagcacggatttaaggtcatcgcccccgtgagagagctgaacctcacgagagagtgggaaatcgaatacgcgaggcagcacggcattgaggtgcccgcaacaaaggagaagccgtacagcatcgacgagaatctctggagcaggagcgttgagggagggaagctggaagatccatccttcgagccgcctgaggacatctacgagtggacagcgagcccggaaaaggctccagacaagccagagatcgtaaagatagatttcgagaagggagttcctgtagcgctgaacgatgagagaatgggcggatttgagctgataaaagcccttaacgagattggcggaaagcacggagtgggaagaacggacatgattgaggacagggttctcggactgaaggcgagggagaactacgagcatcctgcagccacaatccttataacagcccacagggaccttgaaaacctcgtcctcagcagaagggagctgaagttcaagaagttcgttgaggaggagtgggcggagcttgtttactatggcctggtcaacgacccgcttttcgacgctctgaacgccttcatagacaagacacaggagagggtgacggggtgggttaaagttaagctttacaagggctccgcagttgttgtggccagaaactcaccctacgccctttactcggaagagctcgtctccttcgacacggagtccattgaccagcgccttgctgagggatttgcggcattccacggtctgcagggcaggctgttcaggaggctgtttcaataa

SEQ ID NO: 25160 - protein, 390 aa, Archaeoglobus fulgidus
MKVVLSYSGGLDTTVCIPLLKEKYGFDEVITVTVDIGQPEADIKQAEERGKKYADKHYTIDAKKEFVDSLFMLIKANGNYEGYVLGTALARPLIAEKVVEVAKKEGAEAVAHGCTGKGNDQLRFENIFRQHGFKVIAPVRELNLTREWEIEYARQHGIEVPATKEKPYSIDENLWSRSVEGGKLEDPSFEPPEDIYEWTASPEKAPDKPEIVKIDFEKGVPVALNDERMGGFELIKALNEIGGKHGVGRTDMIEDRVLGLKARENYEHPAATILITAHRDLENLVLSRRELKFKKFVEEEWAELVYYGLVNDPLFDALNAFIDKTQERVTGWVKVKLYKGSAVVVARNSPYALYSEELVSFDTESIDQRLAEGFAAFHGLQGRLFRRLFQ

SEQ ID NO: 25161 - DNA, 1209 bp, Deinococcus radiodurans
  CDS (1)..(1209)
atgagcaaggaaaaaatcgtactcgcgtacagcggcggcttagacacctccatcatcctcaagtggctccagaccgagcgcaactacgacgtggtgtgcttcaccgccgacctcgggcagggcgacgaggtggaagaagcccgtgtcaaggcgttgaacaccggcgcggtggcggcctacgcccttgacctgcgcgaagaattcgtgcgcgactacgtgtttccgatgatgcgctcctcggcgctgtacgagggctactacctgctcggcacgtccatcgcccggcccctgattgccaagaagatggtcgagattgccgagaaggagggcgcggtcgccatttcgcacggcgcgaccggcaagggcaacgatcaggtgcgcttcgagatgagcgcctacgccctcaagcccgacatcgtgaccgtggccccctggcgtgactgggactttcagggccgcgccgacctcgaagcctttgcccgcgagcacggcattccggtgcccaccaccaagaaagacccctggagcatggacgccaacatgctgcacatctcctatgagggcggcccgctcgaagacccctggactgagccgcccacccacatgttcaagctgacggtgaaccccgaggacgcgccgagcgaggccgaatacgtcgaaatcgagtacgtgaacggcgacccggtgagcatcaacggtgaacagctctcgcccgccgcgctgctgacgaaggcgaacgaaatcgccgggcgtcacggcgtgggccgcatcgacctcgtggagaaccgcttcgtgggcatgaagtcgcgcggcgtgtacgaaacgcccggcggcacgctgctgtaccacgcccgccgcgccgtggaaagcctgaccctcgaccgcgaagtgctgcatcagcgcgacgccctggggccgaagtacgccgaactggtctataacggcttctggttcgcccccgagcgcgaagccttgcaggtctactttgaccatgtggccaaaagcgtgacgggcaccgctcgcctgaagttgtacaagggcaactgcatcgtggcaggccgcaaggccgagcgcagcctctacgacaaggacctcgtgagcttcgaggcgggcggtgactacaaccagcacgacgccggagccttcatcaagctcaactcgctgcggatgcgggtgcaaaagcgcgtggaggataaagggaagaagtaa

SEQ ID NO: 25162 - protein, 402 aa, Deinococcus radiodurans
MSKEKIVLAYSGGLDTSIILKWLQTERNYDVVCFTADLGQGDEVEEARVKALNTGAVAAYALDLREEFVRDYVFPMMRSSALYEGYYLLGTSIARPLIAKKMVEIAEKEGAVAISHGATGKGNDQVRFEMSAYALKPDIVTVAPWRDWDFQGRADLEAFAREHGIPVPTTKKDPWSMDANMLHISYEGGPLEDPWTEPPTHMFKLTVNPEDAPSEAEYVEIEYVNGDPVSINGEQLSPAALLTKANEIAGRHGVGRIDLVENRFVGMKSRGVYETPGGTLLYHARRAVESLTLDREVLHQRDALGPKYAELVYNGFWFAPEREALQVYFDHVAKSVTGTARLKLYKGNCIVAGRKAERSLYDKDLVSFEAGGDYNQHDAGAFIKLNSLRMRVQKRVEDKGKK

SEQ ID NO: 25163 - DNA, 1197 bp, Lactococcus lactis subsp. lactis
  CDS (1)..(1197)
atgatgggaaacaaaaaaattgtcttggcatattcgggtggattggatacaagtgttgctgtaaaatggttgactgataaaggatttgacgtcattgctgactgcatggacgttggtgaaggaaaagacttgaattttattcatgataaggcgcttcaagtaggggcagtggaatctgttgttttggattgcaaggaagaattcgctaaaatatttgttggagctgcactcaaaggaaatttaatgtatgaaaataaatatcctttagtatccgctttgagtcgccctttgattgctcaaaaattagtagaagtagccaaagaaaaaggggcaacggctattgctcatggttgtacaggaaaaggaaatgaccaagtgcgttttgaagtagccatccattcccttgcgcctgagcttgaagtcattgctccagttcgtgaatggcattgggctcgtgaagaagaaatcgaatatgccaatcaaaatggtgttcctattcctgctgatttagacaatccctactcaattgacatgaatttatggggacgtgcgattgaagctggtgttcttgaaaatccttggaatacttgtccagaggatgctttctttatgactaattctgtagagaacgctccaaacgaagctgaatttatcgaggttgagtttaaagaaggattaccaatcgccttaaatggaaaaagcttagaattgcatgaaatcattaaaaaagtgaatattattgcaggaaaacatggaattggtcggattgaccatattgaaaatcgcctggttgggattaaatcccgtgaattttatgaatgtcctgctgccattactttattaaaagcacataaagatttggaagatttaactttcgttcgagaacttgcacattttaaaccagttcttgaaaatgaattagcaaacttgatttacaatggtttgtggttcaatcctgctactaaggctttgatcgcttatcttgatgaaactcaaaaagtagttaacgggattgtaaaaattaaattatataaaggtttagcaacaccagtgggacgtaaatcaactaattcgctttacagcgaaaaattagcaacatatactgctgcagatgagtttgaccaagcagcggcagttggatttattaaattgtggggtctacctactcaagtcaatgctcaagtaaatctcaaataa

SEQ ID NO: 25164 - protein, 398 aa, Lactococcus lactis subsp. lactis
MMGNKKIVLAYSGGLDTSVAVKWLTDKGFDVIADCMDVGEGKDLNFIHDKALQVGAVESVVLDCKEEFAKIFVGAALKGNLMYENKYPLVSALSRPLIAQKLVEVAKEKGATAIAHGCTGKGNDQVRFEVAIHSLAPELEVIAPVREWHWAREEEIEYANQNGVPIPADLDNPYSIDMNLWGRAIEAGVLENPWNTCPEDAFFMTNSVENAPNEAEFIEVEFKEGLPIALNGKSLELHEIIKKVNIIAGKHGIGRIDHIENRLVGIKSREFYECPAAITLLKAHKDLEDLTFVRELAHFKPVLENELANLIYNGLWFNPATKALIAYLDETQKVVNGIVKIKLYKGLATPVGRKSTNSLYSEKLATYTAADEFDQAAAVGFIKLWGLPTQVNAQVNLK

SEQ ID NO: 25165 - DNA, 1188 bp, Methanococcus jannaschii
  CDS (1)..(1188)
atggagagaatagctgtcttagcgtattctggaggattggatacaagctgttgcttaaaattattggaagataagtatggttataaggtagtttctgtctgtgtggatgttggacagccagaagaagagataaaagaagttgaagagaaagctaaaaaattaggagttttaaagcactacacaatagatgcaaaggaagaattcgttaaagattacatatttagagctataaaggcaaatgcaatgtatgaaggctatcccctatcaacagcattagcgagacctttaattgctcataaggttgttgaaatagctgaggaagttggagctgaggcagttgctcatggatgcactggaaagggtaacgaccagttcagatttgaaacaactataagaattaaagctccacatttgaaaattattgcaccaattagggacttaaacctaacaagggctgaagaaattgagtatgctaaagaaaaaggaatcccaatcccaacggaaagtaaaaaatacagtatagatgaaaacttatggggaagaagtattgaaggtagtgagttagaaaaccctgactttgttccaccagaagagatatatgcatggactaaaaacccagttgaagataaagaggaagagattgttgagattgagtttaaggagggcgttccagtagctataaatggagaaaaattagaaccagttgagttaataaagaaagctaatgagattgctggaaagcatggtgttggaagaatagatattattgaggatagaatcataggattaaaatcaagagaaaactatgaatgtcctggagctgttttgttattaactgctcataaagctttagagcagttagttttaacaagggatgagcttagatttaaagagatcgttgatagtttatacggagagttaatttataaaggactttggtttgatccattaagggaggatttagatgcttttatagacaaaactcaagagagagttactggaactgtgaaagttaagttatttggaggaactgcaagagttgttggtagagatagtccttacgctttatacagtaaggaattagtttcatttgatgagaaggagattgaccagaaagaattggctggaatggttaagtatcatggattacaggcaatgttatatgagatgaggaaaaagagaaaataa

SEQ ID NO: 25166 - protein, 395 aa, Methanococcus jannaschii
MERIAVLAYSGGLDTSCCLKLLEDKYGYKVVSVCVDVGQPEEEIKEVEEKAKKLGVLKHYTIDAKEEFVKDYIFRAIKANAMYEGYPLSTALARPLIAHKVVEIAEEVGAEAVAHGCTGKGNDQFRFETTIRIKAPHLKIIAPIRDLNLTRAEEIEYAKEKGIPIPTESKKYSIDENLWGRSIEGSELENPDFVPPEEIYAWTKNPVEDKEEEIVEIEFKEGVPVAINGEKLEPVELIKKANEIAGKHGVGRIDIIEDRIIGLKSRENYECPGAVLLLTAHKALEQLVLTRDELRFKEIVDSLYGELIYKGLWFDPLREDLDAFIDKTQERVTGTVKVKLFGGTARVVGRDSPYALYSKELVSFDEKEIDQKELAGMVKYHGLQAMLYEMRKKRK

SEQ ID NO: 25167 - DNA, 1197 bp, Mycobacterium tuberculosis
  CDS (1)..(1197)
atgtcagagcgcgtcatcctggcctattccggcggtctggacacctcggtggcgatcagctggataggcaaggagaccggccgtgaggtggtggcggtggcgatcgacctcgggcagggcggcgagcacatggacgtcatacggcagcgggcgctggactgcggcgcggtggaggctgtcgtcgtcgacgcccgcgacgagttcgccgaaggctactgcctgcccaccgtgctgaacaacgcgctgtacatggaccgctacccgctggtgtcggcgatcagccggccgctgatcgtcaaacacctggtcgccgcggcgcgcgagcacggcggcggcatcgtcgcgcacggctgcaccggcaagggcaacgaccaggtccggttcgaagtcgggttcgcctcgctggcaccggatttagaggtgttggcgccggtgcgcgactacgcgtggacgcgggagaaggcgatcgcgttcgccgaggagaacgcgatcccgatcaacgtcaccaaacgttcgccgttctccatcgaccagaacgtctggggccgcgcggtggagaccggcttcttagagcacctgtggaatgccccaaccaaggacatctacgcctacaccgaagaccccacgatcaactggggggtccccgacgaggtgatcgtcggcttcgaacgcggcgtgccggtgtccgtcgacggcaagccggtgtcgatgctggcggcgatcgaggagctcaaccgccgcgccggagcgcaaggtgtcgggcgcctcgacgtcgtggaggatcggctggtgggcatcaagagccgcgagatctacgaggcgcccggcgcgatggtgctgatcaccgcgcacaccgaactcgaacacgtcaccctggagcgtgagctgggccggttcaaacgccagaccgaccagcgctgggccgaactggtctacgacgggctgtggtactcgccgctgaaggccgcgctggaggctttcgtcgccaagacccaggagcacgtgtccggcgaggtgcggctggtgctacacggcggccacatcgcggtcaacggccggcgcagcgcggaatcgttgtacgacttcaacctggccacctacgacgagggcgacagcttcgaccagtccgccgcccgcggcttcgtctacgtgcacgggctgtcctccaagctcgccgcccgccgggatctgcggtga

SEQ ID NO: 25168 - protein, 398 aa, Mycobacterium tuberculosis
MSERVILAYSGGLDTSVAISWIGKETGREVVAVAIDLGQGGEHMDVIRQRALDCGAVEAVVVDARDEFAEGYCLPTVLNNALYMDRYPLVSAISRPLIVKHLVAAAREHGGGIVAHGCTGKGNDQVRFEVGFASLAPDLEVLAPVRDYAWTREKAIAFAEENAIPINVTKRSPFSIDQNVWGRAVETGFLEHLWNAPTKDIYAYTEDPTINWGVPDEVIVGFERGVPVSVDGKPVSMLAAIEELNRRAGAQGVGRLDVVEDRLVGIKSREIYEAPGAMVLITAHTELEHVTLERELGRFKRQTDQRWAELVYDGLWYSPLKAALEAFVAKTQEHVSGEVRLVLHGGHIAVNGRRSAESLYDFNLATYDEGDSFDQSAARGFVYVHGLSSKLAARRDLR

SEQ ID NO: 25169 - DNA, 1335 bp, Haemophilus influenzae
  CDS (1)..(1335)
atgtcaaatactattctacagaatttacctaaaggacaaaaagtagggatcgctttctctggtggtttagacactagtgcagcattactttggatgcgtcaaaaaggcgcagtgccttatgcttacaccgctaatttagggcaacccgatgaagatgattacaacgcaatccctaaaaaagccatggcgtatggtgctgaaaatgctcgcttaattgattgtcgtgctcagcttgctcacgagggaattgccgcaattcaatgtggtgcattccatatttctacaggcggaattccttatttcaacacgactccacttggtcgcgcagtaacaggcacaatgctcgttgcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtacctgtggcattaaatggcaaacattttgataatgctgttgatcttattctagaagccaatcgtattggtgggcgtcatggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacgcttgaacttcgtcgtggtaacgacttcacaattttaaataccgaatcgccaaacttaacctacgaagcagagcgtttaagtatggaaaaagtggaagatgcaccatttgatcctattgatcgtatcggtcaattaacaatgcgtaatttagatgtatcagacacccgaggtaaacttggcatctatgcacaaacaggtttattaagcgcaattaaagattccgtattgccacaattaggcaaaaaataa

SEQ ID NO: 25170 - protein, 444 aa, Haemophilus influenzae
MSNTILQNLPKGQKVGIAFSGGLDTSAALLWMRQKGAVPYAYTANLGQPDEDDYNAIPKKAMAYGAENARLIDCRAQLAHEGIAAIQCGAFHISTGGIPYFNTTPLGRAVTGTMLVAAMKEDDVNIWGDGSTFKGNDIERFYRYGLLTNPNLKIYKPWLDVQFIEELGGRLEMSQFLIENGFDYKMSVEKAYSTDSNMLGATHEAKDLEQLSTGMKIVKPIMGVAFWDEKVEIKPETVTVTFEDGVPVALNGKHFDNAVDLILEANRIGGRHGLGMSDQIENRIIEAKSRGIYEAPGMALLHIAYERLVTGIHNEDTIEQYRINGIRLGRLLYQGRWFDPQALMLRETAQRWVAKAITGTVTLELRRGNDFTILNTESPNLTYEAERLSMEKVEDAPFDPIDRIGQLTMRNLDVSDTRGKLGIYAQTGLLSAIKDSVLPQLGKK

SEQ ID NO: 25171 - DNA, 1200 bp, Methanobacterium thermoautotrophicum
  CDS (1)..(1200)
atgaaggtgattgctgtggataaagtggttcttgctttcagtggaggccttgacacatcagtatgtatcaaactcctcgaggaaaagtataacatggaggtaataacggcctgtgtggatgttggtcagccgcgggatgaaattgaaagaccggccatggttgccaaggaactcggaaactacagacactacacagtagatgcaaggcgggagttcgcagaggactacatatttccagccataaaggccaatgcggtttacgagggttaccccctcagcaccgcccttgcaaggcccttgatagctaaaaagatagttgaagtggccgagaaggagggtgcatctgccatagcccatggatgcaccggtaagggtaacgaccagttccgtttcgaggccgttataaggtcaacgacggacctggatgtcatcgcccccataagggacctcaacctcacaaggacagaggagatggagtacgccaggtcctgtgggataccgctcccctcagacaagctctacagtatcgatgagaacctctggggacgtgcaatagagggggacatccttgaagaccccatggttgagccccctgaggatgcctttgaatggacaaagcccatccacgagacccctgaggatcctgaggtcattgaaatcggtttccacggcggggtcccggttgcattgaatggtgaggaactggagccagttgaactcataggccttgcaaatgaggtggcaggaaaacacggtatcggtagggttgacataatggaggaccgtataataggtatgaaaagccgcgaaatctatgagacacctgcagccttcctgctcctggaggcccacaggggcctggagcagctcacactcacaaggagtgagctcaggtttgctgacataataagcagcacctatgctgaactggtgtacagtgggctgtggcatgaccccctccgtgaggaccttgacatggcagtaaaccacatgcagaggcgtgtcaccggtacagtcagggttaaactccacaggggcagcatgcgcgtcattggaagggagtcaccctacagcctgtacagtgaggagatagtttcatttgaggataaaaccctcgatcagagggagatggccgggatggtcaaaaactatgccctccaggctgcgatatacagcagggtgtgcaggaaggagaactga

SEQ ID NO: 25172 - protein, 399 aa, Methanobacterium thermoautotrophicum
MKVIAVDKVVLAFSGGLDTSVCIKLLEEKYNMEVITACVDVGQPRDEIERPAMVAKELGNYRHYTVDARREFAEDYIFPAIKANAVYEGYPLSTALARPLIAKKIVEVAEKEGASAIAHGCTGKGNDQFRFEAVIRSTTDLDVIAPIRDLNLTRTEEMEYARSCGIPLPSDKLYSIDENLWGRAIEGDILEDPMVEPPEDAFEWTKPIHETPEDPEVIEIGFHGGVPVALNGEELEPVELIGLANEVAGKHGIGRVDIMEDRIIGMKSREIYETPAAFLLLEAHRGLEQLTLTRSELRFADIISSTYAELVYSGLWHDPLREDLDMAVNHMQRRVTGTVRVKLHRGSMRVIGRESPYSLYSEEIVSFEDKTLDQREMAGMVKNYALQAAIYSRVCRKEN

SEQ ID NO: 25173 - DNA, 1344 bp, Neisseria meningitidis
  CDS (1)..(1344)
atgaaccaaaaccatactattttacaaaaccttcccgtcggtcagaaagtcggcatcgccttctccggcggacttgatacctccgccgcgctgttgtggatgaaactcaaaggcgcgctgccttatgcctacactgccaacctcggtcagcccgatgaagacgactacaacgccattcccaaaaaagcgatggaatacggtgcggaaaacgcccgcctgattgactgccgcgcacagctggcacacgaaggcatcgccgccatccaatgcggcgcgttccacgtttccaccggcggcatcgcctacttcaacaccacgcctctgggtcgcgccgtaaccggcactatgcttgtttccgccatgaaagaagacgatgtgaatatttggggcgacggcagcacctacaaaggcaacgacatcgagcgtttctaccgctacggtttgctcaccaatcccgcgctgaaaatctacaaaccctggctcgaccagcaatttatcgacgaactcggcggccgtcatgaaatgagcgaatttttgattgccaacggtttcaactacaaaatgtcggtggaaaaagcctattccaccgattccaatatgctcggcgcgacccacgaagccaaagatttggaatttttgaactcgggcatcaaaatcgtcaaacctattatgggcattgccttctgggacgaaaacgtcgaaatcaaacccgaagaagtcagcgtgcgctttgaagaaggcgtgccggttgcactgaacggcaaagaatacgctgatcccgtcgaactcttcctcgaagccaaccgcatcggcggccgccacggtctgggtatgagcgaccaaatcgaaaaccgcatcatcgaagccaaatcgcgcggcatctacgaagccccgggaatggcgttgttccacatcgcctacgagcgtttggtgaccggtatccacaacgaagacaccatcgaacaataccgcatcaacggcctgcgcctcggacgtttgctctaccaaggccgctggttcgacagccaagccctgatgttgcgcgaaaccgcccaacgctgggttgccaaagccattaccggcgaagtaaccctcgaattgcgtcgcggcaacgactactcgattctgaacaccgaatcgcccaacctgacctaccaacccgaacgcctgagtatggaaaaagtcgaagacgcagcgttcacaccgctcgaccgtatcggacaactgactatgcgcaacctcgacattaccgacacccgcgccaaactgggcatttactcgcaaagcggtttgttggcattgggcgaaggttcggtattgccgcagttgggtaataagcaataa

SEQ ID NO: 25174 - protein, 447 aa, Neisseria meningitidis
MNQNHTILQNLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGIAFWDENVEIKPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAITGEVTLELRRGNDYSILNTESPNLTYQPERLSMEKVEDAAFTPLDRIGQLTMRNLDITDTRAKLGIYSQSGLLALGEGSVLPQLGNKQ

SEQ ID NO: 25175 - DNA, 1200 bp, Mycobacterium leprae
  CDS (1)..(1200)
atgatgccggaacgtattatcctggcgtattcgggggggctggatacctcggtggcgatcaactggatcggcaaggaaactagccatgaggtcgtggcagtggtgattgatctcggccagggcggcgaggacatggaggtcgtacgtcaacgggcgttggactgcggagctgttgaggctatcgttgtcgatgcccgtgacgagttcgctgaaggctattgcttgcccaccgttttgaacaacgcgctgtatatggatcggtacccgttggtgtccgcgatcagcaggccgctgatcgtcaagcacctggtcgcggccgcacgtgcgcacggcggcagcatcgtcgcgcacggttgtaccggcaagggtaacgaccaggtccgattcgaagtcggattcgcttcgctggcaccggatctcgaaatattggcgccggtgcgcgactacgcatggacacgagagaaggcgatcgctttcgccgaagagaacgccatccccatcaatgtcaccaaacgttcgccgttctcgattgaccagaatgtttggggccgcgcagtggaaaccggtttcctggaacacttgtggcacgcacctactaaagaggtttattcctacactgacgaccccaccatcaattggaacacgcccgatgaggtgatcgtcggttttgagcacggagttccggtgtcgattgacggtagtccggtgtccatgctgggcgccatcgaggcactcaaccgacgcgctggcgcgcaaggcgtcgggcgtctcgacgttgtcgaagaccggctggtaggcatcaagagccgcgagatttacgaggcacccggagcaatggtgctcatcaccgcgcacgccgaactcgagcacgtcacgctggagcgtgagttgggacgcttcaagcgtcagaccgatcgacgctgggccgaattggtgtatgacggattgtggtattcgccgctgaagaccgcactggagagttttgtcgccgctacgcaacaacacgttaccggtgaagttcgaatggtgttacatggaggccatattgcggtgaatgggcggcgcagcgccgaatccctatacgatttcaatttggccacctacgacgaaggggataccttcgatcaatccgctgctcgcggcttcgtctacgtgtacgggttaccgtcgaagctcgcggcacgtagggacttacggtga

SEQ ID NO: 25176 - protein, 399 aa, Mycobacterium leprae
MMPERIILAYSGGLDTSVAINWIGKETSHEVVAVVIDLGQGGEDMEVVRQRALDCGAVEAIVVDARDEFAEGYCLPTVLNNALYMDRYPLVSAISRPLIVKHLVAAARAHGGSIVAHGCTGKGNDQVRFEVGFASLAPDLEILAPVRDYAWTREKAIAFAEENAIPINVTKRSPFSIDQNVWGRAVETGFLEHLWHAPTKEVYSYTDDPTINWNTPDEVIVGFEHGVPVSIDGSPVSMLGAIEALNRRAGAQGVGRLDVVEDRLVGIKSREIYEAPGAMVLITAHAELEHVTLERELGRFKRQTDRRWAELVYDGLWYSPLKTALESFVAATQQHVTGEVRMVLHGGHIAVNGRRSAESLYDFNLATYDEGDTFDQSAARGFVYVYGLPSKLAARRDLR

SEQ ID NO: 25177 - DNA, 1248 bp, Streptococcus pneumoniae
  CDS (1)..(1248)
atgaggatgcctttaaagcgtccattgaaaaatagaaagaaggaaaagaacatgagtaaagaaaaagtaattttggcctattctggcggtttagacacatcagttgctattacctggctgaagaaagactatgatgttgttgcagtttgtatggatgtgggtgaagggaaagacttagatttcatccatgataaggctcttaaggttggggcagtcgaatcttatgtcattgatgttaaggacgaatttgctacagattatgtgctagtggctcatcagtcacatgcctattatgaacaaaagtatcccttggtatctgccttgagccgccctctgatttctaaaaaattggttgaaatagcgcatcagataggagcgactacaattgctcatggttgtaccggtaaggggaatgaccaagtacgttttgaagtatcgattgcagccttggatctcaatttaaaagtgattgctccagttcgtgaatggaaatggtctcgggaggaagaaatttattatgccaaggaaaatggggtgcctgttcctgctgaccttgacaatccctactctgtcgaccaaaatctttggggacgtgccaatgagtgtggtattttggaaaatccatggaatcaggctccagaagaagcctttggcatcacaacttctccagagcaagctccagatatgccagaatacattgagattgagtttagtgaaggtgttccagtttccctcaatggagaagtgttaaaattggcagatttgattcaaaaactcaatgaaatagctggaaaacatggggttggacggattgaccacgtggaaaatcgcttggttgggattaaatcaagagaaatctatgagtgtccaggtgcagtgaccctgctgacagctcataaggaaattgaggacttgacgcttgtgagagaagtggctcattttaaaccaatcatagaaaatgaattatcaaatctcatttataatgctttgtggtttagttcggctacacaagccttgattgcttatattaaagagactcaaaaagttgtcaatgggactgcaaaagtcaaactgtataaggggagcgctcaggtcgtggctcggaaatcaccaagttctctttacgatgaaaatttggcgacgtatactagtgcagatacctttgaccaagatgcggctgttggctttattaagttatggggacttccaaccaaggttcattctgaggttcaaaaaagcgccaaatag

SEQ ID NO: 25178 - protein, 415 aa, Streptococcus pneumoniae
MRMPLKRPLKNRKKEKNMSKEKVILAYSGGLDTSVAITWLKKDYDVVAVCMDVGEGKDLDFIHDKALKVGAVESYVIDVKDEFATDYVLVAHQSHAYYEQKYPLVSALSRPLISKKLVEIAHQIGATTIAHGCTGKGNDQVRFEVSIAALDLNLKVIAPVREWKWSREEEIYYAKENGVPVPADLDNPYSVDQNLWGRANECGILENPWNQAPEEAFGITTSPEQAPDMPEYIEIEFSEGVPVSLNGEVLKLADLIQKLNEIAGKHGVGRIDHVENRLVGIKSREIYECPGAVTLLTAHKEIEDLTLVREVAHFKPIIENELSNLIYNALWFSSATQALIAYIKETQKVVNGTAKVKLYKGSAQVVARKSPSSLYDENLATYTSADTFDQDAAVGFIKLWGLPTKVHSEVQKSAK

SEQ ID NO: 25179 - DNA, 1206 bp, Xylella fastidiosa
  CDS (1)..(1206)
atgagtaagaaaaacattgtcttggccttctccggtggactcgacaccagcttttgcatcccctacctgaaagaacagggctatgccgtacacaccgtatttgccgacaccggcggtgttaacgaagaggagcgcgacttcattgaaaaacgtgctgccgaattaggcgtggccagccacctcaccgtggatggcggccctgccatctgggatggtttcgtaaaacagcttgtctggactggcgaaacctaccaaggccagtaccccttacttgtttctgatcgctatttaattgtggatgccgtactacagcgtgccgatgcactgggcacctgcgccgttgcccatgggtgtactggcatggggaacgaccaagtccgcttcgacctggcgatcaaagcacagggcaactacaccatcattgccccgattcgggaaatccagaaagagcacacccagacccgtctctacgaacaaaaatacctagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccgccgatcccctcacggtggctatcaaattcgttgaaggcgaagccgtcgccgtagatggaaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgcgccctggaagacgccgtgttgaccaaacaacagaaccgcttcaaaccgcacatagcccgtaaatgggttgaactggtgtacgaaggatttttccatgaccccttgaagaccgacctagagaccttcttaaaatcctcccaagctaacgtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgcccaggtaaatcgttccctgcgctcatga

SEQ ID NO: 25180 - protein, 401 aa, Xylella fastidiosa
MSKKNIVLAFSGGLDTSFCIPYLKEQGYAVHTVFADTGGVNEEERDFIEKRAAELGVASHLTVDGGPAIWDGFVKQLVWTGETYQGQYPLLVSDRYLIVDAVLQRADALGTCAVAHGCTGMGNDQVRFDLAIKAQGNYTIIAPIREIQKEHTQTRLYEQKYLEERGFGVRAKQKNYTINENLLGITLSGGEIDKWEAPGEGARGWCAPRSAWPADPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAQVNRSLRS

SEQ ID NO: 25181 - DNA, 1230 bp, Thermotoga maritima
  CDS (1)..(1230)
atgaaagagaaagtcgttcttgcatacagtggtggtctcgatacttccgtcattttgaagtggctctgcgaaaagggcttcgacgtgatagcttacgttgcaaacgttggacagaaggacgatttcgttgcaataaaagaaaaggccttgaaaacaggcgcttcaaaagtctacgtggaagacctcagaagggaattcgtcacagattacatattcaccgcactccttggaaacgccatgtacgaaggaaggtaccttcttggaaccgctatcgcaagacctctcatagccaaaagacaggtggagatagccgagaaagaaggagcacagtacgttgcgcacggtgcgaccgggaaaggaaacgaccaggtgaggttcgagctcacctacgccgctttgaatccaaatctcaaagttatctcaccctggaaagaccctgaatttctcgccaaattcaagggcagaacagatctcataaactacgccatggagaaagggattccaatcaaagtctccaaaaaaagaccctacagcgaagacgaaaacctcatgcacatttcccacgaagcgggcaaactggaggatcccgcacacatacctgacgaagacgtgttcacatggacagtctccccaaaggacgctccggatgaagaaaccttgctcgagatccatttcgaaaacggcattccggtgaaagttgtgaacctcaaagatggaacagaaaagacagatcccctcgaactcttcgaatatctgaacgaagtaggtgcgaaaaatggagtgggaagactcgacatggtcgaaaacagattcataggtataaaatcaagaggggtgtacgaaactccgggcgcgacgatcctgtggatcgcacacagagatctcgaaggaatcaccatggacaaagaagtcatgcacctgagagacatgctcgctccgaagttcgcggagctcatatacaacggtttctggttttctccagaaatggagttcctcctcgcagcgttcagaaaagcacaggagaacgtgaccggaaaggtgacggtatccatatacaaaggaaacgtcatgcccgttgcgaggtattcaccgtattcactgtacaatccggaactttcgagcatggacgtcgaaggaggattcgatgccactgactcgaagggcttcatcaacattcacgccctgaggttgaaggtccaccagctcgtgaaaaaggggtatcagagatga

SEQ ID NO: 25182 - protein, 409 aa, Thermotoga maritima
MKEKVVLAYSGGLDTSVILKWLCEKGFDVIAYVANVGQKDDFVAIKEKALKTGASKVYVEDLRREFVTDYIFTALLGNAMYEGRYLLGTAIARPLIAKRQVEIAEKEGAQYVAHGATGKGNDQVRFELTYAALNPNLKVISPWKDPEFLAKFKGRTDLINYAMEKGIPIKVSKKRPYSEDENLMHISHEAGKLEDPAHIPDEDVFTWTVSPKDAPDEETLLEIHFENGIPVKVVNLKDGTEKTDPLELFEYLNEVGAKNGVGRLDMVENRFIGIKSRGVYETPGATILWIAHRDLEGITMDKEVMHLRDMLAPKFAELIYNGFWFSPEMEFLLAAFRKAQENVTGKVTVSIYKGNVMPVARYSPYSLYNPELSSMDVEGGFDATDSKGFINIHALRLKVHQLVKKGYQR

SEQ ID NO: 25183 - DNA, 1227 bp, Caulobacter crescentus
  CDS (1)..(1227)
atggccgacaagtccgtgaagaaggtcgtgctcgcctattcgggcggtctcgacacctcgatcatcctcaagtggctgcagaccgaatacggcgctgaggtcatcaccttcacggccgacctcggccaaggcgaagagatcgagccggcccgcgccaaggccctggccgccggcgtcaagcccgagaacatcttcatcgaggacgtccgcgaagagttcgtgcgcgactacgtcttcccgatgttccgcgccaacacggtctatgagggccagtacctcctgggcacatcgatcgcccgtccgctgatcgccaagaagcagatcgagatcgcccgcaagatgggcgcagacgccgtcagccacggcgcgaccggcaagggcaacgaccaggtccgcttcgagctcggctattatggcctcgagcccgacatcaccgtgatcgccccctggcgcgagtgggacttcaagtcccgcgaggccctgctggacttcgccgagaagcaccagatccagatcaccaaggacaaacgcggcgaagcgccgttcagcgtcgacgccaacctgctgcactcctcgtccgagggtaaggtcctggaggacccggcggtcgaggctcccgagttcgtccacatgcgcaccattgcgccggaagacgcgccggacgcgccgaccatcatcaccatcgacttcgaaaagggtgacccggtcgccatcgacggcgtggcgatgagcccggccaccctgctgaccaagctgaacgaactgggccgcgacaacggcgtcggccgtctggacctcgtggaaaaccgcttcgtcggcatgaagtcgcgcggcgtctacgagacccccggcggcaccatcctgctggccgcccaccgcggcatcgagagcatcacgctggaccggggcgccatgcacctgaaggacgagctgatgccgaagtatgcttcgctcgtctataacggcttctggttctcgcccgagcgcgagatgctgcaggccgctatcgactacagccaggacaaggtcaccggccgcgtccgcgtgaagctgtacaagggcaatgtcacggtcatcggccgcgagagcccctactcgctgtatgaccaggacttggtgaccttcgaagaaggcaaggtcgcctacgaccaccgcgacgccggcggcttcatcaagctcaacgccctgcgcctgcgggtcctggccaagcgcgacaagcgcggctag

SEQ ID NO: 25184 - protein, 408 aa, Caulobacter crescentus
MADKSVKKVVLAYSGGLDTSIILKWLQTEYGAEVITFTADLGQGEEIEPARAKALAAGVKPENIFIEDVREEFVRDYVFPMFRANTVYEGQYLLGTSIARPLIAKKQIEIARKMGADAVSHGATGKGNDQVRFELGYYGLEPDITVIAPWREWDFKSREALLDFAEKHQIQITKDKRGEAPFSVDANLLHSSSEGKVLEDPAVEAPEFVHMRTIAPEDAPDAPTIITIDFEKGDPVAIDGVAMSPATLLTKLNELGRDNGVGRLDLVENRFVGMKSRGVYETPGGTILLAAHRGIESITLDRGAMHLKDELMPKYASLVYNGFWFSPEREMLQAAIDYSQDKVTGRVRVKLYKGNVTVIGRESPYSLYDQDLVTFEEGKVAYDHRDAGGFIKLNALRLRVLAKRDKRG

SEQ ID NO: 25185 - DNA, 1194 bp, Streptomyces clavuligerus
  CDS (1)..(1194)
atgaccgagcgcgtcgtactcgcctactcgggcggtctggacacctccgtcgccatcggctggatcgccgaggagacgggcgccgaggtcatcgccgtcgccgtggacgtcggccagggcggcgaggacctggacgtcatccgcaagcgcgcgctcgcctgcggtgccgtggaggccgaggtggccgacgccaaggacgagttcgccgaggagtactgcctccctgcgatcaaggccaacgcccgctacatggaccggtacccgctggtgtccgcgctctcccggcccgcgatcgtcaagcacctggtcgccgccgcgaagaagcacgacgcctcgatcgtggcgcacggctgcaccggcaaggggaatgaccaggtccgtttcgaggccggtatccaggccctcggcccggacctcaagtgcatcgcgccggtccgtgactacgccatgacccgggacaaggccatcgccttctgcgaggccaagcagctcccgatcgccaccaccaagaagtccccgtactccatcgaccagaacgtcttcggccgggccatcgagaccggcttcctggaggacatctggaacgcgccgatcgaggacatcttcgagtacacctccaacccggccgagccccgcgaggccgacgaggtggtcatctccttcgcctccggtgtcccggtcgccatcgacggccgccccgtcaccgtgctccaggccatccagcagctcaacgagcgcgcgggcgcccagggcatcggccggatcgacatggtcgaggaccggctggtcggcatcaagtcccgtgaggtgtacgaggcgccgggcgcgatcgcgctgatcaccgcccaccaggagctggagaacgtcaccgtcgagcgcgaactggcccgcttcaagcggcaggtcgagcagcgctggggcgagctggtctacgacggcctgtggttctccccgctcaagcgcgccctggacggcttcatcgaggaggccaaccagcaggtcaccggcgacatccggatgaccctgcacgcgggcaccgccgtggtcaccggccgccgctccgagcggtcgctgtacgacttcgacctcgcgacctacgacacgggcgacaccttcgaccagtccaaggcccagggcttcatcgacatcttcgccctctccgcgaagatcgccgccaagcgcgacctggtctga

SEQ ID NO: 25186 - protein, 397 aa, Streptomyces clavuligerus
MTERVVLAYSGGLDTSVAIGWIAEETGAEVIAVAVDVGQGGEDLDVIRKRALACGAVEAEVADAKDEFAEEYCLPAIKANARYMDRYPLVSALSRPAIVKHLVAAAKKHDASIVAHGCTGKGNDQVRFEAGIQALGPDLKCIAPVRDYAMTRDKAIAFCEAKQLPIATTKKSPYSIDQNVFGRAIETGFLEDIWNAPIEDIFEYTSNPAEPREADEVVISFASGVPVAIDGRPVTVLQAIQQLNERAGAQGIGRIDMVEDRLVGIKSREVYEAPGAIALITAHQELENVTVERELARFKRQVEQRWGELVYDGLWFSPLKRALDGFIEEANQQVTGDIRMTLHAGTAVVTGRRSERSLYDFDLATYDTGDTFDQSKAQGFIDIFALSAKIAAKRDLV

SEQ ID NO: 25187 - DNA, 2449 bp, Streptomyces lavendulae
  CDS (535)..(1983)
aagcttgcatgcgcgagttcctggtcgagatcaccaccaccatccccgagggcaccgacccggccgtcgtggacgagcggcgcgccgccgaagcggtccgcgcacgggagctggccgccgcgggacacctcgtacgactgtggcgcccggtcggtgagctgcggagcatcggcctgtggcgggcctccgacgaggccgcgctgcgggaggaggtgctcggcacgctgccgctgcgggcgtggatgacccatgtcgtcaccccggtcgagtcgcaccccaacgaccccggaaggcccgcgtccgcgcagtgagccccgggcccgccccgggctcaggagggccagacgaccgcgccgccccggaccgccggcgggccgcgtcgcggcgggcggtgggacagacgtgcgaccacccggcaggtccaggcctgcgaccaggtggtttcggggcgggggcggctcccgcggcccggtcgcggaaagtccatcccgacgccgcgttgcatgaccatgcgtggtgttgcataatcttcccatgtctaaagtcctcacgtcccttcccgccggcgagcgcgtcggcatcgccttctccggcgggctcgacacctcggtcgccgtcgcctggatgcgcgacaagggcgccgtcccctgcacgtacaccgccgacatcggccagtacgacgagcccgacatcgcctccgtgcccagccgcgcctccgcgtacggcgccgagatcacccggctcgtcgactgccgtgccgccctcgtcgaggagggcctggcggcgctcgcgtgcggtgcgttccacatccggtcgggcgggcgcccgtacttcaacaccacgccgctgggacgtgccgtgaccggcacgctgctggtgcgcgcgatgcttgaggacggggtgcagatctggggcgacggctccaccttcaagggcaacgacatcgagcggttctaccggtacgggctgctcgccaacccgcacctgcggatctacaagccctggctggacgccgacttcgtcaccgagctcggcggccgcaaggagatgtccgagtggctgctcgcgcacgggctgccgtaccgggactcgacggagaaggcgtactccacggacgccaacatctggggcgccacgcacgaggccaagacgctggagcacctcgacaccggcatcgagaccgtcgacccgatcatgggcgtgcggttctgggacccgtcggtggagatcgccacggaggacgtgacggtcggcttcgagcagggccgcccggtctccatcaacggcaaggagttcgcctccgccgtcgacctcgtgatggaggccaacgcgatcggcggccggcacggtctgggcatgtccgaccagatcgagaaccggatcatcgaggccaagagccgcggcatctacgaggcgcccggcatggcgctgctgcacatcgtctacgagcgcctcgtcaacgcgatccacaacgaggacaccctggccgcgtaccacaacgagggccggcgcctcggccggctcatgtacgagggccgctggctggacccgcaggcgctgatgatccgcgagtcgctgcagcgctgggtcggcacggccgtcaccggcgaggtgacgctgcggctgcggcgcggcgaggactactcgatcctcgacaccacgggcccggcgttcagctaccacccggacaagctctccatggagcggaccgaggactcggcgttcggcccggtggaccggatcggccagctcaccatgcgcaacctggacatcgccgactcccgcgcccgcctggagcagtacgtggggctcggcctggtcggcactccccacccgacaccgatcggcgccgcacaggcggccgcgaccgggctgatcggcgccatggacgagggcggtgccgaggcgatcgcctcccgtggcgaggccaccgacgaggagacgatgctggaccgcgccgcgatggagtccggcacggactgaccgcggaaggccggccggctccgtacggccggccggccgccgtgcgcgggtccgtggccgctgccccggtggacttcgttccgccggggcggcggccgttccggggccgtccggggcaccctgcgcgccatcggccgtccgcgcggccgcctcagagcggcccgagccgctggagggcgaccatagccgcgtcgtcacccaggaccccgccggccgcgtgaccgagcaggtcgtcgcgcaggtagtccagcagggcgtgcgggtccgccccggtccaggccgcggcccgctccgccagcgggtagaaggtcccgttccggtcgcgggcctccatgaccccgtccgtgtagagcaggacgatgtcccccggcgccagcgggaaggtctgcgcggtcgcccgcccttcgaccagcccggccaggcccaggggcggtgccggatgctccacctccagcgagccggatcc

SEQ ID NO: 25188 - protein, 482 aa, Streptomyces lavendulae
MSKVLTSLPAGERVGIAFSGGLDTSVAVAWMRDKGAVPCTYTADIGQYDEPDIASVPSRASAYGAEITRLVDCRAALVEEGLAALACGAFHIRSGGRPYFNTTPLGRAVTGTLLVRAMLEDGVQIWGDGSTFKGNDIERFYRYGLLANPHLRIYKPWLDADFVTELGGRKEMSEWLLAHGLPYRDSTEKAYSTDANIWGATHEAKTLEHLDTGIETVDPIMGVRFWDPSVEIATEDVTVGFEQGRPVSINGKEFASAVDLVMEANAIGGRHGLGMSDQIENRIIEAKSRGIYEAPGMALLHIVYERLVNAIHNEDTLAAYHNEGRRLGRLMYEGRWLDPQALMIRESLQRWVGTAVTGEVTLRLRRGEDYSILDTTGPAFSYHPDKLSMERTEDSAFGPVDRIGQLTMRNLDIADSRARLEQYVGLGLVGTPHPTPIGAAQAAATGLIGAMDEGGAEAIASRGEATDEETMLDRAAMESGTD

SEQ ID NO: 25189 - DNA, 1203 bp, Synechocystis sp
  CDS (1)..(1203)
atgggtcgcgccaagaaagtcgttctcgcctattccggtggggtagatacatcggtttgtattccctatttgatgcacgaatggggcgttgaggaagttattaccctcgcggcggatttgggccagggggatgaactggggccgatccaggaaaaagccctgcggtgtggtgcggtagaatccttggttattgacggcaaggaagaattcgttaaggagtatgcttttcgttctatccaggccaatgctctctacgaaaaccgttatcccctctccacagccctagcccggcccttaattgccaaaatgctggtggaagcggcggaaaaatacggtgccgatgcggtggcccatggttgtactggtaagggcaatgaccaagtgcggttcgatatcagcattatggccctaaaccccaatttgaaggtgttggccccagcccgggaatggaaaatgagccgggaagaaaccatcgcctatggggaacggtatggcgtagaatcccccgtgaaaaagtcttccccctacagcattgaccgcaacattctcggccgtagcattgaagcggggcctctggaagaccccatgaccgagcccacggaagaaatttatctgatgaccaaggcgatcgccgacaccccagatgaaccggaatatgtggacatcggctttgaaaaaggtattcccgttagtttgaatggggtgatgctagaccccgttaccctggtggaacgcctgaacgaaattgcggggaaccacggggtaggccgtttggatatggtggagaaccgggtggtggggattaaatcccgcgagatttacgaagctccggctttgctagttttaattgatgcccaccgggatctggaaagtttgacccaaaccgccgatgttacccactataaaaacaccgtcgaagaaatttatagtcagttaatttaccggggattatggtacagccccctcaaagaagccctggatgcttttattgtcaaaacccaggaacgggttacgggcatggtgcgggtgaaattcttcaagggcaatgccaacgttgccggtcgtaaatccgattactccatctatgatgcggaattggccacctacggcatggaagaccaattcgaccataaggcggcggaaggctttatctatatttggggcttacccaccaaagtttgggcccagaaaatgcgcggttaa

SEQ ID NO: 25190 - protein, 400 aa, Synechocystis sp
MGRAKKVVLAYSGGVDTSVCIPYLMHEWGVEEVITLAADLGQGDELGPIQEKALRCGAVESLVIDGKEEFVKEYAFRSIQANALYENRYPLSTALARPLIAKMLVEAAEKYGADAVAHGCTGKGNDQVRFDISIMALNPNLKVLAPAREWKMSREETIAYGERYGVESPVKKSSPYSIDRNILGRSIEAGPLEDPMTEPTEEIYLMTKAIADTPDEPEYVDIGFEKGIPVSLNGVMLDPVTLVERLNEIAGNHGVGRLDMVENRVVGIKSREIYEAPALLVLIDAHRDLESLTQTADVTHYKNTVEEIYSQLIYRGLWYSPLKEALDAFIVKTQERVTGMVRVKFFKGNANVAGRKSDYSIYDAELATYGMEDQFDHKAAEGFIYIWGLPTKVWAQKMRG

SEQ ID NO: 25191 - DNA, 1233 bp, Schizosaccharomyces pombe
  CDS (1)..(1233)
atgccccaagaagtaaaacgttgcgttctcgcctattcaggtggtcttgacacctcctgtatcctcgcctggcttattgaagaaggttgggaggtcatctgctatatggctaatgttggtcaagaggaagattgggatgcagcccgtgaaaaggccttgaaggtgggtgctaagaaggtttacgttgaggacttgcgtgaagagttcatcaatgacaccgtcattcctgctgctcaagctaacgccatttacgaaaatgtttatctcttgggcacttctcttgctcgtcctatcattgctcgccgtcagatccaaatcgccgagaaggaaaactgtatcgctgtctctcacggttgcactggtaagggcaacgatcaagttcgtttcgaattggcatattacgctttgaagccagacgttcaagtcattgctccttggcgtttgcctgtatttttcgagcgcttcgccggtcgtaaggatttgctcgaatatgctgctgctaagggcattcccgttactcaaaccaccaaaaagccttggtctatggatgaaaacattgtacattgctcgtatgaagctggaatcctcgaggatcccagtatgactcctcccaaggacatgtggaagctcaccgttgatcccaaagacgctcctgatgaggttgaagagctcagcattcactttgaaaagggtgctcccaccaaattagagtgcaaggatggtacctttagcggagtcgtttccatcttctaccaattgaacgctatcgctcgtcgtaacggtgttggtcgtatcgatattgttgaaaaccgtttctctggtttgaagagtcgtggttgttacgaaactcctggcttaaccattttgcgtactgctcatatggacttggaaggtttaacaatggaacgtgaagttcgtgctctccgtgaccaattcgttactttcaatctcgctaaaattttgtacaatggacaatttttctctccctgcactcgtatgcttttagcagctaacaacgtttctcaagaggtagtaaacggtgtagttaaactttctgtctacaagggcaatgtcactgtcctcggtcgtaaatctgatactgctcatctttatgacgagaaattgtcatctatggatgagcttggtggatttgaccctacatggacctctggtttcatccaaatcgagtctatgcgtttgcgtaactctgatgaaggaaaacattggatgtaa

SEQ ID NO: 25192 - protein, 410 aa, Schizosaccharomyces pombe
MPQEVKRCVLAYSGGLDTSCILAWLIEEGWEVICYMANVGQEEDWDAAREKALKVGAKKVYVEDLREEFINDTVIPAAQANAIYENVYLLGTSLARPIIARRQIQIAEKENCIAVSHGCTGKGNDQVRFELAYYALKPDVQVIAPWRLPVFFERFAGRKDLLEYAAAKGIPVTQTTKKPWSMDENIVHCSYEAGILEDPSMTPPKDMWKLTVDPKDAPDEVEELSIHFEKGAPTKLECKDGTFSGVVSIFYQLNAIARRNGVGRIDIVENRFSGLKSRGCYETPGLTILRTAHMDLEGLTMEREVRALRDQFVTFNLAKILYNGQFFSPCTRMLLAANNVSQEVVNGVVKLSVYKGNVTVLGRKSDTAHLYDEKLSSMDELGGFDPTWTSGFIQIESMRLRNSDEGKHWM

SEQ ID NO: 25193 - DNA, 1245 bp, Ashbya gossypii
  CDS (1)..(1245)
atggcacgcggaaaggtttgcttggcatactcaggaggcctggacacttcggtgatcctcgcctggttactggagcagggttatgaagttgtagcgtttatggctaatgttgggcaagaggaagatttccaggctgcggaagagaaggcattgaagataggagcgtccaagtttgtgtgcgttgactgccgtgagcagttcgtgacggatgtcttgtttcctgcggtgcaggtgaacgcggtgtacgaagatgtttatctactggggacgtcgcttgcacggcccgtgattgccaaggcacagatcgacatcgcggagcaggagcattgttttgcggtcgctcacggatgcactgggaagggcaacgatcagatccggtttgagcttgcgttctacgcgctgaagccagacgtccaggttatcgcgccatggcgggaccctgcgtttttcgaccggtttgcaggtagaaatgacttgctagagtgtgcggcagagaaacagatacctgttgcgcagaccaaggccaaaccgtggtctaccgacgagaacgaggcgcatatatcgtacgaggctggaattttggaggatcccgatgtcacaccaccggcagacatgtggaagctcacgacagacccgcttcgagcaccaagtgagcctgaggacgtgacgttggtgttcaaggagggtgtccccactcagatgatttacaaggatggagaggcgagcaaaccgttggatatttttcttgcggcttccaaagtggcgcgtagaaacggcgttggcagaatcgacatcgtggaaaaccgttacatcaacctgaagtcgcgtggctgctacgaacaggcaccactgacactcctgcgccgggcccacgtgtatctcgagggtctcaccctggacaaagaggttcggcatttgcgtgaccaatttgttacgccgacttactctcgcctcctctacaatggctcctacttttctccggaatgcgagtatatccgtagcatgattaagccatcccaaattacggtaaatggccaggttcgcttgagactttacaagggtaatgtcattgtgttgggcaggtcctcggaaactgagaacttgtatgatgcgacggagtcctccatggacgaattgaccggattccagccgactgataccactggtttcatcgctattcaagcaattcgcatgaaaaagtacggtcaatccaagaaggacaaaggtgaatccctgactttgtaa

SEQ ID NO: 25194 - protein, 414 aa, Ashbya gossypii
MARGKVCLAYSGGLDTSVILAWLLEQGYEVVAFMANVGQEEDFQAAEEKALKIGASKFVCVDCREQFVTDVLFPAVQVNAVYEDVYLLGTSLARPVIAKAQIDIAEQEHCFAVAHGCTGKGNDQIRFELAFYALKPDVQVIAPWRDPAFFDRFAGRNDLLECAAEKQIPVAQTKAKPWSTDENEAHISYEAGILEDPDVTPPADMWKLTTDPLRAPSEPEDVTLVFKEGVPTQMIYKDGEASKPLDIFLAASKVARRNGVGRIDIVENRYINLKSRGCYEQAPLTLLRRAHVYLEGLTLDKEVRHLRDQFVTPTYSRLLYNGSYFSPECEYIRSMIKPSQITVNGQVRLRLYKGNVIVLGRSSETENLYDATESSMDELTGFQPTDTTGFIAIQAIRMKKYGQSKKDKGESLTL

SEQ ID NO: 25195 - DNA, 1245 bp, Brachydanio rerio
  CDS (1)..(1245)
atgtcgaagggtctggtggtgctggcgtacagcggcggtctcgacacctcctgtattctggtctggctgaaggaacagggttacgatgtcatcgcatacctggctaatattggacaggacgaggactttgatgtggcacggaagaaagctgagaaacttggagccaagaaggtgttcattgaggacctgcgcagtgagtttgtgcaggagttcatctggccggcgctgcaggcgaacgctctgtatgaggaccgatacctgctgggcacctccatcgcccggccctgtatcgcccgccgccaggtgcagatcgcccagcgggagggggcgcagtacgtctcacacggggctactgggaagggaaatgaccaggttcgctttgagctgacgtgttacgcgctctaccctcaagttcaggtcatcgctccatggaggattcctgagttttacaaccgtttccgtggccggaaggacctgatggaatacgcagagaaacacaacattcctgttcccgtcacaccaaaggctccgtggagtatggacgccaatctgatgcacatcagctatgagtctggcattctggagaaccccaagaatcacgcaccttcagatctctaccagatgaccaaaaaccctgagcattctcctgatcaagcagatatgctggagatcgagttcaagaaaggtgttccagtgagagtgtctcatttaaaggatggcatcagtaaagagaccccgctggagattttctgctatctgaatgagatcggaggaaagcatggtgtggggaggatcgatatcgtggagaaccgcttcatcggaatgaagtcccgaggaatctacgagactcctggaggaacggttctccttcaggctcatctggacatcgagaccttcactatggaccgagaggtgcgcaagatcaagcagagcctcggcatcaagttctctgagctcatctataacggcttctggttcagccccgagtgtgagtttgtgcgcgagtgtgtggagagatctcagaaacacgtggagggacgagtccagctctccgtctacaagggacaggtgtacatcctgggccgagagtctcccaaatcactgtacaacgaggagctggtcagtatggatgttcagggcgactacgacccctgcgacgcctcgggcttcatcaagatcaatgctgtccggctgagggaacacaaccgtctgcagggagccgccctcagcaaacacaacgtctga

SEQ ID NO: 25196 - protein, 414 aa, Brachydanio rerio
MSKGLVVLAYSGGLDTSCILVWLKEQGYDVIAYLANIGQDEDFDVARKKAEKLGAKKVFIEDLRSEFVQEFIWPALQANALYEDRYLLGTSIARPCIARRQVQIAQREGAQYVSHGATGKGNDQVRFELTCYALYPQVQVIAPWRIPEFYNRFRGRKDLMEYAEKHNIPVPVTPKAPWSMDANLMHISYESGILENPKNHAPSDLYQMTKNPEHSPDQADMLEIEFKKGVPVRVSHLKDGISKETPLEIFCYLNEIGGKHGVGRIDIVENRFIGMKSRGIYETPGGTVLLQAHLDIETFTMDREVRKIKQSLGIKFSELIYNGFWFSPECEFVRECVERSQKHVEGRVQLSVYKGQVYILGRESPKSLYNEELVSMDVQGDYDPCDASGFIKINAVRLREHNRLQGAALSKHNV

SEQ ID NO: 25197 - DNA, 1206 bp, Symbiobacterium thermophilum
  CDS (1)..(1206)
atggcgaagaagaagtgcgtgctggcctactcaggcgggctggatacctcggtggcgatccactggatcaaggagaactacgacgccgatgtggtcgcgctggcggtggacgtgggcgccaacgacaaggacctggagttcatccggcagaaggcgctttccatcggcgccgtgaagagctacgtctacgatgccaggaaagagttcgcctacgacttcatcctgccgacgctccaggccaacgcctgttacgagtccaagtactacctctcggcggcgctttcccggccgctgatcgcgaagctgctggtccagatcgccgaggaggaaggggccgacttcgtcgcccacggctgcacgggcaagggcaatgaccaggtgcggttcgaggtctccgtggccgccctcaaccccaacctgcaggtgctcgccccggtgcgggagtggggatggagccgggaggaggagatcgactacgcccagaaacatggcatcccggtcccggtgggcaaggagaacccgttctccatcgacgtgaacctgtggggccgctcctgcgaggccggcgtcctggaggacccgtgggcggaggcgccggaggaggccttcgagtggaccgtgaatccgaaggatgcccccgacgagcccgagtacgtggagatcggcttcgagcagggcgtgccggtctcgttgaacggcgaggcgctggacctggtgaccctgatcgagcggctgcacgccatcgccggccgccacggggtgggccgcatcgaccacgtggagaaccgactggtcggcatcaagtcccgggaggtgtacgagatgccggcggcggcggtgctcaccctggcgcacaaggagctggagaccatcaccctgccccgggagctgcaccacttcaagctgggcctggagcagaagtacgccgaactggtctacaacggcctctggttccacccgctgaaggaggccctggacgctttcatcaagaagtcccaggagacggtgaccggcacggtgcgggtgagactcttcaagggctcggccttctgcgtgggccggacttcgccctacacgctctactcctacgacctggccacctacgacaaggcggacaagttcgaccacaaggcggccaaggggttcatcgacatcttcggcctgcccaccaaggtctacgccgccgtgcagaagagcaaggcctga

SEQ ID NO: 25198 - protein, 401 aa, Symbiobacterium thermophilum
MAKKKCVLAYSGGLDTSVAIHWIKENYDADVVALAVDVGANDKDLEFIRQKALSIGAVKSYVYDARKEFAYDFILPTLQANACYESKYYLSAALSRPLIAKLLVQIAEEEGADFVAHGCTGKGNDQVRFEVSVAALNPNLQVLAPVREWGWSREEEIDYAQKHGIPVPVGKENPFSIDVNLWGRSCEAGVLEDPWAEAPEEAFEWTVNPKDAPDEPEYVEIGFEQGVPVSLNGEALDLVTLIERLHAIAGRHGVGRIDHVENRLVGIKSREVYEMPAAAVLTLAHKELETITLPRELHHFKLGLEQKYAELVYNGLWFHPLKEALDAFIKKSQETVTGTVRVRLFKGSAFCVGRTSPYTLYSYDLATYDKADKFDHKAAKGFIDIFGLPTKVYAAVQKSKA

SEQ ID NO: 25199 - DNA, 1425 bp, Propionibacterium acnes
  CDS (1)..(1425)
atggttgccgtgtccaaggtcatcactcagcttcccgtcggcgagcgcgtcggcatcgcattctccggaggactcgacacctccgtcgctgtcgcgtggatgcgcgaaaatggcgcggttccgtgcacctacaccgccgacattggtcagtacgacgagcccgacatcgcgtcagtgccgggtcgcgccctcgactacggcgctgagatctcccgacttgtcgactgcaaggcagcgctcgtcgaggagggactgagcgctatcgcgtgcggcgcgttcaacgttcgctccgccgggcgcccctacttcaacaccaccccaatcggtcgcgccgtcaccggcactctgttggtacgcgctatgcataccgacgacgtctccatttggggcgacggctccacctataagggcaacgacatcgagcggttctaccgctacggcttactcgccaacccgcagctgcgcatctataagccgtggctcgacgaaaacttcgtcgctgaactcggtggccgtgacgagatgagcgcctggcttaccgcccacaacctgccttatcgcgactccaaggaaaaggcctattccaccgacgccaacatctggggcgccacccacgaggccaagaaacttgaatccctgcacgtctccatcgagtccgtcaacccgatcatgggtgtcaagttctgggacccagacgtcaagatcgatactgaggaggtgacggtctccttcgagcagggcctgcccgtcgccatcaatggcaaggaatacgacgataaagtcgccctcgttctggaggccaacgccatcggcggtcgtcacggcctcggtatgagcgaccagatcgaaaatcgcattattgaggcgaaatcccgcggcatctatgaggccccgggcatggccctgctccacatcgcctacgaacgtctcgccaacgccatccacaacgaagacactctggagacttatcacaacgaggggcgtcgcctcgggcggctgctctacgagggacgttggctcgacccgcagtccctcatgatccgtgaatctctcacccactgggtcgccagcgccattactggatcggtcacgctcaagctgcgtcgtggctgggactactccatccttgacaccaccggaccgaacttctcgtaccactctgagaagttgtcgatggagcgcgttgagggggctgccttcggcccgaccgatcgcatcggccagctcacgatgcgcaacctcgatatcgccgatacccgcgaaaagcttgagctctactccgcgcaaggccagctcgccagccacgccgacctcgttgggcagcttgagaccggcggcgcatcagctatcgcgtccaacggcgacgatgacgacgacagccaaaagactctcgacgctgccgcaatggaagttggcgtcaactga

SEQ ID NO: 25200 - protein, 474 aa, Propionibacterium acnes
MVAVSKVITQLPVGERVGIAFSGGLDTSVAVAWMRENGAVPCTYTADIGQYDEPDIASVPGRALDYGAEISRLVDCKAALVEEGLSAIACGAFNVRSAGRPYFNTTPIGRAVTGTLLVRAMHTDDVSIWGDGSTYKGNDIERFYRYGLLANPQLRIYKPWLDENFVAELGGRDEMSAWLTAHNLPYRDSKEKAYSTDANIWGATHEAKKLESLHVSIESVNPIMGVKFWDPDVKIDTEEVTVSFEQGLPVAINGKEYDDKVALVLEANAIGGRHGLGMSDQIENRIIEAKSRGIYEAPGMALLHIAYERLANAIHNEDTLETYHNEGRRLGRLLYEGRWLDPQSLMIRESLTHWVASAITGSVTLKLRRGWDYSILDTTGPNFSYHSEKLSMERVEGAAFGPTDRIGQLTMRNLDIADTREKLELYSAQGQLASHADLVGQLETGGASAIASNGDDDDDSQKTLDAAAMEVGVN

SEQ ID NO: 25201 - DNA, 1437 bp, Leifsonia xyli
  CDS (1)..(1437)
atgtccaaagtcttgagcagtcttccggtcggtgagcgagtcggcatcgcgttctcgggaggtctcgacacctcctgcgcggtcgcctggatgcgcgagaagggcgccgtgccctgcgcctacacggcagacatcggccagtacgacgagccgaacatcgaggaggtccccggtcgcgccaccgagtacggcgcggagatcgcccggctcgtggacgccaagcgcgcactcgtggaggagggcctgatcgcgttgcagtgcggcgccttccacatccgttccggcgggaagacctacttcaacaccaccccgctcggccgggcggtcaccggcgtcatgctggtgcgcgcgatgagggacgacgatgtcgagatctggggcgacggctccacctacaagggcaacgacatcgagcgcttctaccgctacggcctcatcgccaacccgcgcctgcgcatctacaagccgtggctcgacaccgcgttcgtggaggagctcggcggccgcacggagataagcgaatggctcgtcgcgcgcggcttcccctaccgcgacgcgaccgagaaggcatactcgaccgacgcgaacatctggggcgcgacgcacgaggcgaagcgtctggaggagctggacgcgggcctggacatcgtggagccgatcatgggcgtcgccgcctggcgcgaggatatcgaggtcgcccccgagacggtgagcgtgtccttcgagtacggtcgcccggtcgccctcaacgggatcgagttcgccgacccggtcgccctggtgccggaagcgaacgctatcggcggacgccacggcctcggcgcgtccgaccagatcgagaaccgcatcatcgaggcgaagagccgcggcatctacgaagcgccgggcatggctctgctgcacatcgcctacgagcgactcctcaacgccatccacaacgaggataccgtcgccaactaccacaccgaaggccggcgcctcggccgcctgatgtacgagggccgctggctcgatccgcagtcgctcatgctccgcgagtccctgcaacgctgggtcggctccgccatcaccggcgaagtcaccctgcgcctgcgccgcggcgacgactacacgatcctcgacaccaccggcccggcgctcagctaccacccggacaagctctcgatggagcgggtgggcaacgccgccttcggcccggccgaccgcatcggccagctgacgatgcgcaatctcgacatcgcggactcgcgctcgcgtctcgaacagtacgcggccaccggcctcatcggcggcccgaccgccgagctggtgggcgagctacaggagggcagcgcccgcagcatcctggagctggacgtctcccccgaagatgacgccctctcgcgcgagatcgacgcttcctccgagggagccgccttcgacgccgggaccgactga

SEQ ID NO: 25202 - protein, 478 aa, Leifsonia xyli
MSKVLSSLPVGERVGIAFSGGLDTSCAVAWMREKGAVPCAYTADIGQYDEPNIEEVPGRATEYGAEIARLVDAKRALVEEGLIALQCGAFHIRSGGKTYFNTTPLGRAVTGVMLVRAMRDDDVEIWGDGSTYKGNDIERFYRYGLIANPRLRIYKPWLDTAFVEELGGRTEISEWLVARGFPYRDATEKAYSTDANIWGATHEAKRLEELDAGLDIVEPIMGVAAWREDIEVAPETVSVSFEYGRPVALNGIEFADPVALVPEANAIGGRHGLGASDQIENRIIEAKSRGIYEAPGMALLHIAYERLLNAIHNEDTVANYHTEGRRLGRLMYEGRWLDPQSLMLRESLQRWVGSAITGEVTLRLRRGDDYTILDTTGPALSYHPDKLSMERVGNAAFGPADRIGQLTMRNLDIADSRSRLEQYAATGLIGGPTAELVGELQEGSARSILELDVSPEDDALSREIDASSEGAAFDAGTD

SEQ ID NO: 25203 - DNA, 1197 bp, Desulfotalea psychrophila
  CDS (1)..(1197)
atgagcgttgataaaattgtactcgcctattcaggcggtttagatacatctgttattttaaagtggttggccaatgagtatgaatgtcctgttgttgcctattctgctaatattggccagatagaggattgggatgcagttaaggaaaagggtatggccaccggtgccgataaggtaatcgtttccgacctgcagaaggaatttgttgaagattatatcttccccgcctttcgtgcatctgcaatttacgagggcacctatcttcttggtacctctcttgcccgtccacttatctctaaagagcaggtacgtattgcccatgcagagggtgccaacgccgtaagtcatggcgccaccggtaagggtaacgatcaggttcgttttgagctcggttatatcggtcttgatcctagtctgcagatcattgctccatggcgtacctgggatctcaactcccgtaccagacttgaagagtatgctaagcagcataatattcctgtgccaaccaccaagaaaaacccctatagctccgatgagaacctgcttcacatcagctttgagggcggcatccttgagagcccatggaatgagcctgatccggatatgttcaaactcaccgtctctcctgagatggccccggacaagcctacctatctggaaatcacctttcaaaacggtgatcctatagcccttgatggcgttgccatggaaccacttgagcttttcagagcgcttaataaggttgccggtgaaaatgctgttggtcgtcttgatcttgtcgagaaccgtttcgttggtatgaagagtcgtggtgtctatgagactcctggtggaaccctgctctatcatgctcaccgtgatcttgagaccatctgtctcgatcgtgaggtgatgaagattcgtgactctttggtgcctcgttatgctgagcttatctacaatggtttctggttctcacctgagcgcgagcttctccagatgaccatggatactgcccagaagaccgtaagcggtgtggtacgtatgaagctttataagggcaactgtttttctgttggccgtaagtctgatcagagtctttacaaagaagattttgccacctttgaagcagatgatgtatatgaccagggcgatgccaccggttttatccgtctcaatggccttcgtttgaagatcaacgcactgcagggcaagtaa

SEQ ID NO: 25204 - protein, 398 aa, Desulfotalea psychrophila
MSVDKIVLAYSGGLDTSVILKWLANEYECPVVAYSANIGQIEDWDAVKEKGMATGADKVIVSDLQKEFVEDYIFPAFRASAIYEGTYLLGTSLARPLISKEQVRIAHAEGANAVSHGATGKGNDQVRFELGYIGLDPSLQIIAPWRTWDLNSRTRLEEYAKQHNIPVPTTKKNPYSSDENLLHISFEGGILESPWNEPDPDMFKLTVSPEMAPDKPTYLEITFQNGDPIALDGVAMEPLELFRALNKVAGENAVGRLDLVENRFVGMKSRGVYETPGGTLLYHAHRDLETICLDREVMKIRDSLVPRYAELIYNGFWFSPERELLQMTMDTAQKTVSGVVRMKLYKGNCFSVGRKSDQSLYKEDFATFEADDVYDQGDATGFIRLNGLRLKINALQGK

SEQ ID NO: 25205 - DNA, 1251 bp, Debaryomyces hansenii CBS767
  CDS (1)..(1251)
atgtctaaaggtaaggtttgtttggcatactcaggtggtttagatacctcagtcattttggcttggttattggaagaaggatatgaagttatcgcttatttggctaacattggtcaagaggaagacttcgaagaagccgaaagaaaggctttagcaattggtgccaccaagtttgttgttgttgatgtcagaaaggaattcgttgaacaagtttgtttcccagctatccaaactaacgctatttacgagaatgtctacttattaggtacttcgttagctagaccagttattgctcaagctcacatcaaggttgctgaagaaaacggatgttttgctgtttctcacggttgtactggtaagggtaacgatcaagttagatttgaattagctttttatgcattgaaaccagatgttactgttattgctccatggagagacccagactttttcaacagatttgcaggtagaaaagatttattagaatatgctggttctaagaacatcccagttgctcaaaccaaggctaagccatggtcaaccgacgaaaacttggcccatatttccttcgaagctggtattttagaagatcctgataccactccacctaaggatatgtggaaattgactgtcgacccactcgatgctccagataccccagaagatttctctgtttactttgaaaaaggtataccaaagaaattgatcttagatggtggtaagaaggtcattactgaaccagtcgaattgtttactgaagctaacgctttagccagaagaaatggtgtcggtagaattgatattgttgagaacagattcattggtatcaaatctagaggttgttatgaaactcctggtttgaccattttaagatctgcacacattgatttggaaggtttgactcttgatcgtgaagtccgtgccattagagatcaatttgttaccactacttactccaaattattgtacaatggtatgtactttacaccagaatgtgagtatgttagaaccatgattgacccatcccaaaagaccgtaaatggtgttgtcagagctagagcttacaagggatccttgtctattttaggtagatcttctgatactgaaaagttatatgacgaaaccgaatcatctatggacgaattaactggcttttccccagaagacacatccggatttattgccgttcaatccattagaatcaaaaaatatggtgaagcagttagagaaaagggtaatacattatctttataa

SEQ ID NO: 25206 - protein, 416 aa, Debaryomyces hansenii CBS767
MSKGKVCLAYSGGLDTSVILAWLLEEGYEVIAYLANIGQEEDFEEAERKALAIGATKFVVVDVRKEFVEQVCFPAIQTNAIYENVYLLGTSLARPVIAQAHIKVAEENGCFAVSHGCTGKGNDQVRFELAFYALKPDVTVIAPWRDPDFFNRFAGRKDLLEYAGSKNIPVAQTKAKPWSTDENLAHISFEAGILEDPDTTPPKDMWKLTVDPLDAPDTPEDFSVYFEKGIPKKLILDGGKKVITEPVELFTEANALARRNGVGRIDIVENRFIGIKSRGCYETPGLTILRSAHIDLEGLTLDREVRAIRDQFVTTTYSKLLYNGMYFTPECEYVRTMIDPSQKTVNGVVRARAYKGSLSILGRSSDTEKLYDETESSMDELTGFSPEDTSGFIAVQSIRIKKYGEAVREKGNTLSL

SEQ ID NO: 25207 - DNA, 1263 bp, Kluyveromyces lactis NRRL Y
  CDS (1)..(1263)
atgtctaaaggtaaggtttgtttggcatactccggtggtttggatacctctgtgattttggcctggttgttagaacaagggtacgaagttgttgccttcatggccaatgttggtcaagaagaagatttcgaagctgctgaaaagaaggctttactaattggtgctaccaagtttgttctagttgactgcagagaagaattcgtcaaggacgttttgttcccagctgttcaagttaacgcggtatacgaagacgtttatctgttaggtacctctttggctagacctgttatcgctaaggctcaaatcgacgtcgctaagcaagaaggttgtttcgctgtttctcatggttgcaccggtaagggtaacgatcaaattagattcgaattgggtttctacgcattgaaaccagacgtcaaggtcattgccccatggagagatccaactttcttcgacagatttgctggtagaaaagatctattggcttatgctgccgaaaagaacatccctgtgttccaaaccgcttctaaaccatggtccactgatgagaacttggctcatatctcctacgaagctggtattctagaagatccaaaccaaactcctccaaacgatatgtggaagttgatcactggtccagaagatgctccagatcaaccacaagatttggatatcgttttcgaaaagggtttgccagtgaagttgacttacaaggatgccgcttctggcaaagaaactactgctacttcaccattggatatcttcttgacttctgcgaaattggctagagctaacggtgttggtagaatcgatatcgttgaaaatcgttacatcaacttgaaatctagaggttgttacgaacaagctccattgtccgtcttgagaagagctcacgttgacttggaaggtttgactttggacaaagaagtccgtgccttgagagatcaatttgtcactccaaattactccagattgttgtacaacggttcatacttcactccagaatgtgaatatatcagatctatgatccaaccttcccaatctacagttaacggtaccgttagattgagactatacaagggtaacatcattgtgctaggcagatactcagagactgagaacctatacaatcctgatgaatcttctatggatatattgactggtttccaaccaaccgacactaccggtttcatcgctattcaagcgatcagagtaaaaaagtacggtgaatccaaggctgccaagggtgaagaactaactttataa

SEQ ID NO: 25208 - protein, 420 aa, Kluyveromyces lactis NRRL Y
MSKGKVCLAYSGGLDTSVILAWLLEQGYEVVAFMANVGQEEDFEAAEKKALLIGATKFVLVDCREEFVKDVLFPAVQVNAVYEDVYLLGTSLARPVIAKAQIDVAKQEGCFAVSHGCTGKGNDQIRFELGFYALKPDVKVIAPWRDPTFFDRFAGRKDLLAYAAEKNIPVFQTASKPWSTDENLAHISYEAGILEDPNQTPPNDMWKLITGPEDAPDQPQDLDIVFEKGLPVKLTYKDAASGKETTATSPLDIFLTSAKLARANGVGRIDIVENRYINLKSRGCYEQAPLSVLRRAHVDLEGLTLDKEVRALRDQFVTPNYSRLLYNGSYFTPECEYIRSMIQPSQSTVNGTVRLRLYKGNIIVLGRYSETENLYNPDESSMDILTGFQPTDTTGFIAIQAIRVKKYGESKAAKGEELTL

SEQ ID NO: 25209 - DNA, 1347 bp, Erwinia carotovora
  CDS (1)..(1347)
atgacaacgattctcaagcatcttccggttggtcagcgtattggtattgcgttctcgggtggtctggataccagcgctgcactgctttggatgcgtcaaaagggcgcggttccttatgcgtataccgcaaatctggggcaaccagacgaggatgactacgatgaaatccctcgtcgtgcaatggaatacggcgcagaaaatgctcgccttatcgattgccgtaagcaattagtcgctgaaggtatcgctgcgattcagtgtggcgcattccacaatacgacagcgggcgttacctatttcaacaccacgccgctaggccgtgcggttaccggtacgatgctggttgcggcgatgaaagaagacggcgtgaacatctggggtgacggcagcacctataaaggcaacgatattgagcgtttctatcgctacggcctgctgaccaatgctgaactgaagatttacaagccgtggctggataccgacttcattgatgagctgggcggccgtcaggagatgtctgagtttatgtcgcaggcagggttcggctataaaatgtcggccgagaaagcctattctacagattccaacattctgggtgcgacgcacgaagcgaaggatctggaattcctgaattccagcgttaaaatcgttaacccgattatgggcgtgaaattctgggacgagaacgtcaaggttccggcagaagaagtgaccattcgttttgagcgtggacacccggttgcgctgaacggcaagacctttaccgatgacattgaactgatgctggaagcaaaccgcatcggcggtcgtcacggtctgggtatgagcgaccagatcgaaaaccgcatcattgaagcgaaaagccgcggcatctatgaagcgccgggaatggcactgctgcacattgcctatgagcgtctgcttactggtatccacaacgaagacaccatcgagcaataccatgctaatggccgtcagctgggtcgtttcctgtatcagggacgctggtttgattcccaggcattgatgctgcgtgattcttcgcagcgttggatcgccagtgctatcaccggcgaggttacgctggagctgcgtcgtggcaatgattactccatcatgaatactgtgtctgacaatctgacctataagccagaacgcttgaccatggagaaaggcgactcggtcttctcgccagatgaccgtattggccagctgaccatgcgtaatctggacatcacggatacgcgtgaaaaactgtttaactatgctgaaacgggcttgctctcttcctctgccagcacgggcttgccgcaggtagggcaattgcaggataaaacagagaaataa

SEQ ID NO: 25210 - protein, 448 aa, Erwinia carotovora
MTTILKHLPVGQRIGIAFSGGLDTSAALLWMRQKGAVPYAYTANLGQPDEDDYDEIPRRAMEYGAENARLIDCRKQLVAEGIAAIQCGAFHNTTAGVTYFNTTPLGRAVTGTMLVAAMKEDGVNIWGDGSTYKGNDIERFYRYGLLTNAELKIYKPWLDTDFIDELGGRQEMSEFMSQAGFGYKMSAEKAYSTDSNILGATHEAKDLEFLNSSVKIVNPIMGVKFWDENVKVPAEEVTIRFERGHPVALNGKTFTDDIELMLEANRIGGRHGLGMSDQIENRIIEAKSRGIYEAPGMALLHIAYERLLTGIHNEDTIEQYHANGRQLGRFLYQGRWFDSQALMLRDSSQRWIASAITGEVTLELRRGNDYSIMNTVSDNLTYKPERLTMEKGDSVFSPDDRIGQLTMRNLDITDTREKLFNYAETGLLSSSASTGLPQVGQLQDKTEK

SEQ ID NO: 25211 - DNA, 1341 bp, Acinetobacter sp
  CDS (1)..(1341)
atgactgataatgcaaccattttgcagcatgtaccagtaggtaaaaaagtgggtattgccttctctggtggtctggatacttcagctgctttattgtggatgaaacaaaaaggcgcagaaccttatgcatatactgcaaacttaggtcagccagatgaagacgactacgatgcgattccaaaaaaagcagaacaatacggtgcagttaaagcccgtctgatcgattgtcgtttacagcttgcgcttgaaggtattgcagcaattcagtgtggtgcattccatatcagcacaggcggtgttccttatttcaatacgacaccacttggccgtgctgttacaggcacaatgcttgtgactgccatgaaagaagatgatgtcaatatctggggcgatggttcgacctataaaggaaatgacatcgaacgtttctatcgttatggtctactcaccaatccaaacctaaaaatttataagccttggcttgaccaaacgtttattgatgaattaggcggtcgtgcggaaatgtcacaatttctaatcgacaacggttttgactataaaatgtcaaaagaaaaagcgtattcaaccgattcaaacatgctgggtgcaactcacgaagccaaagatcttgaatacctcgatgcaggtatcaagattgtagatccaatcatgggtgttgctttctggaaagatgaggttgaaattcaaccagaacaagtcagcattacctttgaagaaggtatgcctgtggcattgaacggtcaacgtattgaagatccggttgagttcattcttgaagcaaaccgtattggtggtcgtcatggtttaggcatgtcagatcagatcgaaaaccgtatcatcgaagctaaatctcgtggtatttatgaagctccaggtatggcacttctgcatattgcctacgaacgtcttgtgacaggtattcacaatgaagataccatcgaacagtaccgtatcaatggcttacgtttaggtcgtttactttaccaaggtcgctggtttgattcacagtcacttatgcttcgtgaaactgcacagcgctgggttgcaaaagccattacaggtacagtaactctagagttacgtcgcggtaatgattacaccatcatgaacactgaatctccaaacctcacgtatgaagctgagcgtttaaccatggagaaaggtgactcaatgtttagtccaatggatcgtatcggtcaattaaccatgcgtaatctggatattaccgatactcgtgcaaaattaggtatctatacaaattctggtctgctttctattggtcacggttctgctgtacctcagttagagactaagaaataa

SEQ ID NO: 25212 - protein, 446 aa, Acinetobacter sp
MTDNATILQHVPVGKKVGIAFSGGLDTSAALLWMKQKGAEPYAYTANLGQPDEDDYDAIPKKAEQYGAVKARLIDCRLQLALEGIAAIQCGAFHISTGGVPYFNTTPLGRAVTGTMLVTAMKEDDVNIWGDGSTYKGNDIERFYRYGLLTNPNLKIYKPWLDQTFIDELGGRAEMSQFLIDNGFDYKMSKEKAYSTDSNMLGATHEAKDLEYLDAGIKIVDPIMGVAFWKDEVEIQPEQVSITFEEGMPVALNGQRIEDPVEFILEANRIGGRHGLGMSDQIENRIIEAKSRGIYEAPGMALLHIAYERLVTGIHNEDTIEQYRINGLRLGRLLYQGRWFDSQSLMLRETAQRWVAKAITGTVTLELRRGNDYTIMNTESPNLTYEAERLTMEKGDSMFSPMDRIGQLTMRNLDITDTRAKLGIYTNSGLLSIGHGSAVPQLETKK

SEQ ID NO: 25213 - DNA, 1263 bp, Candida glabrata CBS138
  CDS (1)..(1263)
atgtctaaaggaaaagtttgtttggcatactctggtggtctagatacctccatcatcctagcttggttgctagaacaaggctacgaagttgttgctttcatggccgatgtcggtcaggaagaagacttcgaagccgctagagctaaggctttgaagattggtgctaccaaggttgttatcagtgacgtccgtgaacaatttgttaaggatatcatcttccctgccgtccaagtcaacgctgtctacgaagatgtctatttgctaggtacttctttggctagaccagttattgctaaggctcaaatcgatgttgctgaacaagaaggttgtttcgccgtttctcacggttgtaccggtaagggtaacgatcaaatcagattcgaactatctttctacgctttgaagccagacgtccaagtgatcgctccatggagattgccagaattcttcaacagatttgccggtagaaaggatctattggactacgccgcagaaaagggtatcccagtcgcacaaaccaaggccaagccatggtccaccgatgaaaacatggcgcacatctcttacgaggctggtatcctagaagacccaaatactaccccaccaaaggatatgtggaagttgattaccgacccaatggatgctccaaacactccacaagatatcacgctagatttcgaaaagggtatccctgttaagctaacatacaaggacaacgctactggtaaggaacatgtagtcactgacgccttggagttggcccttcacgtctctaacttgggtagagccaacggtgtcggcagaatcgacattgttgaaaaccgttacattaacttgaagtccagaggttgttacgagcaagccttgctaactattttgagaaaggcccacgtcgatcttgaaggtctggtgctagacaaggaagtccgtcaattgagagaccaatttgtcactaccacttactccaagctgctgtacaacggttcttacttcaccccagaatgtgaattcatcagagccatgatcgagccatctcaaaagaccgtcaacggtacagtcagactttctctatacaagggtaacgtgatagtactaggaagatactctaacactgaatccctgtatgacgccactgaatcctcaatggatgagctaacaggtttcctacctaccgataccaccggtttcatcgccatccaagccatcagagtcaagaagttcggtgaagccaagaaggccagcggtgagaagatcactttatag

SEQ ID NO: 25214 - protein, 420 aa, Candida glabrata CBS138
MSKGKVCLAYSGGLDTSIILAWLLEQGYEVVAFMADVGQEEDFEAARAKALKIGATKVVISDVREQFVKDIIFPAVQVNAVYEDVYLLGTSLARPVIAKAQIDVAEQEGCFAVSHGCTGKGNDQIRFELSFYALKPDVQVIAPWRLPEFFNRFAGRKDLLDYAAEKGIPVAQTKAKPWSTDENMAHISYEAGILEDPNTTPPKDMWKLITDPMDAPNTPQDITLDFEKGIPVKLTYKDNATGKEHVVTDALELALHVSNLGRANGVGRIDIVENRYINLKSRGCYEQALLTILRKAHVDLEGLVLDKEVRQLRDQFVTTTYSKLLYNGSYFTPECEFIRAMIEPSQKTVNGTVRLSLYKGNVIVLGRYSNTESLYDATESSMDELTGFLPTDTTGFIAIQAIRVKKFGEAKKASGEKITL

SEQ ID NO: 25215 - DNA, 1206 bp, Bacillus thuringiensis
  CDS (1)..(1206)
atggataagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcattaaatccttacttagaagtaattgcacctgtacgtgaatggaaatggtcacgtgaagaagaaattgcctatgcaaaagaaaataatgtaccgattccaattaatttagatagcccgttttcaatcgatcaaaatttatggggacgcagcaatgaatgtggcattttagaagatccatgggcagcgccgccagaagatgcatatgagatgacattggcattagaagacacaccgaataaaccagaatttgtagaaattggctttgaagcaggcgtaccgactactttaaatggcactgcatatccactttcagaacttattaaaacgttaaatgcacttgcaggaaaacatggcgttggacgtatcgatcacgtagaaaatcgtcttgttggtattaaatcacgtgaagtatacgaatgcccagcagcaatgacattaattacggcgcataaagaacttgaagatttaacacttgtaaaagaagtagcacactttaaaccgatgattgagcaaaaaataacagagcttatttataacggtttatggttctcgcctttaaaacaagcgcttcatgctttcttacaagaaacgcaaaagaatgtaacaggcatggtgcgtgtgaaattatttaaaggtcatgcaattgtagaagggcgtaaatctgagtactctttatacgatgaaaaattagcaacatatactgctcaggatgaatttaatcatgatgcagcagttgggttcatttcattattcggtttaccgacgaaagtatacagccaagtgaatcaaaagaaggtggaagcgtga

SEQ ID NO: 25216 - protein, 401 aa, Bacillus thuringiensis
MDKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGMVRVKLFKGHAIVEGRKSEYSLYDEKLATYTAQDEFNHDAAVGFISLFGLPTKVYSQVNQKKVEA

SEQ ID NO: 25217 - DNA, 1188 bp, Picrophilus torridus
  CDS (1)..(1188)
atggaaaaggcattattattatactctggtggactggatacatccgttatggtcaggtggataaaagaaaaaatgaacatggacgttgtaacattaacacttgacataggtaactctgatcttgaagaaataaaagagaaggccttaaagctgggggccattgatgcaataacgcttgatgttaaaaaggaattcgctgataactatatatcaagggagatacatgccaatggcctttacggtgaatacccgctatcaacagcacttgcaaggccgcttatggccgagaaagccgtctcggttgccaatgaaaacgatataaagttcatagcccatggttccactggaaagggaaatgaccaggtaaggtttgaggtctcaataaacgcacttgataataacataaaggtgattgcgcctgtaagggaatggaatatgaccagggcagatgaacttgaatatgcaaaaatgaataatatatatgtaaaatctgatggcaaatactccgttgatgaaaatatatggggtaggtcaatagagggatcatccatagaaaatattaacgaacccgttaatgatgatgcctttgaatgggtaacaccgccccaatactgcggttcaggcgaaccggtttcaattgaattctataaagggctgccatcatcattaaatggtaaaagcatggatcttttgagcataataaaaaatcttaacattattgcaggcaggaacggtataggtataataaacatgatagaatcgaggctcataggtctcaagagccacgaggtctatgaatgccctgccgcatctgttatattaaaagcacacaaatatcttgagaatttaatactaaacaaaaacgaactttctgtgaagaattacatagataatttctggtcaaacatggtttacaatggattatggtttgatccgtcaatggagcacatgaaccaattcgagaaaagctcaaatcagtacataaccggaagcgtaaatttaagactttacaggggaaacatgatcctggaaggcattgagagcccgtactctctatacgattataacacaataaactatgagaccggtgtatttgatcagggctcatcaaagggctttatagatatatacaaaaatgaaaccgtaaggtcaaacagggttaaaaaggcattaacggtgatacattga

SEQ ID NO: 25218 - protein, 395 aa, Picrophilus torridus
MEKALLLYSGGLDTSVMVRWIKEKMNMDVVTLTLDIGNSDLEEIKEKALKLGAIDAITLDVKKEFADNYISREIHANGLYGEYPLSTALARPLMAEKAVSVANENDIKFIAHGSTGKGNDQVRFEVSINALDNNIKVIAPVREWNMTRADELEYAKMNNIYVKSDGKYSVDENIWGRSIEGSSIENINEPVNDDAFEWVTPPQYCGSGEPVSIEFYKGLPSSLNGKSMDLLSIIKNLNIIAGRNGIGIINMIESRLIGLKSHEVYECPAASVILKAHKYLENLILNKNELSVKNYIDNFWSNMVYNGLWFDPSMEHMNQFEKSSNQYITGSVNLRLYRGNMILEGIESPYSLYDYNTINYETGVFDQGSSKGFIDIYKNETVRSNRVKKALTVIH

SEQ ID NO: 25219 - DNA, 1215 bp, Photobacterium profundum
  CDS (1)..(1215)
atgagtaaggtaactaaagtcgtattagcctattccggcggtctagatacatcagcaatcatcccatggttaaaagaaaactatgactgtgaagttgtcgcttttgtggcagatgttggtcaaggtgcagcagagcttgaaggtattgaagaaaaagcgatcgcatctggcgcatcatcttgttacatcgcggatctaaaagaagaaatggtagcagattacatctacccaagcctcaagacaggtgctatttacgaaggtaagtacttgttgggtacgtcaatggcacgtcctattatcgcgaaagcacaagttgaatgtgcattagccgtcggtgctgatgcagtatgtcatggttgtaccggtaaaggtaacgatcaggttcgttttgaaggtgcgtatgcagcgcttgctcctcaattaacggtgattgcaccgtggcgtgagtgggatctacgtagccgtgaagcattgctagattaccttgccgagcgtgatatcccttgcacggcatcacttgaaaaaatctactctcgtgatgcaaacgcatggcacatttcaaccgaaggtggcgtgttagaaaatacctggaatcagtcgaacgaactgtgctgggtctggacgaaagatcctgagaatgcaccagaaaaagctgaaactgtgtctatcttggtagaaaaaggtgaagttgttgctgtcgatggtgaagcaatgtcgccgtttaatgcccttacttacctaaatgaaaaaggggctgaacacggtgtgggccgtatcgatatcgttgaaaatcgtttggttggtattaagtctcgtggttgttatgaaacgccaggtggcacaatcatgaacgaagcgttacgtgcggtagagcaattagtgcttgataaagagtcgtatgaattccgtgagacggtaggccttaaagcgtcacaccttatctatgatggtcgttggtttaccccgctttgtaaatcgatactagctgcagcagatgaattggctcaagatgtgagtggtgaagttgtagtgaaactgtataaaggtcaagctacagtgattcagaagcgttcaatgaatagcttgtactctgaagagtttgcaaccttcggtgaagatgacgtttacgatcacagccatgctggtggtttcattcgcctttattcgctagcaagtcgtatccgtgcattgaatacacagaaaaaacaaaaataa

SEQ ID NO: 25220 - protein, 404 aa, Photobacterium profundum
MSKVTKVVLAYSGGLDTSAIIPWLKENYDCEVVAFVADVGQGAAELEGIEEKAIASGASSCYIADLKEEMVADYIYPSLKTGAIYEGKYLLGTSMARPIIAKAQVECALAVGADAVCHGCTGKGNDQVRFEGAYAALAPQLTVIAPWREWDLRSREALLDYLAERDIPCTASLEKIYSRDANAWHISTEGGVLENTWNQSNELCWVWTKDPENAPEKAETVSILVEKGEVVAVDGEAMSPFNALTYLNEKGAEHGVGRIDIVENRLVGIKSRGCYETPGGTIMNEALRAVEQLVLDKESYEFRETVGLKASHLIYDGRWFTPLCKSILAAADELAQDVSGEVVVKLYKGQATVIQKRSMNSLYSEEFATFGEDDVYDHSHAGGFIRLYSLASRIRALNTQKKQK

SEQ ID NO: 25221 - DNA, 1338 bp, Rhodopseudomonas palustris
  CDS (1)..(1338)
atgactacgatcttgaaaagcctgcccaagggcgaaaacgtcggcatcgctttctcagggggtctcgataccagcgcggcgctgctgtggatgaagcagaagggcgccaaggtgttcgcctatacggcgaacctcggccagcccgacgaggccgactacgacgcgatcccgcgcaaggcgatggagttcggcgccgagaaagcccggctggtcgattgccgcacccagctggtgcacgaaggcatcgcggcgatccaggccggcgccttccacgtctcgaccggcggcatcgcgtatttcaacaccaccccgctcggccgcgccgtcaccggcaccatgctggtgtcggcgatgaaggaagacggcgtcaacatctggggcgacggctcgacctacaagggcaacgacatcgagcggttctaccgctacggcctgctcaccaatccggccttgcggatctacaagccctggctcgaccagcagttcatcgacgagctcggcggccgcgccgagatgtcggcgttcatgacttcgcacggcttcgcctacaagatgagcgccgaaaaggcgtactcgaccgacagcaacctgctcggcgccacccacgaggccaaggatctcgaacacctcgacagcggcatcaagatcgtcaacccgatcatgggcgtgccgttctggcgcgacgattgcgcggtgaaagccgaagccgtcacggtgcggttcgaggaaggccagccggtcgcgctcaatggccagactttcacggatccggtcgcgatgttctacgaagccaatgccatcggcggacgtcacggcctcggcatgagcgaccagatcgagaaccgcatcatcgaggccaagagccgcggcatctacgaggcgcccggcatggcgctgctgcacatcgcctatgagcggctggtcaccggcattcacaacgaagacaccatcgagcagtaccgcatcaacggcatgaagctcggccggctgctgtatcagggccgctggttcgactcgcaggctttgatgctgcgcgagaccgcgcagcgctgggtcgcccgtgccgtcaccggcgaggtgacgctcgaactgcgccgcggcaacgactactcgatcctcaacaccgtcagcccgaacctgacctacgcgccggagcggctgagcatggagaaggtcgaggacgcgccgttcactccggccgaccgcatcggccagctcaccatgcgcaacctcgacatcaccgacacccgcgccaagctcggcctctacgccaagaccggcctgctgtcctccggcgaaggcaccccgatcccgcagctggaaaacgacaagggctga

SEQ ID NO: 25222 - protein, 445 aa, Rhodopseudomonas palustris
MTTILKSLPKGENVGIAFSGGLDTSAALLWMKQKGAKVFAYTANLGQPDEADYDAIPRKAMEFGAEKARLVDCRTQLVHEGIAAIQAGAFHVSTGGIAYFNTTPLGRAVTGTMLVSAMKEDGVNIWGDGSTYKGNDIERFYRYGLLTNPALRIYKPWLDQQFIDELGGRAEMSAFMTSHGFAYKMSAEKAYSTDSNLLGATHEAKDLEHLDSGIKIVNPIMGVPFWRDDCAVKAEAVTVRFEEGQPVALNGQTFTDPVAMFYEANAIGGRHGLGMSDQIENRIIEAKSRGIYEAPGMALLHIAYERLVTGIHNEDTIEQYRINGMKLGRLLYQGRWFDSQALMLRETAQRWVARAVTGEVTLELRRGNDYSILNTVSPNLTYAPERLSMEKVEDAPFTPADRIGQLTMRNLDITDTRAKLGLYAKTGLLSSGEGTPIPQLENDKG

SEQ ID NO: 25223 - DNA, 1191 bp, Photorhabdus luminescens
  CDS (1)..(1191)
atgagttctgatcgcgttttggtgatttactataatcgcctctataatcctcttatcataagaagtcttaaatctgaatatagagaggtaattgctctttatattgatgaagggcaggtaagagatattgaagatattgaattagaatgcatggttgcaggtgctgataaatttatctataaagattatcgagcgcaatatgctgaacacttccttacaaaagcgataaaagcgaatgctatttatcaaaatggttattttctcagtgctgcactttcccggcctgcgattgctgaggcagcagttgaagttgccaatgagctcaatattgattatattgctcatcaattcagaggtaatgatcaagtcagaatggatatgaatatagaaattctgaataaaatacctattgcttcgttgagagattttaaatacgacgaaaatattgtaaatagttatgcgatgaaatatggtattcctcaagaatttggttgtaataacccttattctactagtgaaaatatatggggattaagtgtcgaatgtggaccgttggcagaaccggaagcattaattccggaagatgccagagagaaattatttgaacatgcactatcagctactgagccaatatttttgtcattaggttttgagaatggtataccgatatcgattgacggcgaaaagaaatcattatatgaaattattgaaatattaaatgagattggtaaaaaattatcaattggtatttttgatattgttgaagatggcattgtcggtttgaaaacacgcgcaatttatcaatcacctgccgcacatatcttaattaccgcacatcgtgatttagaatgttattgtagtaatcgtcacgaaaattggtttaaagagatagttgataaaaaatgggttgaattagtttattctgggctttggtatgatcccttattaactcatttaaaccactttattgatagcatgaatcaacatgtcaatggtgagattaagcttgaattaggttataaatatgccaatgtttgttcccgtatttcaaagacaactatctatgatgataatttagcaatatataattgtgggcatttatatagtcaaaacgatgcagagggatttgcaaaaatatttaatattcatactaagcaaagtgctaaatctaagatgaggcaaaagttatga

SEQ ID NO: 25224 - protein, 396 aa, Photorhabdus luminescens
MSSDRVLVIYYNRLYNPLIIRSLKSEYREVIALYIDEGQVRDIEDIELECMVAGADKFIYKDYRAQYAEHFLTKAIKANAIYQNGYFLSAALSRPAIAEAAVEVANELNIDYIAHQFRGNDQVRMDMNIEILNKIPIASLRDFKYDENIVNSYAMKYGIPQEFGCNNPYSTSENIWGLSVECGPLAEPEALIPEDAREKLFEHALSATEPIFLSLGFENGIPISIDGEKKSLYEIIEILNEIGKKLSIGIFDIVEDGIVGLKTRAIYQSPAAHILITAHRDLECYCSNRHENWFKEIVDKKWVELVYSGLWYDPLLTHLNHFIDSMNQHVNGEIKLELGYKYANVCSRISKTTIYDDNLAIYNCGHLYSQNDAEGFAKIFNIHTKQSAKSKMRQKL

SEQ ID NO: 25225 - DNA, 1227 bp, Neurospora crassa
  CDS (1)..(1227)
atgtctgagtccaagggccgcgtctgtctcgcctattccggaggtcttgatacttccggctacaccgtcgtctgcttcctcgccaatgtcggccaggaggagaactgggatgaggtccgcgccaaggccaagaagctcggtgctgaggagatggtgatcctcgacctccagcaggagttcgttgaccagatcgtcttccgtgccatccagtgcaatgccatctatgaggaccgctacctcctcggcacctccctcgcccgccccatcattgcccgtgcccaggtccgcgttgccgagcaatacaactgcgagttcgtctcccacggctgcactggcaagggcaacgaccaggtccgcttcgagcttgccttcaaggcctgcaaccccgagatcaaggtcattgctccctggagacttcccgagttctgtgctcgcttccagggtcgtcaggatctcctgaagtacgccgccgacaagaacatccccgtctcctcgacccccaaggccccttggtccatggatgacaaccttgtccactgcagctacgaggctggcattcttgaggaccccaaccacactccccccaaggagctctggacccgcactgttgacccccaggacgcccccaacactccccaggagttcaccatcgtctttgagaagggtatccccgtcaaggtcattgtcgatggcaaggagaccactggctctgttgagctcttcaagctcctcaacaagattggtcacgaccacggtgttggccgtgtcgatatcgttgagaaccgcttcatcggtctcaagtcccgtggctgctacgatactcccggcctcaccattgctcgccttgcccatcttgatcttgagggtcttgttatggactctagggtccgtgagctccgtgatcagttcgtcaccatctcctggtctcgtcagctgtacaacggcatgtacttcagccctgagcgcgagttcgtcgagaactccatcatcttctcccagcagaatgttactggtgaggtccgcatgatggcctacaagggtaacgcctacgtcctcggccgcaagtccgatgccagcaacctctactccgaggccgatgcctccatggactccctcgagggcttctcccccatggacaccaccggtttcattgagattaacgccatccgtctcaagaagtacggtcttcagaagattaaggacggcaagcccctcacccagtcttga

SEQ ID NO: 25226 - protein, 408 aa, Neurospora crassa
MSESKGRVCLAYSGGLDTSGYTVVCFLANVGQEENWDEVRAKAKKLGAEEMVILDLQQEFVDQIVFRAIQCNAIYEDRYLLGTSLARPIIARAQVRVAEQYNCEFVSHGCTGKGNDQVRFELAFKACNPEIKVIAPWRLPEFCARFQGRQDLLKYAADKNIPVSSTPKAPWSMDDNLVHCSYEAGILEDPNHTPPKELWTRTVDPQDAPNTPQEFTIVFEKGIPVKVIVDGKETTGSVELFKLLNKIGHDHGVGRVDIVENRFIGLKSRGCYDTPGLTIARLAHLDLEGLVMDSRVRELRDQFVTISWSRQLYNGMYFSPEREFVENSIIFSQQNVTGEVRMMAYKGNAYVLGRKSDASNLYSEADASMDSLEGFSPMDTTGFIEINAIRLKKYGLQKIKDGKPLTQS

SEQ ID NO: 25227 - DNA, 1332 bp, Haemophilus ducreyi
  CDS (1)..(1332)
atgtcagcaacgattttagaatctctcccattaggtcaaaaggttggtatcgctttctcaggtggtttggatacttcagccgcgttactttggatgcgtaaaaaaggtgcaataccttatgcatatactgccaatttaggccaaccagatgaaaatgattacaatgcaattccaaacaaagcgatggaatatggtgcagaaaatgcccgcttaattgattgccgtactcaattagctcacgaagggattgccgcaattcaatgtggagcatttcatatttcaacaggtggtattccatatttcaatactacaccgcttggccgagcagtaacaggcacaatgcttgtggcagcaatgaaagaagataatgtgaatatttggggggatggttcaacgtttaaaggtaatgatattgaacgtttttaccgctatggcttattaactaatccaaaattaaaaatttataaaccttggttagatcagctttttattgatgagcttggcggtcgttttgaaatgtcacaatttttaatttcaaacggctttgattataaaatgtctgttgaaaaagcatattcgactgattcaaatatgttaggcgctacccacgaagcaaaagatttagaagaacttggcacggatatgaaaattgtcaagccaattatgggcgttgcattttgggatgaatcggttgaaattaaaccagaaattgtatcggtcacctttgaagaagggattcctgttgctttaaatggtaaacggattgatgatgcagttgaattaatcttagaagcaaaccgtatcggtggccgtcatggcttaggtatgtcagatcaaattgaaaaccgtattattgaagcaaaatcacgtggaatttatgaagcgccaggaatggcaatattacatattgcttatgagcgtttagtgacgggtattcataatgaagacacgatagaacaatatcgtatcaatggcttgcgtttagggcgtttattatatcaaggtcgttggtttgatcctcaagcgttaatgttacgagaaacggcacaacgttgggtcgcaaaagcaattgcgggcacggtaacattagaattacggcgtggtaatgatttcagcattttaaatactgaatcggttaatttaacttatcaagcagagcggttaagtatggaaaaagtcgaagatgcaccttttacccctgctgatcgtataggtcaattaactatgcgtaatttagacattgttgatacacgtgataaactagctgtttatacggacgcaggtttattatctgtgcaaaataatgttattccacaattgaataaaaaataa

SEQ ID NO: 25228 - protein, 443 aa, Haemophilus ducreyi
MSATILESLPLGQKVGIAFSGGLDTSAALLWMRKKGAIPYAYTANLGQPDENDYNAIPNKAMEYGAENARLIDCRTQLAHEGIAAIQCGAFHISTGGIPYFNTTPLGRAVTGTMLVAAMKEDNVNIWGDGSTFKGNDIERFYRYGLLTNPKLKIYKPWLDQLFIDELGGRFEMSQFLISNGFDYKMSVEKAYSTDSNMLGATHEAKDLEELGTDMKIVKPIMGVAFWDESVEIKPEIVSVTFEEGIPVALNGKRIDDAVELILEANRIGGRHGLGMSDQIENRIIEAKSRGIYEAPGMAILHIAYERLVTGIHNEDTIEQYRINGLRLGRLLYQGRWFDPQALMLRETAQRWVAKAIAGTVTLELRRGNDFSILNTESVNLTYQAERLSMEKVEDAPFTPADRIGQLTMRNLDIVDTRDKLAVYTDAGLLSVQNNVIPQLNKK

SEQ ID NO: 25229 - DNA, 1733 bp, Xenopus laevis
  CDS (81)..(1316)
gcaagaactctctttccttaatacaagaaactgcctgcacaacccattgatccgctgctgtcacattgttactcgataacatgtcccaaagtaaaggtacagtggtccttgcatacagtggggggctggacacgtcctgcattctcgtatggctgaaggaacagggctttgatgtcatcgcttacctggcaaatattgggcagaatgaagatttcgaggaggcccggaaaaaagctgtaaatcttggcgcaaagaaggtttatatagaagacatccgacagcagtttgtggaagaatatatctggccggcggtacaggccaatgctatctatgaggatcgttacttactgggcacctcactggcacgtccctgtattgccaagaagcaagtggaaattgccaagaaagaagcagcagagtatgtgtcccatggtgccactggaaagggtaatgatcagattcgttttgagctcacgtgttactcgctgtaccccgaagtcaagatcattgccccttggaggatgccagagttttacaaccgattcagagggcgcagcgacctgatggagtatgccaagaaacataacatttctgtcccagtgactcccaagagcccttggagtatggatgagaacctcatgcacatcagttatgaaggtggaattctagaaaaccccaagaaccatgctccacctggactgtacttaaagacaaaggaccccgccacgtctccagatgagccagacatacttgagattgagttcaagaaaggtgtccccgtgaaagtcaccaacaccaagaacaagacgcagcacagctcctccctcgcactgttttgttatctcaacgaagtggctggaaagcacggcgttggccggatcgatattgtggagaaccggttcattggcatgaagtctcgaggtatctacgagactccggcggggaccatactctaccaagcgcacttagacattgaggcgtttaccatggaccgcgaaatgcgcaaaattaagcagcagctgtcgcaaaggtttgccgagcagatctacaatggattctggtacagcccagagtgtgagtttgtgcgcagctgtatctccaaatctcaggagatggtggaaggcaaggtgctggtttctgtgctgaaaggacaagtgtatgtgctgggcagagaggcgcctcattctctgtacaacgaggagctggtcagcatggatgttcaaggagattatgacccggctgatgcgtgcggatttatcaagatcaatgctgtaaggttaaaggaatatcaccggcttcaaaagaacaaaaaataacagtgaaggccatgaatggataacatagctgcaaacacaggacagcagagcaccccattttaatatccctcagtgccattaagcatcagtcatccgaagcacaaaaaccacctagagttagagaatggggctgatcttctaaactagcttctaaactgcaccaaagcaactgccagtggaaaccaattgattacatccagtctacttttttagttttaggacctcaccctaaaggccccaaccatttaacgatctactacaagttagacgatgacagcaaagaactaatagtagtagataagggtaattgcatgggttcagtttagcactgctgttagtaaatcaggctcctagtctatatcagtgtaatatttgtagaagtaataaaatttactgtatgtaaaaaaaaaaaaaaaa

SEQ ID NO: 25230 - protein, 411 aa, Xenopus laevis
MSQSKGTVVLAYSGGLDTSCILVWLKEQGFDVIAYLANIGQNEDFEEARKKAVNLGAKKVYIEDIRQQFVEEYIWPAVQANAIYEDRYLLGTSLARPCIAKKQVEIAKKEAAEYVSHGATGKGNDQIRFELTCYSLYPEVKIIAPWRMPEFYNRFRGRSDLMEYAKKHNISVPVTPKSPWSMDENLMHISYEGGILENPKNHAPPGLYLKTKDPATSPDEPDILEIEFKKGVPVKVTNTKNKTQHSSSLALFCYLNEVAGKHGVGRIDIVENRFIGMKSRGIYETPAGTILYQAHLDIEAFTMDREMRKIKQQLSQRFAEQIYNGFWYSPECEFVRSCISKSQEMVEGKVLVSVLKGQVYVLGREAPHSLYNEELVSMDVQGDYDPADACGFIKINAVRLKEYHRLQKNKK

SEQ ID NO: 25231 - DNA, 1455 bp, Streptomyces avermitilis
  CDS (1)..(1455)
atgtctaaggtcctcacctcccttcccgccggcgagcgcgtcggtatcgccttctcgggcggcctcgacacctcggtcgcggtcgcgtggatgcgcgacaagggcgccgtcccgtgcacctacaccgccgacatcggccagtacgacgagcccgacatcgcctcggtgccgggccgcgcgaagacctacggtgccgagatcgcgcggctggtcgactgccgcgcggcgctggtcgaggagggcctggccgcgctcacctgcggggcgttccacatccgttcgggcgggcgtgcctacttcaacaccacgccgctcggtcgcgccgtcacgggcaccctcttggtccgggcgatgctcgaggacgacgtacagatctggggcgacggctcgaccttcaagggcaatgacatcgagcggttctaccggtacggcctgctcgccaacccgcacctgcggatctacaagccgtggctggacgcggacttcgtgaccgagctcggcggccgcaaggaaatgtcggagtggcttctcgcccacgacctgccctaccgcgacagcacggagaaggcgtactccaccgacgccaacatctggggcgccacccacgaggccaagaccctggagcacctggacaccggcgtggagaccgtggagccgatcatgggcgtgcggttctgggaccccgcggtcgagatcgccaccgaggacgtgacgatcggcttcgaccagggccgcccggtgacgatcaacggcaaggagctcgcctcccctgtcgacctggtcatggaggcgaacgcgatcggcggtcggcacggcatgggcatgtcggaccagatcgagaaccggatcatcgaggccaagagccgcggcatctacgaggcgcccggcatggccctgctgcacgcggcgtacgagcgcctggtcaacgcgatccacaacgaggacacgctcgcccagtaccacaacgagggacggcgcctcggccggctgatgtacgagggccgctggctggacccgcaggcgctgatggtgcgcgagtcgctgcagcgctgggtcggcgcggccgtcaccggcgaggtgacgctgcgactgcggcgcggtgaggactactcgatcctcgacaccacgggcccggcgttcagctaccacccggacaagctgtccatggagcgcaccgaggactcggcgttcggcccggtcgaccggatcggccagctcaccatgcgcaacctggacatcgcggattcacgcgtcaagctggagcagtacgccggcctcggcctgatcggcaccggcagtcccgccatcggtgccgcccaggcggccgcgaccggcctgatcggcaccatgccgcagatgccggagggcagcgccgaggccatcgcctcccgcggcgaggtctccggtgacgacgagatgctggaccgcgccgcgatggagttcggcacggactga

SEQ ID NO: 25232 - protein, 484 aa, Streptomyces avermitilis
MSKVLTSLPAGERVGIAFSGGLDTSVAVAWMRDKGAVPCTYTADIGQYDEPDIASVPGRAKTYGAEIARLVDCRAALVEEGLAALTCGAFHIRSGGRAYFNTTPLGRAVTGTLLVRAMLEDDVQIWGDGSTFKGNDIERFYRYGLLANPHLRIYKPWLDADFVTELGGRKEMSEWLLAHDLPYRDSTEKAYSTDANIWGATHEAKTLEHLDTGVETVEPIMGVRFWDPAVEIATEDVTIGFDQGRPVTINGKELASPVDLVMEANAIGGRHGMGMSDQIENRIIEAKSRGIYEAPGMALLHAAYERLVNAIHNEDTLAQYHNEGRRLGRLMYEGRWLDPQALMVRESLQRWVGAAVTGEVTLRLRRGEDYSILDTTGPAFSYHPDKLSMERTEDSAFGPVDRIGQLTMRNLDIADSRVKLEQYAGLGLIGTGSPAIGAAQAAATGLIGTMPQMPEGSAEAIASRGEVSGDDEMLDRAAMEFGTD

SEQ ID NO: 25233 - DNA, 1209 bp, Bacteroides thetaiotaomicron
  CDS (1)..(1209)
atggaagaaaagaagaaaaaagtagtggtggcattcagcggcggactggacacatcgttcaccgtcatgtacctcgctaaagaaaaaggttacgaagtatatgcagcttgtgccaatacgggcggtttcagcgaagaacagctgaagacaaacgaagaaaacgcctacaaactgggagcagtgaaatatgtaacattggacgttactcaggaatactacgaaaagagtctgaaatatatggttttcggaaatgtgctgcgtaatggtacttacccgatctctgtcagctcggaacgtatcttccaggcattggccatcgcacgttatgccaacgaaatcggtgcggatgccattgcccacggttctaccggagcaggtaacgaccagattcgttttgacatgactttccttgtactggctccgaatgtagaaatcatcacgctgacccgtgatatggcattaagccgtcaggaagaaatcgactatctgaacaaacatggtttcagcgcggacttcaccaaactgaaatactcttataacgtaggtttgtggggtacatccatctgtggtggcgaaatcctcgactccgcacagggattaccggaaacagcctacctgaaacatgtggaaaaagaaggcagcgaacaactccgtctcactttcgaaaagggagaactgaaagctgtcaatgacgaaacattcgatgatccgatccaagctatccagaaggtagaagagatcggtgccgcatacggtatcggacgtgatatgcacgtgggcgatacgattatcggcatcaaaggccgtgtgggtttcgaggctgccgctccgatgttgattatcggtgctcaccgcttcctcgaaaaatacacattgagcaaatggcagcaatactggaaagatcaggtggccaactggtacggaatgttcctccacgaaagccagtatctcgaaccggtgatgcgtgacatcgaagccatgcttcaggaaagccagcgtaacgttaacggtacggcaatcctcgagctccgcccgctttctttctctaccgtcggtgtagaatcggaagacgacctcgtgaaaacgaagttcggcgaatatggtgaaatgcagaagggctggacagccgaagatgctaagggctttattaaggtaacttctactccgctacgtgtttactacaataaccataaagacgaagagatatga

SEQ ID NO: 25234 - protein, 402 aa, Bacteroides thetaiotaomicron
MEEKKKKVVVAFSGGLDTSFTVMYLAKEKGYEVYAACANTGGFSEEQLKTNEENAYKLGAVKYVTLDVTQEYYEKSLKYMVFGNVLRNGTYPISVSSERIFQALAIARYANEIGADAIAHGSTGAGNDQIRFDMTFLVLAPNVEIITLTRDMALSRQEEIDYLNKHGFSADFTKLKYSYNVGLWGTSICGGEILDSAQGLPETAYLKHVEKEGSEQLRLTFEKGELKAVNDETFDDPIQAIQKVEEIGAAYGIGRDMHVGDTIIGIKGRVGFEAAAPMLIIGAHRFLEKYTLSKWQQYWKDQVANWYGMFLHESQYLEPVMRDIEAMLQESQRNVNGTAILELRPLSFSTVGVESEDDLVKTKFGEYGEMQKGWTAEDAKGFIKVTSTPLRVYYNNHKDEEI

SEQ ID NO: 25235 - DNA, 1215 bp, Vibrio vulnificus
  CDS (1)..(1215)
atgaagaaaatcagaagtattgaggatgtacaaaacgtcgcgagccaagccaaacatgtgttgacgctctttagcggcggcttagatagctcttacttgctcgagattcttaaaaacagccgcgcaaaagtcacggcggtggccatcgatcttggcgatgacatcgaagaatccaaactcaagctcatcaccgatcattacggcttcgatttaaacatcctcgatgcaaaacaggaatttgttgaacacagcctcttttctgccatacaagcacaagcgctttacctaggtgactatccggtcagttcctcactctctcgaccaatcattgttaaaaaagcggtcgagctggcacagatcctcagttgtgacgccatcatccacaccgcgaatcagtcgcaaaacagcttacgccgtctcaatggcgcgattgaacgttcaggctaccaagggttctacggttcaccgtatgaatattccgccatcagccgcgaagaaaaagctcagacgctatttcactccggtttggttggctttaaatctcgtaatgtcagtggcgattccaatttatggtgtcgcgagtttgaatccggcatcttggacgatccggaaaacttcaccctcgccgattcgctttttacctggtcgcgttggcaaccagagcaccatcttgaaggcgacagcatcaagatcggtttcaaacaaggttatccggttaccttaaatgacaaaccgataaccctactcgagttaatagcgtttattaacaaccacgttggcgcgtatgagataggtcgttatgtagggttcgaccatctcgatcaagacgaaaaagtgttagaggtgcgcgaagcacccgctgctatgctcttgatgaaggcttataagttgctggaaacggccactttacctaccgatgttctcaaagccaaagcatggcacaacgaaacgtggactcaagaagcggtcgaaggtcgcttcggtagcctgttgcaaaatgccagctatgcgttcatcgctcacactgccgagcatgtctctggcagtgtcctctttaaactttcccgaggtaatgcaatcgccaccagtattgttgcagataatgcacgatacctacgtgatcgcgacaattgggagataaacgtggcgcatgcccgcagtatgcgctcggttcaacttgaaccgacatctgataaacagcatcaagtcgcgtaa

SEQ ID NO: 25236 - protein, 404 aa, Vibrio vulnificus
MKKIRSIEDVQNVASQAKHVLTLFSGGLDSSYLLEILKNSRAKVTAVAIDLGDDIEESKLKLITDHYGFDLNILDAKQEFVEHSLFSAIQAQALYLGDYPVSSSLSRPIIVKKAVELAQILSCDAIIHTANQSQNSLRRLNGAIERSGYQGFYGSPYEYSAISREEKAQTLFHSGLVGFKSRNVSGDSNLWCREFESGILDDPENFTLADSLFTWSRWQPEHHLEGDSIKIGFKQGYPVTLNDKPITLLELIAFINNHVGAYEIGRYVGFDHLDQDEKVLEVREAPAAMLLMKAYKLLETATLPTDVLKAKAWHNETWTQEAVEGRFGSLLQNASYAFIAHTAEHVSGSVLFKLSRGNAIATSIVADNARYLRDRDNWEINVAHARSMRSVQLEPTSDKQHQVA

SEQ ID NO: 25237 - DNA, 1516 bp, Arabidopsis thaliana
  CDS (1)..(1485)
atggctgaaatctcggcgacttcgtttccttcttcttcttcctctgctctcgtcatccgtagctcccacaatggtagcttaaaatgtcagaatgtagctgttccaaaaactacttcccagttccaagagttatctctgaaacgaagccagcttgttggcaatgccgttgttaccggtcatgttaccggatcccgcagctgcaagaatcaagctattcgagctgttctatccggtgatggaaccgccttgactactgattcaaaggaggctggacttcgtggaaaactgaaaaaggtcgttctagcttacagtggaggcttagacacctctgtcattgtgccatggcttaaggagaactatggttgtgaagttgtgtgcttcactgctgatgttggtcagggcataaaagagttagagggtttagaacaaaaggctaaggctagtggtgcttctcagttggtcgttaaggatctcacagaggagtttgtgaaagatttcatcttcccttgtcttagagctggtgccatctatgaacgaaaatacttgcttggtacctccatggctcgacctgtcattgctaaggccatggttgatgtagcagcagaggttggagctgatgccgttgcacatgggtgtactggaaaaggaaatgaccaggttcggtttgagctcaccttcttttcattaaaccctgaacttaaagttgtggcaccatggagagaatgggaaatccaaggccgagaagatgctattgagtatgcaaagaagcataatgttcccgtcccagtgacaaagaagtccatttacagccgggacagaaacctgtggcaccttagtcatgagggtgatctattggaagatccagcaaacgagccaaagaaagatatgtacatgatgagtgtggatcctgaagatgctcctgatcagcctgaatacatcgagatcgggatagaatctggacttccagtggcgctgaacgggaaggctctgagtccagccacacttctggccgagctaaacacaataggaggaaagcacgggattgggcggattgacatggttgagaaccgtctggttgggatgaaatcacgaggtgtgtatgaaactcctggaggcactatcctctttgcagctgtacaggaactagaatccctcactctagacagagagagtattcaggtaaaagacacattagcactgaaatatgcagagatggtctacgcaggaagatggtttgatccgcttagggagtccatggacgctttcatggagaagataaccgagacaaccacgggatctgtgacactgaagctgtacaaaggatctgtgtcggttacagggcgtcagagtcctaacagtctgtatagacaggacatatcttcgtttgaagggagtgagatctacaaccaagcggatgcagccgggtttattcgtctttacgggcttccaatgaaaattagagctatgcttaagaaaattagctagaaatggttttcattcatgtcttacttggaat

SEQ ID NO: 25238 - protein, 494 aa, Arabidopsis thaliana
MAEISATSFPSSSSSALVIRSSHNGSLKCQNVAVPKTTSQFQELSLKRSQLVGNAVVTGHVTGSRSCKNQAIRAVLSGDGTALTTDSKEAGLRGKLKKVVLAYSGGLDTSVIVPWLKENYGCEVVCFTADVGQGIKELEGLEQKAKASGASQLVVKDLTEEFVKDFIFPCLRAGAIYERKYLLGTSMARPVIAKAMVDVAAEVGADAVAHGCTGKGNDQVRFELTFFSLNPELKVVAPWREWEIQGREDAIEYAKKHNVPVPVTKKSIYSRDRNLWHLSHEGDLLEDPANEPKKDMYMMSVDPEDAPDQPEYIEIGIESGLPVALNGKALSPATLLAELNTIGGKHGIGRIDMVENRLVGMKSRGVYETPGGTILFAAVQELESLTLDRESIQVKDTLALKYAEMVYAGRWFDPLRESMDAFMEKITETTTGSVTLKLYKGSVSVTGRQSPNSLYRQDISSFEGSEIYNQADAAGFIRLYGLPMKIRAMLKKIS

SEQ ID NO: 25239 - DNA, 1206 bp, Bacillus cereus
  CDS (1)..(1206)
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacattatacgaagggaaataccctcttgtctctgcattatctcgtccgcttattgcgaagaaattagtagaaatcgcagaacaagaaggcgcaactgcagttgcacacggatgtacagggaaaggaaatgatcaagttcgttttgaagtttctattcaagcattaaatccttacttagaagtgattgcacctgtacgtgaatggaagtggtcacgtgaagaagaaattgcctatgcaaaagaaaacgatgtaccaattccgattaatttagatagcccgttttcaatcgatcaaaacttatggggacgcagcaacgaatgtggaattttagaagatccatgggcagcgccgccagaagatgcatatgagatgacattggcattagaagatacaccgaataaaccagagtttgtagaaatcggatttgaagcaggcgtaccgactactttaaatggcactgcatattcacttgcagaattaattaaaacgttaaatgcgcttgctggaaaacacggcgttggacgtattgatcacgtagaaaatcgtcttgtcggtattaaatctcgtgaagtatacgaatgcccagcagcaatgacgttaatcactgcgcataaagagttggaagatttaacacacgtaaaagaagtagcacattttaaaccagtgattgaacagaaaataacagaacttatttataatggtttatggttctcgcctttaaaacaagcgcttcatgcatttttacaagaaacgcaaaagaatgtaacaggtacagtgcgtgtgaaattatttaaaggtcatgcgattgtagaaggacgtaaatctgaatactctttatacgatgaaaaattagcaacatatactgctcaagatgaatttaatcatgatgcagcagttggattcatttcattattcggtttaccgacgaaagtatacagccaagtgaatcaaaagaaggtggaagcgtga

SEQ ID NO: 25240 - protein, 401 aa, Bacillus cereus
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENDVPIPINLDSPFSIDQNLWGRSNECGILEDPWAAPPEDAYEMTLALEDTPNKPEFVEIGFEAGVPTTLNGTAYSLAELIKTLNALAGKHGVGRIDHVENRLVGIKSREVYECPAAMTLITAHKELEDLTHVKEVAHFKPVIEQKITELIYNGLWFSPLKQALHAFLQETQKNVTGTVRVKLFKGHAIVEGRKSEYSLYDEKLATYTAQDEFNHDAAVGFISLFGLPTKVYSQVNQKKVEA

SEQ ID NO: 25241 - DNA, 1239 bp, Bifidobacterium longum
  CDS (1)..(1239)
atggcagataacaagcgcattgttctggcctactccggcggtcttgacacatccgtcgccatctcgtacctgaaggagcgcaccggcaaggacgtcgtggccgtgtccctcgacgtcggccagggcggcgaaagccttgagaccatcaagcagcgcgccctcgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagttgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggtgccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcccgcgacgtcaagttcggcaacggcatcgaggtcccgaagaacaccgtcgagtaa

SEQ ID NO: 25242 - protein, 412 aa, Bifidobacterium longum
MADNKRIVLAYSGGLDTSVAISYLKERTGKDVVAVSLDVGQGGESLETIKQRALACGAVESYVVDARDEFANEYCMKALKANAMYEGVYPLVSAISRPLISKHLVRAAHQFGADTISHGCTGKGNDQVRFEVSIASIDPTLKAISPIRDLSLTRDVEIAFAKEHKLPITQTEKSPYSIDQNVWGRAIETGFLEDPWNGPTKDCYSYTDDPAFPPVEDEVVIEFKEGVPVKIDGRDVTPLQAIEEMNRRAGAQGVGRIDLIEDRLVGIKSRELYEAPGAVALITAHQELENCCLEREQHRIKRDIDKRWGELVYDAQWFSPATQSLNAFIEDTQKYVSGEIRMVLHGGRAVVTGRRSDSSLYDYKLATYDSGDTFDQKSSNGFIDIYGLPSRVAAARDVKFGNGIEVPKNTVE

SEQ ID NO: 25243 - DNA, 1338 bp, Bordetella bronchiseptica
  CDS (1)..(1338)
atgactactattctcccgaaccttcctaccggccagaaggtcggcatcgccttttccggcggcctcgataccagcgccgcgctgctgtggatgcgccagaaaggcgccgtgccctacgcgtacaccgccaacctgggccagcccgacgagccggactacgatgaaatcccccgccgcgccatgcaatacggcgccgaagccgcccgcctggtcgactgtcgcgcgcaactggtcgccgaagggatcgccgcgctgcaggccggcgccttccatatctcgaccgccggcctgacctacttcaacaccacgcctatcgggcgcgccgtcaccggcaccatgctggtggccgccatgaaggaagacggcgtcaacatctggggcgacggcagcacgttcaagggcaacgacatcgagcgcttctaccgctacggcctgctgaccaacccggacctgaagatctacaagccctggctggaccagaccttcatcgacgagctgggcggccgcgcggaaatgtccgagtacatgcgccaggccggtttcgactacaagatgtcggccgagaaagcctactcgaccgactccaacatgctcggcgccacccacgaggccaaggacctggagctcctgaactccggcatccgtatcgtgcagcccatcatgggcgtggccttctggcaggacagcgtgcagatcaaggccgaggaagtgacggtgcgcttcgaggaaggccagccggtcgccctcaacggcgtcgagtacgccgacccggtcgaactgctgctggaagccaaccgcatcggcggccgccacggcctgggcatgagcgaccagatcgagaaccgcatcatcgaagccaagagccgcggcatctacgaagccccgggcctggcgctgctgttcatcgcctacgagcgcctggtcaccggcatccataacgaagacaccatcgagcagtaccgcgagaacggccgcaagctgggccgcctgctgtaccagggccgctggttcgacccgcaggccatcatgctgcgcgaaaccgcacagcgctgggtcgcgcgcgccatcaccggcgaagtcacgctcgaactgcgccgcggcaacgactactcgctgctgaacaccgaatcggccaacctgacgtacgcgcccgagcggctgtccatggagaaggtggaaaacgcccccttcacgccggccgaccgcatcggccagctcaccatgcgcaacctcgacatcgtcgatacccgcgaaaagctgttcacctacgtcaagaccggcttgctggccccgtcggccggctcggcgctgccgcagatcaaggacggcaagaaatag

SEQ ID NO: 25244 - protein, 445 aa, Bordetella bronchiseptica
MTTILPNLPTGQKVGIAFSGGLDTSAALLWMRQKGAVPYAYTANLGQPDEPDYDEIPRRAMQYGAEAARLVDCRAQLVAEGIAALQAGAFHISTAGLTYFNTTPIGRAVTGTMLVAAMKEDGVNIWGDGSTFKGNDIERFYRYGLLTNPDLKIYKPWLDQTFIDELGGRAEMSEYMRQAGFDYKMSAEKAYSTDSNMLGATHEAKDLELLNSGIRIVQPIMGVAFWQDSVQIKAEEVTVRFEEGQPVALNGVEYADPVELLLEANRIGGRHGLGMSDQIENRIIEAKSRGIYEAPGLALLFIAYERLVTGIHNEDTIEQYRENGRKLGRLLYQGRWFDPQAIMLRETAQRWVARAITGEVTLELRRGNDYSLLNTESANLTYAPERLSMEKVENAPFTPADRIGQLTMRNLDIVDTREKLFTYVKTGLLAPSAGSALPQIKDGKK

SEQ ID NO: 25245 - DNA, 1338 bp, Bradyrhizobium japonicum
  CDS (1)..(1338)
atgaccacgatcctgaaaagcctgcccaagggcgagaaagtcggcatcgcgttttcgggcggcctcgacaccagcgcggcgctgctctggatgaagcagaagggcgcgcgctgctacgcctataccgccaatctcggccagcccgatgaagccgactacaacgagatcccgcgcaaggcgcaggaattcggtgccgagaaggccgtgctggtcgattgccgcacgcagctcgtccacgaaggcatcgccgcgatccagtccggcgccttccacatctcgaccggcggcatcacctatttcaacaccacgccgctcggccgtgccgtcaccggcacgatgctggtcgcggcgatgaaggaggacggcgtcaacatctggggcgacggctcgaccttcaagggcaacgacatcgagcgcttctatcgctacggcctgctcaccaatccgagcctgcgcatctacaagccctggctcgaccagcagttcatcgacgaactcggcggccgcgccgagatgtcggcgttcatgaccgcccagggcttcgcctacaagatgagcgccgagaaggcgtactcgaccgacagcaacctgctcggcgccacgcatgaagccaaggatctcgagagcctcgacagcggcatcaagatcgtcaacccgatcatgggcgtgccgttctggcgcgaggactgcaacgtcaaggccgagaaggtcgtcgtgcgtttcgaagaaggccagcccaccgcgctgaacggccagaccttcaccgatcccgtcgcgctgttcctcgaagccaatgcgatcggcggccgccacggcctcggcatgagcgaccagatcgagaaccgcatcatcgaggccaagagccgcggcatctatgaggcgcccggcatggcgctgttgcacatcgcctatgagcgcctcgtcaccggcatccacaacgaggacaccatcgagcagtaccgcatcagcggcatgcgtctcggccgcctgctctatcagggccgctggttcgattcgcaggccctgatgctgcgcgagaccgcgcagcgctgggtcgcgcgcgccgtcaccggcgaggtgacgctcgagctgcgccgcggcaacgattattcgatcctaaacaccgagagccccaacctcacctatgcgccggagcggctcagcatggagaaggtcgaggatgccgccttcacgccggccgaccgcatcggccagctcaccatgcgcaacctcgacatcgccgacacgcgcaccaagctgaagctctatacggacaccggcctgctttcaggcagcgaaggctcgcagatcttccggctggagaacgacaagggctga

SEQ ID NO: 25246 - protein, 445 aa, Bradyrhizobium japonicum
MTTILKSLPKGEKVGIAFSGGLDTSAALLWMKQKGARCYAYTANLGQPDEADYNEIPRKAQEFGAEKAVLVDCRTQLVHEGIAAIQSGAFHISTGGITYFNTTPLGRAVTGTMLVAAMKEDGVNIWGDGSTFKGNDIERFYRYGLLTNPSLRIYKPWLDQQFIDELGGRAEMSAFMTAQGFAYKMSAEKAYSTDSNLLGATHEAKDLESLDSGIKIVNPIMGVPFWREDCNVKAEKVVVRFEEGQPTALNGQTFTDPVALFLEANAIGGRHGLGMSDQIENRIIEAKSRGIYEAPGMALLHIAYERLVTGIHNEDTIEQYRISGMRLGRLLYQGRWFDSQALMLRETAQRWVARAVTGEVTLELRRGNDYSILNTESPNLTYAPERLSMEKVEDAAFTPADRIGQLTMRNLDIADTRTKLKLYTDTGLLSGSEGSQIFRLENDKG

SEQ ID NO: 25247 - DNA, 1221 bp, Brucella suis
  CDS (1)..(1221)
atgagcaagtggaaagacgttaagaaagtcgttctcgcctattcgggcggcctcgacacctcgatcatcctgaagtggcttcagacggaactgggcgcggaagtcgtgacctttaccgctgatctcggccagggcgaggaacttgaaccggcccgcaagaaagcggaaatgctgggcatcaaggaaatcttcattgaggacgtgcgcgaagaattcgtgcgcgatttcgtcttcccgatgttccgcgccaatgccgtctatgaaggcgtctatctgctcggcacatcgattgcccgcccactgatctccaagcatctgatcgacatcgccaaaaaaaccggcgccgacgccatcgcccatggcgcgaccggcaagggcaacgaccaggttcgcttcgagctttcggcctatgcgctgaacccggacatcaagatcatcgctccatggcgcgactggtcgttcaagagccgcacgcagcttctcgaatttgccgaacagcaccagattccggttgccaaggacaaaaagggcgaagcaccgttctccgtcgatgccaacctgctgcactcctcgtcggagggcaaggttctggaagacccatcgcaggaagcgccggaatatgtgcatatgcgcactatttcgccggaaaccgcgcccgacaaggcaacgatcatcaagatcggctttgaaaagggcgatgccgtttcaatcaatggcgagcgcctgtcgccagcgacccttcttgccaagctcaacgactatggccgcgacaatggcattggccgtctcgacctcgtggaaaaccgcttcgtcggcatgaagtcgcgcggcgtctacgaaacgccgggcggtacgatcctgcttgcagcgcaccgcgccattgaatcgatcacgctcgaccgtggtgcggcgcacctgaaagacgagctgatgccgcgctatgcggaactgatctattatggcttctggttctcgccggaacgcgaaatgctgcaagcggccatcgatcacagccagcaccatgtcgaaggcgaagtcacgctcaagctctacaagggcaatgtgatggtgatcggtcgcgaatcggccaagtcgctctattccgacaagctcgtgacctttgaagacgatcagggcgcctacgaccagaaggatgcggcaggcttcatcaagctcaatgcgctgcgtctgcgcacactggctgcacgcgaccgcaaataa

SEQ ID NO: 25248 - protein, 406 aa, Brucella suis
MSKWKDVKKVVLAYSGGLDTSIILKWLQTELGAEVVTFTADLGQGEELEPARKKAEMLGIKEIFIEDVREEFVRDFVFPMFRANAVYEGVYLLGTSIARPLISKHLIDIAKKTGADAIAHGATGKGNDQVRFELSAYALNPDIKIIAPWRDWSFKSRTQLLEFAEQHQIPVAKDKKGEAPFSVDANLLHSSSEGKVLEDPSQEAPEYVHMRTISPETAPDKATIIKIGFEKGDAVSINGERLSPATLLAKLNDYGRDNGIGRLDLVENRFVGMKSRGVYETPGGTILLAAHRAIESITLDRGAAHLKDELMPRYAELIYYGFWFSPEREMLQAAIDHSQHHVEGEVTLKLYKGNVMVIGRESAKSLYSDKLVTFEDDQGAYDQKDAAGFIKLNALRLRTLAARDRK

SEQ ID NO: 25249 - DNA, 1206 bp, Buchnera aphidicola
  CDS (1)..(1206)
atgaataattttaaaaaagtggtgttagcatattctggtggtttagatacttcagccatcatcccttggttgaaagaaaattatcatgttgatgttgtggcttttgtagctgatataggtcaatcaaaaaaagatttaaatggtattgaaaaaaaagcactgcaatctggtgcaattgattgccgtgtttttgatttaaaagaggaatttataaaagattacgtatatccagttttaaaaacaggttctttatatgaaggaaattatttattaggtacagcaatagctagacctattattgctaaaaaacaagtagaattcgcttcgagtattggagcaaaatttttatgtcatggcgctactgggaagggtaatgatcaagttcgttttgagatagcttatgcagcattagctccttatatgaaagtgattgctccatggcgcgaatggaatcttaattcaagagaatcactgttagaatatttgcgtgaaaaaaatattccaacatcagcgactttagagaaaatttacagcagagatgagaattctttgcatatttctacagaaggaggtttacttgaagatctttggaataaaccgaatgcagattgttggaattggacagtagaactagaagatgctccagaacaaccagaatatatttctttaattgtaaaaaatggatctgttgtatctgttaataatgagtttttaactcctttaaaatgtatagaaaaattaaacaaaattggttctaaacacgctataggaagaattgacattgttgaaaatagactcgttggaattaaatctagaggttgctatgaaactccgggtggtactattatgcacatagcactcagagcaattgagcaattagtatttgatcgagaaagttttaaatggcgagaaaaaattggtttagaaatgtcgtctgtagtttacgatggacgttggtttactcctattcgtaaatctttacaagcttctgcagattctttatcttctgaagttaatggcgaagttgtattaaaattgtataaaggcagtgtaattcctgtacaaaaaaaatcttcgaattctttatattctaaagaatatgcaacttttggtgaagatgaagtttataagcattctgatgctgaaggttttattcgtcttttttctctttcttctagaatacgagctcaaaacaagttaaaataa

SEQ ID NO: 25250 - protein, 401 aa, Buchnera aphidicola
MNNFKKVVLAYSGGLDTSAIIPWLKENYHVDVVAFVADIGQSKKDLNGIEKKALQSGAIDCRVFDLKEEFIKDYVYPVLKTGSLYEGNYLLGTAIARPIIAKKQVEFASSIGAKFLCHGATGKGNDQVRFEIAYAALAPYMKVIAPWREWNLNSRESLLEYLREKNIPTSATLEKIYSRDENSLHISTEGGLLEDLWNKPNADCWNWTVELEDAPEQPEYISLIVKNGSVVSVNNEFLTPLKCIEKLNKIGSKHAIGRIDIVENRLVGIKSRGCYETPGGTIMHIALRAIEQLVFDRESFKWREKIGLEMSSVVYDGRWFTPIRKSLQASADSLSSEVNGEVVLKLYKGSVIPVQKKSSNSLYSKEYATFGEDEVYKHSDAEGFIRLFSLSSRIRAQNKLK

SEQ ID NO: 25251 - DNA, 1230 bp, Buchnera aphidicola
  CDS (1)..(1230)
atgcgaaataaaaacatcaaaaaagttgtactagcttattccggtggattagatacatcagctattattccttggataaaagaaaattactcttcagaagtaatagcgtttgtagcaaatgtaggacaaaatcaagcggatttaaaagacattgaatacaaagctctaaaatctggagcatctcaatgtattattaaagatttaagagaagagtttatacgagattatgtatatcctgttttaaaatctggagcattgtatgaggaaaattatttattaggtactgctttagctcgtcctattattgctaaatcacaagtagatctagctctaaaattaaaagctgatggtgtttgtcatggcgctactggaaaaggtaatgatcaagttcgatttgaaactgcatatgtaggattagctccagaattaaaaattattgcaccatggcgagaatggagttttaaatctcgaggagaattattatcttatctaaaagaaaaaaatgttaaaactactgcttctattgaaaaaatttatagcaaagatgaaaatgcttggcatgtttctactgaaggaggtgttttagaagatttatggaataaaccgaatcaggattgttggacttggactaatgatccaaaagatgctcctaatgttccagaaataatttctattaagataaaaaacggtagcgttattgctgttaataatgaatttttgagtccgtttaagtgtttagaaaaattaaatttagttggaattaaacacggtataggacgtattgatgttgttgaaaatcgtttagtaggtatgaagtcgcgagcgtgttatgaaactccaggtggaactattttagtaaatgcgttacgttcacttgaacagttagtattagatagagatagttataaatggaggcaacaaatagctttagaaatgtcttatgttatttataatggaaattggtttagtccttttcggaaatcattgcaagctgcggctacagagttagcgactgaaatagatggagaagttattttagaattatataaaggtacagtaacagctattaggaagttttctcctaattctttatattctaaggaatttgcaacatttgatcaagacgaggtatatcgtcaatctgatgctgatggatttattaagttatattctttgccttcgaagataagagctataaataagtgtatgaataaggcgttaatgaagtag

SEQ ID NO: 25252 - protein, 409 aa, Buchnera aphidicola
MRNKNIKKVVLAYSGGLDTSAIIPWIKENYSSEVIAFVANVGQNQADLKDIEYKALKSGASQCIIKDLREEFIRDYVYPVLKSGALYEENYLLGTALARPIIAKSQVDLALKLKADGVCHGATGKGNDQVRFETAYVGLAPELKIIAPWREWSFKSRGELLSYLKEKNVKTTASIEKIYSKDENAWHVSTEGGVLEDLWNKPNQDCWTWTNDPKDAPNVPEIISIKIKNGSVIAVNNEFLSPFKCLEKLNLVGIKHGIGRIDVVENRLVGMKSRACYETPGGTILVNALRSLEQLVLDRDSYKWRQQIALEMSYVIYNGNWFSPFRKSLQAAATELATEIDGEVILELYKGTVTAIRKFSPNSLYSKEFATFDQDEVYRQSDADGFIKLYSLPSKIRAINKCMNKALMK

SEQ ID NO: 25253 - DNA, 1338 bp, Burkholderia multivorans
  CDS (1)..(1338)
atgagcacgattctcgaaagcctcccgaccggccagaaggtcggtatcgccttctccggcggcctggacaccagcgccgcgctgcactggatgaaactgaagggcgccgtcccgtacgcgtacacggcaaacctcggccagcccgacgaagacgattacgatgcgatcccgaaacgtgcgctcgaatacggtgcggccggtgcccgcctgatcgactgccgcgcgcaactcgtcgccgaaggcatcgccgcgctgcaaagcggcgcgttccacatcacgaccgccggcgtcacgtacttcaacacgacgccgatcggccgcgccgtgacgggcacgatgctcgtcgccgcgatgaaggaagacggcgtgaacatctggggcgacggcagcacgtacaagggcaacgacatcgagcgcttctaccgctacggtctgctcgtgaacccggatctgaagatctacaagccgtggctcgaccagacgttcatcgacgaactcggcggccgcgcggaaatgtccgaattcatgcgtcagtcgggcttcgcgtacaagatgtcggccgagaaggcgtattcgaccgactcgaacctgctcggcgcgacgcacgaggcgaaggatctggaaagcctcgaaagcgggatcaagatcgtgaacccgatcatgggcgtcgcgttctggcgcgacgacgtgaagatcgccgccgaagaagtgacggtgcgcttcgaagccggccagccggtcgcgctgaacggcgtcgagttcaaggatcaggtcgagttgctgctcgaggcgaaccgcatcggcggccgtcacggcctcgggatgagcgaccagatcgagaaccgcatcatcgaggcgaagagccgcggcatctatgaagcgccggggctcgcgctgctgtatatcgcttacgagcgtctcgtgacgggcatccacaacgaagacacgatcgagcagtaccgcgagaacggtcgccgtctcggtcgcctgctgtatcagggccgctggttcgacccgcaggcgatcatgctgcgcgaaacggcccagcgctgggtcgcgcgcgcgatcaccggcgaagtgaagatcgagctgcgccgcggcaacgactattcgattctcagcacgaagtcgccgaacctcacgtatcagccggagcgtctgtcgatggagaaggtcgcgtcgacgttctcgccgcgcgaccggatcggtcagctgacgatgcgcaatctcgacatcaccgatacgcgcgacaagctgcgcgtgtacacgcaggtcgggctgctgacgccgggtgaagcgtcggcgctgccgcaaatcaagggcgatagcggggagtaa

SEQ ID NO: 25254 - protein, 445 aa, Burkholderia multivorans
MSTILESLPTGQKVGIAFSGGLDTSAALHWMKLKGAVPYAYTANLGQPDEDDYDAIPKRALEYGAAGARLIDCRAQLVAEGIAALQSGAFHITTAGVTYFNTTPIGRAVTGTMLVAAMKEDGVNIWGDGSTYKGNDIERFYRYGLLVNPDLKIYKPWLDQTFIDELGGRAEMSEFMRQSGFAYKMSAEKAYSTDSNLLGATHEAKDLESLESGIKIVNPIMGVAFWRDDVKIAAEEVTVRFEAGQPVALNGVEFKDQVELLLEANRIGGRHGLGMSDQIENRIIEAKSRGIYEAPGLALLYIAYERLVTGIHNEDTIEQYRENGRRLGRLLYQGRWFDPQAIMLRETAQRWVARAITGEVKIELRRGNDYSILSTKSPNLTYQPERLSMEKVASTFSPRDRIGQLTMRNLDITDTRDKLRVYTQVGLLTPGEASALPQIKGDSGE

SEQ ID NO: 25255 - DNA, 1206 bp, Chlorobium tepidum
  CDS (1)..(1206)
atgagcaaggaaaaaattgcggtcgcctactccggcggccttgacacgtcagtcatgatcaaatggctgaaggacaagtatgaaggggcggaaatcgttgccgtcacgggcaacctcggccagaagatggaggtcgacaacctcgaacagaaagccatagccaccggcgcaaagtcgttccacttcgtcgatctgcgcaaaaccttcgtcgaagagtacatctggaaagcactaaaagctggcgcgttgtacgaggatgtgtacccactggccactgcgctcggacgcccgctgctcgccaaggcgctcgtcgatgtggcgctcgccgaagggtgcaccatgctcacccacggctgcaccggtaagggcaacgaccaggtgcgcttcgaggtcgccttcgccgcgctcgccccgcatatgaaggtggtcgccccgctgcgcgagtgggagttcacctcacgcgagcaggagatcgcctacgcgatggagcacaacatcccggtttcggcgaccaagaaaaatccctactcgatcgacgagaacatctggggcatcagcatcgagtgcggcgtgctcgaagatccgatggtcgctcccccggctgacgcctaccagatcactacggctcccgaacttgcacccgacgagccgaccgttgtcgatatcgagtttgcccagggggtgcccgtggcgctcgacggccagcagatggagggtctcgacctcatcgtcagactcaacgaactcggcgcgatgaacggcgtcggcaggctcgacatgatcgagaaccgtgtcgtcggcatcaagtctcgcgaaatctacgaagccccggcagccaccatcctgcacttcgcccaccgcgagctcgaacgcctcacgctcgaaaagtcggtcttccagtacaagcgcaatatcggccaggactacgccaacctcatctacaacggcacctggttctcgccaatgcgcaaagcgctcgacgcctttgtggacgagacgcagaagccggtcaccggcatggtcagaatcaagctctacaaaggctcgatgaccctgctcggccgcacctcgcccaactcgctctacaacgaagcgctggccacctataccgaagccgataccttcgaccacaaatctgccgaaggtttcatcaaaatctacggattgggcctgaagactttccacgaggtaaacaagagcgagtga

SEQ ID NO: 25256 - protein, 401 aa, Chlorobium tepidum
MSKEKIAVAYSGGLDTSVMIKWLKDKYEGAEIVAVTGNLGQKMEVDNLEQKAIATGAKSFHFVDLRKTFVEEYIWKALKAGALYEDVYPLATALGRPLLAKALVDVALAEGCTMLTHGCTGKGNDQVRFEVAFAALAPHMKVVAPLREWEFTSREQEIAYAMEHNIPVSATKKNPYSIDENIWGISIECGVLEDPMVAPPADAYQITTAPELAPDEPTVVDIEFAQGVPVALDGQQMEGLDLIVRLNELGAMNGVGRLDMIENRVVGIKSREIYEAPAATILHFAHRELERLTLEKSVFQYKRNIGQDYANLIYNGTWFSPMRKALDAFVDETQKPVTGMVRIKLYKGSMTLLGRTSPNSLYNEALATYTEADTFDHKSAEGFIKIYGLGLKTFHEVNKSE

SEQ ID NO: 25257 - DNA, 1227 bp, Chromobacterium violaceum
  CDS (1)..(1227)
atgtctgacatcaagaaagtggttttggcgtattccggcggtctggatacctcggtgatcctgaagtggctgcaagacgagtatcaatgcgaagtggtgaccttcaccgccgacatcggccagggcgaggaagtggagccggcgcggcagaaagcggtttcgctgggcatcaagccggaaaacatcttcatcgaggacctgcgcgaggagttcgtccgcgatttcgtctacccgatgttccgcgccaacactatttacgaaggcgaatacctgctgggcacctcgatcgcccggccgctgatcgccaagcgtcagatcgagatcgccaaccaggttggcgccgacgcggtatcgcacggcgccaccggcaagggcaacgaccaggtgcgcttcgagctcggttattacgcgctgaagccggatgtgaaagtgatcgcgccgtggcgcgagtgggacctgctgtcgcgcgagaagctgctggcctacgccgaaacccacggcatcgacatcagcaagaagaagaacggcggcagtccgtactcgatggacgccaatctgctgcacatttcctacgaaggcacggtgctggaagatccggcccaggagccggaagaggatatgtggctgtggagcgtgagtccggagaacgcgccggaccaggccgagtacgtggagctggaataccgcaagggcgacatcgtcgccgtcaacggccaagcgctgagcccggccggcgtgctgaccgagctgaaccgcctgggcaacaagcacggcatcggccgcttggacatcgtcgagaaccgctacgtgggcatgaagtcgcgcggctgctatgaaaccccgggcggcaccatcatgctgaaggcgcaccgcgcgatcgagtccatcacgctggaccgcgaagtggcccacctgaaggacgagctgatgccgaaatacgcgcagctgatctacaccggttactggtggagcccggagcgcgcgatgctgcagcagatgatagacgcgtcgcaggccacggtgaacggctgggtgcggctgaagctgtacaagggcaatgtgatcgtcgtcggccgcgaatccaagaccgattcgctgttcgacccgaccatcgccaccttcgacgaggacggcggcgcctacaaccatgccgacgcggccggcttcatccgcctgaacgcgctgcggatgcgcatcgctgccaatgcgcggaacaagcgcggctga

SEQ ID NO: 25258 - protein, 408 aa, Chromobacterium violaceum
MSDIKKVVLAYSGGLDTSVILKWLQDEYQCEVVTFTADIGQGEEVEPARQKAVSLGIKPENIFIEDLREEFVRDFVYPMFRANTIYEGEYLLGTSIARPLIAKRQIEIANQVGADAVSHGATGKGNDQVRFELGYYALKPDVKVIAPWREWDLLSREKLLAYAETHGIDISKKKNGGSPYSMDANLLHISYEGTVLEDPAQEPEEDMWLWSVSPENAPDQAEYVELEYRKGDIVAVNGQALSPAGVLTELNRLGNKHGIGRLDIVENRYVGMKSRGCYETPGGTIMLKAHRAIESITLDREVAHLKDELMPKYAQLIYTGYWWSPERAMLQQMIDASQATVNGWVRLKLYKGNVIVVGRESKTDSLFDPTIATFDEDGGAYNHADAAGFIRLNALRMRIAANARNKRG

SEQ ID NO: 25259 - DNA, 1218 bp, Clostridium perfringens
  CDS (1)..(1218)
atgtatatgaaaaaatttaataaagtaattttagcctattcaggaggattagatacttcaataataatcccttggttaaaagaaaattatggatgtgaagttattgcagtggtaggaaatgttggacaatctgatgaattagttggattaaaagaaaaagctataaaaactggggcgtctaaaatatatattgaggatctaactaaagaatttgtagaagattacatctttcctaccatacaagctggggcaaaatatgaaggaaagtatctactaggcacttcttttgctagacctataatagcaaaaagattagtagaaattgcaaaacttgaaggtgcagatgctatttgtcatggatgtactggaaaaggaaatgaccaagttcgttttgaattagcaattaaaacttttaatccagaaatgcaaattattgctccatggagaacttgggaaattaaatctagagaagaagaaatacaatatgctatagacaatgaagttcctataaatattacttatgaaacaaattatagtaaagataaaaatctatggcatttaagccatgaaggtttagatttagagtttcctgaaaatgaacctaaatatgataaaattcttgaattatgtaataccttagaaaaggctcctaatgaagctgaatatattactttaggttttgaaaaaggaattgcaacctcattaaatggtgaaaaactagatggagtcactcttttacaagaacttaataaaattggtggaaaacatggtattggagttatagatatggttgaaaatagattggttggtatgaaatcaagaggagtatatgaaactccaggaggatctattttatataaagctcataaagatttagaagaattatgtttagataaggaaacttcccattataaagaaatagtttccttaaaattcgctgatttagtttataatggtcaatggtttaccccattgagagaagccttatctgcctttatatcaaaaactcaagaaactgtaactggcgaaataaaattaaaactatataaaggaaatataataaatgctggaatgacatctccatattctttatacagcgaagaatatgctacctttggtgaagatggaatatataatcaaaaggacgctgaaggctttattaatctttttagcttaccatctatagtacaagctaaaatggctcaaaagttaaattaa

SEQ ID NO: 25260 - protein, 405 aa, Clostridium perfringens
MYMKKFNKVILAYSGGLDTSIIIPWLKENYGCEVIAVVGNVGQSDELVGLKEKAIKTGASKIYIEDLTKEFVEDYIFPTIQAGAKYEGKYLLGTSFARPIIAKRLVEIAKLEGADAICHGCTGKGNDQVRFELAIKTFNPEMQIIAPWRTWEIKSREEEIQYAIDNEVPINITYETNYSKDKNLWHLSHEGLDLEFPENEPKYDKILELCNTLEKAPNEAEYITLGFEKGIATSLNGEKLDGVTLLQELNKIGGKHGIGVIDMVENRLVGMKSRGVYETPGGSILYKAHKDLEELCLDKETSHYKEIVSLKFADLVYNGQWFTPLREALSAFISKTQETVTGEIKLKLYKGNIINAGMTSPYSLYSEEYATFGEDGIYNQKDAEGFINLFSLPSIVQAKMAQKLN

SEQ ID NO: 25261 - DNA, 1197 bp, Clostridium tetani
  CDS (1)..(1197)
atgacaaaggaaaaagtagtattagcatattcagggggcttagacacttctataatcataccttggttaaaagagaattatgatttagatgttattgcagtatgtatagatgtaggacaagatgatgatatggaagaagttaagaaaaaagccattaaaactggggcagttaaggtttatgtagaggatgcaaaggaagaattcgtaaaggattatgtttttaaagctttaaaggcaaatgctctttatgaagaaaagtatatgttggggacatctcttgcaagaccgttaatggctaaaaaacttgtggaaattgctcataaagaaggagcaaaatatatatgtcatggatgtacaggtaagggaaatgatcaggtaagatttgaagttggaatagcatcttttgatccaagtatcaaaataatagcaccttggagaatttgggatataaaatctagagaagatgctatagattatgcgaaggaaaaaggcgttgaagtacctgtaactaaaaagaaaatatactcagtagataaaaatatattgcatacaagtcatgaaggtggagaattagaagatcctaaaaatgcacataataaagaaatgtatagtatggttacaccaccagaaaaagctaaagatgagcctacttatgtggacatatattttaataagggtgtacctgaaaaaattaatggaaaagaaatatctcctgttgaacttttaaatactttaaataaaattggtggagaaaatggagtaggtgtagtagatatagtagaaaatagattggttggtatgaaatcaagaggagtttatgaaacaccggggggaactattctatatgaagctcataaagatttagagagccttactttagacaaattaactctccattgtaagcaagaattagctcaaaaatatggtgaaatagcttatgatggtttatggtttactactttaagagaatcattagatgcctttgtggatgtaacacaagaaaatgtaacaggaacagttaagttaaaactatacaaagggaatataatgaatgctggaatagatactaaaaacgctctttatgatgaaggaatatcttcctttggagcaagtgaattatatagtcataaagatgcagaaggatttattaaattattttcccttcctagtaaaataaaagctttaaagaataaataa

SEQ ID NO: 25262 - protein, 398 aa, Clostridium tetani
MTKEKVVLAYSGGLDTSIIIPWLKENYDLDVIAVCIDVGQDDDMEEVKKKAIKTGAVKVYVEDAKEEFVKDYVFKALKANALYEEKYMLGTSLARPLMAKKLVEIAHKEGAKYICHGCTGKGNDQVRFEVGIASFDPSIKIIAPWRIWDIKSREDAIDYAKEKGVEVPVTKKKIYSVDKNILHTSHEGGELEDPKNAHNKEMYSMVTPPEKAKDEPTYVDIYFNKGVPEKINGKEISPVELLNTLNKIGGENGVGVVDIVENRLVGMKSRGVYETPGGTILYEAHKDLESLTLDKLTLHCKQELAQKYGEIAYDGLWFTTLRESLDAFVDVTQENVTGTVKLKLYKGNIMNAGIDTKNALYDEGISSFGASELYSHKDAEGFIKLFSLPSKIKALKNK

SEQ ID NO: 25263 - DNA, 1200 bp, Corynebacterium diphtheriae
  CDS (1)..(1200)
atgaccaatcgtgtcgtcctcgcctattcaggtggactcgatacctccgttgcaattccatacctggctaagatgactggtggcgaagttgtcgcagtttctttggatcttggccaaggcggagaggacatggagtccgttcgtcagcgtgcacttgattgtggtgcggttgaatctattgtcattgacgctaaagatgagtttgccaatgattactgcctgccgactatcaaagcaaacggcatgtacatgaagcagtaccctttggtttctgcaatctctcgtccactcatcgtgaagcacttggtagaagccgctaaaaaacatggtggtacccatgtttcccatggttgtactggtaaaggaaacgatcaggttcgatttgaggtaggtttccgcaaccttgctccagaactgcagatcattgccccagcccgtgattacgcatggactcgcgataaggcgattgcttttgctgaagagattaatctacctatcgagcaatccaagaagtcgccattctccatcgatcaaaatgtttggggacgtgccgtagagaccggtttcctcgaggatctctggaacccgccgacaaaagatctatactcctacactgaagatccagctctcggaaatgctcctgatgagatcatcattagcttcaaagctggtgttccggtagcaatcgatggacgtccagtcaccgtacttgaagcaattgaagaaatgaaccgtcgtgcaggtgcacaaggcattggccgtctggacatggtggaagatcgtctcgttggtattaaatctcgcgaggtctacgaagctccaggcgcaattgcactgattacagcacaccaagctatggaagatgtgaccattgagcgtgagcttgcacgttacaagcgcggaatcgacgctcgttggtctgaagaggtgtacgacggattgtggtacgcgccactcaagcgttctttggatgcgttcattgaaaatactcaagagcacgtaacaggtgacattcgcatggtcatgcatgctggtaagtgcaccgtaaacggacgtcgttctgagcattcgctttacgacttcgacttggctacttatgacaccggtgataccttcgaccagaccttggctaagggctttgtggaacttcacggtttgtcatccaagatctcgaacaagcgtgaccgtgaggcacaatag

SEQ ID NO: 25264 - protein, 399 aa, Corynebacterium diphtheriae
MTNRVVLAYSGGLDTSVAIPYLAKMTGGEVVAVSLDLGQGGEDMESVRQRALDCGAVESIVIDAKDEFANDYCLPTIKANGMYMKQYPLVSAISRPLIVKHLVEAAKKHGGTHVSHGCTGKGNDQVRFEVGFRNLAPELQIIAPARDYAWTRDKAIAFAEEINLPIEQSKKSPFSIDQNVWGRAVETGFLEDLWNPPTKDLYSYTEDPALGNAPDEIIISFKAGVPVAIDGRPVTVLEAIEEMNRRAGAQGIGRLDMVEDRLVGIKSREVYEAPGAIALITAHQAMEDVTIERELARYKRGIDARWSEEVYDGLWYAPLKRSLDAFIENTQEHVTGDIRMVMHAGKCTVNGRRSEHSLYDFDLATYDTGDTFDQTLAKGFVELHGLSSKISNKRDREAQ

SEQ ID NO: 25265 - DNA, 1206 bp, Corynebacterium efficiens
  CDS (1)..(1206)
atgaccaatcgtgtcgtactcgcgtactccggtggcctggacacctctgtcgccatcccgtacctgtccaagatgaccggcggcgaggtcgtcgccgtctccctcgacctcggtcagggcggcgaggacatggagtccgtccgccagcgtgcgctcgactgcggtgcggtcgaatccatcgtcatcgacgccaaggatgagttcgccgaggagtactgcctgcccaccatcaaggccaacggcatgtacatgaagcagtacccgctggtgtccgcgatctcccgtccgctgatcgtcaagcacctggtgcaggccgccaaggagcacggtggcacccacgtctcccacggctgcaccggcaagggcaatgaccaggtccgcttcgaggtcggtttcatggacctcgaccccagcctggagatcatcgccccggcacgtgactacgcatggacccgcgacaaggccatcgagttcgccgaggagaacaacgttccgatcgagcagtccgcagcctccccgttctccatcgaccagaacgtctggggccgtgccatcgaaaccggtttcctcgaggacctgtggaacccgccgaccaaggacctctacgcctacaccgaggatcccgccctgggcaacgcccccgatgaggtcatcatcaccttcaagtccggcaagcctgtcgccatcgacggccgtccggtcaccatgctcgaggccatcgaggagctcaaccgccgtggtggtgcacagggtgtcggtcgtctcgacatggtcgaggaccgcctcgtgggcatcaagtcccgcgagatctacgaggcaccgggtgccatcatcctcatcaccgcccacgaggccatggaggacgtcaccatcgagcgtgagctggcccgctacaagcgcggtatcgacgcccgctggtccgaggaggtctacgacggtctctggttcggcccgctgaagcgctccctggatgccttcatcgagtccacccaggagcacgtcaccggtgatatccgcctggtgctgcacgccggcaaggtcaccgtcaacggccgtcgttccggttcctccctctacgacttcaacctggccacctacgacaccggcgacaccttcgaccagaccgcagccaagggcttcgtccagctgcacggcctgtcctccaagatcgccaataagcgcgaccgcgaggccggcgagaactag

SEQ ID NO: 25266 - protein, 401 aa, Corynebacterium efficiens
MTNRVVLAYSGGLDTSVAIPYLSKMTGGEVVAVSLDLGQGGEDMESVRQRALDCGAVESIVIDAKDEFAEEYCLPTIKANGMYMKQYPLVSAISRPLIVKHLVQAAKEHGGTHVSHGCTGKGNDQVRFEVGFMDLDPSLEIIAPARDYAWTRDKAIEFAEENNVPIEQSAASPFSIDQNVWGRAIETGFLEDLWNPPTKDLYAYTEDPALGNAPDEVIITFKSGKPVAIDGRPVTMLEAIEELNRRGGAQGVGRLDMVEDRLVGIKSREIYEAPGAIILITAHEAMEDVTIERELARYKRGIDARWSEEVYDGLWFGPLKRSLDAFIESTQEHVTGDIRLVLHAGKVTVNGRRSGSSLYDFNLATYDTGDTFDQTAAKGFVQLHGLSSKIANKRDREAGEN

SEQ ID NO: 25267 - DNA, 1206 bp, Corynebacterium glutamicum
  CDS (1)..(1206)
atgactaaccgcatcgttcttgcatactccggcggtctggacaccactgtggcaattccatacctgaagaagatgattgatggtgaagtcatcgcagtttccctcgacctgggccagggtggagagaacatggacaacgttcgccagcgtgcattggatgccggtgcagctgagtccatcgttgttgatgcaaaggatgagttcgctgaggagtactgcctgccaaccatcaaggcaaacggcatgtacatgaagcagtacccactggtttctgcaatctcccgcccactgatcgtcaagcacctcgttgaggctggcaagcagttcaacggtacccacgttgcacacggctgcactggtaagggcaacgaccaggttcgtttcgaggtcggcttcatggacaccgatccaaacctggagatcattgcacctgctcgtgacttcgcatggacccgcgacaaggctatcgccttcgccgaggagaacaacgttccaatcgagcagtccgtgaagtccccattctccatcgaccagaacgtctggggccgcgctattgagaccggttacctggaagatctgtggaatgctccaaccaaggacatctacgcatacaccgaggatccagctctgggtaacgctccagatgaggtcatcatctccttcgagggtggcaagccagtctccatcgatggccgtccagtctccgtactgcaggctattgaagagctgaaccgtcgtgcaggcgcacagggcgttggccgccttgacatggttgaggaccgtctcgtgggcatcaagtcccgcgaaatctacgaagcaccaggcgcaatcgcactgattaaggctcacgaggctttggaagatgtcaccatcgagcgcgaactggctcgctacaagcgcggcgttgacgcacgttgggctgaggaagtatacgacggcctgtggttcggacctctgaagcgctccctggacgcgttcattgattccacccaggagcacgtcaccggcgatatccgcatggttctgcacgcaggttccatcaccatcaatggtcgtcgttccagccactccctgtacgacttcaacctggctacctacgacaccggcgacaccttcgaccagaccctggctaagggctttgtccagctgcacggtctgtcctccaagatcgctaacaagcgcgatcgcgaagctggcaacaactag

SEQ ID NO: 25268 - protein, 401 aa, Corynebacterium glutamicum
MTNRIVLAYSGGLDTTVAIPYLKKMIDGEVIAVSLDLGQGGENMDNVRQRALDAGAAESIVVDAKDEFAEEYCLPTIKANGMYMKQYPLVSAISRPLIVKHLVEAGKQFNGTHVAHGCTGKGNDQVRFEVGFMDTDPNLEIIAPARDFAWTRDKAIAFAEENNVPIEQSVKSPFSIDQNVWGRAIETGYLEDLWNAPTKDIYAYTEDPALGNAPDEVIISFEGGKPVSIDGRPVSVLQAIEELNRRAGAQGVGRLDMVEDRLVGIKSREIYEAPGAIALIKAHEALEDVTIERELARYKRGVDARWAEEVYDGLWFGPLKRSLDAFIDSTQEHVTGDIRMVLHAGSITINGRRSSHSLYDFNLATYDTGDTFDQTLAKGFVQLHGLSSKIANKRDREAGNN

SEQ ID NO: 25269 - DNA, 1191 bp, Desulfovibrio vulgaris
  CDS (1)..(1191)
atgtccggtatcaagaaggtcgttctcgcctactctggcggtctcgatacgtccgtcatcctgaagtggctcgccgtcacctataactgcgaagtggtgaccctcaccgccgacctcggtcaggaagaggacctcgacggcgtggacgacaaggccatgcgcacgggagcctcccgcgcctacgtcgaagacctgcaggaagagttcgcccgcgacttcatcttccccatgatgcgcgccggggcggtctatgaaggccgctacctgctgggcacctccatcgcgcgcccgctcatcgccaagcgccttgtcgagatcgctcgcgccgaaggcgcgcaggccgtggcccacggcgccaccggcaagggcaacgaccaggtgcgcttcgaactggcagtgaacgccctcgcacccgacctgcgcgtcatcgcgccgtggcgagaatgggacctgcgctcgcgcacgcagctcaacgccttcgccgaagagcacggcatccccatctccagttcggccaagcagtacagcatggaccgcaacatgctccactgcagcttcgagggcggcgaacttgaagacccgtggaacgaacccggccccaacagctacgtcatggccgttcccatggaacaggcccccgacgaggccgagtacatcagcatcgacttcgaacacggcaaccccgtggccgtgaacggcgaacgcctctcgcccgccgcgctggtcaagaagctcaacagcatcggcggacgtcacggcatcggccgtctcgacatggtcgagaaccgcttcgtgggcatcaagtcgcgcggcgtgtacgagacccccggcggtacgctcatccacatcgcccaccgagacctcgaaggcatctgcatcgaccgcgagaccatgcacctgcgcgacgccatgctgccccgctacgccgcagccatctacaacggcttctggttcgcccccgaacgcgaggccatgcaggcgatgatcgacgtctcgcagcagcgcgtcaccggcaccgtgcgcctgaagctgtacaagggcaatgcgtggcccgtgggtcgccagtcgcccaacaccctctactgccacgacctcgccaccttcgaagactgcgccacctacgaccacaaggacgcggcaggcttcatcaaactgcagggtctgcgcatccgcggttacaagaagggatag

SEQ ID NO: 25270 - protein, 396 aa, Desulfovibrio vulgaris
MSGIKKVVLAYSGGLDTSVILKWLAVTYNCEVVTLTADLGQEEDLDGVDDKAMRTGASRAYVEDLQEEFARDFIFPMMRAGAVYEGRYLLGTSIARPLIAKRLVEIARAEGAQAVAHGATGKGNDQVRFELAVNALAPDLRVIAPWREWDLRSRTQLNAFAEEHGIPISSSAKQYSMDRNMLHCSFEGGELEDPWNEPGPNSYVMAVPMEQAPDEAEYISIDFEHGNPVAVNGERLSPAALVKKLNSIGGRHGIGRLDMVENRFVGIKSRGVYETPGGTLIHIAHRDLEGICIDRETMHLRDAMLPRYAAAIYNGFWFAPEREAMQAMIDVSQQRVTGTVRLKLYKGNAWPVGRQSPNTLYCHDLATFEDCATYDHKDAAGFIKLQGLRIRGYKKG

SEQ ID NO: 25271 - DNA, 1274 bp, Drosophila melanogaster
  CDS (15)..(1274)
ggcatccgagaaatatgcctaaggaaaccgtaattttggcttactccggtggcctggacactagttgcgtcctcaagtggttgctggacaagcagtatgaggtcatttgcgtcctggccgatgtaggccagaaggaagatttcaccgccgccgagaagaaggctcttaagattggcgcaaaaaaggttatcgtggccgatgtcaagcagtccttcgtcgaggactatatctggccggccgtacaaatgggtctggtgtacgaggagcgctatctactgggcacttctctggccaggccctgcatcagtgtagccctgatggaggtcgcccgcgagtatggagccaagtatctggcccacggagccaccggaaagggaaacgaccaggtgcgcttcgagttgtgcgcctacgccctgaaaccggatctgaagatcatcgctccctggagggatgtagaattctgctgccagtttcaaggtcgacaggacctcattgcctatgcccagcaacacggaatcgaggtaagcgccaagccagccacaccctggagcaccgatgccaacatcctgcacatcagctacgagtccggaatactcgaagatcccaacacagtggctccggaaaatctctacgagatgacagtcgatcccctgacaagggctccacgggatccggttcacttggtcattcaatttgatcggggactgccctccagtgtggaggatttgcccggcggtcgggtctacactaaacccctggagatgctagatttcctcaataagcttggcggatcatatggcattgggcggattgacatcgtggaaaatcgctttgtgggactgaagtcccggggggtgtacgagacgcctggaggcaccatcctctttgctgcccaccaggacctcgaggtgtttgctttggaccgcgaagtactccgcaccaagcaggttctccgggatcgcatggccgactacgtgtacaatggcttctggttcagtcccgaggcaatttatgcccgtaaatgtatcgagttggccgagcagcgggtctccgggaaggtcaccgtggaactggccccaggctattgccgtgccatcgcccgaaaggcggcgaaggatgtgggagctctttacaacgaacagctcgtatctatggacgtccatggtggctatgtgccgcaggatgccggtggatttatcgccatcaatgcggtccgaatcagggaacatgtccgagcgttcggtgcctacgatgtgccaacgaagaaaaactga

SEQ ID NO: 25272 - protein, 419 aa, Drosophila melanogaster
MPKETVILAYSGGLDTSCVLKWLLDKQYEVICVLADVGQKEDFTAAEKKALKIGAKKVIVADVKQSFVEDYIWPAVQMGLVYEERYLLGTSLARPCISVALMEVAREYGAKYLAHGATGKGNDQVRFELCAYALKPDLKIIAPWRDVEFCCQFQGRQDLIAYAQQHGIEVSAKPATPWSTDANILHISYESGILEDPNTVAPENLYEMTVDPLTRAPRDPVHLVIQFDRGLPSSVEDLPGGRVYTKPLEMLDFLNKLGGSYGIGRIDIVENRFVGLKSRGVYETPGGTILFAAHQDLEVFALDREVLRTKQVLRDRMADYVYNGFWFSPEAIYARKCIELAEQRVSGKVTVELAPGYCRAIARKAAKDVGALYNEQLVSMDVHGGYVPQDAGGFIAINAVRIREHVRAFGAYDVPTKKN

SEQ ID NO: 25273 - DNA, 1221 bp, Geobacter sulfurreducens
  CDS (1)..(1221)
atggccaaagcgcacaaagacgtcaagaagatcgtccttgcctattcgggcggactcgacacatccatcatcctcaagtggctcaagaacgagtacggctgcgaggtcatcgccttctccgccgatctgggccaaggcgacgaactggcgccgatccgcgacaaggccatcgcaaccggcgccgacaaggtctacatcgacgacctgaaggaagaattcgtcaaggacttcgtattccccatgttccgcgccaacgccatttacgaggggcactacctcctgggcacctccatcgcccgccccctcatcgccaagcgtcagatggagatcgcgaagatcgagggtgccgacgccgtttcccacggcgccaccggcaaggggaacgaccaggtccgcttcgagctggcctactaccactttgacccggccatcaccgtggttgccccctggcgcgagtggaagctcaacagccgccaggccctggtgaactacgccaggaagaacgggatcccgatcccggtcaccaagaagcgtccctggtcctcggaccgcaacctcctccacatctccttcgagggcggcatcctggaggatacctgggccgagccccccgagaacatgtacgtgctgaccaaggcgccggaaaaggcccccaacaagccccagttcgtggagatcgaattcaaaaacggcaatgccgtggccgttgacggcgagaagatgagcccggcccagctcctggctcacctgaactacatcggcggcgagcacggtatcggccgggtcgatctcctggagaaccgctccgtgggcatgaagtcccggggcgtgtacgagacccccggcggcaccatcctgcgcgaggcccactcggcggtggagcagatcaccatggaccgcgaggtcatgcggatccgcgactccctcatccccgagtacgcccgccaggtctatgccggctactggttctcgccggagcgggagatgctccagaccctgatcgacgattcccagaagtgcgtgaacggcgtggcccgggtgaaactctacaaggggcactgccgtaccgtggggcgcaagtccgagaccaactctctcttcaacctggacttcgccaccttcgaaaaggatcaggtcttcaaccaggccgacgccaccggcttcatcaagatcaactccctgcggctgcggatcaggtcgctcatgcaggggaagaagtag

SEQ ID NO: 25274 - protein, 406 aa, Geobacter sulfurreducens
MAKAHKDVKKIVLAYSGGLDTSIILKWLKNEYGCEVIAFSADLGQGDELAPIRDKAIATGADKVYIDDLKEEFVKDFVFPMFRANAIYEGHYLLGTSIARPLIAKRQMEIAKIEGADAVSHGATGKGNDQVRFELAYYHFDPAITVVAPWREWKLNSRQALVNYARKNGIPIPVTKKRPWSSDRNLLHISFEGGILEDTWAEPPENMYVLTKAPEKAPNKPQFVEIEFKNGNAVAVDGEKMSPAQLLAHLNYIGGEHGIGRVDLLENRSVGMKSRGVYETPGGTILREAHSAVEQITMDREVMRIRDSLIPEYARQVYAGYWFSPEREMLQTLIDDSQKCVNGVARVKLYKGHCRTVGRKSETNSLFNLDFATFEKDQVFNQADATGFIKINSLRLRIRSLMQGKK

SEQ ID NO: 25275 - DNA, 1197 bp, Gloeobacter violaceus
  CDS (1)..(1197)
atgcgggcgaagaaagtcgtactggcctactcgggcggcgtggacaccagcgtgtgcattccttatctaaagcacgaatggggtgtggagcaggtggtggccctggcggccgatctgggccagggtgaagatctcgaagccgtccgccagaaggccctcgcctccggcgccgaccaggcaatcgtccaggatgcccgcgaagattttgtctacgactacgcctttgcggccctgcaggccaacgccctctacgaggggcgctacccgctcgccaccgccctcgcccggccactcatcgcccggatcctcgtcaagtgcgcccaggcggtaggggccgacgccgtcgcccacggctgcacgggcaagggcaacgaccaggtgcgcttcgacgtgtctatcggcgcgctcgacccgaaactgaaagtgctcgcccccgcccgcgagtggggcatgtcccgcgaggagacgatcgcctatggcgagcgctacggcatccccgccccggtcaagaaaaaatcgccctactcgatcgacttcaacctgctgggccgctccgtcgagtgcggcgtcctcgaagatccctgggcggaaccgcccgaggaggtctacgcgatgaccaaatgcgtggcggacacccccgaccagcccacctacatcgaactggagttcgagcgcggcgtgccggtggctttgaatggagcgtccttgggcggggtgaagctggtgggcgaactcaaccgcctggccggggagaacggcgtcgggcgcatcgacatggtcgaaaatcgcctggtcgggattaaatcgcgcgaaatttacgaatgcccggccggggtggtgctggtcctggcgcaccaggccctcgaagcgctcaccctgccccgggaggtgaccgcctacaagcgcggtgtcgaggacacctacgcccaactggtctacaacggtctgtggtacagtccgctgcgcggcgccctcgacgggttcatcgacttcacccagcaacgggcgagcggtgtggtgcgcgtgcgcctgcacaaaggaaccgccaccgtcgtgggccgcaaaagtccctattcgctctacgacgtggagctggccacctactccgaaggggacagcttcgatcacaaagccgccgagggctttatttatgtctggggcctgcccacgcgcatttatgcgcaggtgcgcaaataa

SEQ ID NO: 25276 - protein, 398 aa, Gloeobacter violaceus
MRAKKVVLAYSGGVDTSVCIPYLKHEWGVEQVVALAADLGQGEDLEAVRQKALASGADQAIVQDAREDFVYDYAFAALQANALYEGRYPLATALARPLIARILVKCAQAVGADAVAHGCTGKGNDQVRFDVSIGALDPKLKVLAPAREWGMSREETIAYGERYGIPAPVKKKSPYSIDFNLLGRSVECGVLEDPWAEPPEEVYAMTKCVADTPDQPTYIELEFERGVPVALNGASLGGVKLVGELNRLAGENGVGRIDMVENRLVGIKSREIYECPAGVVLVLAHQALEALTLPREVTAYKRGVEDTYAQLVYNGLWYSPLRGALDGFIDFTQQRASGVVRVRLHKGTATVVGRKSPYSLYDVELATYSEGDSFDHKAAEGFIYVWGLPTRIYAQVRK

SEQ ID NO: 25277 - DNA, 1215 bp, Helicobacter hepaticus
  CDS (1)..(1215)
atggcagcgattaaaaaggttgttttggcatatagtggcggacttgatacgagtgtgattttaaaatggctcggagataattatcattgtgaggtggtaacctttacagctgatattggacagggtgaagaggttgagcctgcacgagaaaaggctttaaagcttggtataaaaagtgaaaatatttttattgaagatttaagagaggagtttatcaaagattttgtctttcctatgtttcgtgcaaatacaatttatgagggagaatatttgcttggcacaagcattgcacgccctcttattgcaaaaagacttgttgagattgctaaaagtgttggggctgatgccatagcacacggagcgacaggaaagggaaatgaccaagtgcgatttgagctcggagcctacgcgcttaatccagatattaaagtcattgcgccttggcgtgaatgggatttgaatagtcgtgaaaaactcttagcctatgcagaatctgcagggattgctattgaaaaaaagcaaaataaatcgccttattcaatggacgcaaacttattgcatattagctatgagggacagattctagaagacccaaatgtagaaccagaagaggatatgtggcgatggagtgtttcaccacttaatgcgccagataagccagaatctattagcattgagtttcaaaatggcgatggcgtggcgataaatggagaaaagctaagtcctgcgaatttttgggtaaatctcaatgagctaggcggaaagcacggcattgggcggcttgatttggtagaaaatcgctatgtgggtatgaaatctcgtgggtgttatgaaacacccggaggcacaatatatttaaaagctcatcgtgcgatagaatctttgtgtcttgatagggaagaggcacatttaaaagattctataatgccaaagtatgcagagctcatttataatggctattggtttagcccagagcgcgaggcattacaagcacttattgataagacacagcaaaaagtaagtggagtagtgcgccttaagctctataaagggaatgtcattgttatagggcgagaatctaaaaattctttatttaatgcagcatatagcacttttgaggaagattctgtatataatcaaaaagatgccgcagggtttattaaacttaatgctttacgctttatcatcgcaggaaaggcaaatagggacaaataa

SEQ ID NO: 25278 - protein, 404 aa, Helicobacter hepaticus
MAAIKKVVLAYSGGLDTSVILKWLGDNYHCEVVTFTADIGQGEEVEPAREKALKLGIKSENIFIEDLREEFIKDFVFPMFRANTIYEGEYLLGTSIARPLIAKRLVEIAKSVGADAIAHGATGKGNDQVRFELGAYALNPDIKVIAPWREWDLNSREKLLAYAESAGIAIEKKQNKSPYSMDANLLHISYEGQILEDPNVEPEEDMWRWSVSPLNAPDKPESISIEFQNGDGVAINGEKLSPANFWVNLNELGGKHGIGRLDLVENRYVGMKSRGCYETPGGTIYLKAHRAIESLCLDREEAHLKDSIMPKYAELIYNGYWFSPEREALQALIDKTQQKVSGVVRLKLYKGNVIVIGRESKNSLFNAAYSTFEEDSVYNQKDAAGFIKLNALRFIIAGKANRDK

SEQ ID NO: 25279 - DNA, 1236 bp, Lactobacillus plantarum
  CDS (1)..(1236)
atggtcaaacaaaatgataaaattattctcgcttattctggtggtttagatacgtcggtcgcaattagttggttgaaggataagggctatgatgttgtggcctgcggaattgatgttggtgaaggcaaggacatggatgcaatcaaagaaaaggccctaaaattaggggctgtttcatcatatatgattgatgctaagcaagaatttgctgaagaatatgcgttaattgctttacaaggtcataccttgtatgaaggtgaatacccgctggtctcagcactttcacgtcctttaattgctaagaagttagtcacattagccaagcaagagcacgctgttgcaattgcccatggttgtactgggaagggtaatgatcaggttcggtttgaggttgctatccatgctcttgcaccggatatcaagatcgaagcgcctgtacgtgattggcactggtcacgggaagaagaaatcgattacgctaaggaacacaatattcccgtaccaatcaatttggacagcccttactcgattgacgaaaacttatggggccgggccaatgaatgtggcattctagaagatccatggcagggcgcgcctgccgatgcgtttgaccggacgaaggccttagctgatacgccggatacgccaacgactttggaaatcacttttgaagctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagttcgggtacaactcttcaagggtaacgttattactgaggggcggaagtcacccaactcactatatgatacgaacttggcaacctatacatcagcggattcatttgaccaacaagcggcagttggtttcattaagctatggggcctaccaacgcaagttaatgcccaagtccaagcgaaggctcaggccgaagctaagactgataaggcacacgcctaa

SEQ ID NO: 25280 - protein, 411 aa, Lactobacillus plantarum
MVKQNDKIILAYSGGLDTSVAISWLKDKGYDVVACGIDVGEGKDMDAIKEKALKLGAVSSYMIDAKQEFAEEYALIALQGHTLYEGEYPLVSALSRPLIAKKLVTLAKQEHAVAIAHGCTGKGNDQVRFEVAIHALAPDIKIEAPVRDWHWSREEEIDYAKEHNIPVPINLDSPYSIDENLWGRANECGILEDPWQGAPADAFDRTKALADTPDTPTTLEITFEAGVPVALDGESLNLADLIIKLDQIAGEHGIGRIDHIENRLVGIKSREVYEAPAATVLLKAHKDLEDLTFERELAHFKPIIEQKLADTIYNGLWFSPLMEAMVAFLKQTQQVVNGVVRVQLFKGNVITEGRKSPNSLYDTNLATYTSADSFDQQAAVGFIKLWGLPTQVNAQVQAKAQAEAKTDKAHA

SEQ ID NO: 25281 - DNA, 1212 bp, Leptospira interrogans
  CDS (1)..(1212)
atggcgcaaaacaaacctgttaagaaaatcgttctcgcttattccggtggattggatacgtccgtaattcttacctggttgaaagatacatacggttgcgaagtaatcgcttttactgcggatataggtcaaaaggaagaactttccggactagaagaaaaaggaattaaaacaggagcttctaaggtttatatccaagatttgcgtttagagtttgctagagattttattttcccagccattcaaggaaatgcaatttatgaaatgaggtatcttcttggaacctctttggctcggcctttaattgccaaggcaatggtagaagtggccgaaaaagaaggtgcagacgcatttgcacacggggccactggcaaaggaaatgaccaagttcgctttgaattaggagtcaaatccttagctcctgaaaaaacaatcatcgctccttggagaatctggagttttggcggtagatcagatctaattgaatacgcaaaatccaaaggaattccagttccagtaactgcggaaaaaccgtattcgatggaccgcaatctaatgcatatatcttatgaaggtggaatattagaagatccttataaagaaccagatgagaaaatgtttttattaacaacctctcccgaaaaagctcccgatgctcctgaatatttggaactcgatttcgaagaaggaaattgtgtagcaatcaacggtaagaaaatgaatcctcttgaaatcatggaaacgctcaatacgattgcgggcaaacatggagtgggaagagttgacatcgttgaaaaccgactcgtaggaatcaaatctagaggagtttacgaaactcccggcgggactatattatttttagctcatagagacttagaatcgattacgatcgatcgagacacacaacatcataaagataaactttccatcgaatttgcagaactcatttataacggacattggttttcttccagaatgaaagcagttcgagcttttattacagaaacacaaagatatgttagtggaaccgtaagaataaaactttacaaaggggtttgttctgttgtaggaagaaaatcccaagtatctctttacaacccagaaatggcgactttcgaaaaagaagaattatacaatcagaaagacgccgaaggttttataaacatctacggcttacccgctcaagaaacggcaaggcttcgcaaaaaatga

SEQ ID NO: 25282 - protein, 403 aa, Leptospira interrogans
MAQNKPVKKIVLAYSGGLDTSVILTWLKDTYGCEVIAFTADIGQKEELSGLEEKGIKTGASKVYIQDLRLEFARDFIFPAIQGNAIYEMRYLLGTSLARPLIAKAMVEVAEKEGADAFAHGATGKGNDQVRFELGVKSLAPEKTIIAPWRIWSFGGRSDLIEYAKSKGIPVPVTAEKPYSMDRNLMHISYEGGILEDPYKEPDEKMFLLTTSPEKAPDAPEYLELDFEEGNCVAINGKKMNPLEIMETLNTIAGKHGVGRVDIVENRLVGIKSRGVYETPGGTILFLAHRDLESITIDRDTQHHKDKLSIEFAELIYNGHWFSSRMKAVRAFITETQRYVSGTVRIKLYKGVCSVVGRKSQVSLYNPEMATFEKEELYNQKDAEGFINIYGLPAQETARLRKK

SEQ ID NO: 25283 - DNA, 1185 bp, Methanopyrus kandleri
  CDS (1)..(1185)
atgtcgcgggtggttctcgcgtattcaggaggcttggatacctcggtttgcatcgagctcctgcgggagcggtacgggtacgacgaggtgatcacggtgaccgcggacgtgggtcagccggaggaggagctgcgggaggcggaggagaaggcacggaagctcgcggatgagcacttcacggtcgactgtgtggacgagttcgtgtgtgagtactgctggcgagccgtgaaggcgaacgcgacgtacgaggggtaccctctgagcacggcgctggcccgaccgctgatcgcgcagaaggtcctggaagtggcgcgtgatgtggacgcggacgcggtcgcacacgggtgcacggggaagggcaacgaccagttccggttcgagtcgtatttgcgggcgcacggcggtgaggagttcgagatcgtggctccggttcgggacctgaacctcacgcgcgacgaggagatcgcgtacgccgaggagcggggtatccccgtcccggtggacgtcgacagtccctacagcgtggacgagaacctatggggtcgatcgatcgagggcggcgtcctggaggacccctccgaggaaccgccggaggaggtcttcgagtggaccgtcagtcccgcggaggccccggacgagcccgaggtcgtggagatcgagttcgaggacggcgtgcccgtggaggtggacgggcgggacgacccggtcgagatcgtccggtacctgaacgagaccgcgggcgagcacggcgtgggtcgcatcgatatcatcgaggaccgggtgatcgggctgaagtcacgcgaggtgtacgaggcaccggcggcggtgacgctgctcgaggcgcaccgggcgctggaggcgttcaccctgacacgccgggagctgtcgctgaaggcctcgctggaggaggagtgggcgcgactcgtctacgacgggctgtggttcaaccccctgcgcgagcacctggaggccttcttcgactcgacgcagcggcacgtggaggggaccgtgcgcgtgaagctgttcaagggctccgcgaccgtgatctcacgggagtccccgcgagcgctctacgaggaggagttgatatcgtacgaagaaaagcagttcgatcagcggacggccgaaggagccgtgaagcttcacggactccaggaacggttggctttaaggcgtcgtgggtga

SEQ ID NO: 25284 - protein, 394 aa, Methanopyrus kandleri
MSRVVLAYSGGLDTSVCIELLRERYGYDEVITVTADVGQPEEELREAEEKARKLADEHFTVDCVDEFVCEYCWRAVKANATYEGYPLSTALARPLIAQKVLEVARDVDADAVAHGCTGKGNDQFRFESYLRAHGGEEFEIVAPVRDLNLTRDEEIAYAEERGIPVPVDVDSPYSVDENLWGRSIEGGVLEDPSEEPPEEVFEWTVSPAEAPDEPEVVEIEFEDGVPVEVDGRDDPVEIVRYLNETAGEHGVGRIDIIEDRVIGLKSREVYEAPAAVTLLEAHRALEAFTLTRRELSLKASLEEEWARLVYDGLWFNPLREHLEAFFDSTQRHVEGTVRVKLFKGSATVISRESPRALYEEELISYEEKQFDQRTAEGAVKLHGLQERLALRRRG

SEQ ID NO: 25285 - DNA, 1185 bp, Methanosarcina mazei
  CDS (1)..(1185)
atggtaaaaaaagttgcacttgcatattccggtgggcttgacacctctgtgtgtatccccatcctcaaagaaaagtacggttacgatgaagtaattacaatttcggttgacgtcggccagcccgaagaagaaatcaggaaggctgatgcgaaagcccagaagatcagcaacaagcactacacgatcgatgcaaaggaagagttcgtaagggactacatcttccccctgataaaagccaacggaaactacgaaggctatgtcatgggcacgtccgtagcccgccccctgattgccaaaaaagtagtcgaagcagccaaaaaagaaggcgcaattgcccttgcccacggctgcaccggaaaaggaaacgaccagctccgctttgaagccgtcttccgccagaccgatatggacgttatcgccccaatgcgtgagatgaacctgacccgcgagtgggaaatcaattacgcaaaggagcacggcatccctgtcgaagccacaaagtccaagccctggagcgttgacgaaaatatctggagccgcagcatcgaaggcggcaggcttgaagatccctcttttgtcccgccggaagagatcttcgagtggacaaaatccgcagaagatgccccgaacgagcccaggattgttgacatcgactttgaagccggtgtccctgttgcaattgacggcgaaaaacttggcggctatgcccttgtcaagaagatgaacgaaattgcaggcgagaacggcgtcggcaggaccgatatgatcgaagaccgcgtgctcggcttaaaagcccgtgagaactacgagcacccggctgcaaccgtcctcctcgcagcccacgccgacctcgagaaactcgtcctgacccgcggggaactgaagttcaagaaaatcgttgaagagcagtggtccgaaatggcatacgcaggccttgtggacgaccctctatttgccgacctcaacgcttttatcgacaagtcgcaggaaagggttacaggtacagtgaaagtgaagctctacaaaggcgcacttactatccttgcccgcagttcgccaaatgccctgtattccgaagacctggtctcgtttgacagccagaccattgaccagaaggatgcagaaggatttgcgaagtatcacgggttccaggcgaggatgtacaggaaagtcgtgggaaaataa

SEQ ID NO: 25286 - protein, 394 aa, Methanosarcina mazei
MVKKVALAYSGGLDTSVCIPILKEKYGYDEVITISVDVGQPEEEIRKADAKAQKISNKHYTIDAKEEFVRDYIFPLIKANGNYEGYVMGTSVARPLIAKKVVEAAKKEGAIALAHGCTGKGNDQLRFEAVFRQTDMDVIAPMREMNLTREWEINYAKEHGIPVEATKSKPWSVDENIWSRSIEGGRLEDPSFVPPEEIFEWTKSAEDAPNEPRIVDIDFEAGVPVAIDGEKLGGYALVKKMNEIAGENGVGRTDMIEDRVLGLKARENYEHPAATVLLAAHADLEKLVLTRGELKFKKIVEEQWSEMAYAGLVDDPLFADLNAFIDKSQERVTGTVKVKLYKGALTILARSSPNALYSEDLVSFDSQTIDQKDAEGFAKYHGFQARMYRKVVGK

SEQ ID NO: 25287 - DNA, 1194 bp, Methanococcus maripaludis
  CDS (1)..(1194)
atgcaagaaaaaattgcagttttggcatattctggagggcttgacacgagctgctgtttaaaattactcgaagacaaatacgactacaaggtaatttcagtagctgtagatgtaggccagcctgaagacgatttaaaagaaccagaagaaaaagcaaaaaaattcggtgtattaaaacactatactatcgatgcaaaggaagaattcgcaaaagattacatatttagggctattaaagcaaatgcgctttacgaaggatacccattatcaaccgctcttgcaagacctttaattgctataaaaattgcagaacttgcacaagaagttggagcaagcgcaatttcacacggatgtactggaaaaggaaacgaccagttcagatttgaatctgtaatgagagcaaaaacacctgaaattgaaattgtagcgccaatcagagatttaaaccttacaagaactgaagaaatagcatatgcaaaagaaaaaggaattccagttccagtagacttagaaaaaccattcagtatcgatgaaaatttatggggaagaagtattgagggcggaattttagaagacccaatgactgaaactccaaaagaatgttttgcatggactgttgacccaacagatgcacaggacaaagaagaatacgtagaaattgacttcgaagaaggggttcctgtagcaatcaacggggatgcattggaagcagtttcattaataagaaaagtaaacgaaattgcaggaagaaatggcgttggaagagtagatattgtagaagatagagttttaggcttaaaatcaagagaaaactatgaatgccctggtgcaatgcttttaataactgcacacaaagctctcgaacagctcgttttaaccagagaagaactcgtattcaaagaaatggttgattcaaaatacgcagatttagtatacaaaggactctggcacgaaccattaagactcgatttagatgcgttcattgataaaacgcaaacaagaatgaacggaaaagtagttttaaaactctacaaaggttcaatgagaatcgctggaagagaaagtaaagatgcaatctacaacgaagaaatggtttcatttgaaaacaaagaaatggaccagagagaaattgtcggaatggttaaattccacggtctccaagcagcaatctatgaaggattaacaagaaaataa

SEQ ID NO: 25288 - protein, 397 aa, Methanococcus maripaludis
MQEKIAVLAYSGGLDTSCCLKLLEDKYDYKVISVAVDVGQPEDDLKEPEEKAKKFGVLKHYTIDAKEEFAKDYIFRAIKANALYEGYPLSTALARPLIAIKIAELAQEVGASAISHGCTGKGNDQFRFESVMRAKTPEIEIVAPIRDLNLTRTEEIAYAKEKGIPVPVDLEKPFSIDENLWGRSIEGGILEDPMTETPKECFAWTVDPTDAQDKEEYVEIDFEEGVPVAINGDALEAVSLIRKVNEIAGRNGVGRVDIVEDRVLGLKSRENYECPGAMLLITAHKALEQLVLTREELVFKEMVDSKYADLVYKGLWHEPLRLDLDAFIDKTQTRMNGKVVLKLYKGSMRIAGRESKDAIYNEEMVSFENKEMDQREIVGMVKFHGLQAAIYEGLTRK

SEQ ID NO: 25289 - DNA, 1215 bp, Moritella abyssi
  CDS (1)..(1215)
atgacacaaacagttaagaaagtagtagtagcgtattctggtggtttagatacttcagtgattttaccttggttacaagagaactatgacaattgtgagattgtcgcgttgtttgttgccgatgtaggtcagggcgctgaagaacttgaaggcattgaagcgaaagcattagcttcaggtgcatctgagtgttacgtggttgatctaaaagatgaactcgtagaaaactatatctaccctacgcttaaaaccggtgctgtctatgaaggtacgtatcttttaggtacgtcaatggcacgtcaatccattgccaaagcacaagttgaaattgcccgcaaagtcggcgctgatgcactttgtcatggttgtaccggtaaaggtaatgatcaaattcgttttgaatcatgctttgcagcactagcaccagagctaacggttattgcaccttggcgtatttgggacttaaccagccgtgaatcactgcttgaatacttagctgaacgtgatattccaaccgccgcatctggcactaagatttatagccgtgatgccaatgcttggcacatctctcatgaaggtggcgagttagaagacccatggaaccaaccttctaagcaagtttggaccatgacggttgatccaattgacgcaccgaatgaacctgaatttttgactatatctgttgttaaaggtgagatcactgcggtgaacggtgaggaaatgtaccttataatacgctatacgtatcttaatgaaaaagcagctgcacatggtgttggccgtgttgatatcgttgaaaaccgtttagtcggtatgaaatcacgtggttgttatgaaacaccgggtggtacggttatggttgaagcattacgtggtatcgaagagttagtattagataaaatcacacgtaaatggaagcatactgttgccgctgaattctcacatcttgtctatgatggtcgttggttcacaccgctatgtgcttcattacttgctgctgcaggtacattagcagaagaaatgaacggtgaagtgatcgttaaaatgtataaaggctcagtacaggcagtacagaagcaatcaccaaacagcctttatagtgaagagtttgccacatttggtgatgataatgtgtatgatgaccaaagccatgcggaaggtttcatccgcttatattcgttgtctagtcgtattaaagctttagctagcaagtaa

SEQ ID NO: 25290 - protein, 404 aa, Moritella abyssi
MTQTVKKVVVAYSGGLDTSVILPWLQENYDNCEIVALFVADVGQGAEELEGIEAKALASGASECYVVDLKDELVENYIYPTLKTGAVYEGTYLLGTSMARQSIAKAQVEIARKVGADALCHGCTGKGNDQIRFESCFAALAPELTVIAPWRIWDLTSRESLLEYLAERDIPTAASGTKIYSRDANAWHISHEGGELEDPWNQPSKQVWTMTVDPIDAPNEPEFLTISVVKGEITAVNGEEMYLIIRYTYLNEKAAAHGVGRVDIVENRLVGMKSRGCYETPGGTVMVEALRGIEELVLDKITRKWKHTVAAEFSHLVYDGRWFTPLCASLLAAAGTLAEEMNGEVIVKMYKGSVQAVQKQSPNSLYSEEFATFGDDNVYDDQSHAEGFIRLYSLSSRIKALASK

SEQ ID NO: 25291 - DNA, 1215 bp, Moritella profunda
  CDS (1)..(1215)
atgaaaatgacacaaacagttaagaaagtagtagtagcgtattctggtggtttagatacttcagtgatcttaccttggttacaagagaactatgacaattgtgagattgtcgcgtttgttgccgatgtcggtcagggcgctgaagaacttgaaggcattgaagcgaaagcattggcttcaggtgcatctgagtgttacgtggttgatctaaaagatgagctcgtagaaaactatatttatccaacgcttaaaaccggtgctgtctatgaaggtacgtaccttttaggtacgtcaatggcacgtccaatcattgccaaagcacaagttgaaattgcccgtaaagtcggcgctgatgcactttgtcatggttgtaccggtaaaggtaatgatcaaattcgttttgaatcatgctttgcagcccttgctccagagctaacggttattgcaccttggcgtatttgggacttaaccagccgtgaatcactgcttgaatacttagctgaacgtgacattccaaccgccgcatctgcgactaagatttatagccgtgatgccaatgcttggcacatttctcatgaaggcggcgagttagaagacccatggaaccaaccttctaagcaagtttggaccatgacggttgatccaattgatgcaccgaatgaacctgaatttttgactatatctgttgttaaaggtgagatcactgcggttaacggcgaagcaatgtcgccttataatacgcttatgtatctaaatgaaaaagccgctgcccatggtgttggtcgtgttgatatcgtggaaaaccgtttggtaggtatgaaatcacgtggttgttatgaaacaccaggtggtacggtaatggttgaagcgttacgtggtatcgaagaattagtattagataaaaccacacgtaaatggaaacaaactgttgccgctgaattctctcatcttgtttatgatggccgttggttcacgccactatgtgcatcattacttgctgctgcaggtacattagcagaagagatgaacggcgaagttatcgttaagatgtacaaaggttcagtacaagcaatacagaagaaatcgccaaacagcctttatagtgaagagtttgccacatttggtgatgataatgtttatgaccaaagccatgcggaaggtttcatccgcttatattcgttgtctagccgtattaaagctttagctagcaagtag

SEQ ID NO: 25292 - protein, 404 aa, Moritella profunda
MKMTQTVKKVVVAYSGGLDTSVILPWLQENYDNCEIVAFVADVGQGAEELEGIEAKALASGASECYVVDLKDELVENYIYPTLKTGAVYEGTYLLGTSMARPIIAKAQVEIARKVGADALCHGCTGKGNDQIRFESCFAALAPELTVIAPWRIWDLTSRESLLEYLAERDIPTAASATKIYSRDANAWHISHEGGELEDPWNQPSKQVWTMTVDPIDAPNEPEFLTISVVKGEITAVNGEAMSPYNTLMYLNEKAAAHGVGRVDIVENRLVGMKSRGCYETPGGTVMVEALRGIEELVLDKTTRKWKQTVAAEFSHLVYDGRWFTPLCASLLAAAGTLAEEMNGEVIVKMYKGSVQAIQKKSPNSLYSEEFATFGDDNVYDQSHAEGFIRLYSLSSRIKALASK

SEQ ID NO: 25293 - DNA, 1197 bp, Mycobacterium paratuberculosis
  CDS (1)..(1197)
atgtcagaacgcgtcatcctggcgtattccggcggtctggacacctcggtggccatcagctggatcggcaaggagaccggccgtgaggtcgtagcggtggcgatcgacctcggccagggcggcgaagacatggaggtcatccgccagcgcgccctggactgcggcgcggtggaggccgtcgttgtggacgcccgcgacgaattcgccgagggctattgcctgcccaccatccgcaacaacgccctctacatggaccgctacccgctggtgtcggcgatcagccggccgctgatcgtcaagcacctggtggccgcggcccgcgagcacggcggcagcaccgtcgcgcacggctgcaccggcaagggcaacgaccaggtccgcttcgaggtcggattcgcttcgctggcaccggatctcgaggtgctggccccggtgcgcgattacgcgtggacgcgggagaaggcgatcgcgttcgccgaggagaacgccatcccgatcaacgtgaccaaacgctcgccgttctccatcgaccagaacgtgtggggtcgcgcggtggaaaccggtttcctggaacacctttggaacgcgcccaccaaggacgtctacgcctacaccgaggaccccacgctgaactggagcacccccgacgaggtgatcgtcgggttcgagcgcggggttccggtgtccatcgacggcaagccggtgtcggtgctgggcgccatcgaggaactcaacgcccgcgccggcgccaagggggtagggcgcctggacgtcgtggaggaccggctggtgggcatcaagagccgcgagatctacgaggcgcccggcgccatggtgctcatcaccgcgcacaccgagctcgagcacgtcaccctggagcgggagctgggccggttcaagcggcacaccgatcagcgctgggccgagctggtgtacgacgggttgtggtattcgccgctgaaggctgcgctggaaagcttcgtcgacaagacccaggagcacgtcaccggcgagatccgaatggtgttgcacggcggccacattgcggtcaacggccggcgcagcgccgaatcgctctacgacttcaacctggccacctacgacgagggcgacagcttcgaccagtcggcggcgaagggtttcgtctacgtgcacgggctgtcgtcgaagatcgcctcccgccgggaccagcggtga

SEQ ID NO: 25294 - protein, 398 aa, Mycobacterium paratuberculosis
MSERVILAYSGGLDTSVAISWIGKETGREVVAVAIDLGQGGEDMEVIRQRALDCGAVEAVVVDARDEFAEGYCLPTIRNNALYMDRYPLVSAISRPLIVKHLVAAAREHGGSTVAHGCTGKGNDQVRFEVGFASLAPDLEVLAPVRDYAWTREKAIAFAEENAIPINVTKRSPFSIDQNVWGRAVETGFLEHLWNAPTKDVYAYTEDPTLNWSTPDEVIVGFERGVPVSIDGKPVSVLGAIEELNARAGAKGVGRLDVVEDRLVGIKSREIYEAPGAMVLITAHTELEHVTLERELGRFKRHTDQRWAELVYDGLWYSPLKAALESFVDKTQEHVTGEIRMVLHGGHIAVNGRRSAESLYDFNLATYDEGDSFDQSAAKGFVYVHGLSSKIASRRDQR

SEQ ID NO: 25295 - DNA, 1215 bp, Nitrosomonas europaea
  CDS (1)..(1215)
atggataaagtcaagaaagcagtactggcattttcaggggggctggatacctcagtcattttgaaatggctgcaggatacctatcagtgtgaggtggttacttttacggcggatatcggccagggcgaggagattgagccggcacgtgccaaagccgtacagtttggcatcagggaaatcttcatcgaggatctgcgcgaagagttcgtgcgtgactatgtttttcccatgttccgtgccaatacgatttatgaaggggaatatctgctcgggaccagtattgcccggccgctgattgccaaacgtcaggttgaaattgcgcagcagaccggcgcggatgcggtttctcacggtgctaccgggaagggaaatgaccaggtacgttttgagcttggttactatgcgttgcagccggatattcgggtaattgctccctggcgcgagtgggatctgacttcgcgtgaaaaactgctgacttatgccgagaagcagggtatcccgatcgaaatgaagcagaaggcaggatcgccctacagcatggacgccaatctgctccatatttcttatgaggggcgtgcgctggaagatccggctgcggagccggaggagagtatgtggcgctggacagtctcgcctgaaactgctccgagtgagcctgaatatctggatctggaatatgaacgcggtgatattgttgcattgaacggtgaaaggttgtctcccgcagccattctgaccaggcttaaccagttgggtggaaaacatggtatcggccgtctcgatctggtggaaaaccgttatgtcgggatgaaatcacgcggctgttatgaaacgcctggtggcacgatcatgttgcgtgcccatcgtgcaatcgaatccattacgcttgaccgcgaagttgcgcatttgaaagatgatctgatgccgcgttatgcagcgctgatttataacggttactggtggagtccggaaagaaaactgttgcaggtgctcatcgatgaatcccaggtgaatgtgaatggccgggtcagagtcaaattgtataagggtaatgtgatggttgtcgggcgtgattcccggaccgactcgttatttgaccccgacattgcgacatttgaagaagatggtggggcttatcatcaggctgatgcagcaggtttcatcaagctcaatgcgctgagaatgcggattgcaaaagctctccgcaggtgctga

SEQ ID NO: 25296 - protein, 404 aa, Nitrosomonas europaea
MDKVKKAVLAFSGGLDTSVILKWLQDTYQCEVVTFTADIGQGEEIEPARAKAVQFGIREIFIEDLREEFVRDYVFPMFRANTIYEGEYLLGTSIARPLIAKRQVEIAQQTGADAVSHGATGKGNDQVRFELGYYALQPDIRVIAPWREWDLTSREKLLTYAEKQGIPIEMKQKAGSPYSMDANLLHISYEGRALEDPAAEPEESMWRWTVSPETAPSEPEYLDLEYERGDIVALNGERLSPAAILTRLNQLGGKHGIGRLDLVENRYVGMKSRGCYETPGGTIMLRAHRAIESITLDREVAHLKDDLMPRYAALIYNGYWWSPERKLLQVLIDESQVNVNGRVRVKLYKGNVMVVGRDSRTDSLFDPDIATFEEDGGAYHQADAAGFIKLNALRMRIAKALRRC

SEQ ID NO: 25297 - DNA, 1254 bp, Oceanobacillus iheyensis
  CDS (1)..(1254)
atgacaaaagaaaagattgtattagcctattctggaggattagacacctctgttgcagttaaatggttacaggataaatataattatgatgtgattgcagttgcattagacgttggagaaggtaaggatttagattttgtgaagaagaaagcattggatgtaggagctatcaaatcctatgttattgatgcgaaaaacttgtttgcggaagaatatgtcttaccagcattacaagcaaatctattatatgaaggaaagtaccctttaatttcagctttatctagaccccttatttctaagattttagtagatattgcagaggaagaaggagcggtagctgttgcacatggctgcactggaaaaggaaatgatcaagtgcgctttgatgtatcatttactgcactaaaccctaaccttaagattgtagcgccggttcgtgaatgggcaatgtcaagagaagaagaaattgagtatgcgaagtcacatgggattccaattccaattaacttggatagtccttacagtattgatcaaaatctatggggcagaagcaatgaatgtgggattttagaagatccatgggcagaggcacctaaagacgcttatgatctaactatagatccagtagatgcacctgaagatccagaagttatccaaattacatttaaaaaaggaaagccagtctctattgatggtaaagaaatgcctctagatgaactaattctacaattaaatacgattgctggtaaacatggtgttggcagaattgatcatgtagaaaatcgtttggtaggaattaaatcaagagagatttatgaagcaccagcagcaacgacgttaattgctgcacatcaggaattagaagcattaacattaccaagagaagtagcggaattcaagccgacaattgagcagaagctagcacaaacggtttattatggattatggtattcacctttaacagaagcactacaatcttttattgagaaaacacaggaacatgtatctggaacagtaaaagtgaagttatataaaggtcatgcacaagtaattggaagagagtctgaaaactccctttatgattttgacttggcgacatacaacaaagcagatgcatttgatcatgatgctgcattaggatttattaaactttggggactacctacgcaggttcactccgctgtaaatggaccacaaggtaaaaaatcaattgaaaaagtagacttggaagtaaaggaagctgtgaaaccatga

SEQ ID NO: 25298 - protein, 417 aa, Oceanobacillus iheyensis
MTKEKIVLAYSGGLDTSVAVKWLQDKYNYDVIAVALDVGEGKDLDFVKKKALDVGAIKSYVIDAKNLFAEEYVLPALQANLLYEGKYPLISALSRPLISKILVDIAEEEGAVAVAHGCTGKGNDQVRFDVSFTALNPNLKIVAPVREWAMSREEEIEYAKSHGIPIPINLDSPYSIDQNLWGRSNECGILEDPWAEAPKDAYDLTIDPVDAPEDPEVIQITFKKGKPVSIDGKEMPLDELILQLNTIAGKHGVGRIDHVENRLVGIKSREIYEAPAATTLIAAHQELEALTLPREVAEFKPTIEQKLAQTVYYGLWYSPLTEALQSFIEKTQEHVSGTVKVKLYKGHAQVIGRESENSLYDFDLATYNKADAFDHDAALGFIKLWGLPTQVHSAVNGPQGKKSIEKVDLEVKEAVKP

SEQ ID NO: 25299 - DNA, 1338 bp, Pasteurella multocida
  CDS (1)..(1338)
atgtcaaacacaattttacagcagcttccaaaaggtcaaaaagtcggtatcgcgttttcaggtggtttagataccagtgcagcattgttatggatgcgtcaaaaaggggctgttccttatgcctataccgcgaacttaggtcaaccagatgaagaggattacaatgcaattccgcgtaaggcgatggaatatggcgcggaaaatgcccgcttaattgattgccgtgcacagcttgctcacgaagggattgcggctattcaaagcggtgccttccatatttcaacaggtggcgtaacgtattttaataccaccccattgggtcgtgcagtaacgggaacgatgttagtgtcggcgatgcgtgaagatgatgtgaatatctggggtgatggcagtaccttcaaaggtaatgatattgagcgtttctatcgttatggtttattaactaatcccaatcttaaaatttataagccatggttagataatcaatttatcgaagaattaggcggtcgtcatgaaatgtcagagttcttgattgcgaatggctttgaatacaaaatgtcagtggaaaaagcctattcaacagattcaaatatgctaggtgccacccatgaagccaaagatcttgaatttttaaatacgggtattcgtattgtaaaaccgattatgggcgtggcattctggcgtgatgatgttgaagtgaaagctgaagaagtcactgtgcgctttgaagaggggattcctgtggcgttaaatggtaaaacattcagcgatcatgttgaattattcctcgaagcaaaccgtattggtgggcgccatggtttaggtatgtcagaccaaattgaaaaccgaattattgaagccaaatcgcgtggtatttatgaggcaccggggatggcgttgttacatattgcctatgagcgcttagtgagtggtatccataatgaagatacgattgaacaataccgtattaacggcttacgtttaggtcgtttactctaccaaggtcgttggtttgatccacaagccttaatgttacgtgaaacggcacaacgctgggttgcgcgtgcgattaccggtgaggtgactttcgaattacgccgtggtaatgattattccattttgaatacggaatcaccaaatttaacttatatgccagagcgtttaagtatggaaaaagtggaaaatgcgccatttgatcctgttgatcgtattggtcaattaacgatgcgcaacttagatatcgtagatacgcgggataagttaggtatttacacgcaaacaggcttactcagtatttcaaaagattctttcttgccacaactaaataagaaaggttaa

SEQ ID NO: 25300 - protein, 445 aa, Pasteurella multocida
MSNTILQQLPKGQKVGIAFSGGLDTSAALLWMRQKGAVPYAYTANLGQPDEEDYNAIPRKAMEYGAENARLIDCRAQLAHEGIAAIQSGAFHISTGGVTYFNTTPLGRAVTGTMLVSAMREDDVNIWGDGSTFKGNDIERFYRYGLLTNPNLKIYKPWLDNQFIEELGGRHEMSEFLIANGFEYKMSVEKAYSTDSNMLGATHEAKDLEFLNTGIRIVKPIMGVAFWRDDVEVKAEEVTVRFEEGIPVALNGKTFSDHVELFLEANRIGGRHGLGMSDQIENRIIEAKSRGIYEAPGMALLHIAYERLVSGIHNEDTIEQYRINGLRLGRLLYQGRWFDPQALMLRETAQRWVARAITGEVTFELRRGNDYSILNTESPNLTYMPERLSMEKVENAPFDPVDRIGQLTMRNLDIVDTRDKLGIYTQTGLLSISKDSFLPQLNKKG

SEQ ID NO: 25301 - DNA, 1215 bp, Photorhabdus luminescens
  CDS (1)..(1215)
atgcatactaaagatatcaaaaaaatcgttcttgcctattctggtggtctggatacttctgccattattccttggctgaaggagcattatggcaactgtgaagttgttgcgtttgttgctgatgtggggcaaagccgtgaagatttggaaggcgtggagcagaaagctttgcgttctggcgcgtcagaatgtcacgttgtggatctgcgtgaggaattcattaaagattatgtttatccggtactgaaaaccggtgctctgtatgaaggtagctatttgttgggcacttcaatggcacgccccattattgctaaagcacaggttgaattggcactgaaagtaggagcagatgcacttgctcatggtgcaacaggtaagggtaacgatcaggttcggtttgaaagcacttatacggcattagcccctcagctaaaagtagttgcaccgtggagagagtgggatttacgttcccgtgaagcgttgctggattatctgaaagcacgagatattccaaccactgcaacattggagaaaatttacagccgtgatgagaatgcgtggcatatctctaccgaaggtggcgtactggaaagcacttggaatgcatccaataaagattgttgggtgtggacagtcgatccagaagaggcaccagatgaagctgaattggttagtgtcatgattgagaaaggcgaggttgttggggtcaacggcaaagtaatgtctccatatcaatgccttgaagcgctgaatattctgggagtaaaacatggtatcggtcgtatcgatatcgtggaaaaccggctggtgggaatgaaatctcgtggttgttatgaaacaccgggaggaaccatcatgatggctgcgttgcgtggtgttgaacaactggttctggaccgcgatagctttaaatggcgtcagcagcttgggctagaaatgtcttatgtcgtttatgacggacgttggtttgccccgctacgtcgatctattcaggcagcggctgagacgttggctgcggatgtcagcggtgaagtagtactgaaactctataaagggcaggtaacagcgatccagaaaagatcaacaaatagcctttattctgaagcgtttgcaacgtttggtgaagatgaggtttacgatcacagccatgcagcaggatttatccgtctgtattctctcccttcgcgcattcgggcattaaatagtaaagagtaa

SEQ ID NO: 25302 - protein, 404 aa, Photorhabdus luminescens
MHTKDIKKIVLAYSGGLDTSAIIPWLKEHYGNCEVVAFVADVGQSREDLEGVEQKALRSGASECHVVDLREEFIKDYVYPVLKTGALYEGSYLLGTSMARPIIAKAQVELALKVGADALAHGATGKGNDQVRFESTYTALAPQLKVVAPWREWDLRSREALLDYLKARDIPTTATLEKIYSRDENAWHISTEGGVLESTWNASNKDCWVWTVDPEEAPDEAELVSVMIEKGEVVGVNGKVMSPYQCLEALNILGVKHGIGRIDIVENRLVGMKSRGCYETPGGTIMMAALRGVEQLVLDRDSFKWRQQLGLEMSYVVYDGRWFAPLRRSIQAAAETLAADVSGEVVLKLYKGQVTAIQKRSTNSLYSEAFATFGEDEVYDHSHAAGFIRLYSLPSRIRALNSKE

SEQ ID NO: 25303 - DNA, 1209 bp, Prochlorococcus marinus
  CDS (1)..(1209)
atgggagattttcagaaagttgttcttgcttattctggcggagtagacactagtgcttgtattccttatttaaaaaatgaatatggagtcgaagagattattgcttttgcagcggacttgggtcagggcgaagaattagaagttgttcgtaaaaaagctttattagcaggagcaaaggaatctttagttgatgatttaatagaaccttttatacatgattttgcatttcctgctattcgggcaaatgctctttatgaaggtcgttatccattatcaacagcattggcaaggcctttgatagcaagtcgcttagttgagttggcaagagaaatggaagctggtgctgttgctcatggttgtactggaaaaggcaatgatcaagttcgctttgatttggctatttcatcgcttgctccgcatttgaagatattaacccctgcaagagagtggtccatgagtagacaggaattaatttcttatggcgagaaatttggcattcctgcccctgtaagtaaaaaatctccatattcgattgatttaaatcttttagggagaagtattgaagctggtccattggaagatccctttttggcgcctcgagaggaagtgtttcagattacttcttcaattcaagagtcccctgatactcctgaagaaatagaaattcagtttgaagcaggaaatccaattgcaatcaatggagttactttggaccccgtaagcattatcaaaaaggcaaatgcattggctggaaggcatggttttggtcgaatagatatgatagaaaatcgagttgtaggaataaaaagtagagaaatttacgaggctccaggtcttatgcttttaataaaatgtcatcaagagattgaaagcattactttgtctgcagatgttttaagaacaaaagtaggtattgagcggcaatgggctgatttggtttatcaaggtttttggtttagtcctttaaaaaatgctttggatgcttttattgatcgtacacaacttgatgttaacggatcagtaaaaattcaattatttaaaggcaatgctactatccaaggaagacaatcatattctaatagtttatatttacctgatattgctacctatagtgcagaagatcaatatgatcataaatctgcagagggatttatttatgtttggggccttgctaatcgtctatgggcttcaattaatagggacaaatag

SEQ ID NO: 25304 - protein, 402 aa, Prochlorococcus marinus
MGDFQKVVLAYSGGVDTSACIPYLKNEYGVEEIIAFAADLGQGEELEVVRKKALLAGAKESLVDDLIEPFIHDFAFPAIRANALYEGRYPLSTALARPLIASRLVELAREMEAGAVAHGCTGKGNDQVRFDLAISSLAPHLKILTPAREWSMSRQELISYGEKFGIPAPVSKKSPYSIDLNLLGRSIEAGPLEDPFLAPREEVFQITSSIQESPDTPEEIEIQFEAGNPIAINGVTLDPVSIIKKANALAGRHGFGRIDMIENRVVGIKSREIYEAPGLMLLIKCHQEIESITLSADVLRTKVGIERQWADLVYQGFWFSPLKNALDAFIDRTQLDVNGSVKIQLFKGNATIQGRQSYSNSLYLPDIATYSAEDQYDHKSAEGFIYVWGLANRLWASINRDK

SEQ ID NO: 25305 - DNA, 1206 bp, Prochlorococcus marinus
  CDS (1)..(1206)
atggggcgtgcgaagaaggtagtgcttgcttattccggtggtgttgataccagcgtttgcatcccatacctcaagcatgaatggggggtagaggaggtgatcacctttgctgccgatttaggtcagggcgatgagcttgatcccatccgccttaaggctcttgatgctggtgctagtcagtctctggtgggagatttgatagagccttttgtagaacagtttgctttgccggcgattcgtgccaatgctctttacgaaggtcgttatccactgtctacggctttagctcgccccctgattgctcgtcagttggtagaggttgccagggaggtcggggccgatgcggtggctcatggctgtacgggtaaaggcaacgatcaggtgcgttttgatttagccattgcagcactagcacctgatctcaaggtgctaactcccgctcgggaatggagcatgagcagagaggaggcgatcgcctatggcgaacgctgtgggatccctgcccccgtgagtaagaaatcgccttattcgatagatctgaatctgttgggtcggagtattgaagccggtcctcttgaagatctgatggtggctccgcccgaggaggtctttgccatgacctcctcgattgacgctgcaccctctcaggctcaggacattgagatcagttttgaagctggtaatcctgtggctattgatggggtgcgacttgattcggtgggtttgatcaaggaggcgaatcgtcttgctggacggcatggtttcggtcgccttgacatcattgagaatcgggtggttggtatcaagagtcgggagatttatgaaactccagggttacttttattgattcgtgctcatcaggaattggagagtttgacacttgctgcggatgtgttgcgcatgaagcgtcaattggagatgcaatgggctgagctggtctatcagggtctttggttttcccctttgaaggatgctctggatggatttatggatcgcactcagacttatgtgaatggcttggtgcggattcgtctccaaaaaggcaatgccatggtgattggccggagctctgacaccaacagcttgtatatatctgagatggctacctatggcagcgaggataactttgaccacagggctgctgaaggatttatctacatctggggacttccaagtcgcctttgggcagcagctcggcgaggttaa

SEQ ID NO: 25306 - protein, 401 aa, Prochlorococcus marinus
MGRAKKVVLAYSGGVDTSVCIPYLKHEWGVEEVITFAADLGQGDELDPIRLKALDAGASQSLVGDLIEPFVEQFALPAIRANALYEGRYPLSTALARPLIARQLVEVAREVGADAVAHGCTGKGNDQVRFDLAIAALAPDLKVLTPAREWSMSREEAIAYGERCGIPAPVSKKSPYSIDLNLLGRSIEAGPLEDLMVAPPEEVFAMTSSIDAAPSQAQDIEISFEAGNPVAIDGVRLDSVGLIKEANRLAGRHGFGRLDIIENRVVGIKSREIYETPGLLLLIRAHQELESLTLAADVLRMKRQLEMQWAELVYQGLWFSPLKDALDGFMDRTQTYVNGLVRIRLQKGNAMVIGRSSDTNSLYISEMATYGSEDNFDHRAAEGFIYIWGLPSRLWAAARRG

SEQ ID NO: 25307 - DNA, 1215 bp, Prochlorococcus marinus subsp
  CDS (1)..(1215)
atgcagcaggtaaaaaaagttgttcttgcatattctggaggagttgatactagtgtctgcattccatatttaaaaaatgaatacggtatttcagaagttgtaacttttgtagctgatcttggccaaggagatgatttagagattgttagacaaaaagccttaaattcaggtgcaacaaaatctgtgattgggaatttagtagataattttgtagaaaagtatgcttttcctgctattagagcgaatgcactttatggagaaaagtatcctttatcaactgctttggctagaccactgatagctgaaaatctcgtaaatttagcaagagaactaaatgctgatgcagtggcgcacggctgtacaggaaaaggaaatgatcaagtaagatttgatttggctattcatgctttaggacctgatttacagataattacacctgctagagaatggaagatgagtagagaagaagctattttgtatggtgaaaaatttggaattccagctcctgtttctaagaagtctccttattcgattgatgtgaatcttcttggtcgtagtattgaagctggtttattggaagatccaatgcaagaaccagatgaagacgtttttgatatgacttcatctattaataacgcaccaaatgctccaaaagacgtagaaattatatttcaaaatggatttcctattgcaataggaaatgaatttttaagtcctgtagagattattcaaaaggctaattctctagcaggcgaacatggctttggaagaatagatatgattgaagatagagttgtcggtattaagagcagagaaatctatgaggcgcccggccttttacttcttataaaagctcacaaagaattggaaagcataacattaaatccagatgtattagattttaaaaatatagtagaaaaaaaatggggtcaattagtttatcagggattttggtttggtcctctcaagcaagcattagatggttttattgattccactcaatcatctgttaacggtaaggtcaaaataagattacataagggaaatgcgatagtaattggtcgttcttctcaaaataactctctctatagggaagatttggcaacttatagtaaagatgatatttttaatcacaagcaagcagaaggatttatttatatgtgggggatgtccaataaaatatgggcagaattaaattcaaaaaagaataaatag

SEQ ID NO: 25308 - protein, 404 aa, Prochlorococcus marinus subsp
MQQVKKVVLAYSGGVDTSVCIPYLKNEYGISEVVTFVADLGQGDDLEIVRQKALNSGATKSVIGNLVDNFVEKYAFPAIRANALYGEKYPLSTALARPLIAENLVNLARELNADAVAHGCTGKGNDQVRFDLAIHALGPDLQIITPAREWKMSREEAILYGEKFGIPAPVSKKSPYSIDVNLLGRSIEAGLLEDPMQEPDEDVFDMTSSINNAPNAPKDVEIIFQNGFPIAIGNEFLSPVEIIQKANSLAGEHGFGRIDMIEDRVVGIKSREIYEAPGLLLLIKAHKELESITLNPDVLDFKNIVEKKWGQLVYQGFWFGPLKQALDGFIDSTQSSVNGKVKIRLHKGNAIVIGRSSQNNSLYREDLATYSKDDIFNHKQAEGFIYMWGMSNKIWAELNSKKNK

SEQ ID NO: 25309 - DNA, 1218 bp, Pseudomonas putida
  CDS (1)..(1218)
atggcggacgtaaaaaaggtcgtactggcgtattccggcggccttgatacttcggtgattctcaagtggctgcaggatacctacaactgcgaagtggtgaccttcaccgctgacctggggcagggcgaagaggtcgaaccggcccgtgccaaggcccaggcaatgggcgttaaagagatctacatcgacgacctgcgcgaagaattcgtgcgtgatttcgtgttcccgatgttccgcgccaacaccgtctacgaaggcgagtacctgctgggtacttccatcgcccgtccgctgatcgccaagcgcctgatcgaaatcgccaacgaaaccggcgctgacgccatttcccatggcgccaccggcaagggtaacgaccaggtgcgcttcgagctgggtgcctatgccctgaagccaggcgtcaaggtcatcgctccatggcgcgagtgggacctgctgtcccgcgaaaagctgatggactacgccgagaagcacggcatcccgatcgagcgccacggcaagaagaagtcgccgtactcgatggacgccaacctgctgcacatctcctacgagggcggtgtcctggaagatacctggaccgagcacgaagaagacatgtggcgctggagtgtctcgcctgagaatgccccggaccaggctacctacatcgagctgacctaccgcaatggtgacatcgttgccatcgacggcgtcgagaaatccccggccaccgtcctggcagacctgaaccgtatcggtggtgccaacggcatcggccgtctggacatcgtcgaaaaccgttacgtcggcatgaagtcgcgcggttgctacgaaacgcctggcggtaccatcatgctcaaggcacaccgtgccatcgagtcgatcaccctggaccgcgaagtcgctcacctgaaagatgagctgatgccaaagtatgccagcctgatctacaccggctactggtggagcccggagcgtctgatgctgcaacagatgatcgatgcttcgcaggtcaacgtgaatggtgtggtgcgcctgaaactgtacaagggcaacgtgaccgtggttggccgcaagtcggacgattcgctgttcgatgccaacatcgccacctttgaagaagatggtggtgcctacaaccaggcagatgctgctggcttcatcaagctcaatgcactgcgtatgcgcattgccgccaacaagggccgttcgctgctctga

SEQ ID NO: 25310 - protein, 405 aa, Pseudomonas putida
MADVKKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWRWSVSPENAPDQATYIELTYRNGDIVAIDGVEKSPATVLADLNRIGGANGIGRLDIVENRYVGMKSRGCYETPGGTIMLKAHRAIESITLDREVAHLKDELMPKYASLIYTGYWWSPERLMLQQMIDASQVNVNGVVRLKLYKGNVTVVGRKSDDSLFDANIATFEEDGGAYNQADAAGFIKLNALRMRIAANKGRSLL

SEQ ID NO: 25311 - DNA, 1218 bp, Pseudomonas syringae
  CDS (1)..(1218)
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgaaccggcacgcgccaaggctcaggccatgggcgtgaaagaaatctacatcgatgacctgcgcgaagagttcgtgcgcgatttcgtgttcccgatgttccgtgccaataccgtctatgaaggcgagtacctgctgggcacttccattgctcgtccgctgattgccaagcgtctgatcgagatcgccaacgaaaccggcgctgacgccatttcccacggcgcaaccggtaaaggcaatgaccaggtacgtttcgagctgggcgcctacgcgctcaagccgggcgtcaaggtgattgctccgtggcgtgaatgggacctgctgtcgcgcgaaaagctgatggattacgccgagaagcacaatattccgatcgagcgtcacggcaagaagaaatccccgtactcgatggatgccaacctgctgcacatctcctatgaaggcggcgtgctggaagacacctggaccgagcacgaagaagacatgtggcgctggaccaagtcccctgaggacgcgccgaacgttgcaacctacctcgagctgacctatcgcaatggcgacatcgtcgctctggacggcgtcgacatgaccccggctaccgtactcgctaccctgaaccgcattggcggcgaaaacggtatcggtcgtctggacatcgttgaaaaccgttacgtgggcatgaagtcccgtggttgctacgaaaccccgggcggcaccatcatgctgcgtgctcaccgcgccatcgaatcgatcaccctggaccgcgaagtcgcccacctcaaggacgaattgatggtcaagtacgccagcctgatctacacaggttactggtggagccctgagcgtctgatgctgcaacagatgatcgacgcgtcccaggtgcacgtgaacggtgttgtgcgtctgaagctgtataaaggcaacgtgatcgttactggccgcaagtccgacgattcactgttcgacgccaacatcgccacctttgaagacgacgcaggtgcctacgatcaggccgatgcagcgggcttcatcaagctgaatgcgttgcgcatgcgtatcgctgcaaacaaaggccgcaagctgttctga

SEQ ID NO: 25312 - protein, 405 aa, Pseudomonas syringae
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVDMTPATVLATLNRIGGENGIGRLDIVENRYVGMKSRGCYETPGGTIMLRAHRAIESITLDREVAHLKDELMVKYASLIYTGYWWSPERLMLQQMIDASQVHVNGVVRLKLYKGNVIVTGRKSDDSLFDANIATFEDDAGAYDQADAAGFIKLNALRMRIAANKGRKLF

SEQ ID NO: 25313 - DNA, 1233 bp, Pyrococcus furiosus
  CDS (1)..(1233)
atgagaatagtgttggcttattcaggtggattggatacttcggtgatactaaaactaatgcaggaaaagctgggagctgaagtaataactgttactgttgatgttgggcagaaggatgacttcgaaaaaatagaagagaaggcctacaagtttggtgccgtgaagcactactacatagatgccaaggaggaattcgccgagaactatgtttgtaaagctataaaagcaaatgctctttacgaaaatgcgtatcctctttcaacggccctagctaggcctcttatagtagaaaagttagttgaggttgcaaagaaggagggggctggaataatagctcatggttgtacaggaaagggaaatgatcaggtgcgctttaacctaggaattaaggccttgatgcctgaggctgaaattctccagccagtagctgagtggaaccttacaagggattgggaaatggagtatgcaaagaagcatggaattcctgtaagtgacaagatatatagcatagatgaaaacatctggggaaggagcattgaaggtggggtacttgaagatccatcaatagaacctccagaagaggtctttgaatggacagtatctatagaaaaagctccagacaaaccagaatatgtgactattggctttgaaaatggagttccagtttcacttaatggggaaaaaatgaagcttctcgagctaattctaaagctcaacgaaatcgctggtaagcatggggttggaaggattgaccatattgaggataggagtgttgggattaagagcagggaggtttatgaagcccctgcggctgttactctaataaaggctcatcaggacttagaaaagttaactttaacaaagtgggttatagaattcaagagtatagtggactctaagtggtcttggcttgtatataatggcctatggtatgaaccacttaggttagccttagaagggttcatagatgaagctgaaaaggctgtcaacggcgaagttacagtcaagctgtggaaaggaaatgcaattgtcgttggaaggaaatcggacaatgccctctacgatgtaaagatggcaacttatgaaaagttcagcacatttgatcagaagcttgcaaagggattcatagagctctttggaatgcagagtgttctagcttataatatgcttcatggagtccactccacctcaaatatttcggaaattaaagaggcaataaagactttggagtga

SEQ ID NO: 25314 - protein, 410 aa, Pyrococcus furiosus
MRIVLAYSGGLDTSVILKLMQEKLGAEVITVTVDVGQKDDFEKIEEKAYKFGAVKHYYIDAKEEFAENYVCKAIKANALYENAYPLSTALARPLIVEKLVEVAKKEGAGIIAHGCTGKGNDQVRFNLGIKALMPEAEILQPVAEWNLTRDWEMEYAKKHGIPVSDKIYSIDENIWGRSIEGGVLEDPSIEPPEEVFEWTVSIEKAPDKPEYVTIGFENGVPVSLNGEKMKLLELILKLNEIAGKHGVGRIDHIEDRSVGIKSREVYEAPAAVTLIKAHQDLEKLTLTKWVIEFKSIVDSKWSWLVYNGLWYEPLRLALEGFIDEAEKAVNGEVTVKLWKGNAIVVGRKSDNALYDVKMATYEKFSTFDQKLAKGFIELFGMQSVLAYNMLHGVHSTSNISEIKEAIKTLE

SEQ ID NO: 25315 - DNA, 1338 bp, Ralstonia solanacearum
  CDS (1)..(1338)
atggaaaccatcctgcaacacgttcccgtcggccagaaggtcggcatcgccttctccggcggcctggacaccagcgcggccctgcgctggatgaagaacaagggcgccctgccctatgcctacaccgccaatctcggccagcccgacgaggaagactacgatgccatcccccgcaaggccctggaatacggtgcagagaaggctcgcctgatcgactgccgcccgcaactggccaatgaaggcattgccgccatccaggccggcgccttccacatcagcaccggcggcatcacctacttcaacaccacgccgttgggccgcgccgtgaccggcaccatgctggtggccgccatgaaggaagacgacgtccacatctggggcgacggctccaccttcaagggcaatgacatcgagcgcttctaccgctacggcctgctgaccaacccggccctgaagatctacaagccgtggcttgaccagaccttcatcgacgagctgggcggccgcgccgaaatgtcggccttcatgacgaaggaaggtttcggctacaagatgagcgccgaaaaggcctactccaccgactccaacatgctgggcgccacccacgaggccaaggacctggagcatctgaacagcggcatccgcatcgtcaacccgatcatgggcgtggcgttctggaagcctgaagtcgaagtcaaggccgaagaggtttcgatcaccttcgacgaaggccgccccgtggccgtcaacggccgcgaaattgccgacccggtggagatgttcctggagctgaaccgcatcggcggccgccacggcctgggcatgagcgaccagatcgaaaaccgcatcatcgaagccaagagccgcggcatctacgaagccccgggcatggcgttgctgcacatcgcctacgagcgcctggtcaccggcatccacaacgaggacaccatcgagcagtaccgcatcaatggcctgcgcctaggccgcctgctgtaccagggccgctggttcgacccgcaggccatcatgctgcgcgaaaccgcccaacgctgggtggcccgcgccgtgaccggtaccgtgacgctggagctgcgccgcggcaacgattactccatcctgaacaccgagtcgcccaacctgacctacgcgcccgagcgcctgtcgatggaaaaggtcgaagacgcaccgttcagcccggccgaccgcatcggccagctgaccatgcgcaacctggacctgatggacacccgcgacaagctggccatctactccaaggccggcctgctgtccctgggcaccagcagcgcgctgccccagctcggcggcgacaagaagtaa

SEQ ID NO: 25316 - protein, 445 aa, Ralstonia solanacearum
METILQHVPVGQKVGIAFSGGLDTSAALRWMKNKGALPYAYTANLGQPDEEDYDAIPRKALEYGAEKARLIDCRPQLANEGIAAIQAGAFHISTGGITYFNTTPLGRAVTGTMLVAAMKEDDVHIWGDGSTFKGNDIERFYRYGLLTNPALKIYKPWLDQTFIDELGGRAEMSAFMTKEGFGYKMSAEKAYSTDSNMLGATHEAKDLEHLNSGIRIVNPIMGVAFWKPEVEVKAEEVSITFDEGRPVAVNGREIADPVEMFLELNRIGGRHGLGMSDQIENRIIEAKSRGIYEAPGMALLHIAYERLVTGIHNEDTIEQYRINGLRLGRLLYQGRWFDPQAIMLRETAQRWVARAVTGTVTLELRRGNDYSILNTESPNLTYAPERLSMEKVEDAPFSPADRIGQLTMRNLDLMDTRDKLAIYSKAGLLSLGTSSALPQLGGDKK

SEQ ID NO: 25317 - DNA, 1224 bp, Rhizobium loti
  CDS (1)..(1224)
atgtccaagaccaaagacgtcaagaaagtcgtgctcgcctattccggcggcctcgacacatccatcatcctgaaatggctgcagaccgaactcggcgccgaagtcgtcaccttcaccgccgatctcggccagggtggcgagttggagccggcacgcaagaaggccgagatgatgggcatcaaggacatccgcatcgtcgatgtgcgggaggaattcgtcgccgacttcgtcttcccgatgttccgtgccaacaccgtctatgaaggcacctatctgctcggcacctcgatcgcgcggccgctgatctccaagcaccttgtcgacatcgccagggagaccggcgccgatgcgatcgcccatggcgccaccggcaagggcaacgaccaggtccgcttcgagctgtcggcctatgcgctgaaccccgatatcaaagtcatcgcgccctggcgcgactggtcgttcaagtcgcgcaccgacctgatcaacttcgccgagcagcaccagatcccggtggccaaggacaaaaggggcgaggcgccgttctcggtcgacgccaacctgctgcactcctcttccgagggcaaggtgctggaagatccgtggagcgagccgccggaattcgtccaccagcgcacggtctcgccgatggacgcgccggacaaggtaaccgagatcgagatcgagttcctgaagggcgacccgatcgcgctcaacggcaagaagctgtcgccggcgaccatgctggccgccctcaacgatcttggccgcgacaacggcatcggccggctcgacctggtcgagaaccgtttcgtcggcatgaaatcgcgcggcgtctacgagacgccaggcggcgccatcctgatcgtggcccaccgcgccatcgaatcgatcacgctcgaccgcggcgccgcgcacctcaaggacgagttcatgccgcgctacgccgagctcatctacaacggcttctggttctcgcccgagcgcctgatgctgcaggcgatgatcgacaagagccaggaagacgtcgaaggcacggtacggttgaagctctacaagggcaatgtcatggtcaccggccgcaagtcgaagaagacgctctattccgacgcgctggtcaccttcgaggacgatcgcggcgcctacgaccagaaggacgccgccggcttcatccgcctcaatgcgctgaggctgcgcacgctggctgcgcgcaaccgcaagggctga

SEQ ID NO: 25318 - protein, 407 aa, Rhizobium loti
MSKTKDVKKVVLAYSGGLDTSIILKWLQTELGAEVVTFTADLGQGGELEPARKKAEMMGIKDIRIVDVREEFVADFVFPMFRANTVYEGTYLLGTSIARPLISKHLVDIARETGADAIAHGATGKGNDQVRFELSAYALNPDIKVIAPWRDWSFKSRTDLINFAEQHQIPVAKDKRGEAPFSVDANLLHSSSEGKVLEDPWSEPPEFVHQRTVSPMDAPDKVTEIEIEFLKGDPIALNGKKLSPATMLAALNDLGRDNGIGRLDLVENRFVGMKSRGVYETPGGAILIVAHRAIESITLDRGAAHLKDEFMPRYAELIYNGFWFSPERLMLQAMIDKSQEDVEGTVRLKLYKGNVMVTGRKSKKTLYSDALVTFEDDRGAYDQKDAAGFIRLNALRLRTLAARNRKG

SEQ ID NO: 25319 - DNA, 1218 bp, Rhizobium meliloti
  CDS (1)..(1218)
atggcatcgcataaagacgtgaagaaggtcgttctcgcctattccggcggtctcgacacctcgatcatcctcaaatggctgcagacggaactgggcgccgaagtggtgaccttcaccgcggacctcggccagggcgaagaactggagccggcgcgcaagaaggcggagatgctcggcatcaaggagatctatatcgaggacgtccgcgaggaattcgtgagggacttcgtgttcccgatgttccgcgccaatgccgtctatgaaggcgtctacctgctcggcacctccatcgcccgtccgctgatctccaaacacctcatcgatatcgccaggaagaccggcgccgacgcgatcgcccatggcgcgaccggcaagggcaacgaccaggtccgcttcgaactttcggcttacgcgctcaatccggacatcaagatcatcgccccctggcgcgactggtcgttcaagagccgcaccgatctgctcgaattcgccgagaagcaccagattccggtcgccaaggacaagaagggcgaggcgcctttctccgtcgacgccaacctcctgcactcctcctcggaaggaaaagtgctggaggacccggcccgggaagctcccgaatacgtgcacatgcgcaccatttcgccggaagcggcacctgacaaggcaaccgtcatcaaggtcggcttcgaacgtggcgatgccgtgtcgatcgacggggtacgcatgtcgccggcaacgcttcttgcgaagctcaacgaatacggccgcgacaacggcatcggccgcctggacctcgtcgagaaccgtttcgtcggcatgaagtcgcgcggcgtctacgaaacccccggcggcacgatcctgcttgcggcccatcgtgcgatcgagagcatcacgctcgaccgcggcgcggcgcatctgaaggacgagctgatgccgcgctatgccgagctcatctattacggcttctggttctctccggagcgcgaaatgctgcaggcggcgatcgacaggagccaggagcatgtggaaggcgaagtgacgctgaagctctacaagggcaatgtcatggtcatcggccgcgaaagcggcaagtcgctctattccgacaagctcgtcaccttcgaggacgatcagggcgcctacgaccagaaggatgccgccggcttcatcaagctcaacgcgctgcgtctgcgcacgctggcagcgcgcaaccggtaa

SEQ ID NO: 25320 - protein, 405 aa, Rhizobium meliloti
MASHKDVKKVVLAYSGGLDTSIILKWLQTELGAEVVTFTADLGQGEELEPARKKAEMLGIKEIYIEDVREEFVRDFVFPMFRANAVYEGVYLLGTSIARPLISKHLIDIARKTGADAIAHGATGKGNDQVRFELSAYALNPDIKIIAPWRDWSFKSRTDLLEFAEKHQIPVAKDKKGEAPFSVDANLLHSSSEGKVLEDPAREAPEYVHMRTISPEAAPDKATVIKVGFERGDAVSIDGVRMSPATLLAKLNEYGRDNGIGRLDLVENRFVGMKSRGVYETPGGTILLAAHRAIESITLDRGAAHLKDELMPRYAELIYYGFWFSPEREMLQAAIDRSQEHVEGEVTLKLYKGNVMVIGRESGKSLYSDKLVTFEDDQGAYDQKDAAGFIKLNALRLRTLAARNR

SEQ ID NO: 25321 - DNA, 1215 bp, Rhodopirellula baltica
  CDS (1)..(1215)
atgaaaagttgtgtgctggcctattccggtggtctcgatacgtccgtcattctgggctggctccaggaccaaggctacgaagttcactgtgtttacgtggacctcgggcagccctgtgaggatcgcgatgccatcatggagaaggctcgtacctgcggggccaagtcctctcgtttggtggacgttcgtgaagaactgtgccgcgattttgctttccccgtgttggcgtggcaagccaagtacgaacaaatctatctgctgggcacctcgatcgctcgcccgctgatcagcaaggtttgcttggaagtggctcgcgaagtcggcgcgaccgcctacgctcacggagcaacaggcaaaggcaatgaccaatgtcgtttccaacttgctgccgaagctcttgatccaaacatcgaaatgatcgctccttggcgaatcaaatcgttccgcgatgccttccctggccgcaccgaactgatcgagtactgcgacgtgaagcgaattcctgtcaaagcctcgactgcaaagccatacagcagcgatgaaaacgtcctgcacatttcctacgaagcgggcaagcttgaagaactcgacgtcaacggcgtggagctggtcgaattcggaatgggcgtttcacctcaagatgctcccgacaaaccagaagaagtcacgatcggttttgaatccggcgtaccaaaaacgttgaatggcaaagccgtcaacgctttggaaatggtcgagcaactcaatgacatcgctggacgcaacggcgtcggtcgcatcgacatggtcgaaaatcgtttcgtcggcatgaagagccgcggtgtttacgagtcgcccggcatgactgtgttgtacgacgcattgatgtacgtcgaacaactcaccatggaccgcgacctgatgcaccttcgcgaccgcatggctcccgaagtggctgaaatggtttactacggtttctggtacacgcccaagatggacgcactgatgtcgttcatcgaaaccgctcagcgtccagtcaccggcgaagtcacgttgcaactctacaagggcaacatcatggtgtcttcacgaaccagcccaaacagcttgtacgacgaagagatcgcaaccatggaaggcggcggctcgtacaaccaagacgacgccgaaggcttcctgcgaatccaaggcttgccgtcgcgagtccaaggccgcgtgtcaccacgcaagttctaa

SEQ ID NO: 25322 - protein, 404 aa, Rhodopirellula baltica
MKSCVLAYSGGLDTSVILGWLQDQGYEVHCVYVDLGQPCEDRDAIMEKARTCGAKSSRLVDVREELCRDFAFPVLAWQAKYEQIYLLGTSIARPLISKVCLEVAREVGATAYAHGATGKGNDQCRFQLAAEALDPNIEMIAPWRIKSFRDAFPGRTELIEYCDVKRIPVKASTAKPYSSDENVLHISYEAGKLEELDVNGVELVEFGMGVSPQDAPDKPEEVTIGFESGVPKTLNGKAVNALEMVEQLNDIAGRNGVGRIDMVENRFVGMKSRGVYESPGMTVLYDALMYVEQLTMDRDLMHLRDRMAPEVAEMVYYGFWYTPKMDALMSFIETAQRPVTGEVTLQLYKGNIMVSSRTSPNSLYDEEIATMEGGGSYNQDDAEGFLRIQGLPSRVQGRVSPRKF

SEQ ID NO: 25323 - DNA, 1188 bp, Rhodococcus fascians
  CDS (1)..(1188)
atgagcatcgtcctggcatattccggcggattggacacatccgttgccgtgcactggctcaaagagcgctatcagaccgaggtcatcgcgtactgcgcgaacctcggccaaatcgaggacctcgaggccgtctcgaagcgcgcaaccgcggccggcgcgtcggaagttatcgtcgaagacgtccgagacctgttcctccacgactatgcaatcccggctctcgccgccggcgctgcatacgagggaaaatatcttctggctgcaccgttgtctcgaccgttgatcgccgagcggctggtcagcatcgctcgcgaacgcggtgcatccgcagtcgctcacggtgccacgggcaagggaaacgatcaggtccggttctacacctccgtgcgggcgttggctcccgagctcgacatcctcgcacctgtcatcgattgggaaatgacctcccgcggtagcgaaattgcctacgccgatcgtcacggtatcgatgtgggtgtcagcaagacgacgccgtacagcatcgacaccaatatctggggcaccagcatcgagtgcggggatctcgacctcatcgaccacgctccaccgcccgatgcatggcagatcacgaccgcgccggtgcaggcaccggatcgtccaacaacgatcacgatcgagttcgaagcaggcatccccgtcgctctcgacggccgcaagctcgacctgatcgacctggtcagcgaactcggggacacagcggccgcgaacggtatcgggcgtaccgaaattctcgagagccgcatcgtcggattcaagagccgcggaatctacgaagcacccgctgcaacagttcttctcgctgcacgaaccgatctcgaagcactcgtactggaccgagagacgctccaccacaagcggtccatcgccgaccagtacgcagagttggtctactacggctactggttcaccgatctgcgtgcagcactcgatgcttactgcgcccgtctggctcaccgcgtgacgggcacagtgaccgtcgagctgtacaagggctccgctcgatgcatcggccggacgtccccgaaatacggccgatacagctcggctctggccgattacgaagaggcagacacctttctacacgaagcaggtgccggattcgcgtactgctgggctctcccactcaccgaaggagttgtcactcgatga

SEQ ID NO: 25324 - protein, 395 aa, Rhodococcus fascians
MSIVLAYSGGLDTSVAVHWLKERYQTEVIAYCANLGQIEDLEAVSKRATAAGASEVIVEDVRDLFLHDYAIPALAAGAAYEGKYLLAAPLSRPLIAERLVSIARERGASAVAHGATGKGNDQVRFYTSVRALAPELDILAPVIDWEMTSRGSEIAYADRHGIDVGVSKTTPYSIDTNIWGTSIECGDLDLIDHAPPPDAWQITTAPVQAPDRPTTITIEFEAGIPVALDGRKLDLIDLVSELGDTAAANGIGRTEILESRIVGFKSRGIYEAPAATVLLAARTDLEALVLDRETLHHKRSIADQYAELVYYGYWFTDLRAALDAYCARLAHRVTGTVTVELYKGSARCIGRTSPKYGRYSSALADYEEADTFLHEAGAGFAYCWALPLTEGVVTR

SEQ ID NO: 25325 - DNA, 1224 bp, Shewanella oneidensis
  CDS (1)..(1224)
atgtctattgagaacaaaaacactggcgtgaaaaaagtcgttttagcctattcgggtggtctagatacttcggccattattccttggttaaaagagaactacgataactgcgaaattattgcgttctgtgctgacgtaggccaaggcgaagaagagctgattggcttgactgaaaaagccttagcctctggcgcatcagaatgccatatcgtcgatctgaaagaagaattcgtaaaagactatatctacccaaccatggcaacgggagcgatttacgaagggacttacttactcggcacctcaatggctcgcccaatcatcgctaaggcgcaggttgaagtggcacgtaaagtgggcgccgatgccctgtgtcacggttgtaccggtaaaggtaacgaccaagtgcgtttcgaaggttgctttgcggcattagcgcctgatttaaaagtgattgccccatggcgtgaatggaccatgcagagccgtgaagatctattggcttacttagctgagcgtaatatcaagacgtcggcttctgccactaagatctacagccgtgatgcaaacgcattccacatctcccatgaaggtggtgagttagaagatccatggaacgagccaagcaaaggtgtgtggacattgactgccgatccagaagatgcgccaaaccaagcagaatatgtgtcattggaagtcgaaaatggtcgtgtgactaaagtgaatggcgaagccttaacgccatatgcggcactgatgaagttgaacgcgattgcggctcctcacggtgtgggtcgtatcgacattaccgaaaaccgtttagtgggcatgaagtcccgtggttgttacgaaacccctggcggcaccgtaatgtttgccgcgctgcgtgccattgaagagttagtactggataaaaccagccgtaattggcgcgagcaagtgggcgcacaaatggctcacttagtgtatgacggtcgttggttcacacctctatgtaagtcgctgctggcggcatctgagtcattagccgagtctgttaatggtgaagttgtggttaaactctacaaaggtcatgcgattgctgttaagaagcgctcgccaaacagcttgtactctgaagcatttgccaccttcggtgaagaccaagtgtacgaccaaaaacacgctgaaggttttatccgtctgtactcgttagcgagccgcatccgcgcgctcaacgctaagtaa

SEQ ID NO: 25326 - protein, 407 aa, Shewanella oneidensis
MSIENKNTGVKKVVLAYSGGLDTSAIIPWLKENYDNCEIIAFCADVGQGEEELIGLTEKALASGASECHIVDLKEEFVKDYIYPTMATGAIYEGTYLLGTSMARPIIAKAQVEVARKVGADALCHGCTGKGNDQVRFEGCFAALAPDLKVIAPWREWTMQSREDLLAYLAERNIKTSASATKIYSRDANAFHISHEGGELEDPWNEPSKGVWTLTADPEDAPNQAEYVSLEVENGRVTKVNGEALTPYAALMKLNAIAAPHGVGRIDITENRLVGMKSRGCYETPGGTVMFAALRAIEELVLDKTSRNWREQVGAQMAHLVYDGRWFTPLCKSLLAASESLAESVNGEVVVKLYKGHAIAVKKRSPNSLYSEAFATFGEDQVYDQKHAEGFIRLYSLASRIRALNAK

SEQ ID NO: 25327 - DNA, 1215 bp, Staphylococcus epidermidis
  CDS (10)..(1215)
ggtgtaaatatgaaagataaaatcgttttagcatattcaggtggtttagatacaagcgttgcagttcaatggcttattgataaaggatatgatgtagttgcttgttgtcttgacgtaggcgaaggcaaagatttagacgttgtatatcaaaaagctttagatatgggtgcagtcgaatgtcatattattgatgcaactaaagaatttagtgatgattatgtaagttatgctattaaaggaaatttaatgtatgaaaatgcatatcctctagtttcagcattatcacgtccactcatcgcgaaaaaactggttgaaattgctgaaaaaacaaattctattggtattgcgcatggatgtactggtaaaggtaatgatcaagtacgtttcgaagtggcaatcaaagctttaaatcctaagttaaaagcatttgcacctgttcgtgaatgggcttggagcagagaagaagaaattgattacgcaatcaaacataatattcctgtttcaatcaattatgactcgccatactcaattgaccaaaacttatgggggagagctaatgaatgtggtattttagaagatccgtatgccgcacctccggaagatgcatttgatttaactacacctttagaagaaactccagacaatgcagacgaaattatccttacatttaaacaaggtattccagtacaagttgatggcaaagattatcaattagatgaccttattctttacttgaatcaacttgctggcaaacacggtattggtagaatcgatcatgttgaaaacagaatggtcgggataaaatcgagagagatttatgaaacacctggtgcggaagttattttaaaagcacacaaagcactagaaacaattacattaactaaagacgtagcgcactttaagcctgtcattgaaaaacaattttcagaacaaatatacaatggtttgtggttctcgccattaacagatagtttaaaactctttatcgatagtactcaacaatatgttgagggagatgtgagaattaaattatttaaagggaacgctattgtcaatggcagacaatctccttacactttatacgatgaaaaattagctacttatacaaaagaagatgccttcaatcaagaatcagcagtaggtttcattgatatttatggtttacctacacaagttaatgcattacttcacggggggtatagtaatgagcaataa

SEQ ID NO: 25328 - protein, 401 aa, Staphylococcus epidermidis
MKDKIVLAYSGGLDTSVAVQWLIDKGYDVVACCLDVGEGKDLDVVYQKALDMGAVECHIIDATKEFSDDYVSYAIKGNLMYENAYPLVSALSRPLIAKKLVEIAEKTNSIGIAHGCTGKGNDQVRFEVAIKALNPKLKAFAPVREWAWSREEEIDYAIKHNIPVSINYDSPYSIDQNLWGRANECGILEDPYAAPPEDAFDLTTPLEETPDNADEIILTFKQGIPVQVDGKDYQLDDLILYLNQLAGKHGIGRIDHVENRMVGIKSREIYETPGAEVILKAHKALETITLTKDVAHFKPVIEKQFSEQIYNGLWFSPLTDSLKLFIDSTQQYVEGDVRIKLFKGNAIVNGRQSPYTLYDEKLATYTKEDAFNQESAVGFIDIYGLPTQVNALLHGGYSNEQ

SEQ ID NO: 25329 - DNA, 1215 bp, Streptomyces avermitilis
  CDS (1)..(1215)
atgcagtgtgaggagaagcccgtgaccgagcgcgtcgtactcgcctactcgggtggtctggacacctccgtcgccatcggctggatcgccgaggagacgggcgccgaggtcatcgccgtcgcggtcgacgtcggccagggcggcgaggacctggacgtcatccgcaagcgcgcgctcgcctgcggtgccgtcgaggccgaggtcgcggacgccaaggacgagttcgccgacgagtactgcctcccggcggtcaaggccaacgccctctacatggaccgctacccgctggtctccgccctctcccggccgaccatcgtcaagcacctcgtcgccgccgcccagaagcacggcgccaccacggtcgcccacggctgcaccggcaagggcaacgaccaggtgcggttcgaggccggcatcgtcgccctcgcccccggcctcaagtgcatcgccccggtccgtgactacgcgatgacccgggacaaggcgatcgccttctgcgaggagaagcggctcccgatcgccaccaccaagaagtccccgtactccatcgaccagaacgtcttcgggcgcgcggtcgagacgggcttcctggaggacatctggaacgcgccgatcgaggacatctacgagtacacctcgaacccggccgagccccgcgaggccgacgaggtcgtcatctccttcaaggagggcgtcccggtcgccatcgacggccggcccgtcaccgtgctccaggcgatccagcagctcaacgagcgcgccggcgcccagggcgtcggccggatcgacatggtcgaggaccggctcgtgggcatcaagtcccgcgaggtgtacgaggctccgggcgcgatcgctctcatcacggcccaccaggagctggagaacgtcaccgtcgagcgtgaactcgcccgctacaagcggcaggtcgagcagcgctggggcgagctggtctacgacggccagtggttctccccgctcaagcgcgccctggagggcttcatcgacgaggccaaccagcacgtcaacggcgacatccggatgaccctgcacggcggccgcgccgtcgtcaccggccggcgctccgagacgtcgctctacgacttcaacctcgccacgtacgacacgggcgacagcttcgaccaggccgcggccaagggcttcatcgacatctacagcctgtcgtcgaagatcgccgccaagcgcgacctggcgtaa

SEQ ID NO: 25330 - protein, 404 aa, Streptomyces avermitilis
MQCEEKPVTERVVLAYSGGLDTSVAIGWIAEETGAEVIAVAVDVGQGGEDLDVIRKRALACGAVEAEVADAKDEFADEYCLPAVKANALYMDRYPLVSALSRPTIVKHLVAAAQKHGATTVAHGCTGKGNDQVRFEAGIVALAPGLKCIAPVRDYAMTRDKAIAFCEEKRLPIATTKKSPYSIDQNVFGRAVETGFLEDIWNAPIEDIYEYTSNPAEPREADEVVISFKEGVPVAIDGRPVTVLQAIQQLNERAGAQGVGRIDMVEDRLVGIKSREVYEAPGAIALITAHQELENVTVERELARYKRQVEQRWGELVYDGQWFSPLKRALEGFIDEANQHVNGDIRMTLHGGRAVVTGRRSETSLYDFNLATYDTGDSFDQAAAKGFIDIYSLSSKIAAKRDLA

SEQ ID NO: 25331 - DNA, 1446 bp, Streptomyces coelicolor
  CDS (1)..(1446)
atgtccaaggtcctcacctccctccccaccggcgagcgcgtcggtatcgccttctcgggcggcctcgacacctcggtcgcggtcgcgtggatgcgtgacaagggcgccgtcccctgcacgtacaccgccgacatcggccagtacgacgagcccgacatcgcctcggtgcccgaccgtgccaagacgtacggcgccgaggtcgcgcgcctggtcgactgccgcgcggcgctggtcgaggaggggctggccgcgctcacctgcggggcgttccacatccgctcgggcgggcgggcgtacttcaacaccacgccgctgggccgcgccgtcacgggcaccctcctcgtccgggccatgctcgaggacgacgtccagatctggggcgacggctccacgttcaagggcaacgacatcgagcggttctaccggtacggcctgctcgccaacccgcagctgaggatctacaagccctggctggacgcggacttcgtgacggagctcggcgggcgcaaggagatgtcggagtggctggtcgcccacgaccttccctaccgggactccacggagaaggcgtactccaccgacgccaacatctggggcgccactcacgaggccaagacgctggagcacctcgacaccggcgtggagaccgtggagcccatcatgggcgtgcggttctgggacccgtcggtcgagatcgcgcccgaggacgtgaccatcggcttcgaccagggccgcccggtgacgatcaacggcaaggagttcgcctccgcggtcgacctggtcatggaggccaacgccgtcggcggccggcacggcatgggcatgtccgaccagatcgagaaccggatcatcgaggccaagagccgcggcatctacgaggcgcccggcatggccctgctgcacgccgcctacgagcgcctggtcaacgccatccacaacgaggacaccctcgcccagtaccacaccgaggggcggcgcctgggccggctgatgtacgagggccgctggctggacccgcagtccctgatgatccgcgagtcgctgcagcgctgggtcggctccgcggtcaccggcgaggtcaccctccggctgcggcgcggcgaggactactcgatcctcgacaccaccggcccggccttcagctaccacccggacaagctctccatggagcgcaccgaggactccgcgttcggcccggtggaccggatcggccagctgaccatgcgcaacctggacatcgccgactcccgcgccaagctggagcagtacgccggtctcggtctcatcggcaccgccaaccccgccatcggcgccgcccaggccgccgcgaccgggctgatcggcgccatgccggagggtggcgcgcaggccatcgcctcccgcggcgaggtctccgccgacgacgagctgctggaccgcgccgcgatggagtccggcacggactga

SEQ ID NO: 25332 - protein, 481 aa, Streptomyces coelicolor
MSKVLTSLPTGERVGIAFSGGLDTSVAVAWMRDKGAVPCTYTADIGQYDEPDIASVPDRAKTYGAEVARLVDCRAALVEEGLAALTCGAFHIRSGGRAYFNTTPLGRAVTGTLLVRAMLEDDVQIWGDGSTFKGNDIERFYRYGLLANPQLRIYKPWLDADFVTELGGRKEMSEWLVAHDLPYRDSTEKAYSTDANIWGATHEAKTLEHLDTGVETVEPIMGVRFWDPSVEIAPEDVTIGFDQGRPVTINGKEFASAVDLVMEANAVGGRHGMGMSDQIENRIIEAKSRGIYEAPGMALLHAAYERLVNAIHNEDTLAQYHTEGRRLGRLMYEGRWLDPQSLMIRESLQRWVGSAVTGEVTLRLRRGEDYSILDTTGPAFSYHPDKLSMERTEDSAFGPVDRIGQLTMRNLDIADSRAKLEQYAGLGLIGTANPAIGAAQAAATGLIGAMPEGGAQAIASRGEVSADDELLDRAAMESGTD

SEQ ID NO: 25333 - DNA, 1191 bp, Streptococcus mutans
  CDS (1)..(1191)
atgtcaaaagagaaagttattttagcttattcaggcggacttgatacgtcagttgccattacgtggttaaaaaaagattatgatgttgttgctgtttgtatggatgttggtgaaggtaaagatcttgagtttattcatgataaagcgctgaaagttggagcaattgaatcttatgtcttggatattaaagatgaatttgctgaagaatatgtccttcctgctctgcaggctcatgcttattatgaacaaaaatatccattagtatcagcccttagtcgtccagtgatttctaagaaattggttgaaattgctcatcagacaggagcaactactattgctcatggctgtaccggtaagggaaatgatcaagttcggtttgaagtagctattgcagcacttgatccaaaattaaaagtcattgcacctgttcgggagtggaaatggtcacgggaagaagagattaattatgctaaagaaaatggcgtaccggttccggctgatcttgataatccttactctgttgatcaaaatctttggggccgtgcaaatgaatgcggtgtccttgaaaatccttggaaccaagctccagaagaggcgtttggtatcaccaattcggttgaagaagctccagataaagcagaatacgttgatattacatttaaagaaggcaagcctgttgctcttgatggacaggaaatgaagttggctgatcttattcaaaagcttaatgttcttgctggtaagcatggtgttggtcgaattgatcatgttgaaaatcgtttagttggtattaaatcacgtgaaatttacgaatgtcccggggcagttactcttttaacagctcataaggaaattgaggatataaccttagtgcgtgaggtgtcgcacttcaagccgattcttgaaaatgaattgtcaaatcttatctacaatgctctttggttcaatccagcaacgcaagctattcttgcttatattacggaaacacaaaaagaagttaatggaacagctaaagtgaaattgtacaagggatctgcaagggttgttgctagaaagtcacctcattcactttatgatgaaaatttagcaacctatacatcagctgatagttttgatcaagatgcagccgttggtttcattaaactttggggattaccaacgcaagttaactcacaggtaaacaacaaataa

SEQ ID NO: 25334 - protein, 396 aa, Streptococcus mutans
MSKEKVILAYSGGLDTSVAITWLKKDYDVVAVCMDVGEGKDLEFIHDKALKVGAIESYVLDIKDEFAEEYVLPALQAHAYYEQKYPLVSALSRPVISKKLVEIAHQTGATTIAHGCTGKGNDQVRFEVAIAALDPKLKVIAPVREWKWSREEEINYAKENGVPVPADLDNPYSVDQNLWGRANECGVLENPWNQAPEEAFGITNSVEEAPDKAEYVDITFKEGKPVALDGQEMKLADLIQKLNVLAGKHGVGRIDHVENRLVGIKSREIYECPGAVTLLTAHKEIEDITLVREVSHFKPILENELSNLIYNALWFNPATQAILAYITETQKEVNGTAKVKLYKGSARVVARKSPHSLYDENLATYTSADSFDQDAAVGFIKLWGLPTQVNSQVNNK

SEQ ID NO: 25335 - DNA, 1173 bp, Sulfolobus tokodaii
  CDS (1)..(1173)
atgaaaatagttcttgcatactctggtgggttagatactacagtagcgataagatggctaaaggaaacctttaatgctgacgttatcacagtcacagtagatgtagggcaaaaagataactttgaagacatagaaaaaagagcatatatagcaggagcaacaaaacattatactatagatgcaaaaaaggaatttgctgataatttcatttcttacgcaatcaaaatgaacgcattatatgaggatgtttatccattatcaacagccttagcaagaccattaatagcacaaaaagttgttgaaatagcaaaaaaagaaaaagtagactatattgctcacggttcaacatctaaaggaaatgatcaagtaagattcgacttagcagttaaagcattatatccagaggctaaaatcatagctccagctagaatatggaatatgacaagagagaaagagatagagtttgcaaaagccagagggattcctatcaaaactgaaagcagtaaatatagtattgacgagaacttatggggtagaagtattgaaggtgatgatatttctgatccgtcaaaagaagtcccagaagatgcttttgaatggaccaaaaagaaaaataatggtaaaattactctctccattgaatttgaaaaaggtattccagttgctataaataatgaaaaaatggatttagttaaaattattcaagtgttaaatgaggtagtaggttcttatggttttggaagagtagaacatttagaaaatagagttgtaggttttaaatctagagaagtttatgaagttcctgcagcgttagttttgataaattcacataaagacttagaaaagactgtttattctccgttagagtttagatttaagaaatatatagactcacaatgggctgatttagtttatcaagggctttggtttgaacctttaagagagactatacaattggccggtgataatttaaataaatgggttactggtgaggtaaaaatagaaatagaaggtaatggaatgagaacattaggtagggcttcaaagtactctccattttctgaaaaagttgccagttataataaaggatggtacccaactgatgagatggcaagagggtttattgaaatatatggtatgcattcattactaaccagacaggtgagagaatag

SEQ ID NO: 25336 - protein, 390 aa, Sulfolobus tokodaii
MKIVLAYSGGLDTTVAIRWLKETFNADVITVTVDVGQKDNFEDIEKRAYIAGATKHYTIDAKKEFADNFISYAIKMNALYEDVYPLSTALARPLIAQKVVEIAKKEKVDYIAHGSTSKGNDQVRFDLAVKALYPEAKIIAPARIWNMTREKEIEFAKARGIPIKTESSKYSIDENLWGRSIEGDDISDPSKEVPEDAFEWTKKKNNGKITLSIEFEKGIPVAINNEKMDLVKIIQVLNEVVGSYGFGRVEHLENRVVGFKSREVYEVPAALVLINSHKDLEKTVYSPLEFRFKKYIDSQWADLVYQGLWFEPLRETIQLAGDNLNKWVTGEVKIEIEGNGMRTLGRASKYSPFSEKVASYNKGWYPTDEMARGFIEIYGMHSLLTRQVRE

SEQ ID NO: 25337 - DNA, 1206 bp, Synechococcus elongatus
  CDS (1)..(1206)
atggggcgtgcagaaaaagtcattttggcctactcggggggggtggatacctccgtgtgtattccctatctccagcacgagtggggagtcaaggaagtgattaccctggcagtggatttaggacagggggatgaactggaacccattcgccaaaaggcccttgatgcaggtgccagcgcctcgttagtggctgatgccaaagctgagttcatccgcaactatgcctttccagccattcaagccaacgccctctacgaaaatcgctatcccctctcgacggcccttgctcgccccttgattgccaagctcttagtggaggcggctacccaatacggtgctgatgctgttgcccacggctgtactgggaaagggaatgatcaagtccgctttgatgtggcgattgctgccctcaatcccaatctcaaggtcttagcacccgcgcgtgaatggggcatgagccgtgaagaaaccattgcctacggcgaacgctttggcattcctgctcctgtgaagaaatcttccccctacagcattgaccgcaatcttttgggacgcagtattgaggccggcccccttgaggatccgtggatggaaccccttgaggaggtctattggatgacccaagccattgaacacacccccaactccccggagtatgtggatattggctttgaagcaggggttcccgtcagcctcgatggtcgccccctggatcccgtgacattggtcagtgaactcaacgagcgagtgggtcgccacggctttggccgcattgatatgattgaaaatcgcctagtcggcattaaatcccgtgaaatttacgaagcccctggtctgctggtgctcattgacgcccaccgcgatttggaaagtttgactctgacggctgatgtgatgcactataagcgaggtattgaggagacctacagccgcttggtttataacggcctctggtacagccccctcaaggaagcccttgatgcctttattcaacagacccagcagcgggtcacaggtaccgtgcgcgtcaagctctttaagggaactgcgcgggtggtgggacgacaatctccctactccctttatacgccggatttggccacctatggcgctgaggatcaattcgaccacagggcagccgagggctttatctatgtgtgggggctacccacccgtgtctgggcagaaaaactgcgccaaggctaa

SEQ ID NO: 25338 - protein, 401 aa, Synechococcus elongatus
MGRAEKVILAYSGGVDTSVCIPYLQHEWGVKEVITLAVDLGQGDELEPIRQKALDAGASASLVADAKAEFIRNYAFPAIQANALYENRYPLSTALARPLIAKLLVEAATQYGADAVAHGCTGKGNDQVRFDVAIAALNPNLKVLAPAREWGMSREETIAYGERFGIPAPVKKSSPYSIDRNLLGRSIEAGPLEDPWMEPLEEVYWMTQAIEHTPNSPEYVDIGFEAGVPVSLDGRPLDPVTLVSELNERVGRHGFGRIDMIENRLVGIKSREIYEAPGLLVLIDAHRDLESLTLTADVMHYKRGIEETYSRLVYNGLWYSPLKEALDAFIQQTQQRVTGTVRVKLFKGTARVVGRQSPYSLYTPDLATYGAEDQFDHRAAEGFIYVWGLPTRVWAEKLRQG

SEQ ID NO: 25339 - DNA, 1212 bp, Synechococcus sp
  CDS (1)..(1212)
atgggccgcgccaacaaggtggttctcgcctactccggcggggtggataccagcgtctgcattccctatttgaagcaggaatggggtgttgaagaggtcatcaccttcgccgctgatctcggccagggcgatgagctggaaccgattcgtcaaaaggccctggatgcgggcgcaagtcagtcgttggtgggggatctgattcagcccttcatcgaagagttcgccttccctgccatccgcgctaacgcgctgtacgaggggcgctaccccctctccacagcattggcgcggccgttgatcgctcgccgattggtggaggtggcccgtgaggtgggtgctgatgcagtggcccatggctgcactggcaagggcaacgaccaggtgcgcttcgatgtggcgattgctgctcttgctcccgatctgaaggtgctgacccccgcgagggagtgggggatgagccgtgaggagaccattgcctatggcgagcgctgcggaatcccggcgccggtgagcaagaagtcgccctactcgatcgatctcaaccttctgggtcgcagcatcgaggcgggaccgcttgaagatccgatggtggcgcctccggaggaggtgttcgccatgacctcaccgatgtcggatacgcctgatgcggcggaggagatcgagattgccttcgaagccggcaaccccgtcgccatcaatggccaggttctggatccggtggcgatgatccgcgaagccaaccgtctggcgggcagtcacggcatcggccgtctcgacatgatcgagaaccgggtggtggggattaaatccagggagatctacgaaacaccgggcttgctgctgttgattcaggcccatcaggaactggagagtttgacgttggccgcggatgttctgcgcagcaaacgtcagctggagatgcagtgggctgacctggtgtatcaggggctgtggttcgggccgctgaaggatgcattggacggtttcatggaccggacccagcagcatgtcaacggcgtcgtgcgcctgcgtctgtacaagggcaatgccacggtcatcggccgcggttcaacccagagcagcctgtatgtgcctgcgatggcgtcctacggcagtgaagacgccttcgaccatcgcgccgctgagggattcatctacgtctggggattgccaacccgtctctgggctgcttcccaacggacatcaggctga

SEQ ID NO: 25340 - protein, 403 aa, Synechococcus sp
MGRANKVVLAYSGGVDTSVCIPYLKQEWGVEEVITFAADLGQGDELEPIRQKALDAGASQSLVGDLIQPFIEEFAFPAIRANALYEGRYPLSTALARPLIARRLVEVAREVGADAVAHGCTGKGNDQVRFDVAIAALAPDLKVLTPAREWGMSREETIAYGERCGIPAPVSKKSPYSIDLNLLGRSIEAGPLEDPMVAPPEEVFAMTSPMSDTPDAAEEIEIAFEAGNPVAINGQVLDPVAMIREANRLAGSHGIGRLDMIENRVVGIKSREIYETPGLLLLIQAHQELESLTLAADVLRSKRQLEMQWADLVYQGLWFGPLKDALDGFMDRTQQHVNGVVRLRLYKGNATVIGRGSTQSSLYVPAMASYGSEDAFDHRAAEGFIYVWGLPTRLWAASQRTSG

SEQ ID NO: 25341 - DNA, 1218 bp, Thermoplasma acidophilum
  CDS (1)..(1218)
atgttcgccatggacaaggcgcttcttctgtattcaggtggacttgatacatcggtcatgatcaaatggatccaggaaaatctgtcgatggatgttgctacgctcacgctcaacgtgggcaacagcgatctggttgccatagaggaaaaggcaaggatgctcggggctgatcctgtcttcgtccacgatgcaaaggatgagtttgctgaaaaattcatagcgaagtcaataatggcaaacgggagctatgaaggctacccgctttcaacagctctcgcaaggccgcttatggctgaaaaggcggtgaaatatgcacagaagatcggtgcaaaatacatcgttcatggatccacgggaaggggcaacgatcaggtcaggtttgaggtatccatcagggcccttgacccgtcaatgcaggttcttgtacccgtacgcgaatggaacatgatgcgaaaggatgaggttgagtatgcaaaaacgcacggaataccggtaaagctcgatggcaagtactcaatagatgagaatatatggggaaggtctgttgaaggcccggatcttgaagatatcggcaagggcgtacctgaggatgtctatgaatgggttgtgcctccatggaaggctaatgcggaacatacactaaaaattgcattcgatggtggcataccgagtgaaattgatggtgaaaaaatgaaactcgcggatctcatagtttttcttaacaccttggcaggatcgagcggcataggcctcatcgatcacatggagaacagggttgttggcctcaagagccatgaggtttacgaatgcccggcagcaacggtgatcacccatgcgcacaggtatctcgaatcgctgatacttaacaggaacgaggccgaggtcaagatgaacatggactggcagttcgcgaagtttgtctacggtgggctatggcatgatcctgttatgaacgctgtgaatgcggctgaggccgaattcaacagggacatcagcggcgagatcaagatcaggatgtcccacggcataatgtacatagaaggtgcatgggggaacagcttcctttacagcaaggatctgatcaactacagttcaatggcctttgatcagagggcgtccaagggcttcatagatatatacggaaatgccacggtgcattctcacaacaggaatccgaagatggtaaaggaggtgcagggttcttcggtcgaattctga

SEQ ID NO: 25342 - protein, 405 aa, Thermoplasma acidophilum
MFAMDKALLLYSGGLDTSVMIKWIQENLSMDVATLTLNVGNSDLVAIEEKARMLGADPVFVHDAKDEFAEKFIAKSIMANGSYEGYPLSTALARPLMAEKAVKYAQKIGAKYIVHGSTGRGNDQVRFEVSIRALDPSMQVLVPVREWNMMRKDEVEYAKTHGIPVKLDGKYSIDENIWGRSVEGPDLEDIGKGVPEDVYEWVVPPWKANAEHTLKIAFDGGIPSEIDGEKMKLADLIVFLNTLAGSSGIGLIDHMENRVVGLKSHEVYECPAATVITHAHRYLESLILNRNEAEVKMNMDWQFAKFVYGGLWHDPVMNAVNAAEAEFNRDISGEIKIRMSHGIMYIEGAWGNSFLYSKDLINYSSMAFDQRASKGFIDIYGNATVHSHNRNPKMVKEVQGSSVEF

SEQ ID NO: 25343 - DNA, 1203 bp, Thermus thermophilus
  CDS (1)..(1203)
atgaagatcgtcttggcctactccggcggactggacaccagcatcatcctgaagtggctcaaggagacctatggggccgaggtcatcgcctttaccgcggacatcggccagggggaggaggtggaggaggcccgggagaaggcgctgaggacgggggcttccaaggccatcgccctggacctcaaggaggagtttgtccgcgacttcgtcttccccatgatgcgggctggcgcggtgtacgagggctactacctcctcggcacctccatcgcgaggcctttgatcgccaagcacctggtgcggatcgccgaggaggagggggcggaggccatcgcccacggggccacggggaaggggaacgaccaggtgcgctttgagctcaccgcctacgccctgaagcccgacatcaaggtcatcgccccctggcgggagtggagcttccagggccgcaaggagatgatcgcctacgccgaggcccacggcatccccgtccccgtgacccaggagaagccttactccatggacgccaacctcttgcatatttcctacgagggcggggtcctcgaggacccctgggccgagccccccaaggggatgttccgcatgacccaagaccccgaggaggcccccgacgccccggagtacgtggaggtggagttttttgagggcgaccccgtggcggtgaacggggagaggctttccccggcggccctcctgcagaggctcaacgagctcggggggcggcacggggtgggccgggtggacatcgtggagaaccgcttcgtgggcatgaagtcccggggggtctacgagaccccgggggggacgatcctctaccacgccaggcgggcggtggaaagcctcaccctggaccgcgaggtcctccaccaaagggacatgctctcccccaagtacgccgagctcgtctactacggcttctggtacgccccggagcgggaggcccttcaggcctactttgaccacgtggcgaagaacgtcaccggcgtggcccggctcaagctctacaaggggaacgtctacgtggtgggaaggaaggccccgaagagcctctaccgccaggacctggtctcctttgacgaggcagggggctacgaccagaaggacgccgagggcttcatcaagatccaggccctgcgcctccgggtgcgggcccttgtggagagggagggccatggcgcatag

SEQ ID NO: 25344 - protein, 400 aa, Thermus thermophilus
MKIVLAYSGGLDTSIILKWLKETYGAEVIAFTADIGQGEEVEEAREKALRTGASKAIALDLKEEFVRDFVFPMMRAGAVYEGYYLLGTSIARPLIAKHLVRIAEEEGAEAIAHGATGKGNDQVRFELTAYALKPDIKVIAPWREWSFQGRKEMIAYAEAHGIPVPVTQEKPYSMDANLLHISYEGGVLEDPWAEPPKGMFRMTQDPEEAPDAPEYVEVEFFEGDPVAVNGERLSPAALLQRLNELGGRHGVGRVDIVENRFVGMKSRGVYETPGGTILYHARRAVESLTLDREVLHQRDMLSPKYAELVYYGFWYAPEREALQAYFDHVAKNVTGVARLKLYKGNVYVVGRKAPKSLYRQDLVSFDEAGGYDQKDAEGFIKIQALRLRVRALVEREGHGA

SEQ ID NO: 25345 - DNA, 1233 bp, Thermoanaerobacter tengcongensis
  CDS (1)..(1233)
atgttaaaaggtgaaaaagtggtactggcatattcgggaggacttgacacctcagtgattataccatggttaaaagaaaattatgaatgtgaaataatagcggtatgcgtggatgtagggcaaagggaagacctaaggtatataaaagataaagctttagcaagtggtgccagcaaagtatatattgaagatgtcaaagaggagtttgtaaaagactatatatttcctacattaaaagcgggggctatatatgaaggaaaataccttctgggaacttcaatggcaaggcctttaattgccaaaaaacttgtagaaattgctcacaaggaaggtgccaaggcgatagcccatggtgcgacaggcaaaggcaatgaccaggtgaggtttgaagtttcaatacgtgctcttgatccttcaataaaaataatagcaccatggagaatatgggaattaaaatcgagggaagatgaaatagaatatgctaaaaagaaaggaatacctattcctgtaactaaagaaaaaatatacagtgtagacagcaatctgtggcatgtgagtcatgagggaggagaccttgaagacccgtggaatgagcctaaaagtgatatttacgatatagttactcctccagagaaagtctcagataagccggaatatgtctatatagagtttgaaaagggcattcctgtaaaggtaaatggaaaaacgctaagccctgtcaaattaatagaagaattaaatgaaattggaggaagaaatggggtagggatagttgaccttgttgaaaatagacttgtaggaatgaaatctcgtggtgtttacgagactcctgcaggaacgttactttatattgctcacagagaacttgagtaccttgtacttgataaagaaacgatgaggtttaaagagttggtagcacagaaatatgcggatctggtctataacggcctctggttttcacctctcaaaacagctttggatgcttttattgatgagacgcagaaaaatgtaacgggtgttgtaaggctaaagctttataaaggaaatgtcataaatgcgggtgcaaaatctccctattctctttacaacgaagaattcgcaacttttggtaaagatgaagtttacaaccaaaaagacgcagaaggatttataaacctctttgggctttctttaaaaattagggctttgatggaaatgggaaggaaggatatggatgaagctgtggggaggtag

SEQ ID NO: 25346 - protein, 410 aa, Thermoanaerobacter tengcongensis
MLKGEKVVLAYSGGLDTSVIIPWLKENYECEIIAVCVDVGQREDLRYIKDKALASGASKVYIEDVKEEFVKDYIFPTLKAGAIYEGKYLLGTSMARPLIAKKLVEIAHKEGAKAIAHGATGKGNDQVRFEVSIRALDPSIKIIAPWRIWELKSREDEIEYAKKKGIPIPVTKEKIYSVDSNLWHVSHEGGDLEDPWNEPKSDIYDIVTPPEKVSDKPEYVYIEFEKGIPVKVNGKTLSPVKLIEELNEIGGRNGVGIVDLVENRLVGMKSRGVYETPAGTLLYIAHRELEYLVLDKETMRFKELVAQKYADLVYNGLWFSPLKTALDAFIDETQKNVTGVVRLKLYKGNVINAGAKSPYSLYNEEFATFGKDEVYNQKDAEGFINLFGLSLKIRALMEMGRKDMDEAVGR

SEQ ID NO: 25347 - DNA, 1212 bp, Vibrio vulnificus
  CDS (1)..(1212)
atgagcaaattaaatgtcaataaagtggttgtcgcttactcaggcggtttggatacgtcagtgatcattccttggttaaaagagaactacgattgtgaagtggtggcctttgttgctgatgtgggtcagggcgaagaagagcttgtcggtattgaagagaaagccaaagcttctggtgcctcagaatgttatgtcgtcgatctgaaagaagaattggtcgctgactacatctacccaacactgaaaacgggcgcttactacgaaggcaaatacctcttggggacgtctatggcgcgtccggtgattgccaaagcacaagttgaaattgcccgtaaagtgggggctgatgcattgtgtcacggctgtactggtaaagggaatgaccaagtgcgttttgaaggtgccttcgccgcattggcccctgatctgaaagtgattgcgccttggcgtgaatgggatcttgtgagtcgtgagcagtgtttagactacttggctgagcgcaacattccttgtgctgcctcgttgaccaaaatctattctcgtgacgcgaatgcgtggcatatctctactgagggtggcgtactagaaagtacctggaatgcaccgaatgaagattgctgggtatggaccgtcgatccagagcaagcgccgaatgaagcggaatacgttaccctgcaagttgaaaaaggtgaagttgtggcggtggatggtgagcaaatgacgccgtacaacgcgctggtttacttgaatgaaaaaggggcgaaacacggtgttggtcgtatcgacattgtagaaaaccgtctagttggcatgaagtctcgtggttgttatgaaaccccagggggcaccatcatgatggaagcgctgcgtgcggttgagcagttggtgctggacaaaacctcttttgagttccgtgaagaactgggtttaaaagcgtctcaccttgtctatgatggtcgctggttcacaccactgcgtaaatcgatcatggctgcggcagatgaattggcgcaggatgtcaatggtgaagtcgtggtgaagctgtataaaggcatggcaacagtgacacagaaacgctctgaaaatagcttgtattccgaagcgtttgcaacctttggtgaagatgaagtgtacgatcaaagccacgcaggcggctttattcgcctttactcactttctagccgaattcgcgcactcaatagccagaaataa

SEQ ID NO: 25348 - protein, 403 aa, Vibrio vulnificus
MSKLNVNKVVVAYSGGLDTSVIIPWLKENYDCEVVAFVADVGQGEEELVGIEEKAKASGASECYVVDLKEELVADYIYPTLKTGAYYEGKYLLGTSMARPVIAKAQVEIARKVGADALCHGCTGKGNDQVRFEGAFAALAPDLKVIAPWREWDLVSREQCLDYLAERNIPCAASLTKIYSRDANAWHISTEGGVLESTWNAPNEDCWVWTVDPEQAPNEAEYVTLQVEKGEVVAVDGEQMTPYNALVYLNEKGAKHGVGRIDIVENRLVGMKSRGCYETPGGTIMMEALRAVEQLVLDKTSFEFREELGLKASHLVYDGRWFTPLRKSIMAAADELAQDVNGEVVVKLYKGMATVTQKRSENSLYSEAFATFGEDEVYDQSHAGGFIRLYSLSSRIRALNSQK

SEQ ID NO: 25349 - DNA, 1215 bp, Wolinella succinogenes
  CDS (1)..(1215)
atgtccaaaaaaatcaacaaaatcgtccttgcctattcgggaggtcttgacaccagcgtcatcttgaaatggcttcaagagcagtatcagtgtgaagtggtcaccttcacggcggatatcggtcaaggcgaagaggtcgagcctgcacgcgccaaagcgaaacttcttggaatcaaagaggagaacattttcatcaaagatctcaaagaggaatttgtccgcgactatgtttttcccatgtttcgagccaataccctttatgaaggcgaataccttctaggtacctctatcgctagaccccttatcgccaagcacctcgtggagatcgccaaagaggtcggagcggatgccatctctcatggcgccacaggcaaaggaaacgaccaagtgcgatttgagcttggaggctatgcgctcatgcccgatgtcaaagtggtcgccccctggagagagtgggatctaaactctcgtgaaaaactcctcgcctacgccgaaaaacatgggattcccatcgagaaaaagggcaaaaaatctccctactctatggacgccaacctcctgcatatctcctatgaagggggaatcctcgaagatcccgccagcgaacctgaggaggatatgtggagatggagcgtctctcctttggacgcacccgatgctccagagaggatcaccattgagtttgaaaggggcgatgccgtagggattaatggcgtgaaaatgtctcccgccaccctcctagccgagctcaatcgcctaggaggcaaacatggaatcgggcggcttgatcttgtggagaatcgctatgtcggaatgaaatctcgcggatgctatgaaactcccggaggcacgattcttctcaaagctcaccgcgccatcgaatcgctaaccctagatcgagaagagactcacctcaaagatgagatgatgccacgctacgctagcctcatctacaatggctactggttctctcctgagcgccgcgccctccaagccctcatcgatgagacacaaaaaaatgtcacgggcagcgttgggctcaaactctataagggcaatgtcatccttgcgggccgcacctccgagcgatcgctcttcaacaccgcctactccacctttgaagaggatagcgtctataaccaaaaagatgccgaaggcttcatcaagctcaacgctctacgcttcatcatcgcaggcaaggcgaatccatcatga

SEQ ID NO: 25350 - protein, 404 aa, Wolinella succinogenes
MSKKINKIVLAYSGGLDTSVILKWLQEQYQCEVVTFTADIGQGEEVEPARAKAKLLGIKEENIFIKDLKEEFVRDYVFPMFRANTLYEGEYLLGTSIARPLIAKHLVEIAKEVGADAISHGATGKGNDQVRFELGGYALMPDVKVVAPWREWDLNSREKLLAYAEKHGIPIEKKGKKSPYSMDANLLHISYEGGILEDPASEPEEDMWRWSVSPLDAPDAPERITIEFERGDAVGINGVKMSPATLLAELNRLGGKHGIGRLDLVENRYVGMKSRGCYETPGGTILLKAHRAIESLTLDREETHLKDEMMPRYASLIYNGYWFSPERRALQALIDETQKNVTGSVGLKLYKGNVILAGRTSERSLFNTAYSTFEEDSVYNQKDAEGFIKLNALRFIIAGKANPS

SEQ ID NO: 25351 - DNA, 1194 bp, Xanthomonas campestris
  CDS (1)..(1194)
atgagcagcaaagatatcgtcctcgctttctccggtggcctcgacaccagcttctgcattccgtacctgcaggagcgcggctatgccgtgcacaccgtgttcgccgataccggcggtgtggatgccgaagaacgcgatttcatcgagaagcgcgccgccgagctgggcgcagccagccatgtcaccgtcgatggcggcccggcgatctgggaaggcttcgtcaagccgttcgtgtgggccggcgagggctaccagggccagtacccgttgctggtgtccgaccgttacctgatcgtcgatgctgcgctcaagcgcgccgaagaactgggcacgcggatcatcgcgcacggctgcaccggcatgggcaacgatcaggtgcgtttcgacctggcggtaaaggcgctgggcgactaccagattgtggcgccgattcgcgagatccagaaagaacacacccagacccgcgcctacgagcaaaagtacctggaagagcgcggcttcggcgtgcgtgccaagcagaaggcctacaccatcaacgagaacctgttgggcgtgaccatgtccggcggcgagatcgatcgctgggaagcaccgggcgaaggcgcacgcggctggtgtgcaccgcgtagcgcgtggccgaccgaagcgttgacggtgacgctgaagtttgtcgaaggcgaggccgtggcgctggacggcaaggccctgccaggtgcgcagatcctggccaagctcaacaccttgttcgcgcagtacggcgtgggccgtggcgtgtacaccggcgacaccgtgatcggcctgaagggccgcatcgtgttcgaagcgccgggcctgatctcgctgctcaccgcgcaccgtgcgctggaagacgcggtgctgaccaagcagcagaaccgcttcaagccggacgtggcgcgcaagtgggtggagctggtgtacgagggcttctaccacgacccgctcaagaccgatatcgaggcgttcctgaagtcgtcgcagtccaaggtcaatggcgaagtcacgctggaaactcgcggtggccgcgtcgatgcggtggcggtgcgttcgccgcacctgctcaacgccaagggcgcgacctacgcccagtcggccgactggggcgtggaagaggccgaggggttcatcaagctgttcggcatgagctccacgctgtatgcgcaggtcaaccgctga

SEQ ID NO: 25352 - protein, 397 aa, Xanthomonas campestris
MSSKDIVLAFSGGLDTSFCIPYLQERGYAVHTVFADTGGVDAEERDFIEKRAAELGAASHVTVDGGPAIWEGFVKPFVWAGEGYQGQYPLLVSDRYLIVDAALKRAEELGTRIIAHGCTGMGNDQVRFDLAVKALGDYQIVAPIREIQKEHTQTRAYEQKYLEERGFGVRAKQKAYTINENLLGVTMSGGEIDRWEAPGEGARGWCAPRSAWPTEALTVTLKFVEGEAVALDGKALPGAQILAKLNTLFAQYGVGRGVYTGDTVIGLKGRIVFEAPGLISLLTAHRALEDAVLTKQQNRFKPDVARKWVELVYEGFYHDPLKTDIEAFLKSSQSKVNGEVTLETRGGRVDAVAVRSPHLLNAKGATYAQSADWGVEEAEGFIKLFGMSSTLYAQVNR

SEQ ID NO: 25353 - DNA, 1206 bp, Xylella fastidiosa
  CDS (1)..(1206)
atgagtaataaaaacattgtcttggccttctccggtggactcgacaccagcttttgcatcccctacctgaaagaacagggctatgccgtacacaccgtatttgccgacaccggcggtgttgacgaagatgagcgcgacttcattgaaaaacgtgctgccgaattaggcgtagctagccacctcaccgtggatggcggccctgccatctgggatggtttcgtaaaacagcttgtctgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctgtacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaatttgttgaaggcgaagccgtcgccgtagatggaaaacccctttccggccctcagattctgatgaaactcaacaaactcttcgcctcctatggcgtggggcgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccccacatagcccgtaaatgggttgaactggtgtacgaaggatttttccatgaccccttgaagaccgacctagagaccttcttaaaatcctcccaagccaacgtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgctcatgtaaatcgttccctgcgctcatga

SEQ ID NO: 25354 - protein, 401 aa, Xylella fastidiosa
MSNKNIVLAFSGGLDTSFCIPYLKEQGYAVHTVFADTGGVDEDERDFIEKRAAELGVASHLTVDGGPAIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAHVNRSLRS

SEQ ID NO: 25355 - DNA, 24 bp, Primer
atgacgacgattctcaagcatctc

SEQ ID NO: 25356 - DNA, 25 bp, Primer
ttactggcctttgttttccagattc

SEQ ID NO: 25357 - DNA, 2063 bp, Saccharomyces cerevisiae; identical to SEQ ID NO: 16128
  CDS (301)..(1872)

SEQ ID NO: 25358 - protein, 523 aa, Saccharomyces cerevisiae; identical to SEQ ID NO: 16129

SEQ ID NO: 25359 - DNA, 27 bp, Primer
atgtaccaaaataatgtattgaatgct

SEQ ID NO: 25360 - DNA, 25 bp, Primer
tcaatagtgcattaactctcccatt

SEQ ID NO: 25361 - DNA, 432 bp, Saccharomyces cerevisiae; identical to SEQ ID NO: 6880
  CDS (1)..(432)

SEQ ID NO: 25362 - protein, 143 aa, Saccharomyces cerevisiae; identical to SEQ ID NO: 6881

SEQ ID NO: 25363 - DNA, 309 bp, Arabidopsis thaliana (mouse-ear cress); identical to SEQ ID NO: 6882
  CDS (1)..(309)

SEQ ID NO: 25364 - protein, 102 aa, Arabidopsis thaliana (mouse-ear cress); identical to SEQ ID NO: 6883

SEQ ID NO: 25365 - DNA, 501 bp, Brucella melitensis; identical to SEQ ID NO: 6884
  CDS (28)..(306)

SEQ ID NO: 25366 - protein, 92 aa, Brucella melitensis; identical to SEQ ID NO: 6885

SEQ ID NO: 25367 - DNA, 324 bp, Nostoc sp. PCC 7120; identical to SEQ ID NO: 6886
  CDS (1)..(324)

SEQ ID NO: 25368 - protein, 107 aa, Nostoc sp. PCC 7120; identical to SEQ ID NO: 6887

SEQ ID NO: 25369 - DNA, 309 bp, Arabidopsis thaliana (mouse-ear cress); identical to SEQ ID NO: 6888
  CDS (1)..(309)

SEQ ID NO: 25370 - protein, 102 aa, Arabidopsis thaliana (mouse-ear cress); identical to SEQ ID NO: 6889

SEQ ID NO: 25371 - DNA, 540 bp, Arabidopsis thaliana (mouse-ear cress); identical to SEQ ID NO: 6890
  CDS (1)..(540)

SEQ ID NO: 25372 - protein, 179 aa, Arabidopsis thaliana (mouse-ear cress); identical to SEQ ID NO: 6891

SEQ ID NO: 25373 - DNA, 327 bp, vaccinia virus; identical to SEQ ID NO: 6892
  CDS (1)..(327)

SEQ ID NO: 25374 - protein, 108 aa, vaccinia virus; identical to SEQ ID NO: 6893

SEQ ID NO: 25375 - DNA, 312 bp, Arabidopsis thaliana (mouse-ear cress); identical to SEQ ID NO: 6894
  CDS (1)..(312)

SEQ ID NO: 25376 - protein, 103 aa, Arabidopsis thaliana (mouse-ear cress); identical to SEQ ID NO: 6895

SEQ ID NO: 25377 - DNA, 309 bp, Arabidopsis thaliana (mouse-ear cress); identical to SEQ ID NO: 6896
  CDS (1)..(309)

SEQ ID NO: 25378 - protein, 102 aa, Arabidopsis thaliana (mouse-ear cress); identical to SEQ ID NO: 6897

SEQ ID NO: 25379 - DNA, 309 bp, Arabidopsis thaliana (mouse-ear cress); identical to SEQ ID NO: 6898
  CDS (1)..(309)

SEQ ID NO: 25380 - protein, 102 aa, Arabidopsis thaliana (mouse-ear cress); identical to SEQ ID NO: 6899

SEQ ID NO: 25381 - DNA, 393 bp, Arabidopsis thaliana (mouse-ear cress); identical to SEQ ID NO: 6900
  CDS (1)..(393)

SEQ ID NO: 25382 - protein, 130 aa, Arabidopsis thaliana (mouse-ear cress); identical to SEQ ID NO: 6901

SEQ ID NO: 25383 - DNA, 589 bp, Bos primigenius taurus (cattle); identical to SEQ ID NO: 6902
  CDS (36)..(356)

SEQ ID NO: 25384 - protein, 106 aa, Bos primigenius taurus (cattle); identical to SEQ ID NO: 6903

SEQ ID NO: 25385 - DNA, 309 bp, Arabidopsis thaliana (mouse-ear cress); identical to SEQ ID NO: 6904
  CDS (1)..(309)

SEQ ID NO: 25386 - protein, 102 aa, Arabidopsis thaliana (mouse-ear cress); identical to SEQ ID NO: 6905

SEQ ID NO: 25387 - DNA, 309 bp, Arabidopsis thaliana (mouse-ear cress); identical to SEQ ID NO: 6906
  CDS (1)..(309)

SEQ ID NO: 25388 - protein, 102 aa, Arabidopsis thaliana (mouse-ear cress); identical to SEQ ID NO: 6907

SEQ ID NO: 25389 - DNA, 575 bp, Oryza sativa (rice); identical to SEQ ID NO: 6908
  CDS (45)..(383)

SEQ ID NO: 25390 - protein, 112 aa, Oryza sativa (rice); identical to SEQ ID NO: 6909

SEQ ID NO: 25391 - DNA, 333 bp, Saccharomyces cerevisiae; identical to SEQ ID NO: 6910
  CDS (1)..(333)

SEQ ID NO: 25392 - protein, 110 aa, Saccharomyces cerevisiae; identical to SEQ ID NO: 6911

SEQ ID NO: 25393 - DNA, 612 bp, Saccharomyces cerevisiae; identical to SEQ ID NO: 6912
  CDS (1)..(612)

SEQ ID NO: 25394 - protein, 203 aa, Saccharomyces cerevisiae; identical to SEQ ID NO: 6913

SEQ ID NO: 25395 - DNA, 321 bp, Homo sapiens (man); identical to SEQ ID NO: 6914
  CDS (1)..(321)

SEQ ID NO: 25396 - protein, 106 aa, Homo sapiens (man); identical to SEQ ID NO: 6915

SEQ ID NO: 25397 - DNA, 583 bp, Ricinus communis (castor bean); identical to SEQ ID NO: 6916
  CDS (44)..(352)

SEQ ID NO: 25398 - protein, 102 aa, Ricinus communis (castor bean); identical to SEQ ID NO: 6917

SEQ ID NO: 25399 - DNA, 531 bp, Arabidopsis thaliana (mouse-ear cress); identical to SEQ ID NO: 6918
  CDS (1)..(531)

SEQ ID NO: 25400 - protein, 176 aa, Arabidopsis thaliana (mouse-ear cress); identical to SEQ ID NO: 6919

SEQ ID NO: 25401 - DNA, 698 bp, Mesembryanthemum crystallinum (common ice plant); identical to SEQ ID NO: 6920
  CDS (60)..(464)

SEQ ID NO: 25402 - protein, 134 aa, Mesembryanthemum crystallinum (common ice plant); identical to SEQ ID NO: 6921

SEQ ID NO: 25403 - DNA, 441 bp, Caenorhabditis elegans; identical to SEQ ID NO: 6922
  CDS (1)..(441)

SEQ ID NO: 25404 - protein, 146 aa, Caenorhabditis elegans; identical to SEQ ID NO: 6923

SEQ ID NO: 25405 - DNA, 361 bp, Schizosaccharomyces pombe; identical to SEQ ID NO: 6924
  CDS (24)..(329)

SEQ ID NO: 25406 - protein, 101 aa, Schizosaccharomyces pombe; identical to SEQ ID NO: 6925

SEQ ID NO: 25407 - DNA, 501 bp, Schizosaccharomyces pombe; identical to SEQ ID NO: 6926
  CDS (1)..(501)

SEQ ID NO: 25408 - protein, 166 aa, Schizosaccharomyces pombe; identical to SEQ ID NO: 6927

SEQ ID NO: 25409 - DNA, 309 bp, Arabidopsis thaliana (mouse-ear cress); identical to SEQ ID NO: 6928
  CDS (1)..(309)

SEQ ID NO: 25410 - protein, 102 aa, Arabidopsis thaliana (mouse-ear cress); identical to SEQ ID NO: 6929

SEQ ID NO: 25411 - DNA, 312 bp, Arabidopsis thaliana (mouse-ear cress); identical to SEQ ID NO: 6930
  CDS (1)..(312)

SEQ ID NO: 25412 - protein, 103 aa, Arabidopsis thaliana (mouse-ear cress); identical to SEQ ID NO: 6931

SEQ ID NO: 25413 - DNA, 391 bp, Arabidopsis thaliana (mouse-ear cress); identical to SEQ ID NO: 6932
  CDS (33)..(341)

SEQ ID NO: 25414 - protein, 102 aa, Arabidopsis thaliana (mouse-ear cress); identical to SEQ ID NO: 6933

SEQ ID NO: 25415 - DNA, 330 bp, Neurospora crassa; identical to SEQ ID NO: 6934
  CDS (1)..(330)

SEQ ID NO: 25416 - protein, 109 aa, Neurospora crassa; identical to SEQ ID NO: 6935

SEQ ID NO: 25417 - DNA, 533 bp, Fritillaria agrestis; identical to SEQ ID NO: 6936
  CDS (39)..(353)

SEQ ID NO: 25418 - protein, 104 aa, Fritillaria agrestis; identical to SEQ ID NO: 6937

SEQ ID NO: 25419 - DNA, 330 bp, Plasmodium yoelii yoelii; identical to SEQ ID NO: 6938
  CDS (1)..(330): m means a or c

SEQ ID NO: 25420 - protein, 109 aa, Plasmodium yoelii yoelii; identical to SEQ ID NO: 6939
  misc_feature (54)..(54): Xaa can be Asn or His

SEQ ID NO: 25421 - DNA, 294 bp, Bordetella bronchiseptica; identical to SEQ ID NO: 6940
  CDS (1)..(294)

SEQ ID NO: 25422 - protein, 97 aa, Bordetella bronchiseptica; identical to SEQ ID NO: 6941

SEQ ID NO: 25423 - DNA, 342 bp, Triticum aestivum; identical to SEQ ID NO: 6942
  CDS (1)..(342)

SEQ ID NO: 25424 - protein, 113 aa, Triticum aestivum; identical to SEQ ID NO: 6943

SEQ ID NO: 25425 - DNA, 324 bp, Aphelenchus avenae; identical to SEQ ID NO: 6944
  CDS (1)..(324)

SEQ ID NO: 25426 - protein, 107 aa, Aphelenchus avenae; identical to SEQ ID NO: 6945

SEQ ID NO: 25427 - DNA, 327 bp, Cowpox virus; identical to SEQ ID NO: 6946
  CDS (1)..(327)

SEQ ID NO: 25428 - protein, 108 aa, Cowpox virus; identical to SEQ ID NO: 6947

SEQ ID NO: 25429 - DNA, 495 bp, Oryza sativa; identical to SEQ ID NO: 6948
  CDS (1)..(495)

SEQ ID NO: 25430 - protein, 164 aa, Oryza sativa; identical to SEQ ID NO: 6949

SEQ ID NO: 25431 - DNA, 270 bp, Vibrio vulnificus; identical to SEQ ID NO: 6950
  CDS (1)..(270)

SEQ ID NO: 25432 - protein, 89 aa, Vibrio vulnificus; identical to SEQ ID NO: 6951

SEQ ID NO: 25433 - DNA, 525 bp, Arabidopsis thaliana; identical to SEQ ID NO: 6952
  CDS (1)..(525)

SEQ ID NO: 25434 - protein, 174 aa, Arabidopsis thaliana; identical to SEQ ID NO: 6953

SEQ ID NO: 25435 - DNA, 608 bp, Arabidopsis thaliana; identical to SEQ ID NO: 6954
  CDS (68)..(445)

SEQ ID NO: 25436 - protein, 125 aa, Arabidopsis thaliana; identical to SEQ ID NO: 6955

SEQ ID NO: 25437 - DNA, 340 bp, Arabidopsis thaliana; identical to SEQ ID NO: 6956
  CDS (1)..(309)

SEQ ID NO: 25438 - protein, 102 aa, Arabidopsis thaliana; identical to SEQ ID NO: 6957

SEQ ID NO: 25439 - DNA, 618 bp, Arabidopsis thaliana; identical to SEQ ID NO: 6958
  CDS (54)..(461)

SEQ ID NO: 25440 - protein, 135 aa, Arabidopsis thaliana; identical to SEQ ID NO: 6959

SEQ ID NO: 25441 - DNA, 420 bp, Populus tremula x Populus tremuloides; identical to SEQ ID NO: 6960
  CDS (1)..(420)

SEQ ID NO: 25442 - protein, 139 aa, Populus tremula x Populus tremuloides; identical to SEQ ID NO: 6961

SEQ ID NO: 25443 - DNA, 664 bp, Mus musculus; identical to SEQ ID NO: 6962
  CDS (37)..(507)

SEQ ID NO: 25444 - protein, 156 aa, Mus musculus; identical to SEQ ID NO: 6963

SEQ ID NO: 25445 - DNA, 508 bp, Tilia platyphyllos; identical to SEQ ID NO: 6964
  CDS (28)..(375)

SEQ ID NO: 25446 - protein, 115 aa, Tilia platyphyllos; identical to SEQ ID NO: 6965

SEQ ID NO: 25447 - DNA, 604 bp, Deschampsia antarctica; identical to SEQ ID NO: 6966
  CDS (85)..(426)

SEQ ID NO: 25448 - protein, 113 aa, Deschampsia antarctica; identical to SEQ ID NO: 6967

SEQ ID NO: 25449 - DNA, 327 bp, Plasmodium berghei; identical to SEQ ID NO: 6968
  CDS (1)..(327)

SEQ ID NO: 25450 - protein, 108 aa, Plasmodium berghei; identical to SEQ ID NO: 6969

SEQ ID NO: 25451 - DNA, 498 bp, Homo sapiens; identical to SEQ ID NO: 6970
  CDS (1)..(498)

SEQ ID NO: 25452 - protein, 165 aa, Homo sapiens; identical to SEQ ID NO: 6971

SEQ ID NO: 25453 - DNA, 456 bp, Theileria parva; identical to SEQ ID NO: 6972
  CDS (1)..(456)

SEQ ID NO: 25454 - protein, 151 aa, Theileria parva; identical to SEQ ID NO: 6973

SEQ ID NO: 25455 - DNA, 336 bp, Arabidopsis thaliana; identical to SEQ ID NO: 6974
  CDS (1)..(336)

SEQ ID NO: 25456 - protein, 111 aa, Arabidopsis thaliana; identical to SEQ ID NO: 6975

SEQ ID NO: 25457 - DNA, 383 bp, Mus musculus; identical to SEQ ID NO: 6976
  CDS (15)..(383)

SEQ ID NO: 25458 - protein, 122 aa, Mus musculus; identical to SEQ ID NO: 6977

SEQ ID NO: 25459 - DNA, 318 bp, Caenorhabditis elegans; identical to SEQ ID NO: 6978
  CDS (1)..(318)

SEQ ID NO: 25460 - protein, 105 aa, Caenorhabditis elegans; identical to SEQ ID NO: 6979

SEQ ID NO: 25461 - DNA, 324 bp, Trypanosoma brucei; identical to SEQ ID NO: 6980
  CDS (1)..(324)

SEQ ID NO: 25462 - protein, 107 aa, Trypanosoma brucei; identical to SEQ ID NO: 6981

SEQ ID NO: 25463 - DNA, 336 bp, Plasmodium falciparum; identical to SEQ ID NO: 6982
  CDS (1)..(336)

SEQ ID NO: 25464 - protein, 111 aa, Plasmodium falciparum; identical to SEQ ID NO: 6983

SEQ ID NO: 25465 - DNA, 654 bp, Homo sapiens; identical to SEQ ID NO: 6984
  CDS (11)..(505)

SEQ ID NO: 25466 - protein, 164 aa, Homo sapiens; identical to SEQ ID NO: 6985

SEQ ID NO: 25467 - DNA, 478 bp, Drosophila melanogaster; identical to SEQ ID NO: 6986
  CDS (48)..(392)

SEQ ID NO: 25468 - protein, 114 aa, Drosophila melanogaster; identical to SEQ ID NO: 6987

SEQ ID NO: 25469 - DNA, 351 bp, Drosophila melanogaster; identical to SEQ ID NO: 6988
  CDS (1)..(351)

SEQ ID NO: 25470 - protein, 116 aa, Drosophila melanogaster; identical to SEQ ID NO: 6989

SEQ ID NO: 25471 - DNA, 644 bp, Homo sapiens; identical to SEQ ID NO: 6990
  CDS (26)..(481)

SEQ ID NO: 25472 - protein, 151 aa, Homo sapiens; identical to SEQ ID NO: 6991

SEQ ID NO: 25473 - DNA, 572 bp, Gallus gallus; identical to SEQ ID NO: 6992
  CDS (47)..(352)

SEQ ID NO: 25474 - protein, 101 aa, Gallus gallus; identical to SEQ ID NO: 6993

SEQ ID NO: 25475 - DNA, 321 bp, Homo sapiens; identical to SEQ ID NO: 6994
  CDS (1)..(321)

SEQ ID NO: 25476 - protein, 106 aa, Homo sapiens; identical to SEQ ID NO: 6915

SEQ ID NO: 25477 - DNA, 531 bp, Lycopersicon esculentum; identical to SEQ ID NO: 6996
  CDS (45)..(371)

SEQ ID NO: 25478 - protein, 108 aa, Lycopersicon esculentum; identical to SEQ ID NO: 6997

SEQ ID NO: 25479 - DNA, 473 bp, Mus musculus; identical to SEQ ID NO: 6998
  CDS (9)..(332)

SEQ ID NO: 25480 - protein, 107 aa, Mus musculus; identical to SEQ ID NO: 6999

SEQ ID NO: 25481 - DNA, 575 bp, Sus scrofa; identical to SEQ ID NO: 7000
  CDS (24)..(344)

SEQ ID NO: 25482 - protein, 106 aa, Sus scrofa; identical to SEQ ID NO: 7001

SEQ ID NO: 25483 - DNA, 432 bp, Saccharomyces cerevisiae; identical to SEQ ID NO: 6880
  CDS (1)..(432)

SEQ ID NO: 25484 - protein, 143 aa, Saccharomyces cerevisiae; identical to SEQ ID NO: 6881

SEQ ID NO: 25485 - DNA, 441 bp, Caenorhabditis elegans; identical to SEQ ID NO: 6922
  CDS (1)..(441)

SEQ ID NO: 25486 - protein, 146 aa, Caenorhabditis elegans; identical to SEQ ID NO: 6923

SEQ ID NO: 25487 - DNA, 324 bp, Rattus norvegicus; identical to SEQ ID NO: 7006
  CDS (1)..(324)

SEQ ID NO: 25488 - protein, 107 aa, Rattus norvegicus; identical to SEQ ID NO: 7007

SEQ ID NO: 25489 - DNA, 378 bp, Arabidopsis thaliana; identical to SEQ ID NO: 7008
  CDS (1)..(378)

SEQ ID NO: 25490 - protein, 125 aa, Arabidopsis thaliana; identical to SEQ ID NO: 7009

SEQ ID NO: 25491 - DNA, 651 bp, Ashbya gossypii; identical to SEQ ID NO: 7010
  CDS (1)..(651)

SEQ ID NO: 25492 - protein, 216 aa, Ashbya gossypii; identical to SEQ ID NO: 7011

SEQ ID NO: 25493 - DNA, 336 bp, Ashbya gossypii; identical to SEQ ID NO: 7012
  CDS (1)..(336)

SEQ ID NO: 25494 - protein, 111 aa, Ashbya gossypii; identical to SEQ ID NO: 7013

SEQ ID NO: 25495 - DNA, 25 bp, Primer
atggagaccaatttttccttcgact

SEQ ID NO: 25496 - DNA, 26 bp, Primer
ctattgaaataccggcttcaatattt

SEQ ID NO: 25497 - protein, 28 aa, consensus
  MISC_FEATURE (1)..(28): consensus for the disclosure of xaa see table XV
MRXXXXXLXAXXXXGCXXXXXXXXXXXX

SEQ ID NO: 25498 - protein, 32 aa, consensus
  MISC_FEATURE (1)..(32): consensus for the disclosure of xaa see table XV
XYXXXXELXGXXFXDXGXVSGXSCXXXXQDXP

SEQ ID NO: 25499 - protein, 22 aa, consensus
  MISC_FEATURE (1)..(22): consensus for the disclosure of xaa see table XV
ARXXMXXXAXXXXANAVLLHXC

SEQ ID NO: 25500 - protein, 20 aa, consensus
  MISC_FEATURE (1)..(20): consensus for the disclosure of xaa see table XV
SGXXGCYXXXXCXGXALXXX

SEQ ID NO: 25501 - protein, 131 aa, consensus
  MISC_FEATURE (1)..(131): Xaa in all positions is any amino acid
MRXXXXXLXAXXXXGCXXXXXXXXXXXXXXXXXXXXXXXXXXXXXXXXXXXXXYXXXEXLXGXXFXDXGXVSGXSCXXXXQDXPXXXXXARXXMXXXAXXXXANAVLLHXCXXXSGXXGCYXXXXCXGXAL

SEQ ID NO: 25502 - protein, 23 aa, consensus
  MISC_FEATURE (1)..(23): consensus for the disclosure of xaa see table XV
SXXTXXXXXXXLXXXXXXXXXXG

SEQ ID NO: 25503 - protein, 222 aa, consensus; identical to SEQ ID NO: 5291
  MISC_FEATURE (1)..(222): Xaa in all positions is any amino acid.

SEQ ID NO: 25504 - protein, 98 aa, consensus; identical to SEQ ID NO: 18676
  MISC_FEATURE (1)..(98): consensus for the disclosure of xaa see table XV

SEQ ID NO: 25505 - protein, 47 aa, consensus; identical to SEQ ID NO: 18677
  MISC_FEATURE (1)..(47): consensus for the disclosure of xaa see table XV

SEQ ID NO: 25506 - protein, 117 aa, consensus; identical to SEQ ID NO: 18678
  MISC_FEATURE (1)..(117): consensus for the disclosure of xaa see table XV

SEQ ID NO: 25507 - protein, 75 aa, consensus; identical to SEQ ID NO: 18679
  MISC_FEATURE (1)..(75): consensus for the disclosure of xaa see table XV

SEQ ID NO: 25508 - protein, 56 aa, consensus
  MISC_FEATURE (1)..(56): consensus for the disclosure of xaa see table XV
XGXXPXXXXXXXXXXXXXXXXXXXXXXXXKXEXXXXXXSXKXRXXXXXXXXXXXXX

SEQ ID NO: 25509 - protein, 53 aa, consensus
  MISC_FEATURE (1)..(53): consensus for the disclosure of xaa see table XV
XXXXXXGNXGXXXXXXXXXXXXXXXXXXXXXXXXXXXXXXXXXXXXXXXGXXX

SEQ ID NO: 25510 - protein, 74 aa, consensus
  MISC_FEATURE (1)..(74): consensus for the disclosure of xaa see table XV
QXXNXXXXXXXXXXXXXEXXXXXXXXXXXXXXXXXXXXXXXXXXXGXXGXXXGXXXXXXXXXXXXXXXXXXXXX

SEQ ID NO: 25511 - protein, 32 aa, consensus
  MISC_FEATURE (1)..(32): consensus for the disclosure of xaa see table XV
XXXXXXXXXXXXXXXXXXXXXGXSXXXXXXXX

SEQ ID NO: 25512 - protein, 420 aa, consensus
  MISC_FEATURE (1)..(420): Xaa in all positions is any amino acid
IGXTPXXXLXXXXXXXXXXXXXXXXXXXXKXEXXNPXXSXKDRXXXXMXXXAEXXGXXXXGXXXXXXEXTSGNTGIXLAXXXXXXGYXXXXXXPXXXSXEXXXXXXXXXXXXAXGAXXXXXXXXXXXXXXXXXXXXXXXXXXAXXXXXXXXXXXXXXXXXXXXXXXXXXXXXXXXXXXXXXXXXXXXXXXXXXQFXNXXNXXXHXXXTXXEIXXXXXXXXXXXXXXXXXXXXXXVXXXGTGGTXXGXXXXXKXXXXXXXXXXXXXXPXXSXXXXXXXXXXXXXXXXXXXXXXXXXXXXXXXXXXXXXXGXGXXXXPXXXXXXXXXXDXXXXXXXXXXXXXXXXXXXXEGXXXGXSXGXXXXAAXXXXXXXXXXXXXXXXXXXXXXXXXXXXXXXXXXXXXXXXXXXXXXXXXXXXXXYXS

SEQ ID NO: 25513 - protein, 30 aa, consensus
  MISC_FEATURE (1)..(30): consensus for the disclosure of xaa see table XV
XXXXXXXXXXXXXXXXXXXXXXXXXXXXXX

SEQ ID NO: 25514 - protein, 28 aa, consensus
  MISC_FEATURE (1)..(28): consensus for the disclosure of xaa see table XV
XXXXXXXXXXNXXXXXXXXXXXSXXXXX

SEQ ID NO: 25515 - protein, 36 aa, consensus
  MISC_FEATURE (1)..(36): consensus for the disclosure of xaa see table XV
XXXXXSGGXDTXXXXXXXXXXXXXXXXXXXXXXXXG

SEQ ID NO: 25516 - protein, 42 aa, consensus
  MISC_FEATURE (1)..(42): consensus for the disclosure of xaa see table XV
XXXXXXXXRXXXXXXXXXXXXXXXXXXXXXGXTXXGNDXXRF

SEQ ID NO: 25517 - protein, 18 aa, consensus
  MISC_FEATURE (1)..(18): consensus for the disclosure of xaa see table XV
XXXXXNXXXXXXXXXXXX

SEQ ID NO: 25518 - protein, 13 aa, consensus
  MISC_FEATURE (1)..(13): consensus for the disclosure of xaa see table XV
XXXXXXXGXXXXX

SEQ ID NO: 25519 - protein, 36 aa, consensus
  MISC_FEATURE (1)..(36): consensus for the disclosure of xaa see table XV
XXXXXXGXXXXXXXXXXXXKXXXXXEXXXXXXXXXA

SEQ ID NO: 25520 - protein, 37 aa, consensus
  MISC_FEATURE (1)..(37): consensus for the disclosure of xaa see table XV
XXXXXXXXXXXXXXXXXXXXXXXXXXXGXXXXXXXXG

SEQ ID NO: 25521 - protein, 409 aa, consensus
  MISC_FEATURE (1)..(409): Xaa in all positions is any amino acid
AXSGGLDTSXXXXXXXXXXXXXXXXXXXXXXXGQXXXXXXXXXXXXAXXXGAXXXXXXXXDXXXXXXXXXXXXXXXXXXXYXXXXXXYXXXXXXXRXXXXXXXXXXAXXXXXXXXXHGXTGKGNDQXRFXXXXXXXXXPXXXXXXPXRXXXXXXXXXXRXXXXXXXXXXXXXXXXXXXXXXXXSXDXNXXXXXXEXXXLEXXXXXXXXXXXXXXXXXXXXXXXXXXXXXXXXXFXXGXXXXXXGXXXXXXXXXXXXXXXXXXXXXNXXXXXXGXGXXDXXEXRXXGXKSRXXYEXPXXXXLXXAXXXXXEXXXXXXXXXXXXXXXXXXXXXXXXYXGXWXXPXXXXXXXXXXXXXXXXXXGXVXXXLXXGXXXXXXXXXXXXXXXXYXXXXXXXXXXXXXXXXXXXXXG

SEQ ID NO: 25522 - protein, 11 aa, consensus
  MISC_FEATURE (1)..(11): consensus for the disclosure of xaa see table XV
XXXXXXXXXXX

SEQ ID NO: 25523 - protein, 14 aa, consensus
  MISC_FEATURE (1)..(14): consensus for the disclosure of xaa see table XV
XXPXXXXXXXXXGX

SEQ ID NO: 25524 - protein, 80 aa, consensus; identical to SEQ ID NO: 7429
  MISC_FEATURE (1)..(80): Xaa in all positions is any amino acid.

SEQ ID NO: 25525 - DNA, 1167 bp, Escherichia coli; identical to SEQ ID NO: 13147
  CDS (1)..(1167)

SEQ ID NO: 25526 - protein, 388 aa, Escherichia coli; identical to SEQ ID NO: 13148

SEQ ID NO: 25527 - DNA, 1242 bp, Caulobacter crescentus; identical to SEQ ID NO: 13149
  CDS (1)..(1242)

SEQ ID NO: 25528 - protein, 413 aa, Caulobacter crescentus; identical to SEQ ID NO: 652

SEQ ID NO: 25529 - DNA, 1149 bp, Geobacter sulfurreducens; identical to SEQ ID NO: 729
  CDS (1)..(1149)

SEQ ID NO: 25530 - protein, 382 aa, Geobacter sulfurreducens; identical to SEQ ID NO: 730

SEQ ID NO: 25531 - DNA, 1167 bp, Salmonella enterica subsp. enterica serovar Typhi; identical to SEQ ID NO: 669
  CDS (1)..(1167)

SEQ ID NO: 25532 - protein, 388 aa, Salmonella enterica subsp. enterica serovar Typhi; identical to SEQ ID NO: 670

SEQ ID NO: 25533 - DNA, 1185 bp, Yersinia pestis; identical to SEQ ID NO: 663
  CDS (1)..(1185)

SEQ ID NO: 25534 - protein, 394 aa, Yersinia pestis; identical to SEQ ID NO: 664

SEQ ID NO: 25535 - DNA, 1350 bp, Helicobacter pylori; identical to SEQ ID NO: 13157
  CDS (34)..(1350)

SEQ ID NO: 25536 - protein, 438 aa, Helicobacter pylori; identical to SEQ ID NO: 656

SEQ ID NO: 25537 - DNA, 1149 bp, Vibrio cholerae; identical to SEQ ID NO: 653
  CDS (1)..(1149)

SEQ ID NO: 25538 - protein, 382 aa, Vibrio cholerae; identical to SEQ ID NO: 654

SEQ ID NO: 25539 - DNA, 1203 bp, Haemophilus influenzae; identical to SEQ ID NO: 647
  CDS (1)..(1203)

SEQ ID NO: 25540 - protein, 400 aa, Haemophilus influenzae; identical to SEQ ID NO: 648

SEQ ID NO: 25541 - DNA, 1314 bp, Sinorhizobium meliloti; identical to SEQ ID NO: 13163
  CDS (1)..(1314)

SEQ ID NO: 25542 - protein, 437 aa, Sinorhizobium meliloti; identical to SEQ ID NO: 662

SEQ ID NO: 25543 - DNA, 441 bp, Rickettsia conorii; identical to SEQ ID NO: 671
  CDS (1)..(441)

SEQ ID NO: 25544 - protein, 146 aa, Rickettsia conorii; identical to SEQ ID NO: 672

SEQ ID NO: 25545 - DNA, 1170 bp, Campylobacter jejuni; identical to SEQ ID NO: 665
  CDS (1)..(1170)

SEQ ID NO: 25546 - protein, 389 aa, Campylobacter jejuni; identical to SEQ ID NO: 666

SEQ ID NO: 25547 - DNA, 1149 bp, Campylobacter jejuni; identical to SEQ ID NO: 13169
  CDS (1)..(1149)

SEQ ID NO: 25548 - protein, 382 aa, Campylobacter jejuni; identical to SEQ ID NO: 668

SEQ ID NO: 25549 - DNA, 1317 bp, Helicobacter pylori; identical to SEQ ID NO: 13171
  CDS (1)..(1317)

SEQ ID NO: 25550 - protein, 438 aa, Helicobacter pylori; identical to SEQ ID NO: 650

SEQ ID NO: 25551 - DNA, 1152 bp, Vibrio parahaemolyticus; identical to SEQ ID NO: 13173
  CDS (1)..(1152)

SEQ ID NO: 25552 - protein, 383 aa, Vibrio parahaemolyticus; identical to SEQ ID NO: 646

SEQ ID NO: 25553 - DNA, 2295 bp, Vibrio alginolyticus; identical to SEQ ID NO: 13175
  CDS (605)..(1756)

SEQ ID NO: 25554 - protein, 383 aa, Vibrio alginolyticus; identical to SEQ ID NO: 13176

SEQ ID NO: 25555 - DNA, 1359 bp, Wolinella succinogenes; identical to SEQ ID NO: 727
  CDS (1)..(1359)

SEQ ID NO: 25556 - protein, 452 aa, Wolinella succinogenes; identical to SEQ ID NO: 728

SEQ ID NO: 25557 - DNA, 1359 bp, Porphyromonas gingivalis; identical to SEQ ID NO: 13179
  CDS (1)..(1359)

SEQ ID NO: 25558 - protein, 452 aa, Porphyromonas gingivalis; identical to SEQ ID NO: 726

SEQ ID NO: 25559 - DNA, 1167 bp, Photorhabdus luminescens; identical to SEQ ID NO: 13181
  CDS (1)..(1167)

SEQ ID NO: 25560 - protein, 388 aa, Photorhabdus luminescens; identical to SEQ ID NO: 724

SEQ ID NO: 25561 - DNA, 441 bp, Rickettsia sibirica; identical to SEQ ID NO: 677
  CDS (1)..(441)

SEQ ID NO: 25562 - protein, 146 aa, Rickettsia sibirica; identical to SEQ ID NO: 678

SEQ ID NO: 25563 - DNA, 1323 bp, Rhodopirellula baltica; identical to SEQ ID NO: 13185
  CDS (1)..(1323)

SEQ ID NO: 25564 - protein, 440 aa, Rhodopirellula baltica; identical to SEQ ID NO: 722

SEQ ID NO: 25565 - DNA, 1335 bp, Helicobacter hepaticus; identical to SEQ ID NO: 719
  CDS (1)..(1335)

SEQ ID NO: 25566 - protein, 444 aa, Helicobacter hepaticus; identical to SEQ ID NO: 720

SEQ ID NO: 25567 - DNA, 1383 bp, Helicobacter hepaticus; identical to SEQ ID NO: 13189
  CDS (1)..(1383)

SEQ ID NO: 25568 - protein, 460 aa, Helicobacter hepaticus; identical to SEQ ID NO: 718

SEQ ID NO: 25569 - DNA, 1185 bp, Haemophilus ducreyi; identical to SEQ ID NO: 715
  CDS (1)..(1185)

SEQ ID NO: 25570 - protein, 394 aa, Haemophilus ducreyi; identical to SEQ ID NO: 716

SEQ ID NO: 25571 - DNA, 1197 bp, Bordetella bronchiseptica; identical to SEQ ID NO: 13193
  CDS (1)..(1197)

SEQ ID NO: 25572 - protein, 398 aa, Bordetella bronchiseptica; identical to SEQ ID NO: 714

SEQ ID NO: 25573 - DNA, 1401 bp, Streptomyces avermitilis; identical to SEQ ID NO: 13195
  CDS (1)..(1401)

SEQ ID NO: 25574 - protein, 466 aa, Streptomyces avermitilis; identical to SEQ ID NO: 712

SEQ ID NO: 25575 - DNA, 1158 bp, Tropheryma whipplei; identical to SEQ ID NO: 13197
  CDS (1)..(1158)

SEQ ID NO: 25576 - protein, 385 aa, Tropheryma whipplei; identical to SEQ ID NO: 710

SEQ ID NO: 25577 - DNA, 1176 bp, Pseudomonas syringae; identical to SEQ ID NO: 13199
  CDS (1)..(1176)

SEQ ID NO: 25578 - protein, 391 aa, Pseudomonas syringae; identical to SEQ ID NO: 708

SEQ ID NO: 25579 - DNA, 1179 bp, Pseudomonas syringae; identical to SEQ ID NO: 13201
  CDS (1)..(1179)

SEQ ID NO: 25580 - protein, 392 aa, Pseudomonas syringae; identical to SEQ ID NO: 706

SEQ ID NO: 25581 - DNA, 1362 bp, Pseudomonas putida; identical to SEQ ID NO: 13203
  CDS (1)..(1362)

SEQ ID NO: 25582 - protein, 453 aa, Pseudomonas putida; identical to SEQ ID NO: 704

SEQ ID NO: 25583 - DNA, 1194 bp, Pseudomonas putida; identical to SEQ ID NO: 13205
  CDS (1)..(1194)

SEQ ID NO: 25584 - protein, 397 aa, Pseudomonas putida; identical to SEQ ID NO: 702

SEQ ID NO: 25585 - DNA, 1320 bp, Bacteroides thetaiotaomicron; identical to SEQ ID NO: 699
  CDS (1)..(1320)

SEQ ID NO: 25586 - protein, 439 aa, Bacteroides thetaiotaomicron; identical to SEQ ID NO: 700

SEQ ID NO: 25587 - DNA, 1191 bp, Wigglesworthia glossinidia brevipalpis; identical to SEQ ID NO: 697
  CDS (1)..(1191)

SEQ ID NO: 25588 - protein, 396 aa, Wigglesworthia glossinidia brevipalpis; identical to SEQ ID NO: 698

SEQ ID NO: 25589 - DNA, 1344 bp, Vibrio vulnificus; identical to SEQ ID NO: 695
  CDS (1)..(1344)

SEQ ID NO: 25590 - protein, 447 aa, Vibrio vulnificus; identical to SEQ ID NO: 696

SEQ ID NO: 25591 - DNA, 1170 bp, Vibrio vulnificus; identical to SEQ ID NO: 13213
  CDS (1)..(1170)

SEQ ID NO: 25592 - protein, 389 aa, Vibrio vulnificus; identical to SEQ ID NO: 694

SEQ ID NO: 25593 - DNA, 1170 bp, Shewanella oneidensis; identical to SEQ ID NO: 691
  CDS (1)..(1170)

SEQ ID NO: 25594 - protein, 389 aa, Shewanella oneidensis; identical to SEQ ID NO: 692

SEQ ID NO: 25595 - DNA, 1167 bp, Escherichia coli O6; identical to SEQ ID NO: 13217
  CDS (1)..(1167)

SEQ ID NO: 25596 - protein, 388 aa, Escherichia coli O6; identical to SEQ ID NO: 690

SEQ ID NO: 25597 - DNA, 1182 bp, Brucella suis; identical to SEQ ID NO: 687
  CDS (1)..(1182)

SEQ ID NO: 25598 - protein, 393 aa, Brucella suis; identical to SEQ ID NO: 688

SEQ ID NO: 25599 - DNA, 1419 bp, Bifidobacterium longum; identical to SEQ ID NO: 13221
  CDS (1)..(1419)

SEQ ID NO: 25600 - protein, 472 aa, Bifidobacterium longum; identical to SEQ ID NO: 686

SEQ ID NO: 25601 - DNA, 1167 bp, Salmonella typhimurium; identical to SEQ ID NO: 683
  CDS (1)..(1167)

SEQ ID NO: 25602 - protein, 388 aa, Salmonella typhimurium; identical to SEQ ID NO: 684

SEQ ID NO: 25603 - DNA, 1891 bp, Gamma; identical to SEQ ID NO: 13225
  CDS (406)..(1590)

SEQ ID NO: 25604 - protein, 394 aa, Gamma; identical to SEQ ID NO: 676

SEQ ID NO: 25605 - DNA, 1443 bp, Streptomyces antibioticus; identical to SEQ ID NO: 13227
  CDS (1)..(1443)

SEQ ID NO: 25606 - protein, 480 aa, Streptomyces antibioticus; identical to SEQ ID NO: 674

SEQ ID NO: 25607 - DNA, 1197 bp, Rhizobium loti; identical to SEQ ID NO: 13229
  CDS (1)..(1197)

SEQ ID NO: 25608 - protein, 398 aa, Rhizobium loti; identical to SEQ ID NO: 682

SEQ ID NO: 25609 - DNA, 1140 bp, Pasteurella multocida; identical to SEQ ID NO: 13231
  CDS (1)..(1140)

SEQ ID NO: 25610 - protein, 379 aa, Pasteurella multocida; identical to SEQ ID NO: 680

SEQ ID NO: 25611 - DNA, 1425 bp, Streptomyces coelicolor; identical to SEQ ID NO: 13233
  CDS (1)..(1425)

SEQ ID NO: 25612 - protein, 474 aa, Streptomyces coelicolor; identical to SEQ ID NO: 660

SEQ ID NO: 25613 - DNA, 1233 bp, Streptomyces coelicolor; identical to SEQ ID NO: 13235
  CDS (1)..(1233)

SEQ ID NO: 25614 - protein, 410 aa, Streptomyces coelicolor; identical to SEQ ID NO: 658

SEQ ID NO: 25615 - DNA, 26 bp, Primer
atgaaacatctgcatcgattctttag

SEQ ID NO: 25616 - DNA, 25 bp, Primer
ttaaactgatggacgcaaacgaacg

SEQ ID NO: 25617 - DNA, 225 bp, Escherichia coli K12
  CDS (1)..(225)
atggaaaagggtactgttaagtggttcaacaatgccaaagggtttggtttcatctgccctgaaggcggcggcgaagatattttcgctcattattccaccattcagatggatggttacagaacgctaaaagctggacaatccgttcagtttgatgtccaccaggggccaaaaggcaatcacgccagtgttattgtgcccgtcgaagtagaagcggcagtcgcatag

SEQ ID NO: 25618 - protein, 74 aa, Escherichia coli K12
MEKGTVKWFNNAKGFGFICPEGGGEDIFAHYSTIQMDGYRTLKAGQSVQFDVHQGPKGNHASVIVPVEVEAAVA

SEQ ID NO: 25619 - DNA, 204 bp, Bacillus subtilis
  CDS (1)..(204)
atgttagaaggtaaagtaaaatggttcaactctgaaaaaggtttcggattcatcgaagtagaaggtcaagacgatgtattcgttcatttctctgctattcaaggcgaaggcttcaaaactttagaagaaggccaagctgtttcttttgaaatcgttgaaggaaaccgcggaccacaagctgctaacgttactaaagaagcgtaa

SEQ ID NO: 25620 - protein, 67 aa, Bacillus subtilis
MLEGKVKWFNSEKGFGFIEVEGQDDVFVHFSAIQGEGFKTLEEGQAVSFEIVEGNRGPQAANVTKEA

SEQ ID NO: 25621 - DNA, 204 bp, Mycobacterium tuberculosis
  CDS (1)..(204)
atgccacagggaactgtgaagtggttcaacgcggagaaggggttcggctttatcgcccccgaagacggttccgcggatgtatttgtccactacacggagatccagggaacgggcttccgcacccttgaagaaaaccagaaggtcgagttcgagatcggccacagccctaagggcccccaggccaccggagtccgctcgctctga

SEQ ID NO: 25622 - protein, 67 aa, Mycobacterium tuberculosis
MPQGTVKWFNAEKGFGFIAPEDGSADVFVHYTEIQGTGFRTLEENQKVEFEIGHSPKGPQATGVRSL

SEQ ID NO: 25623 - DNA, 210 bp, Vibrio cholerae
  CDS (1)..(210)
atgtctactccagttactggtaccgtgaaatggttcaacgaaactaaaggctttggtttcatcaagcaagaaaacggtcctgacgtttttgctcacttcagcgcaatccaaggtgacggtttccgcactctggctgaaggtcaaaaagtggaattcgtgatcactcaaggccagaaaggtccacaagctgaaagcatcaaagttctgtaa

SEQ ID NO: 25624 - protein, 69 aa, Vibrio cholerae
MSTPVTGTVKWFNETKGFGFIKQENGPDVFAHFSAIQGDGFRTLAEGQKVEFVITQGQKGPQAESIKVL

SEQ ID NO: 25625 - DNA, 210 bp, Buchnera sp
  CDS (1)..(210)
atgtccaagattaaaggtaatgttaagtggtttaatgaatctaaaggttttggttttattactccagaagacggtagtaaggatgtgtttgttcatttttcagcaatacaaagcaatggatttaaaactttagcagaaggtcagagtgttgaattcgaaatcaccgaaggagcaaaaggaccatctgccgctaatgttattagtttataa

SEQ ID NO: 25626 - protein, 69 aa, Buchnera sp
MSKIKGNVKWFNESKGFGFITPEDGSKDVFVHFSAIQSNGFKTLAEGQSVEFEITEGAKGPSAANVISL

SEQ ID NO: 25627 - DNA, 201 bp, Lactococcus lactis subsp. lactis
  CDS (1)..(201)
atggcaaatggaacagtaaaatggtttaacgcagataaaggatttggctttatcacttcagaagaaggcaaagatttgttcgctcacttctcagcaatccaatctgatggattcaaatcacttgatgaaggtcaaaaagttgaatttgatgttgaagaaggtcaacgtggtcttcaagcagtcaatatcacaaaagcataa

SEQ ID NO: 25628 - protein, 66 aa, Lactococcus lactis subsp. lactis
MANGTVKWFNADKGFGFITSEEGKDLFAHFSAIQSDGFKSLDEGQKVEFDVEEGQRGLQAVNITKA

SEQ ID NO: 25629 - DNA, 213 bp, Yersinia pestis
  CDS (1)..(213)
atgtctaacatgatgaaaggtcaagtaaagtggttcaacgagtctaaaggcttcggtttcatcactccagctgatggcagcaaagacgtgttcgttcacttctctgctatccaagatcaaggcttcaagaccctggctgaaggccagaatgtacagttctctatcgagaacggtgctaaaggtccgtctgcagcaaacgtaactgcaatctaa

SEQ ID NO: 25630 - protein, 70 aa, Yersinia pestis
MSNMMKGQVKWFNESKGFGFITPADGSKDVFVHFSAIQDQGFKTLAEGQNVQFSIENGAKGPSAANVTAI

SEQ ID NO: 25631 - DNA, 213 bp, Yersinia pestis
  CDS (1)..(213)
atgtctaataaaatgactggtttggtaaaatggtttgatgctggtaaaggttttggttttatttctcctgcagatggcagcaaagatgtatttgtacatttctctgcaatccagggtaatgactacaaaactcttgatgaaggccagaacgttgagttcagcatcgagcaaggccaaaaaggcccttcagctgtaaacgttgtagcactgtaa

SEQ ID NO: 25632 - protein, 70 aa, Yersinia pestis
MSNKMTGLVKWFDAGKGFGFISPADGSKDVFVHFSAIQGNDYKTLDEGQNVEFSIEQGQKGPSAVNVVAL

SEQ ID NO: 25633 - DNA, 213 bp, Salmonella enterica subsp. enterica serovar Typhi
  CDS (1)..(213)
atgacgacgaaaatcactggtttagtaaaatggtttaaccctgaaaagggctttggtttcattacgcctaaagatggcagcaaagatgtgtttgtgcatttttccgccattcaaagtaatgaattccgcactctgaatgaaaatcaggaagtggagttttcagcagagcagggaccaaaaggtccatcagcggtcaacgttgtggcgctttaa

SEQ ID NO: 25634 - protein, 70 aa, Salmonella enterica subsp. enterica serovar Typhi
MTTKITGLVKWFNPEKGFGFITPKDGSKDVFVHFSAIQSNEFRTLNENQEVEFSAEQGPKGPSAVNVVAL

SEQ ID NO: 25635 - DNA, 201 bp, Listeria monocytogenes
  CDS (1)..(201)
atggaacaaggtacagtaaaatggtttaacgcagaaaaaggatttggttttatcgaacgcgaaaacggtgacgatgtattcgtacatttcagcgctatccaaggcgacggattcaaatctttagacgaaggtcaagcagtaactttcgacgttgaagaaggccaacgcggacctcaagcagctaacgttcaaaaagcgtaa

SEQ ID NO: 25636 - protein, 66 aa, Listeria monocytogenes
MEQGTVKWFNAEKGFGFIERENGDDVFVHFSAIQGDGFKSLDEGQAVTFDVEEGQRGPQAANVQKA

SEQ ID NO: 25637 - DNA, 210 bp, Salmonella enterica subsp. enterica serovar Typhi
  CDS (1)..(210)
atggcaaagattaaaggtcaggttaagtggttcaacgagtctaaaggttttggcttcattactccggctgatggcagcaaagatgtgttcgtacacttctccgctatccagggtaatggcttcaaaactctggctgaaggtcagaacgttgagttcgaaattcaggacggtcagaaaggtccggcagctgttaacgtaacagctatctga

SEQ ID NO: 25638 - protein, 69 aa, Salmonella enterica subsp. enterica serovar Typhi
MAKIKGQVKWFNESKGFGFITPADGSKDVFVHFSAIQGNGFKTLAEGQNVEFEIQDGQKGPAAVNVTAI

SEQ ID NO: 25639 - DNA, 210 bp, Yersinia pestis
  CDS (1)..(210)
atgtctaagattaaaggtagcgttaagtggttcaatgaatccaaaggtttcggcttcattaccccagaagatggtagcaaggacgtttttgttcatttttctgccatcgctagcaatggtttcaaaacgcttgctgaaggccagcgtgtagaatttgaaatcacgaacggtgccaaagggccatctgctgctaatgttatcgctatctaa

SEQ ID NO: 25640 - protein, 69 aa, Yersinia pestis
MSKIKGSVKWFNESKGFGFITPEDGSKDVFVHFSAIASNGFKTLAEGQRVEFEITNGAKGPSAANVIAI

SEQ ID NO: 25641 - DNA, 222 bp, Salmonella enterica subsp. enterica serovar Typhi
  CDS (1)..(222)
atggaaacgggtactgtaaagtggttcaacaatgccaaagggtttggtttcatctgccctgaaggcggcggcgaggatattttcgcccattattccaccattcaaatggatggttacagaacgcttaaagccggacagtctgtccggtttgatgtccaccaggggccaaaaggcaatcacgccagcgtcatcgtgcccatcgaagcagaggccgttgcatag

SEQ ID NO: 25642 - protein, 73 aa, Salmonella enterica subsp. enterica serovar Typhi
METGTVKWFNNAKGFGFICPEGGGEDIFAHYSTIQMDGYRTLKAGQSVRFDVHQGPKGNHASVIVPIEAEAVA

SEQ ID NO: 25643 - DNA, 201 bp, Listeria monocytogenes
  CDS (1)..(201)
atgcaaaatgggaaagtaaaatggtttaacaatgaaaagggttacggttttatcgaatcagacggcggcgaagatattttcgttcacttcacagcgatccaaggtgacggctacaaatctttagaagaaggccaagcggtaacatttgaagtagttgaaggtaatcgcggcgctcaagcagctaacgtagaaaaagcctaa

SEQ ID NO: 25644 - protein, 66 aa, Listeria monocytogenes
MQNGKVKWFNNEKGYGFIESDGGEDIFVHFTAIQGDGYKSLEEGQAVTFEVVEGNRGAQAANVEKA

SEQ ID NO: 25645 - DNA, 264 bp, Yersinia pestis
  CDS (1)..(264)
atggagacgggtactgttaaatggttcaacaacgccaaaggttttggctttatttgccctgagggcggtggcgaagacattttcgctcactattcaactatccagatggatggttaccgaacattaaaagccggccaaatagttaactttgatgttcatgaaggccccaaagggaaccatgctagcctgattgttccgctagagttaaatagtgtaccaccgttagacggtgtatcaccgccggaactcgctatactggcctga

SEQ ID NO: 25646 - protein, 87 aa, Yersinia pestis
METGTVKWFNNAKGFGFICPEGGGEDIFAHYSTIQMDGYRTLKAGQIVNFDVHEGPKGNHASLIVPLELNSVPPLDGVSPPELAILA

SEQ ID NO: 25647 - DNA, 210 bp, Salmonella enterica subsp. enterica serovar Typhi
  CDS (1)..(210)
atgtctaagattaaaggtaacgttaagtggtttaatgaatccaaaggattcggtttcattactccggaagatggcagcaaagacgtgtttgtacacttctctgcaatccagaccaatggttttaaaactctggctgaaggtcagcgcgtagagttcgaaatcactaacggtgccaaaggcccttccgctgcaaacgtaactgctctgtaa

SEQ ID NO: 25648 - protein, 69 aa, Salmonella enterica subsp. enterica serovar Typhi
MSKIKGNVKWFNESKGFGFITPEDGSKDVFVHFSAIQTNGFKTLAEGQRVEFEITNGAKGPSAANVTAL

SEQ ID NO: 25649 - DNA, 201 bp, Listeria monocytogenes
  CDS (1)..(201)
atgcaaacaggtacagttaaatggtttaacagtgaaaaaggcttcggtttcatcgaagtagaaggcggagacgatgtattcgtacacttcagcgctatcgaaggtgaaggattcaaaactttagacgaaggtcaaagcgttgaatttgaaatcgttgaaggccaacgtggcccacaagcagaaaaagttactaaactttaa

SEQ ID NO: 25650 - protein, 66 aa, Listeria monocytogenes
MQTGTVKWFNSEKGFGFIEVEGGDDVFVHFSAIEGEGFKTLDEGQSVEFEIVEGQRGPQAEKVTKL

SEQ ID NO: 25651 - DNA, 306 bp, Brucella melitensis
  CDS (1)..(306)
atgcttcctgacgatctcctgtccataaattcgattcacagggacgtgtgcgaagcatgcggacttaatagctactacgttacaaaggacattcccatggctacgggaacagtgaagtggttcaacaccaccaagggcttcggcttcattcagcctgatcagggcggcacggacgtttttgtccacatctccgccgttcagcgcgctggcctcaccacgcttgatgaaggtcagaaggtctcttacgagatcgttcaggaccgccgttcgggccgttcgtctgccgacaatctcgtcgcagcataa

SEQ ID NO: 25652 - protein, 101 aa, Brucella melitensis
MLPDDLLSINSIHRDVCEACGLNSYYVTKDIPMATGTVKWFNTTKGFGFIQPDQGGTDVFVHISAVQRAGLTTLDEGQKVSYEIVQDRRSGRSSADNLVAA

SEQ ID NO: 25653 - DNA, 210 bp, Yersinia pestis
  CDS (1)..(210)
atggcaaagatcaaaggtcaagttaagtggttcaacgagtctaaaggcttcggtttcatcactccagcagatggcagcaaagatgtgtttgtacacttctctgcaatccaaggtaatggcttcaaaaccttggctgaaggccagaatgtagagttcgaaatccaagacggtcagaaaggtccgtctgcagtaaacgttactgcaatctaa

SEQ ID NO: 25654 - protein, 69 aa, Yersinia pestis
MAKIKGQVKWFNESKGFGFITPADGSKDVFVHFSAIQGNGFKTLAEGQNVEFEIQDGQKGPSAVNVTAI

SEQ ID NO: 25655 - DNA, 198 bp, Bacillus halodurans
  CDS (1)..(198)
atgcaaggaaaagtaaaatggtttaacgcagaaaaaggtttcggttttatcgagcgcgaagatggtgacgatgtatttgttcatttctctgccattaacacagacggtttcaaaacattagacgaaggtcaatctgttgagtttgatatcgttgaaggagctcgcggacctcaagctgcgaacgtcactaagctttaa

SEQ ID NO: 25656 - protein, 65 aa, Bacillus halodurans
MQGKVKWFNAEKGFGFIEREDGDDVFVHFSAINTDGFKTLDEGQSVEFDIVEGARGPQAANVTKL

SEQ ID NO: 25657 - DNA, 201 bp, Staphylococcus aureus
  CDS (1)..(201)
atgaaacaaggtacagttaaatggtttaacgctgaaaaaggattcggctttatcgaagttgaaggagaaaatgacgtattcgtacatttttcagcaattaaccaagatggttacaaatcattagaagaaggtcaagctgttgagtttgaagtagttgaaggcgaccgcggtccacaagctgcaaacgttgttaaactataa

SEQ ID NO: 25658 - protein, 66 aa, Staphylococcus aureus
MKQGTVKWFNAEKGFGFIEVEGENDVFVHFSAINQDGYKSLEEGQAVEFEVVEGDRGPQAANVVKL

SEQ ID NO: 25659 - DNA, 213 bp, Escherichia coli
  CDS (1)..(213)
atgtctaacaaaatgactggtttagtgaaatggtttaaccctgaaaaaggttttggtttcatcacgccgaaagatggtagcaaagatgtgtttgtgcatttctcagctattcagagcaacgatttcaaaacgttaactgagaatcaggaagtcgaatttggtattgagaacggacctaaaggccctgcagctgttcatgtagtggcactttga

SEQ ID NO: 25660 - protein, 70 aa, Escherichia coli
MSNKMTGLVKWFNPEKGFGFITPKDGSKDVFVHFSAIQSNDFKTLTENQEVEFGIENGPKGPAAVHVVAL

SEQ ID NO: 25661 - DNA, 204 bp, Neisseria meningitidis
  CDS (1)..(204)
atggcaaccggtatcgtaaaatggtttaacgacgctaaaggttttggtttcatcacgcctgatgaaggcggcgaagatttgttcgctcacttctcagcaatcaatatggaaggtttcaaaaccctgaaagaaggccaacgcgtctctttcgacgtaaccaccggccctaaaggcaaacaggccgccaacattcaggctgcttaa

SEQ ID NO: 25662 - protein, 67 aa, Neisseria meningitidis
MATGIVKWFNDAKGFGFITPDEGGEDLFAHFSAINMEGFKTLKEGQRVSFDVTTGPKGKQAANIQAA

SEQ ID NO: 25663 - DNA, 231 bp, Vibrio cholerae
  CDS (1)..(231)
atgtatagcatggctacaggtacagtgaaatggtttaataatgccaaaggcttcggttttatttgcccggaaggtgaagacggagatattttcgctcattactcaaccattcagatggacggataccgtacactcaaagccggtcaacaggtttcttatcaggtggagcaaggtcctaagggataccacgcgagctgtgttgtgccaatcgagggacaatcagcaaaatag

SEQ ID NO: 25664 - protein, 76 aa, Vibrio cholerae
MYSMATGTVKWFNNAKGFGFICPEGEDGDIFAHYSTIQMDGYRTLKAGQQVSYQVEQGPKGYHASCVVPIEGQSAK

SEQ ID NO: 25665 - DNA, 213 bp, Aquifex aeolicus
  CDS (1)..(213)
atgtcgttcagaggcacagttaagtggtttagcaaggacaagggttacgggttcattacccgtgaggacacaaacgcagacgtttttgtccactttaccgatatccagatggagggtttcaagacccttcaaaaaggtcaaaaagtagagtttgacgtagttgaagacacaaaaggtccaagggctaaaaacgtaagagttttgggcgagtaa

SEQ ID NO: 25666 - protein, 70 aa, Aquifex aeolicus
MSFRGTVKWFSKDKGYGFITREDTNADVFVHFTDIQMEGFKTLQKGQKVEFDVVEDTKGPRAKNVRVLGE

SEQ ID NO: 25667 - DNA, 210 bp, Pseudomonas aeruginosa
  CDS (1)..(210)
atggctgatcgtgaggtcggaaccgtcaagtggttcaatgacgccaaaggttatggattcattcaacgcgatagcggtccggacgtgttcgttcactaccgcgccatccgcggcgagggtcaccgctccctggtggaaggccagaaagtggaattctcggtgatccagggccagaaaggcctgcaagcggaagacgtctccaaggtctga

SEQ ID NO: 25668 - protein, 69 aa, Pseudomonas aeruginosa
MADREVGTVKWFNDAKGYGFIQRDSGPDVFVHYRAIRGEGHRSLVEGQKVEFSVIQGQKGLQAEDVSKV

SEQ ID NO: 25669 - DNA, 198 bp, Clostridium acetobutylicum
  CDS (1)..(198)
atgactggtacagttaaatggtttaatggagaaaaaggttttggatttattacaggagaagatggaaacgatgttttcgctcactattctcaaataaatgtagatggatacaaaactcttgaagaaggtcaaaaagtttcttatgatgttgttaagggaccaaaaggacttcaagctgaaaatattacacttgcataa

SEQ ID NO: 25670 - protein, 65 aa, Clostridium acetobutylicum
MTGTVKWFNGEKGFGFITGEDGNDVFAHYSQINVDGYKTLEEGQKVSYDVVKGPKGLQAENITLA

SEQ ID NO: 25671 - DNA, 201 bp, Bacillus subtilis
  CDS (1)..(201)
atggaacaaggtacagttaaatggtttaatgcagaaaaaggttttggctttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaa

SEQ ID NO: 25672 - protein, 66 aa, Bacillus subtilis
MEQGTVKWFNAEKGFGFIERENGDDVFVHFSAIQSDGFKSLDEGQKVSFDVEQGARGAQAANVQKA

SEQ ID NO: 25673 - DNA, 201 bp, Thermotoga maritima
  CDS (1)..(201)
atgagaggtacggttaagtggtttgactccaagaaaggctacggttttatcaccatggagaacggagaggacatcttcgttcactggtcagcgatccagatggacggtttcaagaccctcagggaaaacgaaacagtcgagttcgaagtccagaaaggtaccaaaggacctcaggctgtcaatgtgagacctgttagataa

SEQ ID NO: 25674 - protein, 66 aa, Thermotoga maritima
MRGTVKWFDSKKGYGFITMENGEDIFVHWSAIQMDGFKTLRENETVEFEVQKGTKGPQAVNVRPVR

SEQ ID NO: 25675 - DNA, 201 bp, Thermotoga maritima
  CDS (1)..(201)
atgagaggaaaggttaagtggttcgattccaagaagggctacggattcatcacaaaggacgaaggaggagacgtgttcgtacactggtcagccatcgaaatggaaggtttcaaaactctgaaggaaggccaggtcgtcgagttcgagattcaggaaggcaagaaaggtccacaggcagcgcacgtgaaagtagttgagtaa

SEQ ID NO: 25676 - protein, 66 aa, Thermotoga maritima
MRGKVKWFDSKKGYGFITKDEGGDVFVHWSAIEMEGFKTLKEGQVVEFEIQEGKKGPQAAHVKVVE

SEQ ID NO: 25677 - DNA, 213 bp, Vibrio cholerae
  CDS (1)..(213)
atgtctactaaaatgactggttctgtaaaatggttcaacgaaactaaaggtttcggttttcttactcaagacaacggtggcaacgatgtgtttgttcactttaattctattcagtcagaaggtttcaaaaccttagctgaaggtcaacgtgttagctttatcgttgaacaaggtaagaaaggccctcaagcgtctaacgtagtcgcactgtaa

SEQ ID NO: 25678 - protein, 70 aa, Vibrio cholerae
MSTKMTGSVKWFNETKGFGFLTQDNGGNDVFVHFNSIQSEGFKTLAEGQRVSFIVEQGKKGPQASNVVAL

SEQ ID NO: 25679 - DNA, 201 bp, Bacillus subtilis
  CDS (1)..(201)
atgcaaaacggtaaagtaaaatggttcaacaacgaaaaaggattcggcttcattgaagttgaaggcggagacgatgtatttgttcacttcacagctatcgaaggagatggatacaaatcattagaagaaggacaagaagtttcttttgaaattgtcgaaggtaatcgtggacctcaagcttctaatgttgtaaaactctaa

SEQ ID NO: 25680 - protein, 66 aa, Bacillus subtilis
MQNGKVKWFNNEKGFGFIEVEGGDDVFVHFTAIEGDGYKSLEEGQEVSFEIVEGNRGPQASNVVKL

SEQ ID NO: 25681 - DNA, 210 bp, Pseudomonas aeruginosa
  CDS (1)..(210)
atgtcccgtcagaacggcaccgttaagtggttcaacgaaaccaaaggctacggcttcattaccccggaaagcggcccggacgttttcgttcacttccgtgccatcgaaggtaacggcttcaagaccctggccgaaggccagaaggtcagcttcgaagtcgtacaaggccagaaaggcatgcaggccgagcgcgttcaggtgatcaactaa

SEQ ID NO: 25682 - protein, 69 aa, Pseudomonas aeruginosa
MSRQNGTVKWFNETKGYGFITPESGPDVFVHFRAIEGNGFKTLAEGQKVSFEVVQGQKGMQAERVQVIN

SEQ ID NO: 25683 - DNA, 858 bp, Arabidopsis thaliana (mouse-ear cress)
  CDS (63)..(668)
ggagagagagagagatctgatcggtgatttacttttagttcgtcggagagattttgatcagaatgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttgaagcaaaccagactgtgaagaaggggtaaatcagtcatcgatccctcttctccgtgacttctatcaaattattatctatcttttgttattcgactctcttcaatgttgttttcggaatttattaattaggacttgtggttgttatggttatggttccttgtgatttgagaaagaaactggattggttttaa

SEQ ID NO: 25684 - protein, 201 aa, Arabidopsis thaliana (mouse-ear cress)
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 25685 - DNA, 204 bp, Mycobacterium leprae
  CDS (1)..(204)
atgccacagggaactgtgaagtggttcaacgcggagaaggggttcggctttatcgcccccgaagacggttctgcggatgtttttgtccactacactgagattcagggttcgggcttccgcacccttgaagagaaccagaaggtcgagtttgagatcggccacagccccaagggcccccaagccactggagttcgctccgtctga

SEQ ID NO: 25686 - protein, 67 aa, Mycobacterium leprae
MPQGTVKWFNAEKGFGFIAPEDGSADVFVHYTEIQGSGFRTLEENQKVEFEIGHSPKGPQATGVRSV

SEQ ID NO: 25687 - DNA, 204 bp, Neisseria meningitidis
  CDS (1)..(204)
atggcaaccggtatcgtaaaatggtttaacgacgctaaaggttttggtttcatcactcctgatgaaggtggcgaagatttgttcgctcacttctcagcgatcaacatggatggtttcaaaaccttgaaagaaggtcaacgcgtatctttcgacgtaaccaccggccctaaaggcaaacaggccgccaacattcaggctgcttaa

SEQ ID NO: 25688 - protein, 67 aa, Neisseria meningitidis
MATGIVKWFNDAKGFGFITPDEGGEDLFAHFSAINMDGFKTLKEGQRVSFDVTTGPKGKQAANIQAA

SEQ ID NO: 25689 - DNA, 213 bp, Vibrio cholerae
  CDS (1)..(213)
atgtctcagaaaatgactggttcagtaaaatggttcaacgaaactaaaggttttggtttcatctctcaagacaacggcggtcaagacgtgttcgtacacttcaagtctatcgtttctgaaggcttcaaaactctggctgaaggccagcgtgtaagcttcaccgttgagcaaggcaaaaaaggcccacaagctgctcaagttactgcgctgtaa

SEQ ID NO: 25690 - protein, 70 aa, Vibrio cholerae
MSQKMTGSVKWFNETKGFGFISQDNGGQDVFVHFKSIVSEGFKTLAEGQRVSFTVEQGKKGPQAAQVTAL

SEQ ID NO: 25691 - DNA, 204 bp, Xylella fastidiosa
  CDS (1)..(204)
atgcagagcggtacagttaagtggtttagcgaccaaaagggattcggatttatttcaccggatgatgggactcccgaggtatttgctcactattcggggattaactcaaaaggcttccgtagtttgcatgaaggccagagagttacttatgacgtgacgcagggcccgaagggtccccaagcatcgaatatcacgccaatataa

SEQ ID NO: 25692 - protein, 67 aa, Xylella fastidiosa
MQSGTVKWFSDQKGFGFISPDDGTPEVFAHYSGINSKGFRSLHEGQRVTYDVTQGPKGPQASNITPI

SEQ ID NO: 25693 - DNA, 273 bp, Pseudomonas aeruginosa
  CDS (1)..(273)
atgctcagcggtaaggtcaagtggttcaacaacgccaagggctacgggttcatcctggccgagggccgagatgaggacctgttcgcccattactcggccattcagatggacggttacaagacactcaaggcgggccagccggtcaatttcgagatcatccagggaccgaagggactgcatgccatcaacatcagccccgccaccgcgacaaccgccgcaccctccgcccccgccccgcaggaagagccgcaggcgacgcccatcgaagcctga

SEQ ID NO: 25694 - protein, 90 aa, Pseudomonas aeruginosa
MLSGKVKWFNNAKGYGFILAEGRDEDLFAHYSAIQMDGYKTLKAGQPVNFEIIQGPKGLHAINISPATATTAAPSAPAPQEEPQATPIEA

SEQ ID NO: 25695 - DNA, 210 bp, Pseudomonas aeruginosa
  CDS (1)..(210)
atgtcgaatcgtcagaacggcaccgtaaaatggttcaacgacgccaaaggcttcggcttcatcaccccggaaagcggtaacgacctgttcgttcacttccgttccatccagggcaccggcttcaagagcctgcaggaaggccagaaggtttccttcgtggtcgtcaacggccagaaaggcctgcaagccgacgaagtacaagttgtctaa

SEQ ID NO: 25696 - protein, 69 aa, Pseudomonas aeruginosa
MSNRQNGTVKWFNDAKGFGFITPESGNDLFVHFRSIQGTGFKSLQEGQKVSFVVVNGQKGLQADEVQVV

SEQ ID NO: 25697 - DNA, 198 bp, Lactococcus lactis subsp. lactis
  CDS (1)..(198)
atggcacaaggaactgttaaatggtttaacgcaactaaaggcttcggctttatcactactgaagaaggaaacgacgttttcgctcacttctcagctatccaaactgatggattcaaaacacttgacgaaggtcaaaaagttacttttgacgttgaagatggccctcgtggacctcaagctgttaacatccaaaaataa

SEQ ID NO: 25698 - protein, 65 aa, Lactococcus lactis subsp. lactis
MAQGTVKWFNATKGFGFITTEEGNDVFAHFSAIQTDGFKTLDEGQKVTFDVEDGPRGPQAVNIQK

SEQ ID NO: 25699 - DNA, 198 bp, Clostridium acetobutylicum
  CDS (1)..(198)
atgttaggaacagttaaatggtttaattctcagaaaggatatggtttcataactacccaagaaggtaacgatgtattcgttcactattcaggtatcaaagataatggctttaagactttagaagaaggtcaggaagttgaatttgatttaactgaaggtcaaaagggcgagcaagcagttaatgttgtaaaacattaa

SEQ ID NO: 25700 - protein, 65 aa, Clostridium acetobutylicum
MLGTVKWFNSQKGYGFITTQEGNDVFVHYSGIKDNGFKTLEEGQEVEFDLTEGQKGEQAVNVVKH

SEQ ID NO: 25701 - DNA, 201 bp, Bacillus caldolyticus
  CDS (1)..(201)
atgcaacgtggtaaagtaaaatggtttaacaacgaaaaaggctacggtttcatcgaagtggagggcggttccgacgtattcgtccacttcacggcgatccaaggtgaagggttcaaaacgttagaagaaggccaagaagtttcgtttgaaatcgtccaaggaaaccgcggaccgcaagcagcgaacgttgtcaaattataa

SEQ ID NO: 25702 - protein, 66 aa, Bacillus caldolyticus
MQRGKVKWFNNEKGYGFIEVEGGSDVFVHFTAIQGEGFKTLEEGQEVSFEIVQGNRGPQAANVVKL

SEQ ID NO: 25703 - DNA, 201 bp, Bacillus stearothermophilus
  CDS (1)..(201)
atgcaacgtggtaaagtaaaatggtttaacaacgaaaaaggctatggtttcatcgaagtggaaggcggttcggacgtattcgttcacttcacggcgatccaaggtgaagggttcaaatcgttggaagaaggccaagaagtttcgtttgaaatcgtacaaggaaaccgcggaccgcaagcagcgaacgttgtcaaattgtaa

SEQ ID NO: 25704 - protein, 66 aa, Bacillus stearothermophilus
MQRGKVKWFNNEKGYGFIEVEGGSDVFVHFTAIQGEGFKSLEEGQEVSFEIVQGNRGPQAANVVKL

SEQ ID NO: 25705 - DNA, 612 bp, Arabidopsis thaliana (mouse-ear cress)
  CDS (1)..(612)
atgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaa

SEQ ID NO: 25706 - protein, 203 aa, Arabidopsis thaliana (mouse-ear cress)
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 25707 - DNA, 991 bp, Nicotiana sylvestris (wood tobacco)
  CDS (30)..(674)
gttttaagctttttagggtttctgtgagaatggctgaggagagtggacagagggctaagggaaccgtcaagtggttcagtgaccaaaaaggttttggtttcatcactcccgatgacggcggcgaagatctgttcgttcaccagtcaggtatcagatctgagggtttccgtagcctagctgaaggggaaaccgttgagttcgaagttgagtctggaggtgacggccgtacaaaggctgttgatgttaccggccctgatggtgcggccgttcaaggtggtcgtggcggcggcggtggcggcggcggtcgcggtggtggtggttatggaggcggcagtggtggatacggtggaggtggccgtggtggtagccgtggatatggtggcggtgacggaggctatggtggtggaggcggctacggtggaggtagccgttatggcggaggtggaggtggctacggtggaggcggtggctacggaggtggtggaagtggtggaggaagcggttgcttcaagtgtggtgaatctggtcacttcgctagggactgtagccagagtggaggcggcggtggcggtggcaggttcggtggtggcggcggtggaggcggcggcggcggctgctacaagtgtggtgaggatggtcactttgcccgtgaatgtaccagtggaggtcgttgaacatgggttgaaaccctttgatcactttttcttttagcctgttatgtttttgtctaaatgtggtgcctatggtaacctttcgtatgggtctttgctactgtttcttcgactatggttgtttgcttatttttttcttctgcttattagtagtatccgttatacggtttagttcagtttgaaacatttggtaatggggagtctgatattttgtggtgctgcattgaatactctctgtacatgtttacatacatgtttctgaagaaatatcaattaatcaactgacaatatttgtatccctaaaaaaaaaaaaaaaaaaa

SEQ ID NO: 25708 - protein, 214 aa, Nicotiana sylvestris (wood tobacco)
MAEESGQRAKGTVKWFSDQKGFGFITPDDGGEDLFVHQSGIRSEGFRSLAEGETVEFEVESGGDGRTKAVDVTGPDGAAVQGGRGGGGGGGGRGGGGYGGGSGGYGGGGRGGSRGYGGGDGGYGGGGGYGGGSRYGGGGGGYGGGGGYGGGGSGGGSGCFKCGESGHFARDCSQSGGGGGGGRFGGGGGGGGGGGCYKCGEDGHFARECTSGGR

SEQ ID NO: 25709 - DNA, 213 bp, Escherichia coli
  CDS (1)..(213)
atgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaa

SEQ ID NO: 25710 - protein, 70 aa, Escherichia coli
MSGKMTGIVKWFNADKGFGFITPDDGSKDVFVHFSAIQNDGYKSLDEGQKVSFTIESGAKGPAAGNVTSL

SEQ ID NO: 25711 - DNA, 371 bp, Streptomyces clavuligerus
  CDS (66)..(266)
ttttgtagttttcagattgtttgcaggttctggagcagggcaaccctttggcccaaggagggcttatggctaccggaaccgtcaagtggttcaacgctgaaaagggcttcggcttcatcgcccaggacggcggcggcccggatgtcttcgtccactactccgcgatcaacgcgaccggcttccgctcccttgaggagaaccaggtcgtgaacttcgacgtcacccacggcgaagggccgcaggcggagaacgtctccccggcctaatcgggccaggtcggcgatcgcacccgacttagcagtacccaaggagccccgtcccttccagggacggggctcctgccttcttacggaacggccctgtccgctcca

SEQ ID NO: 25712 - protein, 66 aa, Streptomyces clavuligerus
MATGTVKWFNAEKGFGFIAQDGGGPDVFVHYSAINATGFRSLEENQVVNFDVTHGEGPQAENVSPA

SEQ ID NO: 25713 - DNA, 216 bp, Escherichia coli
  CDS (1)..(216)
atgtcaaataaaatgactggtttagtaaaatggtttaacgctgataaaggtttcggctttatttctcctgttgatggtagtaaagatgtgtttgtgcatttttctgcgattcagaatgataattatcgaaccttatttgaaggtcaaaaggttaccttctctatagagagtggtgctaaaggtcctgcagcagcaaatgtcatcattactgattaa

SEQ ID NO: 25714 - protein, 71 aa, Escherichia coli
MSNKMTGLVKWFNADKGFGFISPVDGSKDVFVHFSAIQNDNYRTLFEGQKVTFSIESGAKGPAAANVIITD

SEQ ID NO: 25715 - DNA, 210 bp, Escherichia coli
  CDS (1)..(210)
atgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaa

SEQ ID NO: 25716 - protein, 69 aa, Escherichia coli
MSKIKGNVKWFNESKGFGFITPEDGSKDVFVHFSAIQTNGFKTLAEGQRVEFEITNGAKGPSAANVIAL

SEQ ID NO: 25717 - DNA, 204 bp, Streptomyces coelicolor
  CDS (1)..(204)
atggctgctggtaccgtgaagtggttcaacgcggaaaagggcttcggcttcatcgagcaggacggtggcggcgctgatgtgttcgcccactactcgaacatcgccgcccagggcttccgcgagctgctcgaaggccagaaggtgaacttcgacatcgcgcagggccagaagggcccgacggccgagaacatcgttcccgcctga

SEQ ID NO: 25718 - protein, 67 aa, Streptomyces coelicolor
MAAGTVKWFNAEKGFGFIEQDGGGADVFAHYSNIAAQGFRELLEGQKVNFDIAQGQKGPTAENIVPA

SEQ ID NO: 25719 - DNA, 204 bp, Streptomyces coelicolor
  CDS (1)..(204)
atggccagcggaactgtcaagtggttcaactctgaaaagggcttcggcttcatcgcgcaggacggcggcggccccgacgtcttcgcgcactactccaacatcaacgctcagggctaccgcgagctgcaggaaggccaggccgtgaccttcgacatcacccagggccagaagggcccgcaggcggagaacatcacccccgcctga

SEQ ID NO: 25720 - protein, 67 aa, Streptomyces coelicolor
MASGTVKWFNSEKGFGFIAQDGGGPDVFAHYSNINAQGYRELQEGQAVTFDITQGQKGPQAENITPA

SEQ ID NO: 25721 - DNA, 201 bp, Lactococcus lactis
  CDS (1)..(201)
atgacaaaaggaactgtaaaatggtttaatccagataaaggatttggctttatcacttcagaagatggtcaagatgtgttcgcacacttttcacaaattcaaacttcaggttttaaaacacttgatgaaggccaaaaagtaacttttgatgttgaagctggtcaacgtggccctcaagctgttaatatcgaaaaagcataa

SEQ ID NO: 25722 - protein, 66 aa, Lactococcus lactis
MTKGTVKWFNPDKGFGFITSEDGQDVFAHFSQIQTSGFKTLDEGQKVTFDVEAGQRGPQAVNIEKA

SEQ ID NO: 25723 - DNA, 204 bp, Burkholderia mallei ATCC 23344
  CDS (1)..(204)
atggataccggtaccgtcaagtggttcaacgagaccaagggttttggcttcatcacgccggattcgggcggcgacgatctgttcgcgcatttctccgaaatccgcagtgagggatacaagacgctggccgagaaccagaaggtgagcttcgagacgaagcggggcccgaaaggcctccaggctgccaacatcaagccgctgtaa

SEQ ID NO: 25724 - protein, 67 aa, Burkholderia mallei ATCC 23344
MDTGTVKWFNETKGFGFITPDSGGDDLFAHFSEIRSEGYKTLAENQKVSFETKRGPKGLQAANIKPL

SEQ ID NO: 25725 - DNA, 204 bp, Burkholderia mallei ATCC 23344
  CDS (1)..(204)
atggcaaccggtaccgtcaagtggttcaacgacgccaagggttttggtttcatcacgccggaaggcggcggcgaagatctcttcgcgcacttctcggaaatccgcgtcgacggcttcaagacgctgcaagagaaccagaaggtcgagtttgaagtgaagaccggcccgaagggtctgcaggcagcgaacatcaagccgctgtaa

SEQ ID NO: 25726 - protein, 67 aa, Burkholderia mallei ATCC 23344
MATGTVKWFNDAKGFGFITPEGGGEDLFAHFSEIRVDGFKTLQENQKVEFEVKTGPKGLQAANIKPL

SEQ ID NO: 25727 - DNA, 204 bp, Burkholderia mallei ATCC 23344
  CDS (1)..(204)
atggcaactggtattgtcaaatggttcaatgacgcgaagggcttcggcttcatcacgcccgacgaaggcggcgaagatctgtttgcacatttctcggcgatcaacatgcagggcttcaaaaccctgaaggaaggccaaaaggtcagcttcgaggtagtgcaaggcccgaagggcaagcaagcgtcgaacatccaagcagcttga

SEQ ID NO: 25728 - protein, 67 aa, Burkholderia mallei ATCC 23344
MATGIVKWFNDAKGFGFITPDEGGEDLFAHFSAINMQGFKTLKEGQKVSFEVVQGPKGKQASNIQAA

SEQ ID NO: 25729 - DNA, 204 bp, Bacillus cereus ZK
  CDS (1)..(204)
atgaacatgcaaggaagagtgaaatggtttaatgcagaaaagggatttgggtttattgagcgtgaagatggtgatgatgtgtttgttcatttttctgctattcaacaagatggatataagtcattagaagaagggcaacaagttgagtttgatattgtagatggagcacgtggaccacaagcagctaatgttgtaaaactgtag

SEQ ID NO: 25730 - protein, 67 aa, Bacillus cereus ZK
MNMQGRVKWFNAEKGFGFIEREDGDDVFVHFSAIQQDGYKSLEEGQQVEFDIVDGARGPQAANVVKL

SEQ ID NO: 25731 - DNA, 201 bp, Bacillus cereus ZK
  CDS (1)..(201)
atgcaaaacggtaaagtaaaatggtttaactcagaaaaaggtttcggattcatcgaagttgaaggcggagaagacgtattcgttcatttctcagctatccaaggcgaaggtttcaaaactttagaagaaggtcaagaagttactttcgaagtagaacaaggtaaccgtggacctcaagctacaaacgttaacaagaagtaa

SEQ ID NO: 25732 - protein, 66 aa, Bacillus cereus ZK
MQNGKVKWFNSEKGFGFIEVEGGEDVFVHFSAIQGEGFKTLEEGQEVTFEVEQGNRGPQATNVNKK

SEQ ID NO: 25733 - DNA, 204 bp, Burkholderia pseudomallei K96243
  CDS (1)..(204)
atggataccggtatcgtgaaatggtttaacgatgctaagggcttcggctttattacgtcggacaatggcggcgaggatttgtttgcccatttctccgaaatcaggatggaggggttcaagacccttaaagagaatcagcgtgtgtcgttcgaagtgaaaaccggcccgaagggcaagcaagccgcgaatattcaggcgctttga

SEQ ID NO: 25734 - protein, 67 aa, Burkholderia pseudomallei K96243
MDTGIVKWFNDAKGFGFITSDNGGEDLFAHFSEIRMEGFKTLKENQRVSFEVKTGPKGKQAANIQAL

SEQ ID NO: 25735 - DNA, 201 bp, Bacillus licheniformis DSM 13
  CDS (1)..(201)
atgcaaaacggtaaagtaaaatggtttaacaatgaaaaaggcttcggcttcatcgaagttgaaggcggagacgatgtattcgttcatttcactgcaatcgaaggtgaaggatacaaatctctagaagaaggacaagaagtttctttcgaaattgttgaaggtaatcgtggacctcaagcatctaacgttgtgaagctttaa

SEQ ID NO: 25736 - protein, 66 aa, Bacillus licheniformis DSM 13
MQNGKVKWFNNEKGFGFIEVEGGDDVFVHFTAIEGEGYKSLEEGQEVSFEIVEGNRGPQASNVVKL

SEQ ID NO: 25737 - DNA, 201 bp, Bacillus licheniformis DSM 13
  CDS (1)..(201)
atgctagaaggtaaagtaaaatggtttaactctgaaaaaggtttcggattcatcgaagttgaaggacaagacgatgtattcgttcatttctctgctattcaaggcgaaggcttcaaaactttggaagaaggccaatctgtatctttcgaaatcgttgaaggaaaccgcggaccacaagctgctaacgtaacaaaagcgtaa

SEQ ID NO: 25738 - protein, 66 aa, Bacillus licheniformis DSM 13
MLEGKVKWFNSEKGFGFIEVEGQDDVFVHFSAIQGEGFKTLEEGQSVSFEIVEGNRGPQAANVTKA

SEQ ID NO: 25739 - DNA, 204 bp, Bacillus licheniformis DSM 13
  CDS (1)..(204)
atggaacaaggtacagttaaatggtttaatgcagaaaaaggttttggatttatcgaacgtgaaaatggagacgatgtattcgtacacttttctgcaatccaaagcgacggattcaaatcattagacgaaggtcaaaaagtaacatttgacgttgagcaaggtcctcgcggagctcaagctgctaacgttcaaaaaactgcttaa

SEQ ID NO: 25740 - protein, 67 aa, Bacillus licheniformis DSM 13
MEQGTVKWFNAEKGFGFIERENGDDVFVHFSAIQSDGFKSLDEGQKVTFDVEQGPRGAQAANVQKTA

SEQ ID NO: 25741 - DNA, 210 bp, Mannheimia succiniciproducens MBEL55E
  CDS (1)..(210)
atggaagttggtgttgtaaaatggttcaataatgctaagggatttggattcattaatgcggaaggaagtgatgcggatatttttgcacactattcagtcatcgaaatggatggttaccgttcattaaaagccggacaaaaagtgaattttgaagttgtacatggtgaaaaaggctcacacgcaactaaaattattcctattttagaataa

SEQ ID NO: 25742 - protein, 69 aa, Mannheimia succiniciproducens MBEL55E
MEVGVVKWFNNAKGFGFINAEGSDADIFAHYSVIEMDGYRSLKAGQKVNFEVVHGEKGSHATKIIPILE

SEQ ID NO: 25743 - DNA, 213 bp, Yersinia pseudotuberculosis IP 32953
  CDS (1)..(213)
atgtctaataaaatgactggtttagtaaaatggtttgacgctggtaaaggttttggtttcatcactccggctgatggcggcaaagatgtgttcgttcacttctctgctatccagagcaatgatttcaaaaccctggatgaaggccaaaatgtggagttctctatcgagaacggcgctaaaggccctgcagcggtaaacgttattgcgctgtaa

SEQ ID NO: 25744 - protein, 70 aa, Yersinia pseudotuberculosis IP 32953
MSNKMTGLVKWFDAGKGFGFITPADGGKDVFVHFSAIQSNDFKTLDEGQNVEFSIENGAKGPAAVNVIAL

SEQ ID NO: 25745 - DNA, 213 bp, Yersinia pseudotuberculosis IP 32953
  CDS (1)..(213)
atgtctaataaaatgactggtttagtaaaatggtttgacgctggtaaaggttttggtttcatctctccggctgatggcagcaaagatgtgttcgttcacttctctgctatccagagtaatgatttcaaaaccctggatgaaggccaaaatgtggagttctctatcgagaacggcgctaaaggcccctcagcagtaaacgtaatcgccctgtaa

SEQ ID NO: 25746 - protein, 70 aa, Yersinia pseudotuberculosis IP 32953
MSNKMTGLVKWFDAGKGFGFISPADGSKDVFVHFSAIQSNDFKTLDEGQNVEFSIENGAKGPSAVNVIAL

SEQ ID NO: 25747 - DNA, 201 bp, Leuconostoc mesenteroides
  CDS (1)..(201)
atggaaaaaggcacagtaaagtggtttaacggagaaaagggttacggattcatcacacgcgaaagcggcgaagatgtatttgcacacttctcagcaatccaaggcgacggcttcaagactcttgacgaaggtcaagcagttacatttgacgttgaaacttcagaccgcggtttgcaagcaacaaacatcacaaagggttaa

SEQ ID NO: 25748 - protein, 66 aa, Leuconostoc mesenteroides
MEKGTVKWFNGEKGYGFITRESGEDVFAHFSAIQGDGFKTLDEGQAVTFDVETSDRGLQATNITKG

SEQ ID NO: 25749 - DNA, 204 bp, Leifsonia xyli
  CDS (1)..(204)
atggctatcggcaccgtgaagtggttcaacgcagagaaggggtacggcttcatcgctcccgacgacggctcggtcgacgtcttcgcccacttccgcgaaattcaaacccagggcttccgcacccttgaggagaaccagaaggtcgagtacgaactcacccagggccccaaagggatgcaggcttccaacatccgggccgtctga

SEQ ID NO: 25750 - protein, 67 aa, Leifsonia xyli
MAIGTVKWFNAEKGYGFIAPDDGSVDVFAHFREIQTQGFRTLEENQKVEYELTQGPKGMQASNIRAV

SEQ ID NO: 25751 - DNA, 222 bp, Leifsonia xyli
  CDS (1)..(222)
atgaaggaagaaaagacgcccactagcaccgtcaaatggttcaactcgaagaaggggttcggcttcatcgccccggatgacggcagcaccgacgtcttcgtccactacagcgagatcgccgccaccggcggttaccgcaatctcgacgagaaccagaaggtcgaatacgacctcgcgcagggacccaagggtccccaggcagcgaacatccgaccggcctga

SEQ ID NO: 25752 - protein, 73 aa, Leifsonia xyli
MKEEKTPTSTVKWFNSKKGFGFIAPDDGSTDVFVHYSEIAATGGYRNLDENQKVEYDLAQGPKGPQAANIRPA

SEQ ID NO: 25753 - DNA, 201 bp, Desulfotalea psychrophila
  CDS (1)..(201)
atggctgaaggtacagttaagtggtttaatgacgcaaagggttttggttttatcgagcaagaaggtggacaggatgtcttcgtacattattctgctattggtggtgagggattcaaatcacttacagagggctcacgagtaaattttgaaattattgatggccctaaaggccctgctgctgataacgttttaaaagcttag

SEQ ID NO: 25754 - protein, 66 aa, Desulfotalea psychrophila
MAEGTVKWFNDAKGFGFIEQEGGQDVFVHYSAIGGEGFKSLTEGSRVNFEIIDGPKGPAADNVLKA

SEQ ID NO: 25755 - DNA, 201 bp, Desulfotalea psychrophila
  CDS (1)..(201)
atggctgaaggaattgtaaagtggtttaacgatgcgaagggttttggttttatcgagcaagagggtggagatgaccttttcgtacatcacaccagcattaatgcttccggtttcaaaactctcgaagaaggtgcacgcgtatctttcgagatcgaagacggcgctaaaggaccagcggcagcaaacgttaccgccctttaa

SEQ ID NO: 25756 - protein, 66 aa, Desulfotalea psychrophila
MAEGIVKWFNDAKGFGFIEQEGGDDLFVHHTSINASGFKTLEEGARVSFEIEDGAKGPAAANVTAL

SEQ ID NO: 25757 - DNA, 201 bp, Desulfotalea psychrophila
  CDS (1)..(201)
atggctgaaggaacagttaaatggtttaacgacgcgaaaggttttggttttatcgagcaagaaggtggcgatgatctcttcgtacactacagtagcatcagtggagaaggtttcaaaacccttcaagagggtacccgcgtgtctttcgatatcgagcaaggccctaagggcccggcagcagccaacgttgttgttctttaa

SEQ ID NO: 25758 - protein, 66 aa, Desulfotalea psychrophila
MAEGTVKWFNDAKGFGFIEQEGGDDLFVHYSSISGEGFKTLQEGTRVSFDIEQGPKGPAAANVVVL

SEQ ID NO: 25759 - DNA, 201 bp, Desulfotalea psychrophila
  CDS (1)..(201)
atggctgaaggaattgtaaaatggtttaacgatgcgaaaggttttggttttatcgaccaagaaggtggagatgaccttttcgtacaccacaccagcatcaacgcttctggtttcaaaactctcgaagaaggtgctcgcgtatcttttgatatcgaggaaggtcaaaaaggacctgcagctgcgaacgttaccgcactgtaa

SEQ ID NO: 25760 - protein, 66 aa, Desulfotalea psychrophila
MAEGIVKWFNDAKGFGFIDQEGGDDLFVHHTSINASGFKTLEEGARVSFDIEEGQKGPAAANVTAL

SEQ ID NO: 25761 - DNA, 201 bp, Desulfotalea psychrophila
  CDS (1)..(201)
atggctgaaggaattgtaaaatggtttaacgatgcgaaaggttttggttttatcgagcaagaaggtggagatgaccttttcgtacaccacaccagcatcaacgcttccggtttcaaaaccctcgaagaaggtgctcgcgtatcttttgatatcgaggaaggtcaaaaaggacctgcagctgcgaacgttaccgcactgtaa

SEQ ID NO: 25762 - protein, 66 aa, Desulfotalea psychrophila
MAEGIVKWFNDAKGFGFIEQEGGDDLFVHHTSINASGFKTLEEGARVSFDIEEGQKGPAAANVTAL

SEQ ID NO: 25763 - DNA, 201 bp, Desulfotalea psychrophila
  CDS (1)..(201)
atggctgaaggaactgtgaagtggtttaacgacgctaagggttttggttttatcgagcaagaaggtggagatgaccttttcgtacatcacaccagcatcaatgctagtggctttaaaaccctcgaagaaggtgcacgtgtaactttcgacattgaacaaggccccaagggtcctgctgctgcgaatgttaccgttatctag

SEQ ID NO: 25764 - protein, 66 aa, Desulfotalea psychrophila
MAEGTVKWFNDAKGFGFIEQEGGDDLFVHHTSINASGFKTLEEGARVTFDIEQGPKGPAAANVTVI

SEQ ID NO: 25765 - DNA, 222 bp, Erwinia carotovora
  CDS (1)..(222)
atggagacaggtactgttaaatggttcaataatgccaaagggtttggttttatctgtccagaagggggtggtgacgatatcttcgcgcactactcaactattcaaatggatggctaccggacgctgaaagccggacaggttgtcaggtttgatgttcatgaagggccgaaaggcaatcatgcctgcctgatcgtcccgcaaatcgtcgaggccgtatcctga

SEQ ID NO: 25766 - protein, 73 aa, Erwinia carotovora
METGTVKWFNNAKGFGFICPEGGGDDIFAHYSTIQMDGYRTLKAGQVVRFDVHEGPKGNHACLIVPQIVEAVS

SEQ ID NO: 25767 - DNA, 213 bp, Erwinia carotovora
  CDS (1)..(213)
atgtctaataaaatgactggtttagtaaaatggtttgacgctggtaaaggttttggtttcattactcctgacaacggtagcaaagatgtattcgtacatttctctgctattcagagcaacgatttcaaaactctggacgaaggccaaaaagttgagttcaccattgaaaatggtcagaaaggcccatcagctggcaacgttgttgcgctgtaa

SEQ ID NO: 25768 - protein, 70 aa, Erwinia carotovora
MSNKMTGLVKWFDAGKGFGFITPDNGSKDVFVHFSAIQSNDFKTLDEGQKVEFTIENGQKGPSAGNVVAL

SEQ ID NO: 25769 - DNA, 210 bp, Erwinia carotovora
  CDS (1)..(210)
atggcaaagattaaaggtcaggttaagtggttcaacgagtctaaaggctttggtttcatcactcctgctgacggcagcaaagatgtattcgtacatttctctgcaattcaaggcaacggcttcaaaactctggctgaaggccagaacgtagaattcgaaattcaggatggccagaaaggtccttccgcagtaaacgtcactgcgctgtaa

SEQ ID NO: 25770 - protein, 69 aa, Erwinia carotovora
MAKIKGQVKWFNESKGFGFITPADGSKDVFVHFSAIQGNGFKTLAEGQNVEFEIQDGQKGPSAVNVTAL

SEQ ID NO: 25771 - DNA, 210 bp, Erwinia carotovora
  CDS (1)..(210)
atgtctaagattaaaggtagtgttaagtggtttaatgagtcgaaaggcttcggtttcattactccagaagacggtagcaaagatgtgttcgtacacttctctgcaatccagagcaatggtttcaaaactctggctgaaggtcagcgtgtagagttcgaaatcactgacggtgccaaaggtccttctgctgctaacgttaacgctatttaa

SEQ ID NO: 25772 - protein, 69 aa, Erwinia carotovora
MSKIKGSVKWFNESKGFGFITPEDGSKDVFVHFSAIQSNGFKTLAEGQRVEFEITDGAKGPSAANVNAI

SEQ ID NO: 25773 - DNA, 213 bp, Acinetobacter sp
  CDS (1)..(213)
atgagtaatactattcaaggtacagtaaaatggtttaacgaaactaaaggttttggtttcattagttcagattcaggtgaagacgtttttgcacactatagcgaaatttcaaatagtggcttcaaaacacttctagaaggtcaacgtgttgaattcttagttgtaaacggtaaaaaaggtttacaagcaagcaatatcagcattgtaaaataa

SEQ ID NO: 25774 - protein, 70 aa, Acinetobacter sp
MSNTIQGTVKWFNETKGFGFISSDSGEDVFAHYSEISNSGFKTLLEGQRVEFLVVNGKKGLQASNISIVK

SEQ ID NO: 25775 - DNA, 213 bp, Acinetobacter sp
  CDS (1)..(213)
atgacagctcgtgaacaaggtgtagtaaagtggtttaacgataccaagggctttggctttattcaacgtaacggtggtgatgacgtatttgttcatttccgtgcaatcatgggtgacggtcaccgttcacttcgtgacggtcaacgcgttgaattcagtgttgttcaaggtcaaaaaggttttcaggctgaaaacgttcagcctttagactaa

SEQ ID NO: 25776 - protein, 70 aa, Acinetobacter sp
MTAREQGVVKWFNDTKGFGFIQRNGGDDVFVHFRAIMGDGHRSLRDGQRVEFSVVQGQKGFQAENVQPLD

SEQ ID NO: 25777 - DNA, 228 bp, Staphylococcus aureus
  CDS (1)..(228)
atgcaaaagcacacggaggttttctatatgaataacggtacagtaaaatggtttaacgcagaaaaaggttttggtttcatcgaacaagaaaatggcggagacgtattcgtacatttctcaggtatcgctagcgatggctacaaaactttagaagaaggtcaaaaagttactttcgaaatcactgaaggtcaacgtggagaccaagcagttaacgtacaaactgtttaa

SEQ ID NO: 25778 - protein, 75 aa, Staphylococcus aureus
MQKHTEVFYMNNGTVKWFNAEKGFGFIEQENGGDVFVHFSGIASDGYKTLEEGQKVTFEITEGQRGDQAVNVQTV

SEQ ID NO: 25779 - DNA, 210 bp, Photobacterium profundum
  CDS (1)..(210)
atgtctaacacaactggtatcgtgaagtggtttaacgaagagaaaggtttcggtttcatcactcaagacaacggcggcgctgacgtattcgtacatttccgtgcaatcgcttcagaaggctttaaaacgcttgctgaaggtcaaaaagtttcttttgaagtagagcaaggccaaaaaggtcttcaagctgcaaacgttgtagctatctaa

SEQ ID NO: 25780 - protein, 69 aa, Photobacterium profundum
MSNTTGIVKWFNEEKGFGFITQDNGGADVFVHFRAIASEGFKTLAEGQKVSFEVEQGQKGLQAANVVAI

SEQ ID NO: 25781 - DNA, 210 bp, Photobacterium profundum
  CDS (1)..(210)
atgtctaacacaactggtatcgttaagtggttcaacgaagagaaaggtttcggtttcattactcaagataacggcggcgctgacgtattcgttcacttccgtgctatcgctactgaaggcttcaaaactcttgctgaaggtcaaaaagtttcttttgacgttgaacaaggccagaaaggtcctcaagctgctaacgtagttgctctttaa

SEQ ID NO: 25782 - protein, 69 aa, Photobacterium profundum
MSNTTGIVKWFNEEKGFGFITQDNGGADVFVHFRAIATEGFKTLAEGQKVSFDVEQGQKGPQAANVVAL

SEQ ID NO: 25783 - DNA, 240 bp, Photobacterium profundum
  CDS (1)..(240)
atgaatttaaatattaagggacactacatgtctaatacaacaactggtctagtaaaatggtttaacgaagataaaggttttggtttcattactcaagacaacggcggcgctgacgtatttgttcacttccgtgcaatcgcttcagaaggctttaaaacactagctgaaggccaaaaagtatctttcgaagtagagcagggccaaaaaggtcctcaagcagctaacgtagtagcgctttaa

SEQ ID NO: 25784 - protein, 79 aa, Photobacterium profundum
MNLNIKGHYMSNTTTGLVKWFNEDKGFGFITQDNGGADVFVHFRAIASEGFKTLAEGQKVSFEVEQGQKGPQAANVVAL

SEQ ID NO: 25785 - DNA, 210 bp, Photobacterium profundum
  CDS (1)..(210)
atgtctaaaacaacaggtatcgttaagtggtttaacgacgagaaaggtttcggcttcatcactcaagataacggcggtgctgacgtattcgttcacttccgtgcaatcactggtgacggattcaaatctcttgctgaaggccagaaagtatcttttgacgttgagcaaggccagaaaggtcctcaagctgcaaacgttgaaatcgcataa

SEQ ID NO: 25786 - protein, 69 aa, Photobacterium profundum
MSKTTGIVKWFNDEKGFGFITQDNGGADVFVHFRAITGDGFKSLAEGQKVSFDVEQGQKGPQAANVEIA

SEQ ID NO: 25787 - DNA, 249 bp, Photobacterium profundum
  CDS (1)..(249)
atgcctataacagttgatgtagaaaaatcaggagacaacatgtctaaagcaacaggtaccgttaagtggttcaatgaagaaaaaggtttcggtttcatcacacaggataacggcggtgctgacgtattcgttcattttcgtgccattacgggcgacggctttaaaacactagccgaaggtcaaaaagtttcttatgaaactgagcagggaccaaaaggtttacaagctgcaaatgtagaagctatctaa

SEQ ID NO: 25788 - protein, 82 aa, Photobacterium profundum
MPITVDVEKSGDNMSKATGTVKWFNEEKGFGFITQDNGGADVFVHFRAITGDGFKTLAEGQKVSYETEQGPKGLQAANVEAI

SEQ ID NO: 25789 - DNA, 222 bp, Photobacterium profundum
  CDS (1)..(222)
atggcaacaggtacagttaaatggtttaataacgccaaaggttttggttttatctgcccagaagagggtgaaggcgatatttttgcgcactattcaactattcaaatggatggatatcgaactctcaaagccggccagcaggtcaactatgagattcaaacagggcctaaaggtcaccatgctagcgagatcgtcccagtcgaaggtgaactaactaaatag

SEQ ID NO: 25790 - protein, 73 aa, Photobacterium profundum
MATGTVKWFNNAKGFGFICPEEGEGDIFAHYSTIQMDGYRTLKAGQQVNYEIQTGPKGHHASEIVPVEGELTK

SEQ ID NO: 25791 - DNA, 204 bp, Corynebacterium diphtheriae
  CDS (1)..(204)
atggcacagggaactgtgaagtggttcaacgctgaaaaaggtttcggcttcatcgctccggaggacggctccgctgacgtcttcgtccactactccgagatccagggcaacggcttccgtaccctcgaagagaaccagaaggttgagttcgaggtcggcgagggtgccaagggtcctcaggcgcagcaggttcgcgctatctaa

SEQ ID NO: 25792 - protein, 67 aa, Corynebacterium diphtheriae
MAQGTVKWFNAEKGFGFIAPEDGSADVFVHYSEIQGNGFRTLEENQKVEFEVGEGAKGPQAQQVRAI

SEQ ID NO: 25793 - DNA, 210 bp, Pseudomonas aeruginosa
  CDS (1)..(210)
atggcaactcgccaaactggtactgttaagtggtttaacgaagttaaaggtttcggcttcatcaccccggaaagcggcgcagatgttttcgttcacttccgacagatcgaagctagcggttacaagtcccttgacgaaggacaacgtgtaagcttcttcgttactgcaggcgccaaaggcccgcaggccgagcaagtgcaagctctgtag

SEQ ID NO: 25794 - protein, 69 aa, Pseudomonas aeruginosa
MATRQTGTVKWFNEVKGFGFITPESGADVFVHFRQIEASGYKSLDEGQRVSFFVTAGAKGPQAEQVQAL

SEQ ID NO: 25795 - DNA, 726 bp, Oryza sativa
  CDS (1)..(726)
atggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaaggccgtcgacgtcaccggccccgacggatccttcgtcaagggcggcgccggcggcggcggcggtggcgggggaggcttcggatcgcgcggtgggggcggatctggcggtggcggccgcagctatggcggtagctggggcggggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaggtggtggtggtggcggcggcggcggcggcgcctgctacaactgcggcgagaccggccacctcgcgagggactgctacaacggcggcggtggaggcggaggcgggcgattcggcggtggaggcgaccgctcctgctacaactgcggcgaggctggacacatcgcccgcgactgccacaagtga

SEQ ID NO: 25796 - protein, 241 aa, Oryza sativa
MAAAARHRGTVKWFNDTKGFGFISPDDGSEDLFVHQSSIKADGFRSLAEGEQVEFAISESEDGRTKAVDVTGPDGSFVKGGAGGGGGGGGGFGSRGGGGSGGGGRSYGGSWGGGRRSGGGGPGGGCFKCGESGHMARDCFNGGGVGVGGGGGGGGGAGGGCFKCGEMGHMARDCFNSGGGGGGGGGGGGGGACYNCGETGHLARDCYNGGGGGGGGRFGGGGDRSCYNCGEAGHIARDCHK

SEQ ID NO: 25797 - DNA, 201 bp, Lactobacillus casei
  CDS (1)..(201)
atgcaaaaaggtacagttaaatggttcaacgctgataagggttacggcttcatcactggtgaagacggccaagacgtctttgtacatttcagcgccatcaatggcgaaggctacaagagtcttgacgaaggtcaggctgtttcctacgatgtagaacaatctgatcgtggccctcaggctgctaacgttaccaagctttaa

SEQ ID NO: 25798 - protein, 66 aa, Lactobacillus casei
MQKGTVKWFNADKGYGFITGEDGQDVFVHFSAINGEGYKSLDEGQAVSYDVEQSDRGPQAANVTKL

SEQ ID NO: 25799 - DNA, 204 bp, Bacillus cereus
  CDS (1)..(204)
atgaacatgcaaggaagagtaaaatggttcaatgcagaaaagggatttgggtttattgagcgtgaagacggtgatgatgtgtttgttcatttttctgctattcaacaagatggatataagtcattagaagaagggcaacaagttgagtttgatattgtagagggagcacgtggaccacaagcagctaatgttgtaaaactgtag

SEQ ID NO: 25800 - protein, 67 aa, Bacillus cereus
MNMQGRVKWFNAEKGFGFIEREDGDDVFVHFSAIQQDGYKSLEEGQQVEFDIVEGARGPQAANVVKL

SEQ ID NO: 25801 - DNA, 204 bp, Mycobacterium paratuberculosis
  CDS (1)..(204)
atggcacagggaactgtgaaatggttcaacggtgaaaagggcttcggcttcatcacccctgacgacggcacgaaggacctcttcgtccattactccgagatccagggaagcggctatcgctcgctcgacgagaaccagcgtgttcagttcgacgttgagcagggagccaagggaccccaggcggtaggagtcagcaccgtctga

SEQ ID NO: 25802 - protein, 67 aa, Mycobacterium paratuberculosis
MAQGTVKWFNGEKGFGFITPDDGTKDLFVHYSEIQGSGYRSLDENQRVQFDVEQGAKGPQAVGVSTV

SEQ ID NO: 25803 - DNA, 201 bp, Geobacter sulfurreducens
  CDS (1)..(201)
atggctatcggaagagttaagtggttcaacgacgccaagggttttgggttcatcgagcaggacaatggcgaggatgtgttcgtacatttctccgccatccagcaggatggtttcaagtccctcgccgagggtgagcaagtttccttcgacgtggtgaatggccccaaggggcttcaggccgccaacgtcaagaaggcctaa

SEQ ID NO: 25804 - protein, 66 aa, Geobacter sulfurreducens
MAIGRVKWFNDAKGFGFIEQDNGEDVFVHFSAIQQDGFKSLAEGEQVSFDVVNGPKGLQAANVKKA

SEQ ID NO: 25805 - DNA, 201 bp, Geobacter sulfurreducens
  CDS (1)..(201)
atggctaaaggtgtggtgaaatggttcaatgacagcaaggggtatggctttatcgagcaggaaaacggcgaggatgtgtttgttcatttttcctcgatccagggcgacgggttcaagaccttggtcgaaggacaggcggtgacctttgatgtggttcagggggccaagggcctccaggcggccaatgtcatgaaggcgtag

SEQ ID NO: 25806 - protein, 66 aa, Geobacter sulfurreducens
MAKGVVKWFNDSKGYGFIEQENGEDVFVHFSSIQGDGFKTLVEGQAVTFDVVQGAKGLQAANVMKA

SEQ ID NO: 25807 - DNA, 201 bp, Geobacter sulfurreducens
  CDS (1)..(201)
atggtaaacggaacagtgaagtggttcaatgacagcaagggctttggttttcttgagcaggagaatggcgaggacgtattcgtgcatttctccgccatcaacggcaacggcttcaagtcccttgctgaaggcgatagggtaaccttcgaagtgaccaagggccccaaggggcttcaggccgctaacgtgacgcggatatag

SEQ ID NO: 25808 - protein, 66 aa, Geobacter sulfurreducens
MVNGTVKWFNDSKGFGFLEQENGEDVFVHFSAINGNGFKSLAEGDRVTFEVTKGPKGLQAANVTRI

SEQ ID NO: 25809 - DNA, 1025 bp, Triticum aestivum
  CDS (44)..(739)
gtttcctgctagggttttggtccttcgttttcggcggcgcaagatgggggagagggtcaagggaaccgtgaagtggttcaacgtcaccaaggggttcggcttcatctccccggacgacggcggcgaggaccttttcgtccaccagtccgccatcaagtccgacggctaccgcagcctcaacgagaacgacgccgtcgagttcgagataatcaccggcgacgacggacgcaccaaggcctccgacgtcaccgcaccaggaggaggggcgctctccggcggctcccgccctggcgaaggcggtggtgaccgcgggggccgcggcggctatggaggcggcggcggtggctacggcggtggcggtggtggctacggaggcggtggtggcggctacggcggcggtggtggcggttacggtggcggtggctatggaggcggcggtggcggcggccgtgggtgctacaagtgcggcgaagatggccacatctccagggactgcccccagggcggcggtggcggcggcggctacggcggtggtggctacggaggtggtggcggcggcggccgtgagtgctacaagtgcggcgaggagggccacatctccagggactgcccccagggcggcggcggcggcggctacggaggcggtggcggccgtggcggtggcggcggcggtggcggctgcttctcctgcggcgagtccggccacttctcccgcgagtgccccaacaaggcccactaggcggcacagctcttcagatctgagtgccccgtttacccttgctcctttacctacctcctgattctgcagcaagtcataccctatacctatcagtactagtattagtcgccgtagcgtttccccctgctgctcgatgcgagcttggttccagaagaattgctggtggtgtgttcgttaagatccaagttattttgctgtctctctgtgatgaggacacagatctatctatgtgttggatggactaagttatcgaagtcaagtttggtgtcaaaaaaaaaaaaaaaaa

SEQ ID NO: 25810 - protein, 231 aa, Triticum aestivum
MGERVKGTVKWFNVTKGFGFISPDDGGEDLFVHQSAIKSDGYRSLNENDAVEFEIITGDDGRTKASDVTAPGGGALSGGSRPGEGGGDRGGRGGYGGGGGGYGGGGGGYGGGGGGYGGGGGGYGGGGYGGGGGGGRGCYKCGEDGHISRDCPQGGGGGGGYGGGGYGGGGGGGRECYKCGEEGHISRDCPQGGGGGGYGGGGGRGGGGGGGGCFSCGESGHFSRECPNKAH

SEQ ID NO: 25811 - DNA, 996 bp, Triticum aestivum
  CDS (59)..(676)
caccgatctagggtttcctgctagggttttagtccttcgtttccggcggcggcgcaagatgggtgagagactgaagggtaccgtgaagtggttcaacgtgaccaaggggttcggcttcatctccccggaggacggcagcgaggacctcttcgtccaccagtccgccatcaaggccgacggctaccgcagcctcaacgagaacgacgtcgtcgagttcgaggtcatcaccggcgacgacgggcgcaccaaggccaccgacgtcaccgcaccaggaggaggtgcgctcgccggcggctcccgccctagcgaaggcggtggtgaccgcgggggtcgcggcggcggtggctacggtggaggcggctatggcggtggcggcggcggctacggaggtggcggcggtggctacggaggtggcggcggcagctacggcggcggtggcggctacggaggtggtggtggcggcggccgctacggaggaggcagcggtggcggccgtgagtgctacaagtgcggcgaggagggccacatctccagggactgcccccagggcggcggtggcggtggtggtggctacggaggcggtggcggccgtggcggtggtggtggcggtggcggctgcttctcctgcggcgagtccggccacttctcgcgcgagtgccccaacaagaccaactaggcggcgctgcccgtcagatctgagttccccgttccccttcgctccttttcctaccgcctgactctgcagcaagtcatacctatacctatcagtattagtatatgtcgccgtagtgttcccgtgcttctcgtaggaagaagaatcgacgatgcgagcttggttccagaagtattgttggtggattattgttcgttcgaagttatcttgtcgtgtcgtctgatgtggacagactgatctatctctatgtattggatggaccgaagttatgcaagtctaagttatgctgtctgattattgaaaaaaaaaaaaaaaaaaaaaaa

SEQ ID NO: 25812 - protein, 205 aa, Triticum aestivum
MGERLKGTVKWFNVTKGFGFISPEDGSEDLFVHQSAIKADGYRSLNENDVVEFEVITGDDGRTKATDVTAPGGGALAGGSRPSEGGGDRGGRGGGGYGGGGYGGGGGGYGGGGGGYGGGGGSYGGGGGYGGGGGGGRYGGGSGGGRECYKCGEEGHISRDCPQGGGGGGGGYGGGGGRGGGGGGGGCFSCGESGHFSRECPNKTN

SEQ ID NO: 25813 - DNA, 210 bp, Vibrio vulnificus
  CDS (1)..(210)
atgtctaacacagtaaccggcaccgtaaaatggtttaacgaaactaaaggctttggcttcatcaagcaagaaaacggcccggacgtttttgcacacttctctgctatcaaaggtgatggcttccgcactcttgctgaaggtcagaaagtttctttcgtcatctctcaaggccaaaaaggtcctcaagcagaagagatcacactgctttaa

SEQ ID NO: 25814 - protein, 69 aa, Vibrio vulnificus
MSNTVTGTVKWFNETKGFGFIKQENGPDVFAHFSAIKGDGFRTLAEGQKVSFVISQGQKGPQAEEITLL

SEQ ID NO: 25815 - DNA, 213 bp, Vibrio vulnificus
  CDS (1)..(213)
atgtctaataaagtaactggttcagtaaaatggtttaacgaaacgaaaggtttcggttttatttctcaagacaacggtggtaacgatgtgtttgttcacttcaactctatcgtttcaacaggttttaaaactttggcagaaggccaacgcgtaacatttgaagttgagcaaggcaaaaaaggcccacaagctgcaaacgtaactgcgctataa

SEQ ID NO: 25816 - protein, 70 aa, Vibrio vulnificus
MSNKVTGSVKWFNETKGFGFISQDNGGNDVFVHFNSIVSTGFKTLAEGQRVTFEVEQGKKGPQAANVTAL

SEQ ID NO: 25817 - DNA, 231 bp, Vibrio vulnificus
  CDS (1)..(231)
atgtatagcatggctacaggtacagtaaagtggttcaataacgccaaaggatttggttttatctgttcagatcaagaggaaggcgacatcttcgcccactactcaacgattcagatggacggttatcgtacactgaaagcgggccaacaagtcacgtatgagattgagaaaggtccgaaagggtgtcacgctagcagcgtcgttccactcgaagtacaagcaacgaagtaa

SEQ ID NO: 25818 - protein, 76 aa, Vibrio vulnificus
MYSMATGTVKWFNNAKGFGFICSDQEEGDIFAHYSTIQMDGYRTLKAGQQVTYEIEKGPKGCHASSVVPLEVQATK

SEQ ID NO: 25819 - DNA, 213 bp, Vibrio vulnificus
  CDS (1)..(213)
atgtctggtaaaatgactggtacagtaaaatggttcaacgagactaaaggttttggttttatttctcaagacaacggcggcaaagatgtattcgtacacttccgtgctatcgtttctgaaggcttcaaaactcttgctgaaggtcagaaagtaagcttcaacgttgaagaaggtcaaaaaggcccacaagcttctaacgttacagttatctaa

SEQ ID NO: 25820 - protein, 70 aa, Vibrio vulnificus
MSGKMTGTVKWFNETKGFGFISQDNGGKDVFVHFRAIVSEGFKTLAEGQKVSFNVEEGQKGPQASNVTVI

SEQ ID NO: 25821 - DNA, 216 bp, Photorhabdus luminescens
  CDS (1)..(216)
atgtctagttcaatgactggttcagtaaaatggtttaacaacgataaaggttttggctttatttccccaaaagatggtagcaaagatgttttcgttcattattctgcaattcagagtaataatttcaaaacattggaagaaggtcaggaagtctcattctctattgagaatggcgctaaaggcccatctgcggtaaatgttatcgtattatcttaa

SEQ ID NO: 25822 - protein, 71 aa, Photorhabdus luminescens
MSSSMTGSVKWFNNDKGFGFISPKDGSKDVFVHYSAIQSNNFKTLEEGQEVSFSIENGAKGPSAVNVIVLS

SEQ ID NO: 25823 - DNA, 210 bp, Photorhabdus luminescens
  CDS (1)..(210)
atggcaaaaatcactggtactgtaaagtggttcaacgaatctaaaggttttggttttattactccagctgatggtagcaaagatgtgtttgtacattttagcgctattcagagcgagggttttaaaactttggccgaaggtcaaaaagttgagtttgaaattcaggacggtcagaaaggtccttcagcagcaaacgttacagcagcataa

SEQ ID NO: 25824 - protein, 69 aa, Photorhabdus luminescens
MAKITGTVKWFNESKGFGFITPADGSKDVFVHFSAIQSEGFKTLAEGQKVEFEIQDGQKGPSAANVTAA

SEQ ID NO: 25825 - DNA, 213 bp, Photorhabdus luminescens
  CDS (1)..(213)
atgtctgacaaaatgaaaggtcaagtgaagtggttcaacgagtctaaaggcttcggtttcatcaccccagctgacggtagcaaagacgtattcgttcacttctctgccattcagggtaacggtttcaaaactttggcagaaggccagaacgtagaattcaccattgaaaatggtgcgaaaggtccagctgcagcaaacgtaatggctatctga

SEQ ID NO: 25826 - protein, 70 aa, Photorhabdus luminescens
MSDKMKGQVKWFNESKGFGFITPADGSKDVFVHFSAIQGNGFKTLAEGQNVEFTIENGAKGPAAANVMAI

SEQ ID NO: 25827 - DNA, 222 bp, Photorhabdus luminescens
  CDS (1)..(222)
atggagacaggtactgttaagtggttcaataatgctaagggttttgggtttatttgcccggcaagcggcggagaagatatattcgctcattactcaaccattcagatggacggttaccggacgctgaaagcgggccaaaaggtgaatttcagcgttcacctaggaccaaagggaaatcatgccagtattattgttcctcttgaaaacgaacccaaaggctaa

SEQ ID NO: 25828 - protein, 73 aa, Photorhabdus luminescens
METGTVKWFNNAKGFGFICPASGGEDIFAHYSTIQMDGYRTLKAGQKVNFSVHLGPKGNHASIIVPLENEPKG

SEQ ID NO: 25829 - DNA, 213 bp, Photorhabdus luminescens
  CDS (1)..(213)
atgatgtcaaaaattaaaggtaacgttaagtggtttaatgaatctaaaggattcgggtttatcactccagaagatggtagcaaagacgtattcgtgcatttctctgctattcagattaccggatttaaaactttggcagaaggtcaaaaagtagagtttgaaatcactgacggcgctaaaggtccatctgctgtaaacgttgtcgctatctga

SEQ ID NO: 25830 - protein, 70 aa, Photorhabdus luminescens
MMSKIKGNVKWFNESKGFGFITPEDGSKDVFVHFSAIQITGFKTLAEGQKVEFEITDGAKGPSAVNVVAI

SEQ ID NO: 25831 - DNA, 204 bp, Chromobacterium violaceum
  CDS (1)..(204)
atggcatttggtaccgtgaagtggttcaatgacgcgaaaggcttcggctttattaccccggacgaaggtggcgaggatctgttcgcccatttctcggccatcaacatgcaaggcttcaagaccctgaaagagggtcagcgcgtaagctttgaagtggtgtccggcccgaagggtaagcaagcgtccaatattcagaacgcgtaa

SEQ ID NO: 25832 - protein, 67 aa, Chromobacterium violaceum
MAFGTVKWFNDAKGFGFITPDEGGEDLFAHFSAINMQGFKTLKEGQRVSFEVVSGPKGKQASNIQNA

SEQ ID NO: 25833 - DNA, 333 bp, Chromobacterium violaceum
  CDS (1)..(333)
atgcctcccgcaggatgctcaagttgtgtgatgtgtagttgtcgtagtggcaatagccgtacctcagtcgccatttcccttgatcttcgtgccttttattcaactgctcgttttgaggaatttaacaaaatggcaaccggtaccgttaagtggtttaacgactccaaaggctttggcttcatcaccccggacgaaggcggcgacgacgtatttgctcacttctcccaaatcaacgccaagggcttccgctccctggccgaaaaccagcgcgtgagcttcgacatcgtcgaaggcccgaagggcaagcaagcctccaacatccagcccatctaa

SEQ ID NO: 25834 - protein, 110 aa, Chromobacterium violaceum
MPPAGCSSCVMCSCRSGNSRTSVAISLDLRAFYSTARFEEFNKMATGTVKWFNDSKGFGFITPDEGGDDVFAHFSQINAKGFRSLAENQRVSFDIVEGPKGKQASNIQPI

SEQ ID NO: 25835 - DNA, 207 bp, Haemophilus ducreyi
  CDS (1)..(207)
atgcatattggcattgtgaaatggtttaacaacgtaaaaggatttggcttcattacttgtgataccgttgaaggtgatatttttgcccacttttctgaaattaaacaagatggctatcgctcattgaaagtaggacaaaaagtacaatttgaactagtcactaatgaacgtggtgcatctgctacgcatatttctactatagaataa

SEQ ID NO: 25836 - protein, 68 aa, Haemophilus ducreyi
MHIGIVKWFNNVKGFGFITCDTVEGDIFAHFSEIKQDGYRSLKVGQKVQFELVTNERGASATHISTIE

SEQ ID NO: 25837 - DNA, 210 bp, Candidatus Blochmannia floridanus
  CDS (1)..(210)
atggcaaagattaaaggtcaagtaaaatggtttaatgaatctaaggggtttggttttatcacacccgcagatgggagtaaggatgtgtttgttcatttttctgctattcaaggaaatggatttaagacattgtctgaaggtcagaatgtagagtttgaagtacaagatgggcataaaggtccatcggcagtgaatgtaacatctttataa

SEQ ID NO: 25838 - protein, 69 aa, Candidatus Blochmannia floridanus
MAKIKGQVKWFNESKGFGFITPADGSKDVFVHFSAIQGNGFKTLSEGQNVEFEVQDGHKGPSAVNVTSL

SEQ ID NO: 25839 - DNA, 207 bp, Bordetella pertussis
  CDS (1)..(207)
atggctcaaaagggcaaggtcaagtggttcaacgccgacaagggttatggattcatcactccggacagcggcggtactgacgtattcgcacatttctctgcgattcaaggccgcggttatcgcagcctgaacgaaggtcaggaagtcgagttcgaagtgaaggatgttccgaaaggacctcaagcggccgaaattcgcccgctctga

SEQ ID NO: 25840 - protein, 68 aa, Bordetella pertussis
MAQKGKVKWFNADKGYGFITPDSGGTDVFAHFSAIQGRGYRSLNEGQEVEFEVKDVPKGPQAAEIRPL

SEQ ID NO: 25841 - DNA, 246 bp, Bordetella pertussis
  CDS (1)..(246)
atgtctgatacgaccgcaaccgctgtccaaggggacaatcctaaagccacgggtaccgttaaatggttcaacgatgcgaaggggttcggattcatcacgcccgatgacggcggtgaagatctgttcgcgcatttctcgtccatccagatgaacggtttcaaaaccctaaaagaaggccagaaggtctcgttcgagatcattcagggtcccaagggcaaacaggcactcaatattacgtctgcctga

SEQ ID NO: 25842 - protein, 81 aa, Bordetella pertussis
MSDTTATAVQGDNPKATGTVKWFNDAKGFGFITPDDGGEDLFAHFSSIQMNGFKTLKEGQKVSFEIIQGPKGKQALNITSA

SEQ ID NO: 25843 - DNA, 201 bp, Bordetella pertussis
  CDS (1)..(201)
atggcaaccggtatcgtcaagtggttcaatgccgaaaagggctatggattcatcatgcccgatgacggcagtaaagatctttttgcacattattccgagatctgcagcgagggctacaaatcgctgcaggagaatcagcgcgtatccttcgaggtgggacaagggcccaagggcccaaggggccaagcgccaagaacataa

SEQ ID NO: 25844 - protein, 66 aa, Bordetella pertussis
MATGIVKWFNAEKGYGFIMPDDGSKDLFAHYSEICSEGYKSLQENQRVSFEVGQGPKGPRGQAPRT

SEQ ID NO: 25845 - DNA, 207 bp, Bordetella parapertussis
  CDS (1)..(207)
atggctcaaaagggcaaggtcaagtggttcaacgccgacaagggttatggattcatcactccggacagcggcggtactgacgtattcgcacatttctcggcgattcaaggccgcggttatcgcagcctgaacgaaggtcaggaagtcgagttcgaagtgaaggatggtccgaaaggacctcaagcggccgaaattcgcccgctctga

SEQ ID NO: 25846 - protein, 68 aa, Bordetella parapertussis
MAQKGKVKWFNADKGYGFITPDSGGTDVFAHFSAIQGRGYRSLNEGQEVEFEVKDGPKGPQAAEIRPL

SEQ ID NO: 25847 - DNA, 207 bp, Bordetella parapertussis
  CDS (1)..(207)
atggcaaccggtatcgtcaagtggttcaatgccgaaaagggctatggattcatcatgcccgatgacggcagtaaagatctttttgcacattattccgagatccgcagcgagggctacaaatcgctgcaggagaatcagcgcgtatccttcgaggtgggacaagggcccaaggggccaagcgccaagaacataaaagtcatcgcttga

SEQ ID NO: 25848 - protein, 68 aa, Bordetella parapertussis
MATGIVKWFNAEKGYGFIMPDDGSKDLFAHYSEIRSEGYKSLQENQRVSFEVGQGPKGPSAKNIKVIA

SEQ ID NO: 25849 - DNA, 204 bp, Bordetella parapertussis
  CDS (1)..(204)
atgcaaacaggcatagtcaagtggttcaacgacgagaagggttttggtttcatcatgccggaaaacggcggccccgatcttttcgcccactactctgaaatccagggcgagggccacaaggcgctcgtcgaacagcaacgagtgagctacgtccagggccacgggcccaaggggccgatggccaccaagatcaccccgttgtga

SEQ ID NO: 25850 - protein, 67 aa, Bordetella parapertussis
MQTGIVKWFNDEKGFGFIMPENGGPDLFAHYSEIQGEGHKALVEQQRVSYVQGHGPKGPMATKITPL

SEQ ID NO: 25851 - DNA, 198 bp, Bacillus cereus
  CDS (1)..(198)
atgcaaggaaaagtaaaatggtttaacaacgaaaaaggttttggatttatcgaaatggaaggcgctgacgatgtattcgtacatttctctgctattcaaggcgacggctacaaagctttagaagaaggtcaagaagtatctttcgacattactgaaggtaaccgcggacctcaagctgctaacgtagtaaaactttaa

SEQ ID NO: 25852 - protein, 65 aa, Bacillus cereus
MQGKVKWFNNEKGFGFIEMEGADDVFVHFSAIQGDGYKALEEGQEVSFDITEGNRGPQAANVVKL

SEQ ID NO: 25853 - DNA, 198 bp, Bacillus anthracis
  CDS (1)..(198)
atgcaaggaaaagtaaaatggtttaacaacgaaaaaggttttggatttatcgaaatggaaggcgctgacgatgtattcgtacatttctctgcgattcaaggcgaaggctacaaagctttagaagaaggtcaagaagtatctttcgatatcactgaaggaaaccgcggacctcaagctgctaacgtagtaaaactttaa

SEQ ID NO: 25854 - protein, 65 aa, Bacillus anthracis
MQGKVKWFNNEKGFGFIEMEGADDVFVHFSAIQGEGYKALEEGQEVSFDITEGNRGPQAANVVKL

SEQ ID NO: 25855 - DNA, 204 bp, Streptomyces avermitilis
  CDS (1)..(204)
atggctaccggaaccgtgaagtggtttaacgccgaaaagggctttggtttcatcgcccaggaaggcggcggcccggacgtcttcgtccactactccgcgatcaacgcgagcggattccgctctctcgaagagaaccagtcggtttccttcgacgtcacgcagggtccgaagggcccgcaggcggagaacgtcaccccgctctaa

SEQ ID NO: 25856 - protein, 67 aa, Streptomyces avermitilis
MATGTVKWFNAEKGFGFIAQEGGGPDVFVHYSAINASGFRSLEENQSVSFDVTQGPKGPQAENVTPL

SEQ ID NO: 25857 - DNA, 204 bp, Streptomyces avermitilis
  CDS (1)..(204)
atggctactggtaccgtgaagtggttcaacgcggaaaagggtttcggcttcatcgagcaggacggtggcggcgctgacgtcttcgcccactactcgaacatcgccacccagggcttccgcgagctgcaggaaggccagaaggtgacgttcgacgtcacgcagggccagaagggcccgcaggcggagaacatcgtcccggcctaa

SEQ ID NO: 25858 - protein, 67 aa, Streptomyces avermitilis
MATGTVKWFNAEKGFGFIEQDGGGADVFAHYSNIATQGFRELQEGQKVTFDVTQGQKGPQAENIVPA

SEQ ID NO: 25859 - DNA, 204 bp, Streptomyces avermitilis
  CDS (1)..(204)
atggcatctggcaccgtgaagtggttcaacgcggaaaagggttttggcttcatcgagcaggacggtggcggcgctgacgtgttcgcccactactcgaacatcgccacctccggcttccgcgagcttcaggagggccagaaggtgaacttcgacgtcacgcagggccagaagggcccgcaggccgagaacatcgttcccgcctga

SEQ ID NO: 25860 - protein, 67 aa, Streptomyces avermitilis
MASGTVKWFNAEKGFGFIEQDGGGADVFAHYSNIATSGFRELQEGQKVNFDVTQGQKGPQAENIVPA

SEQ ID NO: 25861 - DNA, 204 bp, Streptomyces avermitilis
  CDS (1)..(204)
atggctactggcaccgtgaagtggttcaacgcggaaaagggtttcggcttcatcgagcaggacggcggcggcccggacgtcttcgcccactactcgaacatcgccgcccagggcttccgcgagctccaggaaggccagaaggtgaacttcgacatcgcgcagggccagaagggcccgacggccgagaacatcgttcccgcctga

SEQ ID NO: 25862 - protein, 67 aa, Streptomyces avermitilis
MATGTVKWFNAEKGFGFIEQDGGGPDVFAHYSNIAAQGFRELQEGQKVNFDIAQGQKGPTAENIVPA

SEQ ID NO: 25863 - DNA, 207 bp, Streptomyces avermitilis
  CDS (1)..(207)
atggctcagggcaccgtcaagtggttcaacgcggagaaggggtacggcttcatcgcggtcgacggtggtgcggatgtattcgtccactacagcgcgattcagatggacggctaccgcaccctggaagagggtcagcgggtcgatttcgagatctcgcaaggccagaaggggccgcaggcggacatggtccgactggcgaccggctga

SEQ ID NO: 25864 - protein, 68 aa, Streptomyces avermitilis
MAQGTVKWFNAEKGYGFIAVDGGADVFVHYSAIQMDGYRTLEEGQRVDFEISQGQKGPQADMVRLATG

SEQ ID NO: 25865 - DNA, 204 bp, Streptomyces avermitilis
  CDS (1)..(204)
atggccagcggtaccgtcaagtggttcaactcggaaaagggcttcggcttcatcgagcaggacggtggaggcccggacgtcttcgcccactactcgaacatcgccagctcgggcttccgtgagcttcaggaaggccagaaggtgaacttcgatgtcacccagggccagaagggcccgcaggcggagaacatcacccccgcctga

SEQ ID NO: 25866 - protein, 67 aa, Streptomyces avermitilis
MASGTVKWFNSEKGFGFIEQDGGGPDVFAHYSNIASSGFRELQEGQKVNFDVTQGQKGPQAENITPA

SEQ ID NO: 25867 - DNA, 204 bp, Streptomyces avermitilis
  CDS (1)..(204)
atggccaccggcaccgtgaaatggttcaacgcagaaaagggcttcggattcatcgagcaggagggcggcggccccgacgtcttcgtgcactactcggccatcaacagcgctggtttccgggaactgcaggagggacagaaggtcaacttcgacgtcacccagggcccgaagggcccccaggcggagaacgtcaccccggcctga

SEQ ID NO: 25868 - protein, 67 aa, Streptomyces avermitilis
MATGTVKWFNAEKGFGFIEQEGGGPDVFVHYSAINSAGFRELQEGQKVNFDVTQGPKGPQAENVTPA

SEQ ID NO: 25869 - DNA, 204 bp, Nitrosomonas europaea
  CDS (1)..(204)
atggcaacaggtacagtaaagtggttcaatgattcaaaaggatttggttttattacaccggacgacggcagcgaagatttgttcgcacacttttccgcgatcaatatgacaggtttcaagaccctgaaagaaggccagaaagtaagttttgaagttacgcaaggaccaaaaggcaaacaggcttcaaatatccagtctgcttga

SEQ ID NO: 25870 - protein, 67 aa, Nitrosomonas europaea
MATGTVKWFNDSKGFGFITPDDGSEDLFAHFSAINMTGFKTLKEGQKVSFEVTQGPKGKQASNIQSA

SEQ ID NO: 25871 - DNA, 204 bp, Nitrosomonas europaea
  CDS (1)..(204)
atgacgacaggtacagttaaatggtttaatgatgcaaaaggttttgggtttattactcctgacgatggtagtgaagatctattcgcgcatttttctgcaatcaatatgaatgggtttaagacgcttagagaaggtcagaaagtttcttttgatgtaacacaaggtcaaaagggcaagcaggcatccaatattcaagctccttga

SEQ ID NO: 25872 - protein, 67 aa, Nitrosomonas europaea
MTTGTVKWFNDAKGFGFITPDDGSEDLFAHFSAINMNGFKTLREGQKVSFDVTQGQKGKQASNIQAP

SEQ ID NO: 25873 - DNA, 201 bp, Enterococcus faecalis
  CDS (1)..(201)
atggaacaaggaacagtaaaatggtttaacgcagaaaaaggttttgggtttatctcacgcgaagacggaagcgacgtattcgtacacttctcagctatccaaggtgatggtttcaaaactttagaagaaggtcaagcagtgacttttgatgttgaagattcagaccgtggccctcaagcagttaacgtagaaaaaaactaa

SEQ ID NO: 25874 - protein, 66 aa, Enterococcus faecalis
MEQGTVKWFNAEKGFGFISREDGSDVFVHFSAIQGDGFKTLEEGQAVTFDVEDSDRGPQAVNVEKN

SEQ ID NO: 25875 - DNA, 201 bp, Enterococcus faecalis
  CDS (1)..(201)
atgaacaacggtacagtaaagtggtttaactcagacaaaggttttggatttattacaggtgaagatggcaatgacgtatttgctcatttttcagcaattcaagcggatggttttaagtcattagaagaaggacaagcagtaacttttgatattgaagaaggacagcgcggtatgcaagctgttaatatttttaaagcataa

SEQ ID NO: 25876 - protein, 66 aa, Enterococcus faecalis
MNNGTVKWFNSDKGFGFITGEDGNDVFAHFSAIQADGFKSLEEGQAVTFDIEEGQRGMQAVNIFKA

SEQ ID NO: 25877 - DNA, 201 bp, Enterococcus faecalis
  CDS (1)..(201)
atggaaacaggtacagtaaaatggtttaactcagacaaaggctttggcttcatcactgcagaaaacggaaacgatgtattcgtacatttctcagctatccaaggtgacggcttcaaaactttagaagaaggtcaagcagtaactttcgaaatcgaagaaggtcaacgtggccctcaagcaactaacgttactaaagcttaa

SEQ ID NO: 25878 - protein, 66 aa, Enterococcus faecalis
METGTVKWFNSDKGFGFITAENGNDVFVHFSAIQGDGFKTLEEGQAVTFEIEEGQRGPQATNVTKA

SEQ ID NO: 25879 - DNA, 201 bp, Enterococcus faecalis
  CDS (1)..(201)
atgaacaacggtacagtaaaatggtttaacgcagacaaaggttttggatttattacaggtgaagatggcaatgatgtatttgcacatttttcagctattcaatcagatggatttaaaactttagacgaaggccaagcagtaacttttgatactgaagaaggtccacgcggcttacaagcaacgaacatcgtaaaagcttaa

SEQ ID NO: 25880 - protein, 66 aa, Enterococcus faecalis
MNNGTVKWFNADKGFGFITGEDGNDVFAHFSAIQSDGFKTLDEGQAVTFDTEEGPRGLQATNIVKA

SEQ ID NO: 25881 - DNA, 216 bp, Photorhabdus luminescens
  CDS (1)..(216)
atgtctaatgcaatgactggttcagtaaaatggtttaacaacgataaaggttttggctttatttcgccaaaagatggtagcaaagatgtttttgttcattattctgcaattcagagtaataatttcaaaacattggaagaaggtcaggaagtttcattctctattgagaatggcgctaaaggtccatccgcagtaaatgttatcgtattatcttga

SEQ ID NO: 25882 - protein, 71 aa, Photorhabdus luminescens
MSNAMTGSVKWFNNDKGFGFISPKDGSKDVFVHYSAIQSNNFKTLEEGQEVSFSIENGAKGPSAVNVIVLS

SEQ ID NO: 25883 - DNA, 594 bp, Oryza sativa
  CDS (1)..(594)
atggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactag

SEQ ID NO: 25884 - protein, 197 aa, Oryza sativa
MASERVKGTVKWFDATKGFGFITPDDGGEDLFVHQSSLKSDGYRSLNDGDVVEFSVGSGNDGRTKAVDVTAPGGGALTGGSRPSGGGDRGYGGGGGGGRYGGDRGYGGGGGGYGGGDRGYGGGGGYGGGGGGGSRACYKCGEEGHMARDCSQGGGGGGGYGGGGGGYRGGGGGGGGGGCYNCGETGHIARECPSKTY

SEQ ID NO: 25885 - DNA, 204 bp, Xylella fastidiosa
  CDS (1)..(204)
atgcagagcggtacagttaagtggtttagtgaccaaaagggattcggatttattttaccggatgatgggactcccgaggtatttgttcactattcggggattaactcaaaaggcttccgtagtttgcatgaaggccagagagttacttatgacgtgacgcagggcccgaagggtccccaagcatcgaatatcacgccaatataa

SEQ ID NO: 25886 - protein, 67 aa, Xylella fastidiosa
MQSGTVKWFSDQKGFGFILPDDGTPEVFVHYSGINSKGFRSLHEGQRVTYDVTQGPKGPQASNITPI

SEQ ID NO: 25887 - DNA, 213 bp, Vibrio parahaemolyticus
  CDS (1)..(213)
atgtctgctaaagtaactggttcagtaaaatggttcaacgaaactaaaggttttggtttcctatctcaagacaacggcggccaagatgtattcgtacacttcaacgctatcgttgctgacggtttcaaaacactgactgaaggtcagaaagtaagcttcaacgtagagcaaggtaaaaaaggtcctcaagcgactgaagttactcctctataa

SEQ ID NO: 25888 - protein, 70 aa, Vibrio parahaemolyticus
MSAKVTGSVKWFNETKGFGFLSQDNGGQDVFVHFNAIVADGFKTLTEGQKVSFNVEQGKKGPQATEVTPL

SEQ ID NO: 25889 - DNA, 210 bp, Vibrio parahaemolyticus
  CDS (1)..(210)
atgtctaacacagctactggcacagttaagtggttcaacgaaactaaaggcttcggtttcatccaacaagaaaacggtcctgacgtatttgctcacttctctgcaatcactggtgacggcttccgtactctagttgaaggccagaaagtagaatttgttatctctcaaggtcaaaaaggccctcaagcagagcaaatcaaagtactttaa

SEQ ID NO: 25890 - protein, 69 aa, Vibrio parahaemolyticus
MSNTATGTVKWFNETKGFGFIQQENGPDVFAHFSAITGDGFRTLVEGQKVEFVISQGQKGPQAEQIKVL

SEQ ID NO: 25891 - DNA, 213 bp, Vibrio parahaemolyticus
  CDS (1)..(213)
atgtctaataaatcaactggttcagtaaaatggttcaacgaaactaaaggtttcggctttatttctccagagaatggtggtgaagacttgtttgttcatttccaatcaattgtctcaactggcttcaaaacactttctgaaggccaaaaagtatcttacgttgttgagcaaggtaaaaaaggtctgcaagcaggcgaagttactgtaatgtaa

SEQ ID NO: 25892 - protein, 70 aa, Vibrio parahaemolyticus
MSNKSTGSVKWFNETKGFGFISPENGGEDLFVHFQSIVSTGFKTLSEGQKVSYVVEQGKKGLQAGEVTVM

SEQ ID NO: 25893 - DNA, 240 bp, Vibrio parahaemolyticus
  CDS (1)..(240)
atgcatgagggatgtataagcatggctacaggtacagtaaagtggtttaacaatgccaaaggatttgggtttatctgttcagacgaagaggaaggagacatctttgcccactactcaactatccaaatggacggttatcgtacactgaaagcaggccaacaagtctcttacgagattgaaaaaggtccaaagggttgccacgcaagtagcgttgtgccaattgaagcccaagccaagtaa

SEQ ID NO: 25894 - protein, 79 aa, Vibrio parahaemolyticus
MHEGCISMATGTVKWFNNAKGFGFICSDEEEGDIFAHYSTIQMDGYRTLKAGQQVSYEIEKGPKGCHASSVVPIEAQAK

SEQ ID NO: 25895 - DNA, 270 bp, Pseudomonas syringae
  CDS (1)..(270)
atgcttaacggaaaagtcaagtggttcaacaatgcaaaaggttatggattcatactcgaagacggtaagcctgatgaagacttgttcgctcattattcggccatccagatggacggctacaaaaccctcaaagccggccagccggtcagatttgagatcattcaagggccaaaaggtttgcatgcggtgaatatccagtcatctctggccaaaataggcgaaccggtaaagagcgcgcatgcgcatacacctgaacacgcacacgcttga

SEQ ID NO: 25896 - protein, 89 aa, Pseudomonas syringae
MLNGKVKWFNNAKGYGFILEDGKPDEDLFAHYSAIQMDGYKTLKAGQPVRFEIIQGPKGLHAVNIQSSLAKIGEPVKSAHAHTPEHAHA

SEQ ID NO: 25897 - DNA, 213 bp, Pseudomonas syringae
  CDS (1)..(213)
atgtctaatcgccaaaccggcaccgtaaaatggttcaacgatgaaaaaggcttcggctttatcactccacaaggtggcggtgacgacctgttcgtacacttcaaagcgatcgaaagcgacggtttcaaaagcctgaaagaaggccagaccgtttcttttgttgctgctaaaggccagaaaggcatgcaagcagaacaagttcgcgttgactga

SEQ ID NO: 25898 - protein, 70 aa, Pseudomonas syringae
MSNRQTGTVKWFNDEKGFGFITPQGGGDDLFVHFKAIESDGFKSLKEGQTVSFVAAKGQKGMQAEQVRVD

SEQ ID NO: 25899 - DNA, 213 bp, Pseudomonas syringae
  CDS (1)..(213)
atggctgaacgtcagagcggcaccgtcaagtggttcaacgacgaaaaaggttttggttttatcactccggagagcggtccagacctgttcgtgcactttcgcgccattcaaggcaacggcttcaagagcctgaaagaaggccagaaagtgaccttcattgctgtgcagggtcagaagggtctgcaggctgacgaagtacacgccgaaggctaa

SEQ ID NO: 25900 - protein, 70 aa, Pseudomonas syringae
MAERQSGTVKWFNDEKGFGFITPESGPDLFVHFRAIQGNGFKSLKEGQKVTFIAVQGQKGLQADEVHAEG

SEQ ID NO: 25901 - DNA, 267 bp, Pseudomonas putida
  CDS (1)..(267)
atggcaagcggtaaagtcaagtggttcaacaatgccaagggctatggattcatcaatgaggaaggtaaatccgatgacctgttcgcccattattccgccatccaaatggacggatacaagaccctgaaggctggccaggccgtggtattcaacatcgtccagggccccaagggcttgcacgccgttgaaatcaaagatgccgcggccgctgcggcagaggctgccagagccttgggcgagccgcaaagcgaaactgcaaaagcctga

SEQ ID NO: 25902 - protein, 88 aa, Pseudomonas putida
MASGKVKWFNNAKGYGFINEEGKSDDLFAHYSAIQMDGYKTLKAGQAVVFNIVQGPKGLHAVEIKDAAAAAAEAARALGEPQSETAKA

SEQ ID NO: 25903 - DNA, 213 bp, Pseudomonas putida
  CDS (1)..(213)
atgtccaatcgccaacaaggcaccgtcaaatggttcaatgatgagaaaggctacggcttcatcaccccagcaggcggcggcgacgacctgttcgtacacttcaaagccatcgaatctgacggcttcaagagcctgaaagaaggccagactgtttccttcgtcgccgagcgcggccagaagggcatgcaggctgcacaggttcgtccggagtaa

SEQ ID NO: 25904 - protein, 70 aa, Pseudomonas putida
MSNRQQGTVKWFNDEKGYGFITPAGGGDDLFVHFKAIESDGFKSLKEGQTVSFVAERGQKGMQAAQVRPE

SEQ ID NO: 25905 - DNA, 210 bp, Pseudomonas putida
  CDS (1)..(210)
atgtcgtctcgtgagactgggaatgtaaagtggttcaacgatgccaagggttatggcttcattcagcgcgaaggtggtgcggatgtattcgtccactatcgggcgatccgcggtgaggggcatcgtaccctggtcgaagggcagcgggtggagtacgcctgcgtgcagggccagaaaggcctgcaagccgaagacgtagtgggcctctga

SEQ ID NO: 25906 - protein, 69 aa, Pseudomonas putida
MSSRETGNVKWFNDAKGYGFIQREGGADVFVHYRAIRGEGHRTLVEGQRVEYACVQGQKGLQAEDVVGL

SEQ ID NO: 25907 - DNA, 210 bp, Pseudomonas putida
  CDS (1)..(210)
atgtccaaccgtcaatccggtgttgttaagtggttcaacgatgagaaaggctacggcttcatcacccctcagtcgggcgacgacctgttcgtgcacttcaaagccatccaagctgacggcttcaaaaccctgaaagaaggccaggctgttactttcgtcgctacccgcggccagaaaggcatgcaggctgaagaagttcagatcgcctaa

SEQ ID NO: 25908 - protein, 69 aa, Pseudomonas putida
MSNRQSGVVKWFNDEKGYGFITPQSGDDLFVHFKAIQADGFKTLKEGQAVTFVATRGQKGMQAEEVQIA

SEQ ID NO: 25909 - DNA, 498 bp, Pseudomonas putida
  CDS (1)..(498)
atggcgccaggccaggcgccatgccgtttccgacaaatcggtcggttatcggcaaaccgccagttttccatacgaccaagggcttgtttttcgctcgagagttggcgtagagtcactgcactgtgtttgcatgggtcgcaacagttcgtgacctgggccagtagccgagatttgctacaacccgttcgacgtctcttacttcctgcaacccagcccagtaatctttcgcttacaaaaaagtgcgaaagtaactgtcatcaaaatttaagtttcataggaaataagacaatggctgagcgtcagaagggtaccgtcaagtggttcaatgacgaaaaaggttacggcttcatcaccccagaaagcggtccggatctcttcgttcacttccgcgctatcgaaggcaacggcttcaagagcctgaaagaaggccagcaagtcaccttcgaagcagtccaaggccagaaaggcatgcaggctgacaaggttcaacctgtctga

SEQ ID NO: 25910 - protein, 165 aa, Pseudomonas putida
MAPGQAPCRFRQIGRLSANRQFSIRPRACFSLESWRRVTALCLHGSQQFVTWASSRDLLQPVRRLLLPATQPSNLSLTKKCESNCHQNLSFIGNKTMAERQKGTVKWFNDEKGYGFITPESGPDLFVHFRAIEGNGFKSLKEGQQVTFEAVQGQKGMQADKVQPV

SEQ ID NO: 25911 - DNA, 201 bp, Lactobacillus plantarum
  CDS (1)..(201)
atggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataa

SEQ ID NO: 25912 - protein, 66 aa, Lactobacillus plantarum
MEHGTVKWFNADKGFGFITRENGSDVFVHFSAIQEDGFKSLDEGQAVNFDVEESDRGPQAVNVTKA

SEQ ID NO: 25913 - DNA, 201 bp, Staphylococcus epidermidis
  CDS (1)..(201)
atgaaacaaggtacagttaaatggtttaatgccgaaaaaggttttggtttcatcgaagttgaaggagaaaacgacgtattcgtacacttctcagcaattaaccaagaaggatacaaatcattagaagaaggtcaatcagttgaatttgaagtagttgaaggcgatcgcggtcctcaagctgcaaacgttgttaaactataa

SEQ ID NO: 25914 - protein, 66 aa, Staphylococcus epidermidis
MKQGTVKWFNAEKGFGFIEVEGENDVFVHFSAINQEGYKSLEEGQSVEFEVVEGDRGPQAANVVKL

SEQ ID NO: 25915 - DNA, 201 bp, Staphylococcus epidermidis
  CDS (1)..(201)
atgaataacggtacagttaaatggtttaatgcagaaaaaggttttggtttcatcgaaagagaaaatggcggagatgtattcgtgcatttctcagcaatcgttgaagatggatataaatctttagaagaaggccaaagcgttgaattcgatatcgtcgaaggtgaacgtggtgagcaagctgcaaacgttgttaagatgtaa

SEQ ID NO: 25916 - protein, 66 aa, Staphylococcus epidermidis
MNNGTVKWFNAEKGFGFIERENGGDVFVHFSAIVEDGYKSLEEGQSVEFDIVEGERGEQAANVVKM

SEQ ID NO: 25917 - DNA, 201 bp, Oceanobacillus iheyensis
  CDS (1)..(201)
atgaacacaggttcagtaaaatggtttaacgcagaaaaaggcttcggtttcatcgaagttgaaggtggagacgatgtattcgtacacttctcagcaatccaaggcgaaggtttcaaaacattagaagaaggtcaatcagtttctttcgatatcgaagaaggtaaccgtggacctcaagcagctaacgttgttaaaaactaa

SEQ ID NO: 25918 - protein, 66 aa, Oceanobacillus iheyensis
MNTGSVKWFNAEKGFGFIEVEGGDDVFVHFSAIQGEGFKTLEEGQSVSFDIEEGNRGPQAANVVKN

SEQ ID NO: 25919 - DNA, 288 bp, Yersinia pestis
  CDS (1)..(288)
atgccccataagttctacccaagcctatctagtcgcctgtggcggcaattaaaaattattgaaggaagtatctctatgtctaataaaatgactggtttagtaaaatggtttgacgctggtaaaggttttggtttcatcactccggctgatggcagcaaagatgtgttcgttcacttctctgctatccagagcaatgatttcaaaaccctggatgaaggccaaaatgtggagttctctatcgagaacggcgctaaaggccctgcagcggtaaacgttattgcgctgtaa

SEQ ID NO: 25920 - protein, 95 aa, Yersinia pestis
MPHKFYPSLSSRLWRQLKIIEGSISMSNKMTGLVKWFDAGKGFGFITPADGSKDVFVHFSAIQSNDFKTLDEGQNVEFSIENGAKGPAAVNVIAL

SEQ ID NO: 25921 - DNA, 309 bp, Yersinia pestis
  CDS (1)..(309)
atgagtctcctcctaagtgcccaagtaagacatcctctgaaagacagaccacgttcgctacactattgtggcaaaataattgaaggaaatatctctatgtctaataaaatgactggtttagtaaaatggtttgacgctggtaaaggttttggtttcatcactccggccgatggcagcaaagatgtgttcgttcacttctctgctatccagagcaatgattttaaaaccctggatgaaggccaaaatgtggagttctctatcgagaacggcgctaaaggcccctcagcagtaaacgtaatcgccctgtaa

SEQ ID NO: 25922 - protein, 102 aa, Yersinia pestis
MSLLLSAQVRHPLKDRPRSLHYCGKIIEGNISMSNKMTGLVKWFDAGKGFGFITPADGSKDVFVHFSAIQSNDFKTLDEGQNVEFSIENGAKGPSAVNVIAL

SEQ ID NO: 25923 - DNA, 210 bp, Wigglesworthia glossinidia brevipalpis
  CDS (1)..(210)
atgtctaaaattaaaggtaatgtaaaatggtttaacgaatctaaaggatttgggtttattactccagaagatggtagtaaagatgtatttgtacatttttctgctattcaaagcaatggttttaaaactcttgcagaaggtcaacgtgtagaatttgagattactaatggggctaaaggcccttcagctgctcatgttactactatttaa

SEQ ID NO: 25924 - protein, 69 aa, Wigglesworthia glossinidia brevipalpis
MSKIKGNVKWFNESKGFGFITPEDGSKDVFVHFSAIQSNGFKTLAEGQRVEFEITNGAKGPSAAHVTTI

SEQ ID NO: 25925 - DNA, 204 bp, Streptococcus agalactiae
  CDS (1)..(204)
atgacacaaggtacagtgaaatggtttaactcagaaaaaggttttggctttatttctagcgaaactggaacagacgtcttcgctcatttttcagagattaaagttgatggcttcaaaactcttgaagaaggacaaaaagtaacatttgatattcaagatggtcaacgtggaccacaagcaacaaatatcaatcttgttaaataa

SEQ ID NO: 25926 - protein, 67 aa, Streptococcus agalactiae
MTQGTVKWFNSEKGFGFISSETGTDVFAHFSEIKVDGFKTLEEGQKVTFDIQDGQRGPQATNINLVK

SEQ ID NO: 25927 - DNA, 207 bp, Shewanella oneidensis
  CDS (1)..(207)
atggcaagcggaactgttaaatggttcaacaacgccaaaggattcgggtttatttgccctgatcaaggtggcgaggacgtttttgcacactattctaccattgaaatggaaggctatagaactctaaaagcaggccaacccgttcaatttgaagtagaacaaggtccaaaaggaatgcacgcttcagccatttcaccaacaaaataa

SEQ ID NO: 25928 - protein, 68 aa, Shewanella oneidensis
MASGTVKWFNNAKGFGFICPDQGGEDVFAHYSTIEMEGYRTLKAGQPVQFEVEQGPKGMHASAISPTK

SEQ ID NO: 25929 - DNA, 246 bp, Shewanella oneidensis
  CDS (1)..(246)
atgcgaattatttttttgaaaaatttggagacattcatgtctaaaactactggcgtagtaaaatggtttaacgaagacaaaggttttggttttatttcccctgataacggtggcgctgacgcattcgttcacttccgcgcaatcgtatctgatggctttaaaacccttgctgaaggtcaaaaggtttcttacgaagtcgaacaaggccaaaaaggtcctcaagctgcgaacgtagttgttctgtaa

SEQ ID NO: 25930 - protein, 81 aa, Shewanella oneidensis
MRIIFLKNLETFMSKTTGVVKWFNEDKGFGFISPDNGGADAFVHFRAIVSDGFKTLAEGQKVSYEVEQGQKGPQAANVVVL

SEQ ID NO: 25931 - DNA, 201 bp, Oceanobacillus iheyensis
  CDS (1)..(201)
atggaaaacggagtagtaaaatggtttaatgctgaaaaaggttatggatttatccaacttgaagaaggtaatgatgtattcgtacactattcagcaattcaagaagaaggctttaagtctttagaagaaggacaagaagtttcctttgaaattgttgaaggtgaacgtggtccgcaagcagcaaacgttgtaaaaaaataa

SEQ ID NO: 25932 - protein, 66 aa, Oceanobacillus iheyensis
MENGVVKWFNAEKGYGFIQLEEGNDVFVHYSAIQEEGFKSLEEGQEVSFEIVEGERGPQAANVVKK

SEQ ID NO: 25933 - DNA, 198 bp, Oceanobacillus iheyensis
  CDS (1)..(198)
atgactggtaaagtaaaatggtttaatgcagaaaaaggttttggtttcatcgagcgtgaagatggagacgatgtattcgtacatttctcagctatccaagctgatggtttcaaaacacttgaagaaggtcaagacgttgaatttgaaatcgttgaaggtaaccgtggcccacaagcggctaacgtagttcgtttataa

SEQ ID NO: 25934 - protein, 65 aa, Oceanobacillus iheyensis
MTGKVKWFNAEKGFGFIEREDGDDVFVHFSAIQADGFKTLEEGQDVEFEIVEGNRGPQAANVVRL

SEQ ID NO: 25935 - DNA, 216 bp, Escherichia coli O6
  CDS (1)..(216)
atgtcaaataaaatgactggtttagtaaaatggtttaacgctgataaaggttttggctttatttctcctgttgatggtagtaaagatgtgtttgtgcatttttctgcgattcagaatgataattttcgaaccttatttgaaggtcaaaaggttaccttctctgtagagagtggtgctaaaggtcctgcagcagcaaatgtcataattactgattaa

SEQ ID NO: 25936 - protein, 71 aa, Escherichia coli O6
MSNKMTGLVKWFNADKGFGFISPVDGSKDVFVHFSAIQNDNFRTLFEGQKVTFSVESGAKGPAAANVIITD

SEQ ID NO: 25937 - DNA, 756 bp, Corynebacterium efficiens
  CDS (1)..(756)
atggaatacggcaccccgccaccacccagtaccagccccacccctgacgcaacctgcgcacatggcttgtccaacttcccccactgcgacgaacaccaccctcgcctcccccggcaatatgccccacagtccggggccgagctggtcctcccccgcaccagcagccccctcaccccacatccgcaccggaccacctgctcacacccggtgaatccgatcctcaccggatatacggaggtcctgcaccgtggcaaatgccagacccacacctccaaccccaccggcaccggcccccgagatttgacgcgaggggaacttttctcaaggggggactatcgctgggagggatttcatggcacactggacgacggtcgcggtttctatgcgcagtgtctaggcgctcgcaggagatgtacacgcgagcgcccggttttcttcaccagagcagttactgctggggttgatggtcaccgaggagttttaacgacccggacgtcagtgaatcatgctggcgaacgtagcatcacctcatcagaaataaaggtaattcatatggcacagggaactgtgaagtggttcaacgctgagaagggcttcggcttcatcgccccctccgacggatccgcagacgtcttcgtccactactccgagatccagggcaacggcttccgtaacctggaggagaaccagcaggttgagttcgagctcggcgagggcgccaagggcccccaggcccagcaggttcgcgcactgtag

SEQ ID NO: 25938 - protein, 251 aa, Corynebacterium efficiens
MEYGTPPPPSTSPTPDATCAHGLSNFPHCDEHHPRLPRQYAPQSGAELVLPRTSSPLTPHPHRTTCSHPVNPILTGYTEVLHRGKCQTHTSNPTGTGPRDLTRGELFSRGDYRWEGFHGTLDDGRGFYAQCLGARRRCTRERPVFFTRAVTAGVDGHRGVLTTRTSVNHAGERSITSSEIKVIHMAQGTVKWFNAEKGFGFIAPSDGSADVFVHYSEIQGNGFRNLEENQQVEFELGEGAKGPQAQQVRAL

SEQ ID NO: 25939 - DNA, 204 bp, Corynebacterium efficiens
  CDS (1)..(204)
atggcacagggcacagttaagtggttcaacccggagaagggcttcggcttcatcgctccctccgacggatccgctgacgttttcgtccactactccgagattgagggcaacggcttccgcaccctcgaggagaaccagctcgtagagttcgagatcggcgaaggcgccaagggccttcaggcacagtctgttcgcgcagtctaa

SEQ ID NO: 25940 - protein, 67 aa, Corynebacterium efficiens
MAQGTVKWFNPEKGFGFIAPSDGSADVFVHYSEIEGNGFRTLEENQLVEFEIGEGAKGLQAQSVRAV

SEQ ID NO: 25941 - DNA, 744 bp, Chlamydomonas reinhardtii
  CDS (1)..(744)
atgggcgagcagctgaggcaacagggaaccgtaaagtggttcaacgccaccaaaggcttcggcttcatcacgcctggtggtggcggcgaggacctctttgtgcaccagaccaacatcaactcggagggcttccgcagcctgcgggagggtgaagtcgtcgagttcgaggttgaggctgggccggatggacgctctaaggctgtgaacgtgacgggccccggaggggccgcgcccgagggcgctccgcggaacttccgcggtggcggccgcggccgcggccgcgctcgcggcgcccgcggcggctatgctgctgcgtacggctacccgcagatggcgccggtctaccccggctactacttcttccccgcggaccccacgggccggggacggggtcgcggcggccgcggcggcgccatgcccgccatgcagggcgtgatgccgggtgtggcgtacccgggcatgcccatgggcggggtgggcatggagccgacgggcgagccgtcggggctgcaggtggtggtgcacaacctgccgtggagctgccagtggcagcagctcaaggaccacttcaaggagtggcgggtggagcgcgcagacgtcgtgtacgacgcctggggccgctcgcggggcttcggcaccgtgcgcttcacgaccaaggaggacgccgcgacggcgtgcgacaagttgaacaacagccaaatcgacgggcgcacgataagcgtccggctcgaccgtttcgcttga

SEQ ID NO: 25942 - protein, 247 aa, Chlamydomonas reinhardtii
MGEQLRQQGTVKWFNATKGFGFITPGGGGEDLFVHQTNINSEGFRSLREGEVVEFEVEAGPDGRSKAVNVTGPGGAAPEGAPRNFRGGGRGRGRARGARGGYAAAYGYPQMAPVYPGYYFFPADPTGRGRGRGGRGGAMPAMQGVMPGVAYPGMPMGGVGMEPTGEPSGLQVVVHNLPWSCQWQQLKDHFKEWRVERADVVYDAWGRSRGFGTVRFTTKEDAATACDKLNNSQIDGRTISVRLDRFA

SEQ ID NO: 25943 - DNA, 198 bp, Lactobacillus delbrueckii
  CDS (1)..(198)
atgcaaaatggtactgtaaaatggtttaatgctgataaaggctttgggtttatcactggttcagatggagatgtattcgtacacttttcatcaattaaaactaacggttttaagagtcttgaggaagggcaaaaagttagttacgatgttgaacaaggcaatcgaggacctcaagcgactaatgttgttccacaataa

SEQ ID NO: 25944 - protein, 65 aa, Lactobacillus delbrueckii
MQNGTVKWFNADKGFGFITGSDGDVFVHFSSIKTNGFKSLEEGQKVSYDVEQGNRGPQATNVVPQ

SEQ ID NO: 25945 - DNA, 201 bp, Lactobacillus plantarum
  CDS (1)..(201)
atgcaaagtggtactgtgaaatggtttaacgcggataagggctttggatttatcaccggttcggataataaagatgtattcgttcatttctcatcaatccaaacagatgggtttaaaagccttgatgaaggtcaaaaggtaagctatgaagttgaacaaggggatcgtggccctcaagcaacgaatgttgttccacaataa

SEQ ID NO: 25946 - protein, 66 aa, Lactobacillus plantarum
MQSGTVKWFNADKGFGFITGSDNKDVFVHFSSIQTDGFKSLDEGQKVSYEVEQGDRGPQATNVVPQ

SEQ ID NO: 25947 - DNA, 1029 bp, Triticum aestivum
  CDS (62)..(751)
ggcacgaggcgatctagggtttcctgctagggttttggtccttcggtttcggcggcgcaagatgggggagagggtcaagggaaccgtgaagtggttcaacgtcaccaaggggttcggcttcatctccccggaggacggcagcgaggacctcttcgtccaccagtccgccatcaagtccgacggctaccgcagcctcaacgagaacgacaccgtcgagttcgaggtcatcaccggcgacgacggtcgcaccaaggcctccgacgtcaccgcaccaggaggaggagcgctctccggcggctcccgccctggcgatggcggtggtgaccgtgggggccgcggcggctacggtggcggtggctacggcggtggcggtggcggtggcggctacggaggcggtggtggcggttacggcggtggcggtggcggctacggtggtggcggcggcggccgtggatgctacaagtgcggcgaggagggccacatctccagggactgcccccagggcggcggcggtggcggcggatacggcggtggtggctatggaggaggcggcggcggcggccgcgagtgctacaagtgcggcgaggagggccacatctccagggactgcccccagggcggtggtggtggcggcggcggcggcggctacggaggcggtggtggccgtggcggcggcggcggcggtggcggctgcttctcctgcggcgagtccggccacttctcccgcgagtgccccaacaaggcccactaggcggcacagctcttcagatctgagtgccccgtttaccctcgctcctttacctacctcctgattctgcagcaagtcataccctatacctatcagtactagtattagtcgccgtagcgtttccccctgctgctcgatccgagcttggttccagaagaattgctggtggtgtgttcgtcgttaagatccaagttattttgttgtctctctgtgatgaggacacagatctatctatgtgttggatggactaagttatcgaaaaaaaaaaaaaaaaaaaaaaa

SEQ ID NO: 25948 - protein, 229 aa, Triticum aestivum
MGERVKGTVKWFNVTKGFGFISPEDGSEDLFVHQSAIKSDGYRSLNENDTVEFEVITGDDGRTKASDVTAPGGGALSGGSRPGDGGGDRGGRGGYGGGGYGGGGGGGGYGGGGGGYGGGGGGYGGGGGGRGCYKCGEEGHISRDCPQGGGGGGGYGGGGYGGGGGGGRECYKCGEEGHISRDCPQGGGGGGGGGGYGGGGGRGGGGGGGGCFSCGESGHFSRECPNKAH

SEQ ID NO: 25949 - DNA, 207 bp, Xanthomonas axonopodis
  CDS (1)..(207)
atgccgaacggtaccgtcaagtggttcaacgacgccaagggatttggcttcatctcaccggaagacggcagcgccgatgtcttcgcgcacttctccgcgatcaactccaagggcttccgcagcctgcaggaaggccagcgcgtcagttatgacgtgacccagggccccaagggtgcccaggcttcgaacatcacgccggttgagtga

SEQ ID NO: 25950 - protein, 68 aa, Xanthomonas axonopodis
MPNGTVKWFNDAKGFGFISPEDGSADVFAHFSAINSKGFRSLQEGQRVSYDVTQGPKGAQASNITPVE

SEQ ID NO: 25951 - DNA, 216 bp, Xanthomonas axonopodis
  CDS (1)..(216)
atgtccaacatcgaacgcgaaaatggtgtcgtgaagtggttcaacgatgccaagggcttcggcttcatcagccgcgaaaatggcgaggatgtgttcgtgcatttccgcgcgatccagatccagggcttcaagagcctcaaggaaggtcagaaggtcagctttaccgtcgtgcaaggccagaagggcctgcaggccgacgcggtgcaggtggtctga

SEQ ID NO: 25952 - protein, 71 aa, Xanthomonas axonopodis
MSNIERENGVVKWFNDAKGFGFISRENGEDVFVHFRAIQIQGFKSLKEGQKVSFTVVQGQKGLQADAVQVV

SEQ ID NO: 25953 - DNA, 204 bp, Corynebacterium glutamicum
  CDS (1)..(204)
atggcacagggcactgttaagtggttcaacccagagaagggcttcggcttcatcgctccttccgacggatccgctgacgttttcgtccactactccgagatcgagggcaacggcttccgtaccctcgaggagaaccagctcgtcgagttcgaaatcggcgagggcgctaagggccttcaggctcaggctgttcgtgcaatctaa

SEQ ID NO: 25954 - protein, 67 aa, Corynebacterium glutamicum
MAQGTVKWFNPEKGFGFIAPSDGSADVFVHYSEIEGNGFRTLEENQLVEFEIGEGAKGLQAQAVRAI

SEQ ID NO: 25955 - DNA, 204 bp, Corynebacterium glutamicum
  CDS (1)..(204)
atggcacagggtactgtgaaatggttcaacggcgaaaagggatttggtttcatcgctcccaacgatggctccgcagatctcttcgtccactactctgagattcagggctccggtttccgtaatcttgaggaaaaccagccagttgaatttgaggtcggcgagggcgccaagggcccacaggctcagcaggttcgtgctctctaa

SEQ ID NO: 25956 - protein, 67 aa, Corynebacterium glutamicum
MAQGTVKWFNGEKGFGFIAPNDGSADLFVHYSEIQGSGFRNLEENQPVEFEVGEGAKGPQAQQVRAL

SEQ ID NO: 25957 - DNA, 210 bp, Xanthomonas campestris
  CDS (1)..(210)
atgtcagatcgtcagaacggtgtcgtgaagtggttcaatgatgccaagggcttcggcttcatcaccccggaaagcggcccggacctgttcgtgcatttccgtgccatccagggcaccggcttcaagtcgttgcaggaaggccagaaggtctccttcgtcgccgtgcagggccagaagggcatgcaggctgaccaggtgcaggcggtctaa

SEQ ID NO: 25958 - protein, 69 aa, Xanthomonas campestris
MSDRQNGVVKWFNDAKGFGFITPESGPDLFVHFRAIQGTGFKSLQEGQKVSFVAVQGQKGMQADQVQAV

SEQ ID NO: 25959 - DNA, 210 bp, Xanthomonas axonopodis
  CDS (1)..(210)
atgtcagagcgtcagagcggtaccgtgaagtggttcaacgatgccaagggcttcggcttcatcaccccggaaagcggcccggacctgttcgtgcacttccgtgccatccagggcaccggcttcaagtcgctgcaggaaggccagaaggtcaccttcgtcgccgtgcagggccagaagggcatgcaggctgaccaggtgcaggcggtctaa

SEQ ID NO: 25960 - protein, 69 aa, Xanthomonas axonopodis
MSERQSGTVKWFNDAKGFGFITPESGPDLFVHFRAIQGTGFKSLQEGQKVTFVAVQGQKGMQADQVQAV

SEQ ID NO: 25961 - DNA, 201 bp, Thermoanaerobacter tengcongensis
  CDS (1)..(201)
atggtaagaggtaaagttaaatggtttaatgccgagaaaggctatggttttattgagagagaggatggcacagacgtatttgtgcactactccgcgattgaaggcgagggctttaagacgttagaggaaggacaggcggtagaatttgaggtagttcaggcggctaaaggcccacaggcttctaaggtaagaaagctgtaa

SEQ ID NO: 25962 - protein, 66 aa, Thermoanaerobacter tengcongensis
MVRGKVKWFNAEKGYGFIEREDGTDVFVHYSAIEGEGFKTLEEGQAVEFEVVQAAKGPQASKVRKL

SEQ ID NO: 25963 - DNA, 216 bp, Fusobacterium nucleatum
  CDS (1)..(216)
atggaggtattacagatgaaaggtactgtaaaatggtttaacaaagaaaaaggatttggatttatcacaggagaagatggaaaagatgtttttgcacacttttctcaaattcaaaaagaaggatttaaagaattatttgaaggacaagaagtagaatttgaaattactgaaggacaaaaaggacctcaagcttcaaatatcgttgttattaaatag

SEQ ID NO: 25964 - protein, 71 aa, Fusobacterium nucleatum
MEVLQMKGTVKWFNKEKGFGFITGEDGKDVFAHFSQIQKEGFKELFEGQEVEFEITEGQKGPQASNIVVIK

SEQ ID NO: 25965 - DNA, 201 bp, Staphylococcus aureus
  CDS (1)..(201)
atgaaacaaggtacagttaaatggtttaacgctgaaaaaggattcggctttatcgaagttgaaggagaaaatgacgtattagtacatttttcagcaattaaccaagatggttacaaatcattagaagaaggtcaagctgttgagtttgaagtagttgaaggcgaccgcggtccacaagctgcaaacgttgttaaactataa

SEQ ID NO: 25966 - protein, 66 aa, Staphylococcus aureus
MKQGTVKWFNAEKGFGFIEVEGENDVLVHFSAINQDGYKSLEEGQAVEFEVVEGDRGPQAANVVKL

SEQ ID NO: 25967 - DNA, 204 bp, Ralstonia solanacearum
  CDS (1)..(204)
atggctactggtaccgtcaagtggttcaacgacgctaagggtttcggctttattaccccggatgaaggcggcgaggaccttttcgcgcatttctctgcgatcaacatgcaagggttcaagaccctgaaggaaggtcaacgcgtttcgtttgaaatcacgcaaggcccgaagggcaagcaagcctcgaatatccaggcggcttga

SEQ ID NO: 25968 - protein, 67 aa, Ralstonia solanacearum
MATGTVKWFNDAKGFGFITPDEGGEDLFAHFSAINMQGFKTLKEGQRVSFEITQGPKGKQASNIQAA

SEQ ID NO: 25969 - DNA, 204 bp, Ralstonia solanacearum
  CDS (1)..(204)
atggccacgggtactgtcaaatggtttaacgaaaccaaaggcttcggcttcatcactccggacggcggtggcgcggatctgttcgcacacttctcggaaattcagggctccggctttaagaccctgaaggacggccagaaggtgtccttcgaagtgaagcaaggcccgaagggcctgcaagcctcgggtatcaagccggaataa

SEQ ID NO: 25970 - protein, 67 aa, Ralstonia solanacearum
MATGTVKWFNETKGFGFITPDGGGADLFAHFSEIQGSGFKTLKDGQKVSFEVKQGPKGLQASGIKPE

SEQ ID NO: 25971 - DNA, 204 bp, Ralstonia solanacearum
  CDS (1)..(204)
atggaaaccggtaccgtaaagtggttcaacgaatcgaagggttttggcttcatcacgcctgacgcgggtggaaacgatctcttcgcgcatttctccgaaattcagggcagcggcttcaaaacgctgcaagagggcgagaaggtgcgttacgttgctggcgtcggccaaaagggccccgcagccaccaagatcgaacggatctga

SEQ ID NO: 25972 - protein, 67 aa, Ralstonia solanacearum
METGTVKWFNESKGFGFITPDAGGNDLFAHFSEIQGSGFKTLQEGEKVRYVAGVGQKGPAATKIERI

SEQ ID NO: 25973 - DNA, 204 bp, Ralstonia solanacearum
  CDS (1)..(204)
atggcaaacggtacggtcaagtggttcaacgacgccaagggttttggcttcatctctcccgacgagggcggcgaagagctgttcgcgcatttctcggcgatccagatgaacggtttcaagacgctcaaggaaggccagcgcgtcgcgttcgacgtgacacagggcccgaagggcaagcaggccaccaacatccaggccgcctga

SEQ ID NO: 25974 - protein, 67 aa, Ralstonia solanacearum
MANGTVKWFNDAKGFGFISPDEGGEELFAHFSAIQMNGFKTLKEGQRVAFDVTQGPKGKQATNIQAA

SEQ ID NO: 25975 - DNA, 210 bp, Rhizobium meliloti
  CDS (1)..(210)
atggcttctggaacggtaaagtggttcaacagcaccaagggcttcggtttcatccagccagatgacggcgccgctgacgtgttcgtccatatttcggcggttgaacgcgccggcctgtccacgctgaaagacgggcagaaggtaagcttcgagctgacgcaggatcggcgctcgggcaagacctcggcggacaaccttcgcgctctctga

SEQ ID NO: 25976 - protein, 69 aa, Rhizobium meliloti
MASGTVKWFNSTKGFGFIQPDDGAADVFVHISAVERAGLSTLKDGQKVSFELTQDRRSGKTSADNLRAL

SEQ ID NO: 25977 - DNA, 213 bp, Rhizobium loti
  CDS (1)..(213)
atggcgattggaaccgtgaaatggttcaacagcacgaagggatttggattcatccagcccgacaatggcggtcaggatgttttcgtccacatttccgctgtcgaacgcgcgggcctctccaccctcacggacggccagaagatcaattatgaggtcgaacaggaccgccgcactggcaagtcttccgccggcaacctcagcaaagctggctga

SEQ ID NO: 25978 - protein, 70 aa, Rhizobium loti
MAIGTVKWFNSTKGFGFIQPDNGGQDVFVHISAVERAGLSTLTDGQKINYEVEQDRRTGKSSAGNLSKAG

SEQ ID NO: 25979 - DNA, 213 bp, Rhizobium loti
  CDS (1)..(213)
atggcccagaccggcaccgttaaattcttcaacgcgaccaaaggcttcggtttcatcacgcccgacggcggcgccaaggatgtgttcgtccatatttccgcgatcgaggcatcgggcctgcgcacgctcgtcgacggccagaaggtcaccttcgacgtcgagccggaccgcatgggcaagggcccgaaggcggtcaacctccgcgctgcctga

SEQ ID NO: 25980 - protein, 70 aa, Rhizobium loti
MAQTGTVKFFNATKGFGFITPDGGAKDVFVHISAIEASGLRTLVDGQKVTFDVEPDRMGKGPKAVNLRAA

SEQ ID NO: 25981 - DNA, 210 bp, Pseudomonas sp
  CDS (1)..(210)
atgtctaatcgccaaactggtaccgttaagtggttcaacgatgaaaaaggcttcggcttcatcactccacaatccggtgacgacctgttcgttcacttcaaagctatcccatccgacggcttcaaaagcctgaaagaaggccaacaggtctctttcatcgctacccgcggtcagaaaggcatgcaagctgaggaagttcaagttatctaa

SEQ ID NO: 25982 - protein, 69 aa, Pseudomonas sp
MSNRQTGTVKWFNDEKGFGFITPQSGDDLFVHFKAIPSDGFKSLKEGQQVSFIATRGQKGMQAEEVQVI

SEQ ID NO: 25983 - DNA, 210 bp, Pasteurella multocida
  CDS (1)..(210)
atgtctaaattaaacggtacagtaaaatggttcaactctgataaaggttttggtttcatcacgccagcagacggcggtaaagatcttttcgttcatttttcaggtatcatcggttctaactacagaacattaaatgaaggtgaccgcgtagaatacagcgttcaagattcacaacgtggaccttcagcgattgatgtaaaagcaatctaa

SEQ ID NO: 25984 - protein, 69 aa, Pasteurella multocida
MSKLNGTVKWFNSDKGFGFITPADGGKDLFVHFSGIIGSNYRTLNEGDRVEYSVQDSQRGPSAIDVKAI

SEQ ID NO: 25985 - DNA, 210 bp, Pasteurella multocida
  CDS (1)..(210)
atggaagttggtgtagttaaatggttcaataacgcgaaaggatttggattcatttctgcagaaggaacagacgcagatatttttgcgcattactcagtcatcgaaatggaaggctaccgttcattaaaagcgggtcaaaaagtgcaatttgaagtcgtacatggcgataaaggatcacatgcgacgaaaattattccaatcgttgaataa

SEQ ID NO: 25986 - protein, 69 aa, Pasteurella multocida
MEVGVVKWFNNAKGFGFISAEGTDADIFAHYSVIEMEGYRSLKAGQKVQFEVVHGDKGSHATKIIPIVE

SEQ ID NO: 25987 - DNA, 207 bp, Streptomyces hygroscopicus
  CDS (1)..(207)
atggctcagggcaccgtcaagtggttcaacgcggagaaggggtacggcttcatcgcggtcgacggtggtgcggacgtgttcgtccactacagcgcgatccagatggacgggtaccgcaccctcgaggaaggccagcgggtcgagttcgagatctcgcagggccagaagggcccgcaggccgacatggtccgcgtggccgtaggctga

SEQ ID NO: 25988 - protein, 68 aa, Streptomyces hygroscopicus
MAQGTVKWFNAEKGYGFIAVDGGADVFVHYSAIQMDGYRTLEEGQRVEFEISQGQKGPQADMVRVAVG

SEQ ID NO: 25989 - DNA, 204 bp, Streptomyces nodosus
  CDS (1)..(204)
atggctcagggcaccgtcaagtggttcaacgcggagaaggggtacggcttcatcgcggtcgacggtggtgcggatgttttcgtccactacagcgccatccagatggacggctaccgcaccctggaggagggccagcgggtcgagttcgagatctcgcagggtcagaaggggccgcaggcggacatggtccgcgtggccggctga

SEQ ID NO: 25990 - protein, 67 aa, Streptomyces nodosus
MAQGTVKWFNAEKGYGFIAVDGGADVFVHYSAIQMDGYRTLEEGQRVEFEISQGQKGPQADMVRVAG

SEQ ID NO: 25991 - DNA, 201 bp, Lactobacillus plantarum
  CDS (1)..(201)
atggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccaccagcagctaacgttacaaaagcataa

SEQ ID NO: 25992 - protein, 66 aa, Lactobacillus plantarum
MEHGTVKWFNADKGFGFITRENGSDVFVHFSAIQEDGFKSLDEGQAVNFDVEESDRGPPAANVTKA

SEQ ID NO: 25993 - DNA, 204 bp, Mycobacterium smegmatis
  CDS (1)..(204)
atgccacagggaactgtgaagtggttcaacgcggagaagggcttcggcttcatcgcccccgaggacggctccgctgacgtgtttgtccactacacggaaatccagggcagcggcttccgcaccctggaggaaaaccagaaggttgagttcgaggtcggccagagccccaaggggccgcaggccacgggtgtccggaccatctga

SEQ ID NO: 25994 - protein, 67 aa, Mycobacterium smegmatis
MPQGTVKWFNAEKGFGFIAPEDGSADVFVHYTEIQGSGFRTLEENQKVEFEVGQSPKGPQATGVRTI

SEQ ID NO: 25995 - DNA, 204 bp, Streptomyces coelicolor
  CDS (1)..(204)
atggctcagggcaccgtcaagtggttcaacgcggagaaggggtacggcttcatcgcggtcgacggtggtgcggatgttttcgtccactacagcgcgattcagatggacggctaccgcaccctcgaagaaggccagcgggtcgagttcgagatctcgcagggtcagaagggcccgcaggccgacatggttcgcctcagcgcctga

SEQ ID NO: 25996 - protein, 67 aa, Streptomyces coelicolor
MAQGTVKWFNAEKGYGFIAVDGGADVFVHYSAIQMDGYRTLEEGQRVEFEISQGQKGPQADMVRLSA

SEQ ID NO: 25997 - DNA, 204 bp, Streptomyces coelicolor
  CDS (1)..(204)
atggctactggcaccgtgaagtggttcaacgcggaaaagggattcggcttcatcgagcaggacggtggcggcgcggacgtgttcgcccactactcgaacatcgccgcccagggcttccgcgagctgctcgaaggccagaaggtgaacttcgacatcgcgcagggccagaagggcccgacggccgagaacatcgtcctcgcctga

SEQ ID NO: 25998 - protein, 67 aa, Streptomyces coelicolor
MATGTVKWFNAEKGFGFIEQDGGGADVFAHYSNIAAQGFRELLEGQKVNFDIAQGQKGPTAENIVLA

SEQ ID NO: 25999 - DNA, 204 bp, Streptomyces coelicolor
  CDS (1)..(204)
atggctaccggaaccgtgaagtggttcaacgccgaaaagggctttggtttcatcgcccaggaaggcggcggcccggacgtcttcgtccactactccgcgatcaacgctcagggattccgttccctcgaggagaaccagcaggtgtccttcgacgtcacgcagggccccaagggtccgcaggcggagaatgtcactcctgtctga

SEQ ID NO: 26000 - protein, 67 aa, Streptomyces coelicolor
MATGTVKWFNAEKGFGFIAQEGGGPDVFVHYSAINAQGFRSLEENQQVSFDVTQGPKGPQAENVTPV

SEQ ID NO: 26001 - DNA, 204 bp, Streptomyces coelicolor
  CDS (1)..(204)
atggcttccggcaccgtgaagtggttcaacgccgaaaagggcttcggcttcatcgagcaggacggcggcggtcccgacgtcttcgcccactactcgaacatcaacgcgcagggcttccgcgagctgctcgagggtcagaaggtgaccttcgacatcgcgcagggccagaagggcccgacggccgagaacatcaccccggcctga

SEQ ID NO: 26002 - protein, 67 aa, Streptomyces coelicolor
MASGTVKWFNAEKGFGFIEQDGGGPDVFAHYSNINAQGFRELLEGQKVTFDIAQGQKGPTAENITPA

SEQ ID NO: 26003 - DNA, 213 bp, Yersinia enterocolitica
  CDS (1)..(213)
atgtctaataaaatgactggtttagtaaaatggtttaacgctgataaaggttttggtttcattacgcctgctgacggcagcaaagacgtgttcgttcacttctctgctatccagagcaatgatttcaaaaccctggatgaaggtcaaaaagttgagttctctatcgagaatggtgctaaaggcccatcagcggtaaacgttattgctctgtaa

SEQ ID NO: 26004 - protein, 70 aa, Yersinia enterocolitica
MSNKMTGLVKWFNADKGFGFITPADGSKDVFVHFSAIQSNDFKTLDEGQKVEFSIENGAKGPSAVNVIAL

SEQ ID NO: 26005 - DNA, 213 bp, Yersinia enterocolitica
  CDS (1)..(213)
atgtctaataaaatgactggtttagtaaaatggtttgacgctggtaaaggttttggtttcattacgcctgctgacggcagcaaagacgtgttcgttcacttctctgctatccagagcaatgatttcaaaaccctggatgaaggtcaaaaagttgagttctctatcgagaatggcgctaaaggcccatcagcggtaaacgtagtcgccctgtaa

SEQ ID NO: 26006 - protein, 70 aa, Yersinia enterocolitica
MSNKMTGLVKWFDAGKGFGFITPADGSKDVFVHFSAIQSNDFKTLDEGQKVEFSIENGAKGPSAVNVVAL

SEQ ID NO: 26007 - DNA, 204 bp, Streptomyces coelicolor
  CDS (1)..(204)
atggcttccggtaccgtgaagtggttcaacgccgaaaagggcttcggtttcatcgcgcaggacggcggcggcgccgacgtcttcgcccactactcgaacatcgccacccagggcttccgcgagctccaggagggccagcgggtgaacttcgacgtcacgcagggccagaagggcccgcaggcggagaacatcgttcccgcgtaa

SEQ ID NO: 26008 - protein, 67 aa, Streptomyces coelicolor
MASGTVKWFNAEKGFGFIAQDGGGADVFAHYSNIATQGFRELQEGQRVNFDVTQGQKGPQAENIVPA

SEQ ID NO: 26009 - DNA, 198 bp, Lactococcus lactis
  CDS (1)..(198)
atggcacaaggaactgttaaatggtttaacgcaactaaaggcttcggctttatcactactgaagaaggaaacgacgttttcgcacacttctcagctatccaaactgatggattcaaaacacttgacgaaggtcaaaaagttacttttgacgttgaagaaggccctcgtggacctcaagctgttaacatccaaaaataa

SEQ ID NO: 26010 - protein, 65 aa, Lactococcus lactis
MAQGTVKWFNATKGFGFITTEEGNDVFAHFSAIQTDGFKTLDEGQKVTFDVEEGPRGPQAVNIQK

SEQ ID NO: 26011 - DNA, 201 bp, Lactococcus lactis
  CDS (1)..(201)
atggcaaatggaacagtaaaatggtttaacgctactaaaggatttggttttattacttctgaagatggtcaagatttgttcgctcacttctcagcaatccaatctgatggattcaaatcacttgacgaaggtcaaaaagttgaatttgatgttgaagaaggtcaacgtggacctcaagcagttaatatcacaaaagcataa

SEQ ID NO: 26012 - protein, 66 aa, Lactococcus lactis
MANGTVKWFNATKGFGFITSEDGQDLFAHFSAIQSDGFKSLDEGQKVEFDVEEGQRGPQAVNITKA

SEQ ID NO: 26013 - DNA, 213 bp, Vibrio cholerae
  CDS (1)..(213)
atgtctactaaaatgactggttctgtaaaatggttcaacgaaactaaaggtttcggttttcttactcaagacaatggtggcaacgatgtgtttgttcacttaaactctattcagtcagaaggtttcaaaaccttagctgaaggtcaacgtgttagcttcatcgttgaacaaggtaagaaaggccctcaagcgtcaaacgtagtcgcgctgtaa

SEQ ID NO: 26014 - protein, 70 aa, Vibrio cholerae
MSTKMTGSVKWFNETKGFGFLTQDNGGNDVFVHLNSIQSEGFKTLAEGQRVSFIVEQGKKGPQASNVVAL

SEQ ID NO: 26015 - DNA, 207 bp, Myxococcus xanthus
  CDS (1)..(207)
atggcaaccggtaccgtgaagtggttcaacgacgcgaagggctttggcttcatcacccaggacggcggcggtgaagacgtgttctgccaccacaccgccatcaacatggacggcttccgcaccctggccgaaggccagaaggtggagttcgaagtcacccgtggccccaagggcctccaggcgcagaacgtccgcgccgccggctaa

SEQ ID NO: 26016 - protein, 68 aa, Myxococcus xanthus
MATGTVKWFNDAKGFGFITQDGGGEDVFCHHTAINMDGFRTLAEGQKVEFEVTRGPKGLQAQNVRAAG

SEQ ID NO: 26017 - DNA, 204 bp, Myxococcus xanthus
  CDS (1)..(204)
atggctactggtaccgtgaagtggttcaacgatgcgaagggtttcggtttcctcacgcaggacggtggtggtgaggacgtgttctgccaccacacggccatcaacatggatggcttccgcaccctgcaggagggtcagaaggtggagttcgaagtgacccgtggccccaagggcctgcaggcgcagaacgtccgcgcggcctga

SEQ ID NO: 26018 - protein, 67 aa, Myxococcus xanthus
MATGTVKWFNDAKGFGFLTQDGGGEDVFCHHTAINMDGFRTLQEGQKVEFEVTRGPKGLQAQNVRAA

SEQ ID NO: 26019 - DNA, 204 bp, Myxococcus xanthus
  CDS (1)..(204)
atggcaaccggtaccgtcaagtggttcaacgatgcgaagggctttgggttcatcgtgcaggacggcggcggtgaggacgtgttcgtccatcacagcgcaatcaacatggatggcttccgcaccctgcaggaaggccagaaggtggagttcgaagtaggccggggccccaagggtctgcaggcgcagaacgttcgcgcggcctga

SEQ ID NO: 26020 - protein, 67 aa, Myxococcus xanthus
MATGTVKWFNDAKGFGFIVQDGGGEDVFVHHSAINMDGFRTLQEGQKVEFEVGRGPKGLQAQNVRAA

SEQ ID NO: 26021 - DNA, 201 bp, Myxococcus xanthus
  CDS (1)..(201)
atggcaatcggtaccgtgaagtggttcaacgacgccaaggggttcggattcatcgcgcaggacaacggtgaggacgtgttctgccaccacactgccatcaacatggatggcttccgcaccctccaggaagggcagcaggtggagttcgaggtcacgcgtggccccaagggcctgcaggcgcagaacgtccgcgccgtctga

SEQ ID NO: 26022 - protein, 66 aa, Myxococcus xanthus
MAIGTVKWFNDAKGFGFIAQDNGEDVFCHHTAINMDGFRTLQEGQQVEFEVTRGPKGLQAQNVRAV

SEQ ID NO: 26023 - DNA, 207 bp, Myxococcus xanthus
  CDS (1)..(207)
atggcaactggcaccgtgaaatggttcaacgacgcgaagggctttggctttatcgcccaggacgacggtggggccgacgtgttctgccaccacaccgccatccagacggatggcttccgtaccctggccgaaggccagaaggtggagttcgagacccggaagggccccaagggcctccaggccgagaacgtccgcgtcgtcggctga

SEQ ID NO: 26024 - protein, 68 aa, Myxococcus xanthus
MATGTVKWFNDAKGFGFIAQDDGGADVFCHHTAIQTDGFRTLAEGQKVEFETRKGPKGLQAENVRVVG

SEQ ID NO: 26025 - DNA, 210 bp, Pseudomonas syringae
  CDS (1)..(210)
atgtctaatcgccaaactggtaccgttaagtggttcaacgatgaaaaaggcttcggcttcatcactccacaatccggtgacgacctgtttgttcacttcaaagcaatccaatccgacggcttcaagagcctgaaagaaggccaacaggtttctttcatcgctactcgcggtcagaaaggcatgcaagctgaggaagttcaagttatctaa

SEQ ID NO: 26026 - protein, 69 aa, Pseudomonas syringae
MSNRQTGTVKWFNDEKGFGFITPQSGDDLFVHFKAIQSDGFKSLKEGQQVSFIATRGQKGMQAEEVQVI

SEQ ID NO: 26027 - DNA, 201 bp, Lactobacillus plantarum
  CDS (1)..(201)
atgaaaaatggtactgtaaaatggttcaatgctgataagggttatggctttattactggtgaagatggcaacgatgtattcgttcacttctcagctatccaaactgacggtttcaagaccttagaagaaggccaaaaagttacttttgatgaagaatcaagcgatcgtggcccacaagctgctaacgttgttcctcaataa

SEQ ID NO: 26028 - protein, 66 aa, Lactobacillus plantarum
MKNGTVKWFNADKGYGFITGEDGNDVFVHFSAIQTDGFKTLEEGQKVTFDEESSDRGPQAANVVPQ

SEQ ID NO: 26029 - DNA, 201 bp, Lactobacillus plantarum
  CDS (1)..(201)
atgaagaatggtacagtaaaatggttcaatgcggataaagggtttggttttattacgggtgaagacggtaccgatgtctttgttcatttttcagcgattcaaactgatggctttaaaaccttagatgaaggtcaaaaagtaacttatgatgaagaacagggcgatcgtggcccccaagcaacgaacgttcaaccacaatag

SEQ ID NO: 26030 - protein, 66 aa, Lactobacillus plantarum
MKNGTVKWFNADKGFGFITGEDGTDVFVHFSAIQTDGFKTLDEGQKVTYDEEQGDRGPQATNVQPQ

SEQ ID NO: 26031 - DNA, 204 bp, Bacillus anthracis
  CDS (1)..(204)
atggcagtaacaggacaagtaaaatggtttaacaacgaaaaaggcttcggtttcatcgaagttccaggcgaaaacgacgtattcgtacatttctctgcaatcgaaactgacggtttcaaatctctagaagaaggtcaaaaagttagcttcgaaatcgaagaaggtaaccgtggacctcaagctaaaaacgtaatcaaactataa

SEQ ID NO: 26032 - protein, 67 aa, Bacillus anthracis
MAVTGQVKWFNNEKGFGFIEVPGENDVFVHFSAIETDGFKSLEEGQKVSFEIEEGNRGPQAKNVIKL

SEQ ID NO: 26033 - DNA, 204 bp, Bordetella pertussis
  CDS (1)..(204)
atggaaaccggcgtcgttaagtggttcaacgcggaaaaaggttatggcttcatcaccccggaagcgggcggcaaggatttgttcgcgcacttctcggaaatccaggccaatggcttcaagtcgttggaagagaatcagcgcgtcagcttcgtgacggcgatgggcccgaagggtcctcaggcgacgaagatccagattctgtaa

SEQ ID NO: 26034 - protein, 67 aa, Bordetella pertussis
METGVVKWFNAEKGYGFITPEAGGKDLFAHFSEIQANGFKSLEENQRVSFVTAMGPKGPQATKIQIL

SEQ ID NO: 26035 - DNA, 402 bp, Micrococcus luteus
  CDS (135)..(338)
cgtcagcccggcatcgccggcgtcgatgagtgttgggcaagcggttcagtctcgccgcttcacccgcgtcccacatccgggccgcggtccaacaccgccaccgcaccgcgggggcacatcgaaaggacaccatcatggctgtcggtactgtcaagtggttcaacgctgagaagggctacggcttcatcgcccccgaggacaactccgcggacgtgttcgtgcacttctccgccatccagggcaacggcttcaaggagctccaggagaacgaccgcgtcgagttcgagacccaggacggccccaagggcctccaggccgccaacgtgacgaagctctgatcttcgcctgacgcacggcttccgacgcccccggtccacacggaccgggggcgtcgtcgtgtgt

SEQ ID NO: 26036 - protein, 67 aa, Micrococcus luteus
MAVGTVKWFNAEKGYGFIAPEDNSADVFVHFSAIQGNGFKELQENDRVEFETQDGPKGLQAANVTKL

SEQ ID NO: 26037 - DNA, 213 bp, Shewanella violacea
  CDS (1)..(213)
atgtctgattcaaatactggtactgtaaaatggtttaacgaagataaaggattcggtttccttactcaagataatggtggcgctgacgtattcgtacattttcgtgctatcgcatcagaaggtttcaaaactcttgatgaaggtcaaaaagtgactttcgaagtagagcaaggcccaaaaggtctgcaagcaagcaacgttatcgctctttaa

SEQ ID NO: 26038 - protein, 70 aa, Shewanella violacea
MSDSNTGTVKWFNEDKGFGFLTQDNGGADVFVHFRAIASEGFKTLDEGQKVTFEVEQGPKGLQASNVIAL

SEQ ID NO: 26039 - DNA, 207 bp, Stigmatella aurantiaca
  CDS (1)..(207)
atggctactggtaccgtgaagtggttcaacgatgcgaagggcttcggctttattactcaggacggaggtggcgaggacgtgttctgccatcactccgccatcaacatggatggcttccgcacccttcaggaggggcagaaggtcgagttcgaggtgacccgcggtcccaagggtctgcaagcccagaacgtgcgttccatcccctga

SEQ ID NO: 26040 - protein, 68 aa, Stigmatella aurantiaca
MATGTVKWFNDAKGFGFITQDGGGEDVFCHHSAINMDGFRTLQEGQKVEFEVTRGPKGLQAQNVRSIP

SEQ ID NO: 26041 - DNA, 204 bp, Streptococcus pyogenes
  CDS (1)..(204)
atggcacaaggtacagtaaaatggtttaatgctgaaaaaggttttggttttatttcaactgaaaacggtcaagatgtctttgcacatttttcagccatccaaactaatggttttaaaacgttagaagaaggacaaaaagtggcatttgacgtcgaagaaggtcaacgtggacctcaagcagtcaatatcactaaattggcctaa

SEQ ID NO: 26042 - protein, 67 aa, Streptococcus pyogenes
MAQGTVKWFNAEKGFGFISTENGQDVFAHFSAIQTNGFKTLEEGQKVAFDVEEGQRGPQAVNITKLA

SEQ ID NO: 26043 - DNA, 324 bp, Bacillus cereus
  CDS (41)..(238)
ctaaatgaaaaaaggaatcgtttttaggaggaattgtgacatgaacggtaaagttaaatggtttaacaatgaaaaaggttttggatttatcgaaatggaaggctctgaagacgtattcgtacatttctctgctattcaaagcgacggctacaaagctttagaggaaggtcaagaagtatctttcgacattactgaaggaaaccgcggacctcaagctgctaacgtagcaaaactttaatcccacatatgacaggaggttaccttacttggtaacctcctttgttattacctttgtatatttccgttttccagagagcaaaaact

SEQ ID NO: 26044 - protein, 65 aa, Bacillus cereus
MNGKVKWFNNEKGFGFIEMEGSEDVFVHFSAIQSDGYKALEEGQEVSFDITEGNRGPQAANVAKL

SEQ ID NO: 26045 - DNA, 210 bp, Shigella flexneri
  CDS (1)..(210)
atggcaaagattaaaggtcaggttaagtggttcaacgagtctaaaggttttggcttcattactccggctgatggcagcaaagatgtgttcgtacacttctccgctatccagggtaatggcttgaaaactctggctgaaggtcagaacgttgagttcgaaattcaggacggccagaaaggtccggcagctgttaacgtaacagctatctga

SEQ ID NO: 26046 - protein, 69 aa, Shigella flexneri
MAKIKGQVKWFNESKGFGFITPADGSKDVFVHFSAIQGNGLKTLAEGQNVEFEIQDGQKGPAAVNVTAI

SEQ ID NO: 26047 - DNA, 201 bp, Bacillus anthracis
  CDS (1)..(201)
atgcaaacaggtaaagttaaatggttcaacagcgaaaaaggtttcggtttcatcgaagttgaaggtggagacgatgtattcgttcacttctcagctatccaaggtgacggattcaaaactttagaagaaggtcaagaagtttctttcgaaatcgttgaaggtaaccgtggaccacaagctgctaacgttacaaaaaactaa

SEQ ID NO: 26048 - protein, 66 aa, Bacillus anthracis
MQTGKVKWFNSEKGFGFIEVEGGDDVFVHFSAIQGDGFKTLEEGQEVSFEIVEGNRGPQAANVTKN

SEQ ID NO: 26049 - DNA, 327 bp, Bacillus cereus
  CDS (41)..(241)
gtggattcatagtttcatttttatttaggaggtacatgacatgcaaacaggtaaagtaaaatggtttaacggcgaaaaaggttttggcttcatcgaagttgaaggcggagaagacgtattcgtacatttctcagctattcaaggcgacggcttcaaaactttagaagaaggtcaagaagtttctttcgaaatcgttgatggaaaccgcggaccacaagcagctaacgttacaaaaaactaattagctagcgaaaaaaagcattccgaatttcggaatgctttttttatgctttagaaccagactcatctgaagataattcaccttta

SEQ ID NO: 26050 - protein, 66 aa, Bacillus cereus
MQTGKVKWFNGEKGFGFIEVEGGEDVFVHFSAIQGDGFKTLEEGQEVSFEIVDGNRGPQAANVTKN

SEQ ID NO: 26051 - DNA, 219 bp, Haemophilus influenzae
  CDS (1)..(219)
atggaaattggtattgtaaaatggttcaataatgcaaaaggatttggtttcatttccgcagaaggtgtagatgccgatatttttgcacattattcagtgattgaaatggacggctatcgttcattaaaagcgggtcaaaaagtacaatttgaagttctccacagcgataaaggatctcacgccacaaaaataatcccaattgcggatactcaagaataa

SEQ ID NO: 26052 - protein, 72 aa, Haemophilus influenzae
MEIGIVKWFNNAKGFGFISAEGVDADIFAHYSVIEMDGYRSLKAGQKVQFEVLHSDKGSHATKIIPIADTQE

SEQ ID NO: 26053 - DNA, 204 bp, Bacillus anthracis
  CDS (1)..(204)
atgacattaacaggtaaagtaaaatggtttaacagcgaaaaaggtttcggtttcatcgaagttgaaggcggtaacgacgtattcgttcacttctcagctatcactggcgacggtttcaaatctcttgacgaaggtcaagaagttagcttcgaagttgaagacggtaaccgtggacctcaagctaaaaacgttgtaaagctataa

SEQ ID NO: 26054 - protein, 67 aa, Bacillus anthracis
MTLTGKVKWFNSEKGFGFIEVEGGNDVFVHFSAITGDGFKSLDEGQEVSFEVEDGNRGPQAKNVVKL

SEQ ID NO: 26055 - DNA, 210 bp, Buchnera aphidicola
  CDS (1)..(210)
atgtccaagattaaaggtaatgtaaaatggtttaatgaatctaaagggtttggtttcattactcctgaagatggaagcaaagatgtttttgttcatttttcagctatccaaagcaacggatttaagactttatcagaaggtcaaagtgttgaattcgaaattaccgaaggagcaaaagggccatcagcggctaatgtgattagtttataa

SEQ ID NO: 26056 - protein, 69 aa, Buchnera aphidicola
MSKIKGNVKWFNESKGFGFITPEDGSKDVFVHFSAIQSNGFKTLSEGQSVEFEITEGAKGPSAANVISL

SEQ ID NO: 26057 - DNA, 213 bp, Shewanella violacea
  CDS (1)..(213)
atgtctaattcaacaactggtctagtaaaatggtttaacgaagagaaaggttttggtttcattactcaagacaatggcggcgatgacgttttcgttcacttccgttcaatcacttcagacggcttcaagactcttgctgaaggccaaaaagtatctttcgaagtagagcaaggtcaaaaaggccttcaagcagctaacgtagttgcgctttaa

SEQ ID NO: 26058 - protein, 70 aa, Shewanella violacea
MSNSTTGLVKWFNEEKGFGFITQDNGGDDVFVHFRSITSDGFKTLAEGQKVSFEVEQGQKGLQAANVVAL

SEQ ID NO: 26059 - DNA, 213 bp, Salmonella typhimurium
  CDS (1)..(213)
atgacgacgaaaatcactggtttagtaaaatggtttaaccctgaaaagggctttggtttcattacgcctaaagatggcagcaaagatgtgtttgtgcatttttcagccattcaaagtaatgaattccgcactctgaatgaaaatcaggaagtggagttttcagtagagcagggaccaaaaggtccatcagcggtcaacgttgtggcgctttaa

SEQ ID NO: 26060 - protein, 70 aa, Salmonella typhimurium
MTTKITGLVKWFNPEKGFGFITPKDGSKDVFVHFSAIQSNEFRTLNENQEVEFSVEQGPKGPSAVNVVAL

SEQ ID NO: 26061 - DNA, 204 bp, Arthrobacter globiformis
  CDS (1)..(204)
atggcacagggaaccgtcaagtggttcaacgctgaaaagggcttcggcttcatcaccccggatgactccgatggcgatgtcttcgttcactactctgagatccagaccggtggcttcaagaccctcgacgagaacgctcgcgttcagttcgaaatcggccagggcgccaagggcccccaggccaccggcgtaacgctggtctag

SEQ ID NO: 26062 - protein, 67 aa, Arthrobacter globiformis
MAQGTVKWFNAEKGFGFITPDDSDGDVFVHYSEIQTGGFKTLDENARVQFEIGQGAKGPQATGVTLV

SEQ ID NO: 26063 - DNA, 23 bp, Primer
atggaaaagggtactgttaagtg

SEQ ID NO: 26064 - DNA, 24 bp, Primer
ttatgcgactgccgcttctacttc

SEQ ID NO: 26065 - DNA, 1662 bp, Escherichia coli K12; identical to SEQ ID NO: 20332
  CDS (1)..(1662)

SEQ ID NO: 26066 - protein, 553 aa, Escherichia coli K12; identical to SEQ ID NO: 20333

SEQ ID NO: 26067 - DNA, 2040 bp, Pseudomonas aeruginosa; identical to SEQ ID NO: 20334
  CDS (1)..(2040)

SEQ ID NO: 26068 - protein, 679 aa, Pseudomonas aeruginosa; identical to SEQ ID NO: 20335

SEQ ID NO: 26069 - DNA, 1797 bp, Caulobacter crescentus; identical to SEQ ID NO: 20336
  CDS (1)..(1797)

SEQ ID NO: 26070 - protein, 598 aa, Caulobacter crescentus; identical to SEQ ID NO: 20337

SEQ ID NO: 26071 - DNA, 2148 bp, Agrobacterium tumefaciens; identical to SEQ ID NO: 20338
  CDS (1)..(2148)

SEQ ID NO: 26072 - protein, 715 aa, Agrobacterium tumefaciens; identical to SEQ ID NO: 20339

SEQ ID NO: 26073 - DNA, 1500 bp, Agrobacterium tumefaciens; identical to SEQ ID NO: 20340
  CDS (1)..(1500)

SEQ ID NO: 26074 - protein, 499 aa, Agrobacterium tumefaciens; identical to SEQ ID NO: 20341

SEQ ID NO: 26075 - DNA, 2010 bp, Agrobacterium tumefaciens; identical to SEQ ID NO: 20342
  CDS (1)..(2010)

SEQ ID NO: 26076 - protein, 669 aa, Agrobacterium tumefaciens; identical to SEQ ID NO: 20343

SEQ ID NO: 26077 - DNA, 1941 bp, Agrobacterium tumefaciens; identical to SEQ ID NO: 20344
  CDS (1)..(1941)

SEQ ID NO: 26078 - protein, 646 aa, Agrobacterium tumefaciens; identical to SEQ ID NO: 20345

SEQ ID NO: 26079 - DNA, 1956 bp, Agrobacterium tumefaciens; identical to SEQ ID NO: 20346
  CDS (1)..(1956)

SEQ ID NO: 26080 - protein, 651 aa, Agrobacterium tumefaciens; identical to SEQ ID NO: 20347

SEQ ID NO: 26081 - DNA, 1674 bp, Yersinia pestis; identical to SEQ ID NO: 20348
  CDS (1)..(1674)

SEQ ID NO: 26082 - protein, 557 aa, Yersinia pestis; identical to SEQ ID NO: 20349

SEQ ID NO: 26083 - DNA, 1569 bp, Salmonella enterica subsp. enterica serovar Typhi; identical to SEQ ID NO: 20350
  CDS (1)..(1569)

SEQ ID NO: 26084 - protein, 522 aa, Salmonella enterica subsp. enterica serovar Typhi; identical to SEQ ID NO: 20351

SEQ ID NO: 26085 - DNA, 1815 bp, Agrobacterium tumefaciens; identical to SEQ ID NO: 20352
  CDS (1)..(1815)

SEQ ID NO: 26086 - protein, 604 aa, Agrobacterium tumefaciens; identical to SEQ ID NO: 20353

SEQ ID NO: 26087 - DNA, 1950 bp, Agrobacterium tumefaciens; identical to SEQ ID NO: 20354
  CDS (1)..(1950)

SEQ ID NO: 26088 - protein, 649 aa, Agrobacterium tumefaciens; identical to SEQ ID NO: 20355

SEQ ID NO: 26089 - DNA, 1950 bp, Yersinia pestis; identical to SEQ ID NO: 20356
  CDS (1)..(1950)

SEQ ID NO: 26090 - protein, 649 aa, Yersinia pestis; identical to SEQ ID NO: 20357

SEQ ID NO: 26091 - DNA, 1644 bp, Salmonella enterica subsp. enterica serovar Typhi; identical to SEQ ID NO: 20358
  CDS (1)..(1644)

SEQ ID NO: 26092 - protein, 547 aa, Salmonella enterica subsp. enterica serovar Typhi; identical to SEQ ID NO: 20359

SEQ ID NO: 26093 - DNA, 1960 bp, Clostridium thermocellum; identical to SEQ ID NO: 20360
  CDS (189)..(1862)

SEQ ID NO: 26094 - protein, 557 aa, Clostridium thermocellum; identical to SEQ ID NO: 20361

SEQ ID NO: 26095 - DNA, 1674 bp, Enterobacter aerogenes; identical to SEQ ID NO: 20362
  CDS (1)..(1674)

SEQ ID NO: 26096 - protein, 557 aa, Enterobacter aerogenes; identical to SEQ ID NO: 20363

SEQ ID NO: 26097 - DNA, 1614 bp, Caulobacter crescentus; identical to SEQ ID NO: 20364
  CDS (1)..(1614)

SEQ ID NO: 26098 - protein, 537 aa, Caulobacter crescentus; identical to SEQ ID NO: 20365

SEQ ID NO: 26099 - DNA, 1770 bp, Caulobacter crescentus; identical to SEQ ID NO: 20366
  CDS (1)..(1770)

SEQ ID NO: 26100 - protein, 589 aa, Caulobacter crescentus; identical to SEQ ID NO: 20367

SEQ ID NO: 26101 - DNA, 1818 bp, Agrobacterium tumefaciens; identical to SEQ ID NO: 20368
  CDS (1)..(1818)

SEQ ID NO: 26102 - protein, 605 aa, Agrobacterium tumefaciens; identical to SEQ ID NO: 20369

SEQ ID NO: 26103 - DNA, 1752 bp, Agrobacterium tumefaciens; identical to SEQ ID NO: 20370
  CDS (1)..(1752)

SEQ ID NO: 26104 - protein, 583 aa, Agrobacterium tumefaciens; identical to SEQ ID NO: 20371

SEQ ID NO: 26105 - DNA, 1539 bp, Enterobacter aerogenes; identical to SEQ ID NO: 20372
  CDS (1)..(1539)

SEQ ID NO: 26106 - protein, 512 aa, Enterobacter aerogenes; identical to SEQ ID NO: 20373

SEQ ID NO: 26107 - DNA, 1668 bp, Caulobacter crescentus; identical to SEQ ID NO: 20374
  CDS (1)..(1668)

SEQ ID NO: 26108 - protein, 555 aa, Caulobacter crescentus; identical to SEQ ID NO: 20375

SEQ ID NO: 26109 - DNA, 750 bp, Caulobacter crescentus; identical to SEQ ID NO: 20376
  CDS (1)..(750)

SEQ ID NO: 26110 - protein, 249 aa, Caulobacter crescentus; identical to SEQ ID NO: 20377

SEQ ID NO: 26111 - DNA, 1794 bp, Caulobacter crescentus; identical to SEQ ID NO: 20378
  CDS (1)..(1794)

SEQ ID NO: 26112 - protein, 597 aa, Caulobacter crescentus; identical to SEQ ID NO: 20379

SEQ ID NO: 26113 - DNA, 1869 bp, Agrobacterium tumefaciens; identical to SEQ ID NO: 20380
  CDS (1)..(1869)

SEQ ID NO: 26114 - protein, 622 aa, Agrobacterium tumefaciens; identical to SEQ ID NO: 20381

SEQ ID NO: 26115 - DNA, 2307 bp, Agrobacterium tumefaciens; identical to SEQ ID NO: 20382
  CDS (1)..(2307)

SEQ ID NO: 26116 - protein, 768 aa, Agrobacterium tumefaciens; identical to SEQ ID NO: 20383

SEQ ID NO: 26117 - DNA, 1506 bp, Caulobacter crescentus; identical to SEQ ID NO: 20384
  CDS (1)..(1506)

SEQ ID NO: 26118 - protein, 501 aa, Caulobacter crescentus; identical to SEQ ID NO: 20385

SEQ ID NO: 26119 - DNA, 2352 bp, Agrobacterium tumefaciens; identical to SEQ ID NO: 20386
  CDS (1)..(2352)

SEQ ID NO: 26120 - protein, 783 aa, Agrobacterium tumefaciens; identical to SEQ ID NO: 20387

SEQ ID NO: 26121 - DNA, 2154 bp, Agrobacterium tumefaciens; identical to SEQ ID NO: 20388
  CDS (1)..(2154)

SEQ ID NO: 26122 - protein, 717 aa, Agrobacterium tumefaciens; identical to SEQ ID NO: 20389

SEQ ID NO: 26123 - DNA, 2004 bp, Caulobacter crescentus; identical to SEQ ID NO: 20390
  CDS (1)..(2004)

SEQ ID NO: 26124 - protein, 667 aa, Caulobacter crescentus; identical to SEQ ID NO: 20391

SEQ ID NO: 26125 - DNA, 1668 bp, Clostridium acetobutylicum; identical to SEQ ID NO: 20392
  CDS (1)..(1668)

SEQ ID NO: 26126 - protein, 555 aa, Clostridium acetobutylicum; identical to SEQ ID NO: 20393

SEQ ID NO: 26127 - DNA, 2358 bp, Agrobacterium tumefaciens; identical to SEQ ID NO: 20394
  CDS (1)..(2358)

SEQ ID NO: 26128 - protein, 785 aa, Agrobacterium tumefaciens; identical to SEQ ID NO: 20395

SEQ ID NO: 26129 - DNA, 2367 bp, Agrobacterium tumefaciens; identical to SEQ ID NO: 20396
  CDS (1)..(2367)

SEQ ID NO: 26130 - protein, 788 aa, Agrobacterium tumefaciens; identical to SEQ ID NO: 20397

SEQ ID NO: 26131 - DNA, 1980 bp, Vibrio cholerae; identical to SEQ ID NO: 20398
  CDS (1)..(1980)

SEQ ID NO: 26132 - protein, 659 aa, Vibrio cholerae; identical to SEQ ID NO: 20399

SEQ ID NO: 26133 - DNA, 1869 bp, Caulobacter crescentus; identical to SEQ ID NO: 20400
  CDS (1)..(1869)

SEQ ID NO: 26134 - protein, 622 aa, Caulobacter crescentus; identical to SEQ ID NO: 20401

SEQ ID NO: 26135 - DNA, 1827 bp, Caulobacter crescentus; identical to SEQ ID NO: 20402
  CDS (1)..(1827)

SEQ ID NO: 26136 - protein, 608 aa, Caulobacter crescentus; identical to SEQ ID NO: 20403

SEQ ID NO: 26137 - DNA, 2037 bp, Vibrio cholerae; identical to SEQ ID NO: 20404
  CDS (1)..(2037)

SEQ ID NO: 26138 - protein, 678 aa, Vibrio cholerae; identical to SEQ ID NO: 20405

SEQ ID NO: 26139 - DNA, 1608 bp, Pseudomonas aeruginosa; identical to SEQ ID NO: 20406
  CDS (1)..(1608)

SEQ ID NO: 26140 - protein, 535 aa, Pseudomonas aeruginosa; identical to SEQ ID NO: 20407

SEQ ID NO: 26141 - DNA, 1515 bp, Caulobacter crescentus; identical to SEQ ID NO: 20408
  CDS (1)..(1515)

SEQ ID NO: 26142 - protein, 504 aa, Caulobacter crescentus; identical to SEQ ID NO: 20409

SEQ ID NO: 26143 - DNA, 2295 bp, Rhodobacter capsulatus; identical to SEQ ID NO: 20410
  CDS (1)..(2295)

SEQ ID NO: 26144 - protein, 764 aa, Rhodobacter capsulatus; identical to SEQ ID NO: 20411

SEQ ID NO: 26145 - DNA, 1602 bp, Escherichia coli; identical to SEQ ID NO: 20412
  CDS (1)..(1602)

SEQ ID NO: 26146 - protein, 533 aa, Escherichia coli; identical to SEQ ID NO: 20413

SEQ ID NO: 26147 - DNA, 1656 bp, Escherichia coli; identical to SEQ ID NO: 20414
  CDS (1)..(1656)

SEQ ID NO: 26148 - protein, 551 aa, Escherichia coli; identical to SEQ ID NO: 20415

SEQ ID NO: 26149 - DNA, 2076 bp, Rhodobacter sphaeroides; identical to SEQ ID NO: 20416
  CDS (1)..(2076)

SEQ ID NO: 26150 - protein, 691 aa, Rhodobacter sphaeroides; identical to SEQ ID NO: 20417

SEQ ID NO: 26151 - DNA, 1917 bp, Rhodobacter capsulatus; identical to SEQ ID NO: 20418
  CDS (1)..(1917)

SEQ ID NO: 26152 - protein, 638 aa, Rhodobacter capsulatus; identical to SEQ ID NO: 20419

SEQ ID NO: 26153 - DNA, 3696 bp, Rhizobium leguminosarum; identical to SEQ ID NO: 20420
  CDS (482)..(2401)

SEQ ID NO: 26154 - protein, 639 aa, Rhizobium leguminosarum; identical to SEQ ID NO: 20421

SEQ ID NO: 26155 - DNA, 2399 bp, Rhizobium leguminosarum; identical to SEQ ID NO: 20422
  CDS (174)..(2321)

SEQ ID NO: 26156 - protein, 715 aa, Rhizobium leguminosarum; identical to SEQ ID NO: 20423

SEQ ID NO: 26157 - DNA, 2149 bp, Rhizobium leguminosarum; identical to SEQ ID NO: 20424
  CDS (202)..(2079)

SEQ ID NO: 26158 - protein, 625 aa, Rhizobium leguminosarum; identical to SEQ ID NO: 20425

SEQ ID NO: 26159 - DNA, 2362 bp, Rhizobium leguminosarum; identical to SEQ ID NO: 20426
  CDS (326)..(2200)

SEQ ID NO: 26160 - protein, 624 aa, Rhizobium leguminosarum; identical to SEQ ID NO: 20427

SEQ ID NO: 26161 - DNA, 2220 bp, Agrobacterium tumefaciens; identical to SEQ ID NO: 20428
  CDS (1)..(2220)

SEQ ID NO: 26162 - protein, 739 aa, Agrobacterium tumefaciens; identical to SEQ ID NO: 20429

SEQ ID NO: 26163 - DNA, 2379 bp, Rhodobacter sphaeroides; identical to SEQ ID NO: 20430
  CDS (1)..(2379)

SEQ ID NO: 26164 - protein, 792 aa, Rhodobacter sphaeroides; identical to SEQ ID NO: 20431

SEQ ID NO: 26165 - DNA, 1647 bp, Erwinia carotovora subsp; identical to SEQ ID NO: 20432
  CDS (1)..(1647)

SEQ ID NO: 26166 - protein, 548 aa, Erwinia carotovora subsp; identical to SEQ ID NO: 20433

SEQ ID NO: 26167 - DNA, 1671 bp, Erwinia carotovora subsp; identical to SEQ ID NO: 20434
  CDS (1)..(1671)

SEQ ID NO: 26168 - protein, 556 aa, Erwinia carotovora subsp; identical to SEQ ID NO: 20435

SEQ ID NO: 26169 - DNA, 1680 bp, Erwinia carotovora subsp; identical to SEQ ID NO: 20436
  CDS (1)..(1680)

SEQ ID NO: 26170 - protein, 559 aa, Erwinia carotovora subsp; identical to SEQ ID NO: 20437

SEQ ID NO: 26171 - DNA, 1572 bp, Erwinia carotovora subsp; identical to SEQ ID NO: 20438
  CDS (1)..(1572)

SEQ ID NO: 26172 - protein, 523 aa, Erwinia carotovora subsp; identical to SEQ ID NO: 20439

SEQ ID NO: 26173 - DNA, 1941 bp, Erwinia carotovora subsp; identical to SEQ ID NO: 20440
  CDS (1)..(1941)

SEQ ID NO: 26174 - protein, 646 aa, Erwinia carotovora subsp; identical to SEQ ID NO: 20441

SEQ ID NO: 26175 - DNA, 1536 bp, Erwinia carotovora subsp; identical to SEQ ID NO: 20442
  CDS (1)..(1536)

SEQ ID NO: 26176 - protein, 511 aa, Erwinia carotovora subsp; identical to SEQ ID NO: 20443

SEQ ID NO: 26177 - DNA, 1941 bp, Erwinia carotovora subsp; identical to SEQ ID NO: 20444
  CDS (1)..(1941)

SEQ ID NO: 26178 - protein, 646 aa, Erwinia carotovora subsp; identical to SEQ ID NO: 20445

SEQ ID NO: 26179 - DNA, 1935 bp, Erwinia carotovora subsp; identical to SEQ ID NO: 20446
  CDS (1)..(1935)

SEQ ID NO: 26180 - protein, 644 aa, Erwinia carotovora subsp; identical to SEQ ID NO: 20447

SEQ ID NO: 26181 - DNA, 1797 bp, Erwinia carotovora subsp; identical to SEQ ID NO: 20448
  CDS (1)..(1797)

SEQ ID NO: 26182 - protein, 598 aa, Erwinia carotovora subsp; identical to SEQ ID NO: 20449

SEQ ID NO: 26183 - DNA, 1836 bp, Erwinia carotovora subsp; identical to SEQ ID NO: 20450
  CDS (1)..(1836)

SEQ ID NO: 26184 - protein, 611 aa, Erwinia carotovora subsp; identical to SEQ ID NO: 20451

SEQ ID NO: 26185 - DNA, 1680 bp, Erwinia carotovora subsp; identical to SEQ ID NO: 20452
  CDS (1)..(1680)

SEQ ID NO: 26186 - protein, 559 aa, Erwinia carotovora subsp; identical to SEQ ID NO: 20453

SEQ ID NO: 26187 - DNA, 1791 bp, Erwinia carotovora subsp; identical to SEQ ID NO: 20454
  CDS (1)..(1791)

SEQ ID NO: 26188 - protein, 596 aa, Erwinia carotovora subsp; identical to SEQ ID NO: 20455

SEQ ID NO: 26189 - DNA, 1620 bp, Erwinia carotovora subsp; identical to SEQ ID NO: 20456
  CDS (1)..(1620)

SEQ ID NO: 26190 - protein, 539 aa, Erwinia carotovora subsp; identical to SEQ ID NO: 20457

SEQ ID NO: 26191 - DNA, 1662 bp, Erwinia carotovora subsp; identical to SEQ ID NO: 20458
  CDS (1)..(1662)

SEQ ID NO: 26192 - protein, 553 aa, Erwinia carotovora subsp; identical to SEQ ID NO: 20459

SEQ ID NO: 26193 - DNA, 1953 bp, Erwinia carotovora subsp; identical to SEQ ID NO: 20460
  CDS (1)..(1953)

SEQ ID NO: 26194 - protein, 650 aa, Erwinia carotovora subsp; identical to SEQ ID NO: 20461

SEQ ID NO: 26195 - DNA, 2796 bp, Photobacterium profundum; identical to SEQ ID NO: 20462
  CDS (1)..(2796)

SEQ ID NO: 26196 - protein, 931 aa, Photobacterium profundum; identical to SEQ ID NO: 20463

SEQ ID NO: 26197 - DNA, 1464 bp, Bdellovibrio bacteriovorus; identical to SEQ ID NO: 20464
  CDS (1)..(1464)

SEQ ID NO: 26198 - protein, 487 aa, Bdellovibrio bacteriovorus; identical to SEQ ID NO: 20465

SEQ ID NO: 26199 - DNA, 1539 bp, Bdellovibrio bacteriovorus; identical to SEQ ID NO: 20466
  CDS (1)..(1539)

SEQ ID NO: 26200 - protein, 512 aa, Bdellovibrio bacteriovorus; identical to SEQ ID NO: 20467

SEQ ID NO: 26201 - DNA, 1647 bp, Bdellovibrio bacteriovorus; identical to SEQ ID NO: 20468
  CDS (1)..(1647)

SEQ ID NO: 26202 - protein, 548 aa, Bdellovibrio bacteriovorus; identical to SEQ ID NO: 20469

SEQ ID NO: 26203 - DNA, 1449 bp, Bdellovibrio bacteriovorus; identical to SEQ ID NO: 20470
  CDS (1)..(1449)

SEQ ID NO: 26204 - protein, 482 aa, Bdellovibrio bacteriovorus; identical to SEQ ID NO: 20471

SEQ ID NO: 26205 - DNA, 1815 bp, Bdellovibrio bacteriovorus; identical to SEQ ID NO: 20472
  CDS (1)..(1815)

SEQ ID NO: 26206 - protein, 604 aa, Bdellovibrio bacteriovorus; identical to SEQ ID NO: 20473

SEQ ID NO: 26207 - DNA, 1599 bp, Bdellovibrio bacteriovorus; identical to SEQ ID NO: 20474
  CDS (1)..(1599)

SEQ ID NO: 26208 - protein, 532 aa, Bdellovibrio bacteriovorus; identical to SEQ ID NO: 20475

SEQ ID NO: 26209 - DNA, 1680 bp, Bdellovibrio bacteriovorus; identical to SEQ ID NO: 20476
  CDS (1)..(1680)

SEQ ID NO: 26210 - protein, 559 aa, Bdellovibrio bacteriovorus; identical to SEQ ID NO: 20477

SEQ ID NO: 26211 - DNA, 1905 bp, Bdellovibrio bacteriovorus; identical to SEQ ID NO: 20478
  CDS (1)..(1905)

SEQ ID NO: 26212 - protein, 634 aa, Bdellovibrio bacteriovorus; identical to SEQ ID NO: 20479

SEQ ID NO: 26213 - DNA, 1536 bp, Bdellovibrio bacteriovorus; identical to SEQ ID NO: 20480
  CDS (1)..(1536)

SEQ ID NO: 26214 - protein, 511 aa, Bdellovibrio bacteriovorus; identical to SEQ ID NO: 20481

SEQ ID NO: 26215 - DNA, 1650 bp, Bdellovibrio bacteriovorus; identical to SEQ ID NO: 20482
  CDS (1)..(1650)

SEQ ID NO: 26216 - protein, 549 aa, Bdellovibrio bacteriovorus; identical to SEQ ID NO: 20483

SEQ ID NO: 26217 - DNA, 1950 bp, Rhizobium sp; identical to SEQ ID NO: 20484
  CDS (1)..(1950)

SEQ ID NO: 26218 - protein, 649 aa, Rhizobium sp; identical to SEQ ID NO: 20485

SEQ ID NO: 26219 - DNA, 1959 bp, Desulfovibrio vulgaris; identical to SEQ ID NO: 20486
  CDS (1)..(1959)

SEQ ID NO: 26220 - protein, 652 aa, Desulfovibrio vulgaris; identical to SEQ ID NO: 20487

SEQ ID NO: 26221 - DNA, 1701 bp, Geobacter sulfurreducens; identical to SEQ ID NO: 20488
  CDS (1)..(1701)

SEQ ID NO: 26222 - protein, 566 aa, Geobacter sulfurreducens; identical to SEQ ID NO: 20489

SEQ ID NO: 26223 - DNA, 1485 bp, Geobacter sulfurreducens; identical to SEQ ID NO: 20490
  CDS (1)..(1485)

SEQ ID NO: 26224 - protein, 494 aa, Geobacter sulfurreducens; identical to SEQ ID NO: 20491

SEQ ID NO: 26225 - DNA, 1692 bp, Geobacter sulfurreducens; identical to SEQ ID NO: 20492
  CDS (1)..(1692)

SEQ ID NO: 26226 - protein, 563 aa, Geobacter sulfurreducens; identical to SEQ ID NO: 20493

SEQ ID NO: 26227 - DNA, 1707 bp, Geobacter sulfurreducens; identical to SEQ ID NO: 20494
  CDS (1)..(1707)

SEQ ID NO: 26228 - protein, 568 aa, Geobacter sulfurreducens; identical to SEQ ID NO: 20495

SEQ ID NO: 26229 - DNA, 2889 bp, Geobacter sulfurreducens; identical to SEQ ID NO: 20496
  CDS (1)..(2889)

SEQ ID NO: 26230 - protein, 962 aa, Geobacter sulfurreducens; identical to SEQ ID NO: 20497

SEQ ID NO: 26231 - DNA, 1590 bp, Geobacter sulfurreducens; identical to SEQ ID NO: 20498
  CDS (1)..(1590)

SEQ ID NO: 26232 - protein, 529 aa, Geobacter sulfurreducens; identical to SEQ ID NO: 20499

SEQ ID NO: 26233 - DNA, 2184 bp, Geobacter sulfurreducens; identical to SEQ ID NO: 20500
  CDS (1)..(2184)

SEQ ID NO: 26234 - protein, 727 aa, Geobacter sulfurreducens; identical to SEQ ID NO: 20501

SEQ ID NO: 26235 - DNA, 1701 bp, Yersinia pestis; identical to SEQ ID NO: 20502
  CDS (1)..(1701)

SEQ ID NO: 26236 - protein, 566 aa, Yersinia pestis; identical to SEQ ID NO: 20503

SEQ ID NO: 26237 - DNA, 1641 bp, Shigella flexneri; identical to SEQ ID NO: 20504
  CDS (1)..(1641)

SEQ ID NO: 26238 - protein, 546 aa, Shigella flexneri; identical to SEQ ID NO: 20505

SEQ ID NO: 26239 - DNA, 1995 bp, Wolinella succinogenes; identical to SEQ ID NO: 20506
  CDS (1)..(1995)

SEQ ID NO: 26240 - protein, 664 aa, Wolinella succinogenes; identical to SEQ ID NO: 20507

SEQ ID NO: 26241 - DNA, 1635 bp, Photorhabdus luminescens; identical to SEQ ID NO: 20508
  CDS (1)..(1635)

SEQ ID NO: 26242 - protein, 544 aa, Photorhabdus luminescens; identical to SEQ ID NO: 20509

SEQ ID NO: 26243 - DNA, 1695 bp, Photorhabdus luminescens; identical to SEQ ID NO: 20510
  CDS (1)..(1695)

SEQ ID NO: 26244 - protein, 564 aa, Photorhabdus luminescens; identical to SEQ ID NO: 20511

SEQ ID NO: 26245 - DNA, 2955 bp, Chromobacterium violaceum; identical to SEQ ID NO: 20512
  CDS (1)..(2955)

SEQ ID NO: 26246 - protein, 984 aa, Chromobacterium violaceum; identical to SEQ ID NO: 20513

SEQ ID NO: 26247 - DNA, 1620 bp, Chromobacterium violaceum; identical to SEQ ID NO: 20514
  CDS (1)..(1620)

SEQ ID NO: 26248 - protein, 539 aa, Chromobacterium violaceum; identical to SEQ ID NO: 20515

SEQ ID NO: 26249 - DNA, 1542 bp, Bordetella pertussis; identical to SEQ ID NO: 20516
  CDS (1)..(1542)

SEQ ID NO: 26250 - protein, 513 aa, Bordetella pertussis; identical to SEQ ID NO: 20517

SEQ ID NO: 26251 - DNA, 1620 bp, Bordetella pertussis; identical to SEQ ID NO: 20518
  CDS (1)..(1620)

SEQ ID NO: 26252 - protein, 539 aa, Bordetella pertussis; identical to SEQ ID NO: 20519

SEQ ID NO: 26253 - DNA, 1821 bp, Bordetella pertussis; identical to SEQ ID NO: 20520
  CDS (1)..(1821)

SEQ ID NO: 26254 - protein, 606 aa, Bordetella pertussis; identical to SEQ ID NO: 20521

SEQ ID NO: 26255 - DNA, 1707 bp, Bordetella pertussis; identical to SEQ ID NO: 20522
  CDS (1)..(1707)

SEQ ID NO: 26256 - protein, 568 aa, Bordetella pertussis; identical to SEQ ID NO: 20523

SEQ ID NO: 26257 - DNA, 1638 bp, Bordetella parapertussis; identical to SEQ ID NO: 20524
  CDS (1)..(1638)

SEQ ID NO: 26258 - protein, 545 aa, Bordetella parapertussis; identical to SEQ ID NO: 20525

SEQ ID NO: 26259 - DNA, 1668 bp, Bordetella parapertussis; identical to SEQ ID NO: 20526
  CDS (1)..(1668)

SEQ ID NO: 26260 - protein, 555 aa, Bordetella parapertussis; identical to SEQ ID NO: 20527

SEQ ID NO: 26261 - DNA, 1497 bp, Bordetella parapertussis; identical to SEQ ID NO: 20528
  CDS (1)..(1497)

SEQ ID NO: 26262 - protein, 498 aa, Bordetella parapertussis; identical to SEQ ID NO: 20529

SEQ ID NO: 26263 - DNA, 1659 bp, Bordetella bronchiseptica; identical to SEQ ID NO: 20530
  CDS (1)..(1659)

SEQ ID NO: 26264 - protein, 552 aa, Bordetella bronchiseptica; identical to SEQ ID NO: 20531

SEQ ID NO: 26265 - DNA, 1740 bp, Bordetella bronchiseptica; identical to SEQ ID NO: 20532
  CDS (1)..(1740)

SEQ ID NO: 26266 - protein, 579 aa, Bordetella bronchiseptica; identical to SEQ ID NO: 20533

SEQ ID NO: 26267 - DNA, 1599 bp, Bordetella bronchiseptica; identical to SEQ ID NO: 20534
  CDS (1)..(1599)

SEQ ID NO: 26268 - protein, 532 aa, Bordetella bronchiseptica; identical to SEQ ID NO: 20535

SEQ ID NO: 26269 - DNA, 1611 bp, Bordetella bronchiseptica; identical to SEQ ID NO: 20536
  CDS (1)..(1611)

SEQ ID NO: 26270 - protein, 536 aa, Bordetella bronchiseptica; identical to SEQ ID NO: 20537

SEQ ID NO: 26271 - DNA, 1842 bp, Treponema hyodysenteriae; identical to SEQ ID NO: 20538
  CDS (1)..(1842)

SEQ ID NO: 26272 - protein, 613 aa, Treponema hyodysenteriae; identical to SEQ ID NO: 20539

SEQ ID NO: 26273 - DNA, 1557 bp, Erwinia sp; identical to SEQ ID NO: 20540
  CDS (1)..(1557)

SEQ ID NO: 26274 - protein, 518 aa, Erwinia sp; identical to SEQ ID NO: 20541

SEQ ID NO: 26275 - DNA, 2259 bp, Nitrosomonas europaea; identical to SEQ ID NO: 20542
  CDS (1)..(2259)

SEQ ID NO: 26276 - protein, 752 aa, Nitrosomonas europaea; identical to SEQ ID NO: 20543

SEQ ID NO: 26277 - DNA, 2331 bp, Nitrosomonas europaea; identical to SEQ ID NO: 20544
  CDS (1)..(2331)

SEQ ID NO: 26278 - protein, 776 aa, Nitrosomonas europaea; identical to SEQ ID NO: 20545

SEQ ID NO: 26279 - DNA, 1863 bp, Erwinia chrysanthemi; identical to SEQ ID NO: 20546
  CDS (1)..(1863)

SEQ ID NO: 26280 - protein, 620 aa, Erwinia chrysanthemi; identical to SEQ ID NO: 20547

SEQ ID NO: 26281 - DNA, 1533 bp, Janthinobacterium sp; identical to SEQ ID NO: 20548
  CDS (1)..(1533)

SEQ ID NO: 26282 - protein, 510 aa, Janthinobacterium sp; identical to SEQ ID NO: 20549

SEQ ID NO: 26283 - DNA, 1656 bp, Pseudomonas syringae; identical to SEQ ID NO: 20550
  CDS (1)..(1656)

SEQ ID NO: 26284 - protein, 551 aa, Pseudomonas syringae; identical to SEQ ID NO: 20551

SEQ ID NO: 26285 - DNA, 1815 bp, Yersinia pestis; identical to SEQ ID NO: 20552
  CDS (1)..(1815)

SEQ ID NO: 26286 - protein, 604 aa, Yersinia pestis; identical to SEQ ID NO: 20553

SEQ ID NO: 26287 - DNA, 1611 bp, Yersinia pestis; identical to SEQ ID NO: 20554
  CDS (1)..(1611)

SEQ ID NO: 26288 - protein, 536 aa, Yersinia pestis; identical to SEQ ID NO: 20555

SEQ ID NO: 26289 - DNA, 1638 bp, Yersinia pestis; identical to SEQ ID NO: 20556
  CDS (1)..(1638)

SEQ ID NO: 26290 - protein, 545 aa, Yersinia pestis; identical to SEQ ID NO: 20557

SEQ ID NO: 26291 - DNA, 2424 bp, Vibrio vulnificus; identical to SEQ ID NO: 20558
  CDS (1)..(2424)

SEQ ID NO: 26292 - protein, 807 aa, Vibrio vulnificus; identical to SEQ ID NO: 20559

SEQ ID NO: 26293 - DNA, 1941 bp, Shewanella oneidensis; identical to SEQ ID NO: 20560
  CDS (1)..(1941)

SEQ ID NO: 26294 - protein, 646 aa, Shewanella oneidensis; identical to SEQ ID NO: 20561

SEQ ID NO: 26295 - DNA, 1965 bp, Shewanella oneidensis; identical to SEQ ID NO: 20562
  CDS (1)..(1965)

SEQ ID NO: 26296 - protein, 654 aa, Shewanella oneidensis; identical to SEQ ID NO: 20563

SEQ ID NO: 26297 - DNA, 2931 bp, Leptospira interrogans; identical to SEQ ID NO: 20564
  CDS (1)..(2931)

SEQ ID NO: 26298 - protein, 976 aa, Leptospira interrogans; identical to SEQ ID NO: 20565

SEQ ID NO: 26299 - DNA, 1521 bp, Escherichia coli O6; identical to SEQ ID NO: 20566
  CDS (1)..(1521)

SEQ ID NO: 26300 - protein, 506 aa, Escherichia coli O6; identical to SEQ ID NO: 20567

SEQ ID NO: 26301 - DNA, 2010 bp, Rhizobium etli; identical to SEQ ID NO: 20568
  CDS (1)..(2010)

SEQ ID NO: 26302 - protein, 669 aa, Rhizobium etli; identical to SEQ ID NO: 20569

SEQ ID NO: 26303 - DNA, 2535 bp, Rhizobium etli; identical to SEQ ID NO: 20570
  CDS (1)..(2535)

SEQ ID NO: 26304 - protein, 844 aa, Rhizobium etli; identical to SEQ ID NO: 20571

SEQ ID NO: 26305 - DNA, 2262 bp, Rhizobium etli; identical to SEQ ID NO: 20572
  CDS (1)..(2262)

SEQ ID NO: 26306 - protein, 753 aa, Rhizobium etli; identical to SEQ ID NO: 20573

SEQ ID NO: 26307 - DNA, 786 bp, Azotobacter vinelandii; identical to SEQ ID NO: 20574
  CDS (1)..(786)

SEQ ID NO: 26308 - protein, 261 aa, Azotobacter vinelandii; identical to SEQ ID NO: 20575

SEQ ID NO: 26309 - DNA, 1953 bp, Xanthomonas campestris; identical to SEQ ID NO: 20576
  CDS (1)..(1953)

SEQ ID NO: 26310 - protein, 650 aa, Xanthomonas campestris; identical to SEQ ID NO: 20577

SEQ ID NO: 26311 - DNA, 1869 bp, Xanthomonas campestris; identical to SEQ ID NO: 20578
  CDS (1)..(1869)

SEQ ID NO: 26312 - protein, 622 aa, Xanthomonas campestris; identical to SEQ ID NO: 20579

SEQ ID NO: 26313 - DNA, 1659 bp, Xanthomonas campestris; identical to SEQ ID NO: 20580
  CDS (1)..(1659)

SEQ ID NO: 26314 - protein, 552 aa, Xanthomonas campestris; identical to SEQ ID NO: 20581

SEQ ID NO: 26315 - DNA, 2040 bp, Xanthomonas campestris; identical to SEQ ID NO: 20582
  CDS (1)..(2040)

SEQ ID NO: 26316 - protein, 679 aa, Xanthomonas campestris; identical to SEQ ID NO: 20583

SEQ ID NO: 26317 - DNA, 1638 bp, Xanthomonas campestris; identical to SEQ ID NO: 20584
  CDS (1)..(1638)

SEQ ID NO: 26318 - protein, 545 aa, Xanthomonas campestris; identical to SEQ ID NO: 20585

SEQ ID NO: 26319 - DNA, 2058 bp, Xanthomonas campestris; identical to SEQ ID NO: 20586
  CDS (1)..(2058)

SEQ ID NO: 26320 - protein, 685 aa, Xanthomonas campestris; identical to SEQ ID NO: 20587

SEQ ID NO: 26321 - DNA, 2259 bp, Xanthomonas campestris; identical to SEQ ID NO: 20588
  CDS (1)..(2259)

SEQ ID NO: 26322 - protein, 752 aa, Xanthomonas campestris; identical to SEQ ID NO: 20589

SEQ ID NO: 26323 - DNA, 2019 bp, Xanthomonas campestris; identical to SEQ ID NO: 20590
  CDS (1)..(2019)

SEQ ID NO: 26324 - protein, 672 aa, Xanthomonas campestris; identical to SEQ ID NO: 20591

SEQ ID NO: 26325 - DNA, 2100 bp, Xanthomonas campestris; identical to SEQ ID NO: 20592
  CDS (1)..(2100)

SEQ ID NO: 26326 - protein, 699 aa, Xanthomonas campestris; identical to SEQ ID NO: 20593

SEQ ID NO: 26327 - DNA, 1356 bp, Xanthomonas campestris; identical to SEQ ID NO: 20594
  CDS (1)..(1356)

SEQ ID NO: 26328 - protein, 451 aa, Xanthomonas campestris; identical to SEQ ID NO: 20595

SEQ ID NO: 26329 - DNA, 2373 bp, Xanthomonas campestris; identical to SEQ ID NO: 20596
  CDS (1)..(2373)

SEQ ID NO: 26330 - protein, 790 aa, Xanthomonas campestris; identical to SEQ ID NO: 20597

SEQ ID NO: 26331 - DNA, 1974 bp, Xanthomonas campestris; identical to SEQ ID NO: 20598
  CDS (1)..(1974)

SEQ ID NO: 26332 - protein, 657 aa, Xanthomonas campestris; identical to SEQ ID NO: 20599

SEQ ID NO: 26333 - DNA, 2133 bp, Xanthomonas axonopodis; identical to SEQ ID NO: 20600
  CDS (1)..(2133)

SEQ ID NO: 26334 - protein, 710 aa, Xanthomonas axonopodis; identical to SEQ ID NO: 20601

SEQ ID NO: 26335 - DNA, 1911 bp, Xanthomonas axonopodis; identical to SEQ ID NO: 20602
  CDS (1)..(1911)

SEQ ID NO: 26336 - protein, 636 aa, Xanthomonas axonopodis; identical to SEQ ID NO: 20603

SEQ ID NO: 26337 - DNA, 1992 bp, Xanthomonas axonopodis; identical to SEQ ID NO: 20604
  CDS (1)..(1992)

SEQ ID NO: 26338 - protein, 663 aa, Xanthomonas axonopodis; identical to SEQ ID NO: 20605

SEQ ID NO: 26339 - DNA, 2001 bp, Xanthomonas axonopodis; identical to SEQ ID NO: 20606
  CDS (1)..(2001)

SEQ ID NO: 26340 - protein, 666 aa, Xanthomonas axonopodis; identical to SEQ ID NO: 20607

SEQ ID NO: 26341 - DNA, 2112 bp, Xanthomonas axonopodis; identical to SEQ ID NO: 20608
  CDS (1)..(2112)

SEQ ID NO: 26342 - protein, 703 aa, Xanthomonas axonopodis; identical to SEQ ID NO: 20609

SEQ ID NO: 26343 - DNA, 1989 bp, Xanthomonas axonopodis; identical to SEQ ID NO: 20610
  CDS (1)..(1989)

SEQ ID NO: 26344 - protein, 662 aa, Xanthomonas axonopodis; identical to SEQ ID NO: 20611

SEQ ID NO: 26345 - DNA, 2061 bp, Xanthomonas axonopodis; identical to SEQ ID NO: 20612
  CDS (1)..(2061)

SEQ ID NO: 26346 - protein, 686 aa, Xanthomonas axonopodis; identical to SEQ ID NO: 20613

SEQ ID NO: 26347 - DNA, 2304 bp, Xanthomonas axonopodis; identical to SEQ ID NO: 20614
  CDS (1)..(2304)

SEQ ID NO: 26348 - protein, 767 aa, Xanthomonas axonopodis; identical to SEQ ID NO: 20615

SEQ ID NO: 26349 - DNA, 2085 bp, Xanthomonas axonopodis; identical to SEQ ID NO: 20616
  CDS (1)..(2085)

SEQ ID NO: 26350 - protein, 694 aa, Xanthomonas axonopodis; identical to SEQ ID NO: 20617

SEQ ID NO: 26351 - DNA, 2079 bp, Xanthomonas axonopodis; identical to SEQ ID NO: 20618
  CDS (1)..(2079)

SEQ ID NO: 26352 - protein, 692 aa, Xanthomonas axonopodis; identical to SEQ ID NO: 20619

SEQ ID NO: 26353 - DNA, 2070 bp, Xanthomonas axonopodis; identical to SEQ ID NO: 20620
  CDS (1)..(2070)

SEQ ID NO: 26354 - protein, 689 aa, Xanthomonas axonopodis; identical to SEQ ID NO: 20621

SEQ ID NO: 26355 - DNA, 2064 bp, Xanthomonas axonopodis; identical to SEQ ID NO: 20622
  CDS (1)..(2064)

SEQ ID NO: 26356 - protein, 687 aa, Xanthomonas axonopodis; identical to SEQ ID NO: 20623

SEQ ID NO: 26357 - DNA, 1965 bp, Xanthomonas axonopodis; identical to SEQ ID NO: 20624
  CDS (1)..(1965)

SEQ ID NO: 26358 - protein, 654 aa, Xanthomonas axonopodis; identical to SEQ ID NO: 20625

SEQ ID NO: 26359 - DNA, 2088 bp, Xanthomonas axonopodis; identical to SEQ ID NO: 20626
  CDS (1)..(2088)

SEQ ID NO: 26360 - protein, 695 aa, Xanthomonas axonopodis; identical to SEQ ID NO: 20627

SEQ ID NO: 26361 - DNA, 2043 bp, Xanthomonas axonopodis; identical to SEQ ID NO: 20628
  CDS (1)..(2043)

SEQ ID NO: 26362 - protein, 680 aa, Xanthomonas axonopodis; identical to SEQ ID NO: 20629

SEQ ID NO: 26363 - DNA, 2013 bp, Xanthomonas axonopodis; identical to SEQ ID NO: 20630
  CDS (1)..(2013)

SEQ ID NO: 26364 - protein, 670 aa, Xanthomonas axonopodis; identical to SEQ ID NO: 20631

SEQ ID NO: 26365 - DNA, 1560 bp, Rhodovulum sulfidophilum; identical to SEQ ID NO: 20632
  CDS (1)..(1560)

SEQ ID NO: 26366 - protein, 519 aa, Rhodovulum sulfidophilum; identical to SEQ ID NO: 20633

SEQ ID NO: 26367 - DNA, 1422 bp, Burkholderia cepacia; identical to SEQ ID NO: 20634
  CDS (1)..(1422)

SEQ ID NO: 26368 - protein, 473 aa, Burkholderia cepacia; identical to SEQ ID NO: 20635

SEQ ID NO: 26369 - DNA, 1632 bp, Ralstonia solanacearum; identical to SEQ ID NO: 20636
  CDS (1)..(1632)

SEQ ID NO: 26370 - protein, 543 aa, Ralstonia solanacearum; identical to SEQ ID NO: 20637

SEQ ID NO: 26371 - DNA, 1545 bp, Ralstonia solanacearum; identical to SEQ ID NO: 20638
  CDS (1)..(1545)

SEQ ID NO: 26372 - protein, 514 aa, Ralstonia solanacearum; identical to SEQ ID NO: 20639

SEQ ID NO: 26373 - DNA, 1575 bp, Ralstonia solanacearum; identical to SEQ ID NO: 20640
  CDS (1)..(1575)

SEQ ID NO: 26374 - protein, 524 aa, Ralstonia solanacearum; identical to SEQ ID NO: 20641

SEQ ID NO: 26375 - DNA, 1542 bp, Ralstonia solanacearum; identical to SEQ ID NO: 20642
  CDS (1)..(1542)

SEQ ID NO: 26376 - protein, 513 aa, Ralstonia solanacearum; identical to SEQ ID NO: 20643

SEQ ID NO: 26377 - DNA, 1575 bp, Ralstonia solanacearum; identical to SEQ ID NO: 20644
  CDS (1)..(1575)

SEQ ID NO: 26378 - protein, 524 aa, Ralstonia solanacearum; identical to SEQ ID NO: 20645

SEQ ID NO: 26379 - DNA, 1557 bp, Ralstonia solanacearum; identical to SEQ ID NO: 20646
  CDS (1)..(1557)

SEQ ID NO: 26380 - protein, 518 aa, Ralstonia solanacearum; identical to SEQ ID NO: 20647

SEQ ID NO: 26381 - DNA, 1803 bp, Ralstonia solanacearum; identical to SEQ ID NO: 20648
  CDS (1)..(1803)

SEQ ID NO: 26382 - protein, 600 aa, Ralstonia solanacearum; identical to SEQ ID NO: 20649

SEQ ID NO: 26383 - DNA, 1548 bp, Ralstonia solanacearum; identical to SEQ ID NO: 20650
  CDS (1)..(1548)

SEQ ID NO: 26384 - protein, 515 aa, Ralstonia solanacearum; identical to SEQ ID NO: 20651

SEQ ID NO: 26385 - DNA, 1590 bp, Ralstonia solanacearum; identical to SEQ ID NO: 20652
  CDS (1)..(1590)

SEQ ID NO: 26386 - protein, 529 aa, Ralstonia solanacearum; identical to SEQ ID NO: 20653

SEQ ID NO: 26387 - DNA, 1548 bp, Ralstonia solanacearum; identical to SEQ ID NO: 20654
  CDS (1)..(1548)

SEQ ID NO: 26388 - protein, 515 aa, Ralstonia solanacearum; identical to SEQ ID NO: 20655

SEQ ID NO: 26389 - DNA, 1941 bp, Ralstonia solanacearum; identical to SEQ ID NO: 20656
  CDS (1)..(1941)

SEQ ID NO: 26390 - protein, 646 aa, Ralstonia solanacearum; identical to SEQ ID NO: 20657

SEQ ID NO: 26391 - DNA, 1986 bp, Ralstonia solanacearum; identical to SEQ ID NO: 20658
  CDS (1)..(1986)

SEQ ID NO: 26392 - protein, 661 aa, Ralstonia solanacearum; identical to SEQ ID NO: 20659

SEQ ID NO: 26393 - DNA, 1548 bp, Ralstonia solanacearum; identical to SEQ ID NO: 20660
  CDS (1)..(1548)

SEQ ID NO: 26394 - protein, 515 aa, Ralstonia solanacearum; identical to SEQ ID NO: 20661

SEQ ID NO: 26395 - DNA, 990 bp, Ralstonia solanacearum; identical to SEQ ID NO: 20662
  CDS (1)..(990)

SEQ ID NO: 26396 - protein, 329 aa, Ralstonia solanacearum; identical to SEQ ID NO: 20663

SEQ ID NO: 26397 - DNA, 1608 bp, Ralstonia solanacearum; identical to SEQ ID NO: 20664
  CDS (1)..(1608)

SEQ ID NO: 26398 - protein, 535 aa, Ralstonia solanacearum; identical to SEQ ID NO: 20665

SEQ ID NO: 26399 - DNA, 1542 bp, Ralstonia solanacearum; identical to SEQ ID NO: 20666
  CDS (1)..(1542)

SEQ ID NO: 26400 - protein, 513 aa, Ralstonia solanacearum; identical to SEQ ID NO: 20667

SEQ ID NO: 26401 - DNA, 1545 bp, Ralstonia solanacearum; identical to SEQ ID NO: 20668
  CDS (1)..(1545)

SEQ ID NO: 26402 - protein, 514 aa, Ralstonia solanacearum; identical to SEQ ID NO: 20669

SEQ ID NO: 26403 - DNA, 1803 bp, Ralstonia solanacearum; identical to SEQ ID NO: 20670
  CDS (1)..(1803)

SEQ ID NO: 26404 - protein, 600 aa, Ralstonia solanacearum; identical to SEQ ID NO: 20671

SEQ ID NO: 26405 - DNA, 1890 bp, Ralstonia solanacearum; identical to SEQ ID NO: 20672
  CDS (1)..(1890)

SEQ ID NO: 26406 - protein, 629 aa, Ralstonia solanacearum; identical to SEQ ID NO: 20673

SEQ ID NO: 26407 - DNA, 1854 bp, Ralstonia solanacearum; identical to SEQ ID NO: 20674
  CDS (1)..(1854)

SEQ ID NO: 26408 - protein, 617 aa, Ralstonia solanacearum; identical to SEQ ID NO: 20675

SEQ ID NO: 26409 - DNA, 1662 bp, Salmonella typhimurium; identical to SEQ ID NO: 20676
  CDS (1)..(1662)

SEQ ID NO: 26410 - protein, 553 aa, Salmonella typhimurium; identical to SEQ ID NO: 20677

SEQ ID NO: 26411 - DNA, 1521 bp, Salmonella typhimurium; identical to SEQ ID NO: 20678
  CDS (1)..(1521)

SEQ ID NO: 26412 - protein, 506 aa, Salmonella typhimurium; identical to SEQ ID NO: 20679

SEQ ID NO: 26413 - DNA, 1644 bp, Salmonella typhimurium; identical to SEQ ID NO: 20680
  CDS (1)..(1644)

SEQ ID NO: 26414 - protein, 547 aa, Salmonella typhimurium; identical to SEQ ID NO: 20681

SEQ ID NO: 26415 - DNA, 1155 bp, Salmonella typhimurium; identical to SEQ ID NO: 20682
  CDS (1)..(1155)

SEQ ID NO: 26416 - protein, 384 aa, Salmonella typhimurium; identical to SEQ ID NO: 20683

SEQ ID NO: 26417 - DNA, 1626 bp, Salmonella typhimurium; identical to SEQ ID NO: 20684
  CDS (1)..(1626)

SEQ ID NO: 26418 - protein, 541 aa, Salmonella typhimurium; identical to SEQ ID NO: 20685

SEQ ID NO: 26419 - DNA, 1782 bp, Rhizobium meliloti; identical to SEQ ID NO: 20686
  CDS (1)..(1782)

SEQ ID NO: 26420 - protein, 593 aa, Rhizobium meliloti; identical to SEQ ID NO: 20687

SEQ ID NO: 26421 - DNA, 2070 bp, Rhizobium meliloti; identical to SEQ ID NO: 20688
  CDS (1)..(2070)

SEQ ID NO: 26422 - protein, 689 aa, Rhizobium meliloti; identical to SEQ ID NO: 20689

SEQ ID NO: 26423 - DNA, 2526 bp, Rhizobium meliloti; identical to SEQ ID NO: 20690
  CDS (1)..(2526)

SEQ ID NO: 26424 - protein, 841 aa, Rhizobium meliloti; identical to SEQ ID NO: 20691

SEQ ID NO: 26425 - DNA, 1998 bp, Rhizobium meliloti; identical to SEQ ID NO: 20692
  CDS (1)..(1998)

SEQ ID NO: 26426 - protein, 665 aa, Rhizobium meliloti; identical to SEQ ID NO: 20693

SEQ ID NO: 26427 - DNA, 2367 bp, Rhizobium meliloti; identical to SEQ ID NO: 20694
  CDS (1)..(2367)

SEQ ID NO: 26428 - protein, 788 aa, Rhizobium meliloti; identical to SEQ ID NO: 20695

SEQ ID NO: 26429 - DNA, 1665 bp, Rahnella aquatilis; identical to SEQ ID NO: 20696
  CDS (1)..(1665)

SEQ ID NO: 26430 - protein, 554 aa, Rahnella aquatilis; identical to SEQ ID NO: 20697

SEQ ID NO: 26431 - DNA, 1587 bp, Agrobacterium tumefaciens; identical to SEQ ID NO: 20698
  CDS (1)..(1587)

SEQ ID NO: 26432 - protein, 528 aa, Agrobacterium tumefaciens; identical to SEQ ID NO: 20699

SEQ ID NO: 26433 - DNA, 1857 bp, Agrobacterium rhizogenes; identical to SEQ ID NO: 20700
  CDS (1)..(1857)

SEQ ID NO: 26434 - protein, 618 aa, Agrobacterium rhizogenes; identical to SEQ ID NO: 20701

SEQ ID NO: 26435 - DNA, 1815 bp, Rhizobium meliloti; identical to SEQ ID NO: 20702
  CDS (1)..(1815)

SEQ ID NO: 26436 - protein, 604 aa, Rhizobium meliloti; identical to SEQ ID NO: 20703

SEQ ID NO: 26437 - DNA, 2124 bp, Rhizobium meliloti; identical to SEQ ID NO: 20704
  CDS (1)..(2124)

SEQ ID NO: 26438 - protein, 707 aa, Rhizobium meliloti; identical to SEQ ID NO: 20705

SEQ ID NO: 26439 - DNA, 1524 bp, Erwinia amylovora; identical to SEQ ID NO: 20706
  CDS (1)..(1524)

SEQ ID NO: 26440 - protein, 507 aa, Erwinia amylovora; identical to SEQ ID NO: 20707

SEQ ID NO: 26441 - DNA, 2172 bp, Agrobacterium rhizogenes; identical to SEQ ID NO: 20708
  CDS (1)..(2172)

SEQ ID NO: 26442 - protein, 723 aa, Agrobacterium rhizogenes; identical to SEQ ID NO: 20709

SEQ ID NO: 26443 - DNA, 2277 bp, Agrobacterium rhizogenes; identical to SEQ ID NO: 20710
  CDS (1)..(2277)

SEQ ID NO: 26444 - protein, 758 aa, Agrobacterium rhizogenes; identical to SEQ ID NO: 20711

SEQ ID NO: 26445 - DNA, 1725 bp, Agrobacterium tumefaciens; identical to SEQ ID NO: 20712
  CDS (1)..(1725)

SEQ ID NO: 26446 - protein, 574 aa, Agrobacterium tumefaciens; identical to SEQ ID NO: 20713

SEQ ID NO: 26447 - DNA, 2410 bp, Rhizobium leguminosarum; identical to SEQ ID NO: 20714
  CDS (37)..(1998)

SEQ ID NO: 26448 - protein, 653 aa, Rhizobium leguminosarum; identical to SEQ ID NO: 20715

SEQ ID NO: 26449 - DNA, 3600 bp, Desulfovibrio gigas; identical to SEQ ID NO: 20716
  CDS (302)..(2251)

SEQ ID NO: 26450 - protein, 649 aa, Desulfovibrio gigas; identical to SEQ ID NO: 20717

SEQ ID NO: 26451 - DNA, 1662 bp, Salmonella typhimurium; identical to SEQ ID NO: 20718
  CDS (1)..(1662)

SEQ ID NO: 26452 - protein, 553 aa, Salmonella typhimurium; identical to SEQ ID NO: 20719

SEQ ID NO: 26453 - DNA, 24 bp, Primer
atgattaaccgtatccgcgtagtc

SEQ ID NO: 26454 - DNA, 27 bp, Primer
ttaaaatgtttcccagtttggatcttg

SEQ ID NO: 26455 - DNA, 2200 bp, Escherichia coli K12; identical to SEQ ID NO: 17198
  CDS (776)..(2200)

SEQ ID NO: 26456 - protein, 474 aa, Escherichia coli K12; identical to SEQ ID NO: 17199

SEQ ID NO: 26457 - DNA, 3053 bp, Arabidopsis thaliana (mouse-ear cress); identical to SEQ ID NO: 17200
  CDS (1)..(2556)

SEQ ID NO: 26458 - protein, 851 aa, Arabidopsis thaliana (mouse-ear cress); identical to SEQ ID NO: 17201

SEQ ID NO: 26459 - DNA, 1422 bp, Salmonella enterica subsp. enterica serovar Typhi; identical to SEQ ID NO: 17202
  CDS (1)..(1422)

SEQ ID NO: 26460 - protein, 473 aa, Salmonella enterica subsp. enterica serovar Typhi; identical to SEQ ID NO: 17203

SEQ ID NO: 26461 - DNA, 1497 bp, Mycobacterium leprae; identical to SEQ ID NO: 17204
  CDS (1)..(1497)

SEQ ID NO: 26462 - protein, 498 aa, Mycobacterium leprae; identical to SEQ ID NO: 17205

SEQ ID NO: 26463 - DNA, 2829 bp, Arabidopsis thaliana (mouse-ear cress); identical to SEQ ID NO: 17206
  CDS (1)..(2829)

SEQ ID NO: 26464 - protein, 942 aa, Arabidopsis thaliana (mouse-ear cress); identical to SEQ ID NO: 17207

SEQ ID NO: 26465 - DNA, 1491 bp, Methanobacterium thermoautotrophicum; identical to SEQ ID NO: 17208
  CDS (1)..(1491)

SEQ ID NO: 26466 - protein, 496 aa, Methanobacterium thermoautotrophicum; identical to SEQ ID NO: 17209

SEQ ID NO: 26467 - DNA, 1392 bp, Sinorhizobium meliloti; identical to SEQ ID NO: 17210
  CDS (1)..(1392)

SEQ ID NO: 26468 - protein, 463 aa, Sinorhizobium meliloti; identical to SEQ ID NO: 17211

SEQ ID NO: 26469 - DNA, 1503 bp, Mycobacterium tuberculosis; identical to SEQ ID NO: 17212
  CDS (1)..(1503)

SEQ ID NO: 26470 - protein, 500 aa, Mycobacterium tuberculosis; identical to SEQ ID NO: 17213

SEQ ID NO: 26471 - DNA, 2091 bp, Saccharomyces cerevisiae; identical to SEQ ID NO: 17214
  CDS (233)..(1720)

SEQ ID NO: 26472 - protein, 495 aa, Saccharomyces cerevisiae; identical to SEQ ID NO: 17215

SEQ ID NO: 26473 - DNA, 5981 bp, Saccharomyces cerevisiae; identical to SEQ ID NO: 17216
  CDS (2282)..(5578)

SEQ ID NO: 26474 - protein, 1098 aa, Saccharomyces cerevisiae; identical to SEQ ID NO: 17217

SEQ ID NO: 26475 - DNA, 2358 bp, Kluyveromyces marxianus var. lactis, Candida sphaerica; identical to SEQ ID NO: 17218
  CDS (722)..(2188)

SEQ ID NO: 26476 - protein, 488 aa, Kluyveromyces marxianus var. lactis, Candida sphaerica; identical to SEQ ID NO: 17219

SEQ ID NO: 26477 - DNA, 3170 bp, Saccharomyces cerevisiae; identical to SEQ ID NO: 17220
  CDS (147)..(2837)

SEQ ID NO: 26478 - protein, 896 aa, Saccharomyces cerevisiae; identical to SEQ ID NO: 17221

SEQ ID NO: 26479 - DNA, 1500 bp, Synechocystis sp; identical to SEQ ID NO: 17222
  CDS (1)..(1500)

SEQ ID NO: 26480 - protein, 499 aa, Synechocystis sp; identical to SEQ ID NO: 17223

SEQ ID NO: 26481 - DNA, 2586 bp, Arabidopsis thaliana (mouse-ear cress); identical to SEQ ID NO: 17224
  CDS (1)..(2586)

SEQ ID NO: 26482 - protein, 861 aa, Arabidopsis thaliana (mouse-ear cress); identical to SEQ ID NO: 17225

SEQ ID NO: 26483 - DNA, 2388 bp, Arabidopsis thaliana (mouse-ear cress); identical to SEQ ID NO: 17226
  CDS (1)..(2388)

SEQ ID NO: 26484 - protein, 795 aa, Arabidopsis thaliana (mouse-ear cress); identical to SEQ ID NO: 17227

SEQ ID NO: 26485 - DNA, 2676 bp, Schizosaccharomyces pombe; identical to SEQ ID NO: 17228
  CDS (1)..(2676)

SEQ ID NO: 26486 - protein, 891 aa, Schizosaccharomyces pombe; identical to SEQ ID NO: 17229

SEQ ID NO: 26487 - DNA, 2550 bp, Schizosaccharomyces pombe; identical to SEQ ID NO: 17230
  CDS (1)..(2550)

SEQ ID NO: 26488 - protein, 849 aa, Schizosaccharomyces pombe; identical to SEQ ID NO: 17231

SEQ ID NO: 26489 - DNA, 2835 bp, Schizosaccharomyces pombe; identical to SEQ ID NO: 17232
  CDS (1)..(2835)

SEQ ID NO: 26490 - protein, 944 aa, Schizosaccharomyces pombe; identical to SEQ ID NO: 17233

SEQ ID NO: 26491 - DNA, 2580 bp, Schizosaccharomyces pombe; identical to SEQ ID NO: 17234
  CDS (52)..(2505)

SEQ ID NO: 26492 - protein, 817 aa, Schizosaccharomyces pombe; identical to SEQ ID NO: 17235

SEQ ID NO: 26493 - DNA, 1993 bp, Schizosaccharomyces pombe; identical to SEQ ID NO: 17236
  CDS (266)..(1705)

SEQ ID NO: 26494 - protein, 479 aa, Schizosaccharomyces pombe; identical to SEQ ID NO: 17237

SEQ ID NO: 26495 - DNA, 2621 bp, unidentified; identical to SEQ ID NO: 17238
  CDS (25)..(2487)

SEQ ID NO: 26496 - protein, 820 aa, unidentified; identical to SEQ ID NO: 17239

SEQ ID NO: 26497 - DNA, 2640 bp, Helianthus annuus; identical to SEQ ID NO: 17240
  CDS (171)..(2510)

SEQ ID NO: 26498 - protein, 779 aa, Helianthus annuus; identical to SEQ ID NO: 17241

SEQ ID NO: 26499 - DNA, 1913 bp, Selaginella lepidophylla; identical to SEQ ID NO: 17242
  CDS (111)..(1913)

SEQ ID NO: 26500 - protein, 600 aa, Selaginella lepidophylla; identical to SEQ ID NO: 17243

SEQ ID NO: 26501 - DNA, 4351 bp, Caenorhabditis elegans; identical to SEQ ID NO: 17244
  CDS (112)..(3996)

SEQ ID NO: 26502 - protein, 1294 aa, Caenorhabditis elegans; identical to SEQ ID NO: 17245

SEQ ID NO: 26503 - DNA, 2637 bp, Debaryomyces hansenii; identical to SEQ ID NO: 17246
  CDS (1)..(2637)

SEQ ID NO: 26504 - protein, 878 aa, Debaryomyces hansenii; identical to SEQ ID NO: 17247

SEQ ID NO: 26505 - DNA, 1443 bp, Debaryomyces hansenii; identical to SEQ ID NO: 17248
  CDS (1)..(1443)

SEQ ID NO: 26506 - protein, 480 aa, Debaryomyces hansenii; identical to SEQ ID NO: 17249

SEQ ID NO: 26507 - DNA, 2403 bp, Yarrowia lipolytica; identical to SEQ ID NO: 17250
  CDS (1)..(2403)

SEQ ID NO: 26508 - protein, 800 aa, Yarrowia lipolytica; identical to SEQ ID NO: 17251

SEQ ID NO: 26509 - DNA, 3447 bp, Kluyveromyces lactis; identical to SEQ ID NO: 17252
  CDS (1)..(3447)

SEQ ID NO: 26510 - protein, 1148 aa, Kluyveromyces lactis; identical to SEQ ID NO: 17253

SEQ ID NO: 26511 - DNA, 2631 bp, Kluyveromyces lactis; identical to SEQ ID NO: 17254
  CDS (1)..(2631)

SEQ ID NO: 26512 - protein, 876 aa, Kluyveromyces lactis; identical to SEQ ID NO: 17255

SEQ ID NO: 26513 - DNA, 1437 bp, Acinetobacter sp; identical to SEQ ID NO: 17256
  CDS (1)..(1437)

SEQ ID NO: 26514 - protein, 478 aa, Acinetobacter sp; identical to SEQ ID NO: 17257

SEQ ID NO: 26515 - DNA, 1476 bp, Candida glabrata; identical to SEQ ID NO: 17258
  CDS (1)..(1476)

SEQ ID NO: 26516 - protein, 491 aa, Candida glabrata; identical to SEQ ID NO: 17259

SEQ ID NO: 26517 - DNA, 3198 bp, Candida glabrata; identical to SEQ ID NO: 17260
  CDS (1)..(3198)

SEQ ID NO: 26518 - protein, 1065 aa, Candida glabrata; identical to SEQ ID NO: 17261

SEQ ID NO: 26519 - DNA, 3345 bp, Candida glabrata; identical to SEQ ID NO: 17262
  CDS (1)..(3345)

SEQ ID NO: 26520 - protein, 1114 aa, Candida glabrata; identical to SEQ ID NO: 17263

SEQ ID NO: 26521 - DNA, 2673 bp, Candida glabrata; identical to SEQ ID NO: 17264
  CDS (1)..(2673)

SEQ ID NO: 26522 - protein, 890 aa, Candida glabrata; identical to SEQ ID NO: 17265

SEQ ID NO: 26523 - DNA, 2013 bp, Cryptococcus neoformans var; identical to SEQ ID NO: 17266
  CDS (1)..(2013)

SEQ ID NO: 26524 - protein, 670 aa, Cryptococcus neoformans var; identical to SEQ ID NO: 17267

SEQ ID NO: 26525 - DNA, 1302 bp, Picrophilus torridus; identical to SEQ ID NO: 17268
  CDS (1)..(1302)

SEQ ID NO: 26526 - protein, 433 aa, Picrophilus torridus; identical to SEQ ID NO: 17269

SEQ ID NO: 26527 - DNA, 1482 bp, Rhodopseudomonas palustris; identical to SEQ ID NO: 17270
  CDS (1)..(1482)

SEQ ID NO: 26528 - protein, 493 aa, Rhodopseudomonas palustris; identical to SEQ ID NO: 17271

SEQ ID NO: 26529 - DNA, 1440 bp, Corynebacterium diphtheriae; identical to SEQ ID NO: 17272
  CDS (1)..(1440)

SEQ ID NO: 26530 - protein, 479 aa, Corynebacterium diphtheriae; identical to SEQ ID NO: 17273

SEQ ID NO: 26531 - DNA, 2589 bp, Oryza sativa; identical to SEQ ID NO: 17274
  CDS (1)..(2589)

SEQ ID NO: 26532 - protein, 862 aa, Oryza sativa; identical to SEQ ID NO: 17275

SEQ ID NO: 26533 - DNA, 2812 bp, Oryza sativa; identical to SEQ ID NO: 17276
  CDS (53)..(2527)

SEQ ID NO: 26534 - protein, 824 aa, Oryza sativa; identical to SEQ ID NO: 17277

SEQ ID NO: 26535 - DNA, 2208 bp, Thermoproteus tenax; identical to SEQ ID NO: 17278
  CDS (1)..(2208)

SEQ ID NO: 26536 - protein, 735 aa, Thermoproteus tenax; identical to SEQ ID NO: 17279

SEQ ID NO: 26537 - DNA, 1479 bp, Mycobacterium paratuberculosis; identical to SEQ ID NO: 17280
  CDS (1)..(1479)

SEQ ID NO: 26538 - protein, 492 aa, Mycobacterium paratuberculosis; identical to SEQ ID NO: 17281

SEQ ID NO: 26539 - DNA, 1461 bp, Geobacter sulfurreducens; identical to SEQ ID NO: 17282
  CDS (1)..(1461)

SEQ ID NO: 26540 - protein, 486 aa, Geobacter sulfurreducens; identical to SEQ ID NO: 17283

SEQ ID NO: 26541 - DNA, 3333 bp, Ashbya gossypii; identical to SEQ ID NO: 17284
  CDS (1)..(3333)

SEQ ID NO: 26542 - protein, 1110 aa, Ashbya gossypii; identical to SEQ ID NO: 17285

SEQ ID NO: 26543 - DNA, 1485 bp, Ashbya gossypii; identical to SEQ ID NO: 17286
  CDS (1)..(1485)

SEQ ID NO: 26544 - protein, 494 aa, Ashbya gossypii; identical to SEQ ID NO: 17287

SEQ ID NO: 26545 - DNA, 3498 bp, Oryza sativa; identical to SEQ ID NO: 17288
  CDS (176)..(2875)

SEQ ID NO: 26546 - protein, 899 aa, Oryza sativa; identical to SEQ ID NO: 17289

SEQ ID NO: 26547 - DNA, 3048 bp, Neurospora crassa; identical to SEQ ID NO: 17290
  CDS (1)..(3048)

SEQ ID NO: 26548 - protein, 1015 aa, Neurospora crassa; identical to SEQ ID NO: 17291

SEQ ID NO: 26549 - DNA, 1572 bp, Neurospora crassa; identical to SEQ ID NO: 17292
  CDS (1)..(1572)

SEQ ID NO: 26550 - protein, 523 aa, Neurospora crassa; identical to SEQ ID NO: 17293

SEQ ID NO: 26551 - DNA, 2730 bp, Neurospora crassa; identical to SEQ ID NO: 17294
  CDS (1)..(2730)

SEQ ID NO: 26552 - protein, 909 aa, Neurospora crassa; identical to SEQ ID NO: 17295

SEQ ID NO: 26553 - DNA, 1488 bp, Synechococcus sp; identical to SEQ ID NO: 17296
  CDS (1)..(1488)

SEQ ID NO: 26554 - protein, 495 aa, Synechococcus sp; identical to SEQ ID NO: 17297

SEQ ID NO: 26555 - DNA, 1350 bp, Thermus thermophilus; identical to SEQ ID NO: 17298
  CDS (1)..(1350)

SEQ ID NO: 26556 - protein, 449 aa, Thermus thermophilus; identical to SEQ ID NO: 17299

SEQ ID NO: 26557 - DNA, 3862 bp, Caenorhabditis elegans; identical to SEQ ID NO: 17300
  CDS (30)..(3722)

SEQ ID NO: 26558 - protein, 1230 aa, Caenorhabditis elegans; identical to SEQ ID NO: 17301

SEQ ID NO: 26559 - DNA, 1590 bp, Magnaporthe grisea; identical to SEQ ID NO: 17302
  CDS (1)..(1590)

SEQ ID NO: 26560 - protein, 529 aa, Magnaporthe grisea; identical to SEQ ID NO: 17303

SEQ ID NO: 26561 - DNA, 1485 bp, Bradyrhizobium japonicum; identical to SEQ ID NO: 17304
  CDS (1)..(1485)

SEQ ID NO: 26562 - protein, 494 aa, Bradyrhizobium japonicum; identical to SEQ ID NO: 17305

SEQ ID NO: 26563 - DNA, 1449 bp, Corynebacterium efficiens; identical to SEQ ID NO: 17306
  CDS (1)..(1449)

SEQ ID NO: 26564 - protein, 482 aa, Corynebacterium efficiens; identical to SEQ ID NO: 17307

SEQ ID NO: 26565 - DNA, 2774 bp, Arabidopsis thaliana; identical to SEQ ID NO: 17308
  CDS (102)..(2690)

SEQ ID NO: 26566 - protein, 862 aa, Arabidopsis thaliana; identical to SEQ ID NO: 17309

SEQ ID NO: 26567 - DNA, 2583 bp, Oryza sativa; identical to SEQ ID NO: 17310
  CDS (1)..(2583)

SEQ ID NO: 26568 - protein, 860 aa, Oryza sativa; identical to SEQ ID NO: 17311

SEQ ID NO: 26569 - DNA, 1458 bp, Corynebacterium glutamicum; identical to SEQ ID NO: 17312
  CDS (1)..(1458)

SEQ ID NO: 26570 - protein, 485 aa, Corynebacterium glutamicum; identical to SEQ ID NO: 17313

SEQ ID NO: 26571 - DNA, 2358 bp, Xanthomonas campestris; identical to SEQ ID NO: 17314
  CDS (1)..(2358)

SEQ ID NO: 26572 - protein, 785 aa, Xanthomonas campestris; identical to SEQ ID NO: 17315

SEQ ID NO: 26573 - DNA, 1368 bp, Xanthomonas axonopodis; identical to SEQ ID NO: 17316
  CDS (1)..(1368)

SEQ ID NO: 26574 - protein, 455 aa, Xanthomonas axonopodis; identical to SEQ ID NO: 17317

SEQ ID NO: 26575 - DNA, 2574 bp, Solanum tuberosum; identical to SEQ ID NO: 17318
  CDS (1)..(2574)

SEQ ID NO: 26576 - protein, 857 aa, Solanum tuberosum; identical to SEQ ID NO: 17319

SEQ ID NO: 26577 - DNA, 1380 bp, Encephalitozoon cuniculi; identical to SEQ ID NO: 17320
  CDS (1)..(1380)

SEQ ID NO: 26578 - protein, 459 aa, Encephalitozoon cuniculi; identical to SEQ ID NO: 17321

SEQ ID NO: 26579 - DNA, 1398 bp, Ralstonia solanacearum; identical to SEQ ID NO: 17322
  CDS (1)..(1398)

SEQ ID NO: 26580 - protein, 465 aa, Ralstonia solanacearum; identical to SEQ ID NO: 17323

SEQ ID NO: 26581 - DNA, 1674 bp, Ralstonia solanacearum; identical to SEQ ID NO: 17324
  CDS (1)..(1674)

SEQ ID NO: 26582 - protein, 557 aa, Ralstonia solanacearum; identical to SEQ ID NO: 17325

SEQ ID NO: 26583 - DNA, 2214 bp, Pyrobaculum aerophilum; identical to SEQ ID NO: 17326
  CDS (1)..(2214)

SEQ ID NO: 26584 - protein, 737 aa, Pyrobaculum aerophilum; identical to SEQ ID NO: 17327

SEQ ID NO: 26585 - DNA, 3001 bp, Arabidopsis thaliana; identical to SEQ ID NO: 17328
  CDS (204)..(2306)

SEQ ID NO: 26586 - protein, 700 aa, Arabidopsis thaliana; identical to SEQ ID NO: 17329

SEQ ID NO: 26587 - DNA, 3272 bp, Oryza sativa; identical to SEQ ID NO: 17330
  CDS (247)..(2985)

SEQ ID NO: 26588 - protein, 912 aa, Oryza sativa; identical to SEQ ID NO: 17331

SEQ ID NO: 26589 - DNA, 1681 bp, Amanita muscaria; identical to SEQ ID NO: 17332
  CDS (101)..(1552)

SEQ ID NO: 26590 - protein, 483 aa, Amanita muscaria; identical to SEQ ID NO: 17333

SEQ ID NO: 26591 - DNA, 1344 bp, Thermoplasma volcanium; identical to SEQ ID NO: 17334
  CDS (1)..(1344)

SEQ ID NO: 26592 - protein, 447 aa, Thermoplasma volcanium; identical to SEQ ID NO: 17335

SEQ ID NO: 26593 - DNA, 1563 bp, Rhizobium loti; identical to SEQ ID NO: 17336
  CDS (1)..(1563)

SEQ ID NO: 26594 - protein, 520 aa, Rhizobium loti; identical to SEQ ID NO: 17337

SEQ ID NO: 26595 - DNA, 2637 bp, Oryza sativa; identical to SEQ ID NO: 17338
  CDS (1)..(2637)

SEQ ID NO: 26596 - protein, 878 aa, Oryza sativa; identical to SEQ ID NO: 17339

SEQ ID NO: 26597 - DNA, 1326 bp, Thermoplasma acidophilum; identical to SEQ ID NO: 17340
  CDS (1)..(1326)

SEQ ID NO: 26598 - protein, 441 aa, Thermoplasma acidophilum; identical to SEQ ID NO: 17341

SEQ ID NO: 26599 - DNA, 1389 bp, Streptomyces coelicolor; identical to SEQ ID NO: 17342
  CDS (1)..(1389)

SEQ ID NO: 26600 - protein, 462 aa, Streptomyces coelicolor; identical to SEQ ID NO: 17343

SEQ ID NO: 26601 - DNA, 2635 bp, Arabidopsis thaliana; identical to SEQ ID NO: 17344
  CDS (1)..(2604)

SEQ ID NO: 26602 - protein, 867 aa, Arabidopsis thaliana; identical to SEQ ID NO: 17345

SEQ ID NO: 26603 - DNA, 2843 bp, Zygosaccharomyces rouxii; identical to SEQ ID NO: 17346
  CDS (24)..(2726)

SEQ ID NO: 26604 - protein, 900 aa, Zygosaccharomyces rouxii; identical to SEQ ID NO: 17347

SEQ ID NO: 26605 - DNA, 3197 bp, Drosophila melanogaster; identical to SEQ ID NO: 17348
  CDS (662)..(3091)

SEQ ID NO: 26606 - protein, 809 aa, Drosophila melanogaster; identical to SEQ ID NO: 17349

SEQ ID NO: 26607 - DNA, 1503 bp, Pseudomonas anguilliseptica; identical to SEQ ID NO: 17350
  CDS (1)..(1503)

SEQ ID NO: 26608 - protein, 500 aa, Pseudomonas anguilliseptica; identical to SEQ ID NO: 17351

SEQ ID NO: 26609 - DNA, 1503 bp, Synechococcus sp; identical to SEQ ID NO: 17352
  CDS (1)..(1503)

SEQ ID NO: 26610 - protein, 500 aa, Synechococcus sp; identical to SEQ ID NO: 17353

SEQ ID NO: 26611 - DNA, 1395 bp, Rhizobium sp; identical to SEQ ID NO: 17354
  CDS (1)..(1395)

SEQ ID NO: 26612 - protein, 464 aa, Rhizobium sp; identical to SEQ ID NO: 17355

SEQ ID NO: 26613 - DNA, 1437 bp, Candida albicans; identical to SEQ ID NO: 17356
  CDS (1)..(1437)

SEQ ID NO: 26614 - protein, 478 aa, Candida albicans; identical to SEQ ID NO: 17357

SEQ ID NO: 26615 - DNA, 1515 bp, Emericella nidulans; identical to SEQ ID NO: 17358
  CDS (1)..(1515)

SEQ ID NO: 26616 - protein, 504 aa, Emericella nidulans; identical to SEQ ID NO: 17359

SEQ ID NO: 26617 - DNA, 2695 bp, Pichia angusta; identical to SEQ ID NO: 17360
  CDS (793)..(2220)

SEQ ID NO: 26618 - protein, 475 aa, Pichia angusta; identical to SEQ ID NO: 17361

SEQ ID NO: 26619 - DNA, 1542 bp, Schizosaccharomyces pombe; identical to SEQ ID NO: 17362
  CDS (1)..(1542)

SEQ ID NO: 26620 - protein, 513 aa, Schizosaccharomyces pombe; identical to SEQ ID NO: 17363

SEQ ID NO: 26621 - DNA, 1520 bp, Yarrowia lipolytica; identical to SEQ ID NO: 17364
  CDS (27)..(1436)

SEQ ID NO: 26622 - protein, 469 aa, Yarrowia lipolytica; identical to SEQ ID NO: 17365

SEQ ID NO: 26623 - DNA, 1645 bp, Zygosaccharomyces rouxii; identical to SEQ ID NO: 17366
  CDS (77)..(1534)

SEQ ID NO: 26624 - protein, 485 aa, Zygosaccharomyces rouxii; identical to SEQ ID NO: 17367

SEQ ID NO: 26625 - DNA, 3069 bp, Saccharomyces cerevisiae; identical to SEQ ID NO: 17368
  CDS (1)..(3069)

SEQ ID NO: 26626 - protein, 1022 aa, Saccharomyces cerevisiae; identical to SEQ ID NO: 17369

SEQ ID NO: 26627 - DNA, 1554 bp, Aspergillus niger; identical to SEQ ID NO: 17370
  CDS (1)..(1554)

SEQ ID NO: 26628 - protein, 517 aa, Aspergillus niger; identical to SEQ ID NO: 17371

SEQ ID NO: 26629 - DNA, 25 bp, Primer
atgagtcgtttagtcgtagtatcta

SEQ ID NO: 26630 - DNA, 24 bp, Primer
ttacgcaagctttggaaaggtagc

SEQ ID NO: 26631 - DNA, 318 bp, Escherichia coli K12
  CDS (1)..(318)
atggctgaatggagcggcgaatatatcagcccatacgctgagcacggcaagaagagtgaacaagtcaaaaagattacggtttccattcctcttaaggtgttaaaaatcctcaccgatgaacgcacgcgtcgtcaggtgaacaacctgcgtcacgctaccaacagcgagctgctgtgcgaagcgtttctgcatgcctttaccgggcaacctttgccggatgatgccgatctgcgtaaagagcgcagcgacgaaatcccggaagcggcaaaagagatcatgcgtgagatggggattaacccggagacgtgggaatactaa

SEQ ID NO: 26632 - protein, 105 aa, Escherichia coli K12
MAEWSGEYISPYAEHGKKSEQVKKITVSIPLKVLKILTDERTRRQVNNLRHATNSELLCEAFLHAFTGQPLPDDADLRKERSDEIPEAAKEIMREMGINPETWEY

SEQ ID NO: 26633 - DNA, 318 bp, Salmonella typhimurium
  CDS (1)..(318)
atggctgaatggagcggcgaatatatcagcccatacgctgagcacggtaagaagagtgagcaagtcaaaaaaattacggtttccattcctctgaaggtgttaaaaatcctcaccgatgaacgtacgcgtcgtcaggtgaacaacctgcgccacgccaccaacagcgagctgttgtgtgaagcatttctgcacgcctttaccgggcaacccttgccggatgatgccgatctgcgaaaagagcgcagcgatgaaatcccggaagcggcaaaagagatcatgcgtgagttggggattgatccggaaacgtgggaatactga

SEQ ID NO: 26634 - protein, 105 aa, Salmonella typhimurium
MAEWSGEYISPYAEHGKKSEQVKKITVSIPLKVLKILTDERTRRQVNNLRHATNSELLCEAFLHAFTGQPLPDDADLRKERSDEIPEAAKEIMRELGIDPETWEY

SEQ ID NO: 26635 - DNA, 318 bp, Haemophilus influenzae
  CDS (1)..(318)
atggcgaattgggacggaaaatatatcagcccttatgcagaacatggcaaaaaaagtgagcaagtaaaaaaaattacagtatccattcccattaaagtactggaaattttgacgaatgaacgcactcgccgccaattaaaaagtttacgtcacgcaactaacagtgaattgctttgtgaagcgttcttgcatgcattcacaggacaacctttacccaccgatgcagatttaatgaaagagcgtaatgatgaaatccctgaagatgccaaagtgcttatgcgtgaattaggtgtcgatccagaaagctgggaatattaa

SEQ ID NO: 26636 - protein, 105 aa, Haemophilus influenzae
MANWDGKYISPYAEHGKKSEQVKKITVSIPIKVLEILTNERTRRQLKSLRHATNSELLCEAFLHAFTGQPLPTDADLMKERNDEIPEDAKVLMRELGVDPESWEY

SEQ ID NO: 26637 - DNA, 318 bp, Yersinia pestis
  CDS (1)..(318)
atggctgagtggaacggcgagtatgtcagcccttacgctgaacacggcaagaaaagcaagcaggtcaaaaaaatcacggtatccattccgttgaaagtgttaaaaatcctcaccgatgagcggacccgccgtcaggtgaataacctgcgccatgctaccaacagtgaattgttgtgtgaggcctttttgcatgcatttactggccagccgctaccgaatgacgaagacctgcgtaaagaacgcagtgatgagatcccggaagccgcgaaaattttaatgcgtgaattgggtgttgaccctgacacctgggaatattga

SEQ ID NO: 26638 - protein, 105 aa, Yersinia pestis
MAEWNGEYVSPYAEHGKKSKQVKKITVSIPLKVLKILTDERTRRQVNNLRHATNSELLCEAFLHAFTGQPLPNDEDLRKERSDEIPEAAKILMRELGVDPDTWEY

SEQ ID NO: 26639 - DNA, 318 bp, Yersinia pseudotuberculosis IP 32953
  CDS (1)..(318)
atggctgagtggaacggcgagtatgtcagcccttacgctgaacacggcaagaaaagcgagcaggtcaaaaaaatcacggtatccattccgttgaaagtgttaaaaatcctcaccgatgagcggacccgccgtcaggtgaataacctgcgccatgctaccaacagtgaattgttgtgtgaggcctttttgcatgcatttactggccagccgctaccgaatgacgaagacctgcgtaaagaacgcagtgatgagatcccggaagccgcgaaaattttaatgcgtgaattgggtgttgaccctgacacctgggaatattga

SEQ ID NO: 26640 - protein, 105 aa, Yersinia pseudotuberculosis IP 32953
MAEWNGEYVSPYAEHGKKSEQVKKITVSIPLKVLKILTDERTRRQVNNLRHATNSELLCEAFLHAFTGQPLPNDEDLRKERSDEIPEAAKILMRELGVDPDTWEY

SEQ ID NO: 26641 - DNA, 318 bp, Erwinia carotovora
  CDS (1)..(318)
atggctgagtggaacggcgagtatgtcagcccttacgctgaacacggtaaaaaaagcgagcaagtcaagaagataacagtatctatcccgctgaaagtattgaagatactgaccgacgaacgcacacgtcgtcaggtgaacaacctgcgccacgccaccaacagcgaactgctgtgcgaagcgtttctgcatgcgttcacaggtcaaccgttaccgaatgatgaagacctgcgtaaagaacgtagcgatgaaattcctgaagcagcgaaaatcatcatgcgtgaaatgggtatcgacccggatacgtgggaatactga

SEQ ID NO: 26642 - protein, 105 aa, Erwinia carotovora
MAEWNGEYVSPYAEHGKKSEQVKKITVSIPLKVLKILTDERTRRQVNNLRHATNSELLCEAFLHAFTGQPLPNDEDLRKERSDEIPEAAKIIMREMGIDPDTWEY

SEQ ID NO: 26643 - DNA, 318 bp, Photobacterium profundum
  CDS (1)..(318)
atggcagagtggaatggcgagtacatcagcccatacgcggaacatggtaagaaaaacgaacaagttaagaaaattactgtttcgattccattaaaggttttaaaaatcttgactgatgaacgcactcgtcgccaggtaaataacctgcgtcatgcaacaaacagtgaattactgtgtgaagcattcctacatgcttatacaggtcagccgttaccaactgatgacgatattcgtaaagattgcccagatgcgcttcctgctgaagcgaaagcaatcatggatgaaatgggtatcacctacgaagacatcaacgaataa

SEQ ID NO: 26644 - protein, 105 aa, Photobacterium profundum
MAEWNGEYISPYAEHGKKNEQVKKITVSIPLKVLKILTDERTRRQVNNLRHATNSELLCEAFLHAYTGQPLPTDDDIRKDCPDALPAEAKAIMDEMGITYEDINE

SEQ ID NO: 26645 - DNA, 318 bp, Haemophilus ducreyi
  CDS (1)..(318)
atgataaattggagtggcaaatacattagcccatatgcagaacacggaaaaaaaagtaaacaagtcaaaaaaatcactgtttctattccaataaaagtattggaaatcctcactaatgaaagaactcgccgccaaatcaataacctacgccacgccaccaacagtgaactattatgtgaggcgtttttacatgcttttaccggtcagccgttacccgcagatgaagatttaatgaaagaacgctatgacgaaatccccgaaaaagcaaaaagcagaatgcgcgatcttggtattgatccagacgaatggcaatactaa

SEQ ID NO: 26646 - protein, 105 aa, Haemophilus ducreyi
MINWSGKYISPYAEHGKKSKQVKKITVSIPIKVLEILTNERTRRQINNLRHATNSELLCEAFLHAFTGQPLPADEDLMKERYDEIPEKAKSRMRDLGIDPDEWQY

SEQ ID NO: 26647 - DNA, 318 bp, Pasteurella multocida
  CDS (1)..(318)
atggcaaattgggacggtaaatatattagcccttacgcagagcatggcaagaagagtgagcaagtcaaaaaaattacagtatcgattccgattaaagtattggaaattttaaccaatgaacggacacgcagacaaattcgtaatttacgtcatgcaacgaacagtgaattgctctgtgaagcctttttgcatgcctttaccggtcaaccgttgccaacggatgaagacttattaaaagagcgccatgacgaaattcctgagcaagcaaagcaagtgatgcgcgaattgggtatcgatccagaaaaatgggaatactaa

SEQ ID NO: 26648 - protein, 105 aa, Pasteurella multocida
MANWDGKYISPYAEHGKKSEQVKKITVSIPIKVLEILTNERTRRQIRNLRHATNSELLCEAFLHAFTGQPLPTDEDLLKERHDEIPEQAKQVMRELGIDPEKWEY

SEQ ID NO: 26649 - DNA, 318 bp, Photorhabdus luminescens
  CDS (1)..(318)
atggctgagtggaacggtgaatatgtcagcccttatgctgaacatggcaaaaaaagcgaacaagtgaagaaaatcacagtctcaattccgttgaaagtgttgagaatcctcactgatgaacgcactcgtcgccaggtcaataacctgcgtcatgcaactaatagtgaattgttgtgtgaagcattcctgcatgcatttactgggcagccgctgcccgatgatgctgatttacgtaaagagcgtaatgatgaaatcccagaggaagccaaaaaaatcatgcgggaattaggtattgatcctgatacttgggaatattga

SEQ ID NO: 26650 - protein, 105 aa, Photorhabdus luminescens
MAEWNGEYVSPYAEHGKKSEQVKKITVSIPLKVLRILTDERTRRQVNNLRHATNSELLCEAFLHAFTGQPLPDDADLRKERNDEIPEEAKKIMRELGIDPDTWEY

SEQ ID NO: 26651 - DNA, 315 bp, Shewanella oneidensis
  CDS (1)..(315)
atgactgaatggaatggggaatacatcagcccctatgctgaacatggcaagaagaatgaacaagtaaagaaaattactgtgtctattccgctcaaagtgctaaaagtcctcacggatgaacgtacgcgtcgtcaggtcaacaacctgcgccatgcgaccaatagcgaactgttgtgcgaagcatttttgcatgcctacaccggccagcctctgcctgatgatgccgatctgtcgaaagagtgcccagacagcatccccgccgaagcgaagcggttgatggacgaaatggggatcgagtgggaagacatggaataa

SEQ ID NO: 26652 - protein, 104 aa, Shewanella oneidensis
MTEWNGEYISPYAEHGKKNEQVKKITVSIPLKVLKVLTDERTRRQVNNLRHATNSELLCEAFLHAYTGQPLPDDADLSKECPDSIPAEAKRLMDEMGIEWEDME

SEQ ID NO: 26653 - DNA, 321 bp, Vibrio parahaemolyticus
  CDS (1)..(321)
atggctgactggaatggcgaatacattagcccatatgctgagcacggtaaaaaaagcgaacaagtaaaaaaaattaccgtttctatcccgctaaaagttttaaaagtgctgactgatgagcgtactcgtcgtcagatcaataacttacgccatgcaaccaacagcgaactactatgtgaagcattcctgcacgcatatacaggtcagccattaccaacggatgaagaccttcgtaaagacagaccggatgacattccaactgaagcaaaagcgttaatgacggcgatgggtatcgaattcgaagcatttgacgaagaataa

SEQ ID NO: 26654 - protein, 106 aa, Vibrio parahaemolyticus
MADWNGEYISPYAEHGKKSEQVKKITVSIPLKVLKVLTDERTRRQINNLRHATNSELLCEAFLHAYTGQPLPTDEDLRKDRPDDIPTEAKALMTAMGIEFEAFDEE

SEQ ID NO: 26655 - DNA, 318 bp, Vibrio vulnificus
  CDS (1)..(318)
atggctgactggaatggcgaatacataagtccatacgcagagcatggaaagaaaagcgagcaagtaaaaaaaattaccgtttctatcccgcttaaagtactaaaagttctgacggatgaacgtactcgtcgtcaaattaataacctacgccacgcaacaaacagtgagttgttgtgtgaggcatttctgcatgcgtacactggccagcctctgccaacggatgaagatctcagaaaagatcgcccggatgatatcccaacagaagccaaagaattgatgacggcgatgggtatcgaatttgaagcgtatgacgactaa

SEQ ID NO: 26656 - protein, 105 aa, Vibrio vulnificus
MADWNGEYISPYAEHGKKSEQVKKITVSIPLKVLKVLTDERTRRQINNLRHATNSELLCEAFLHAYTGQPLPTDEDLRKDRPDDIPTEAKELMTAMGIEFEAYDD

SEQ ID NO: 26657 - DNA, 20 bp, Primer
atggctgaatggagcggcga

SEQ ID NO: 26658 - DNA, 22 bp, Primer
ttagtattcccacgtctccggg

SEQ ID NO: 26659 - DNA, 432 bp, Saccharomyces cerevisiae; identical to SEQ ID NO: 6880
  CDS (1)..(432)

SEQ ID NO: 26660 - protein, 143 aa, Saccharomyces cerevisiae; identical to SEQ ID NO: 6881

SEQ ID NO: 26661 - DNA, 309 bp, Arabidopsis thaliana (mouse-ear cress); identical to SEQ ID NO: 6882
  CDS (1)..(309)

SEQ ID NO: 26662 - protein, 102 aa, Arabidopsis thaliana (mouse-ear cress); identical to SEQ ID NO: 6883

SEQ ID NO: 26663 - DNA, 501 bp, Brucella melitensis; identical to SEQ ID NO: 6884
  CDS (28)..(306)

SEQ ID NO: 26664 - protein, 92 aa, Brucella melitensis; identical to SEQ ID NO: 6885

SEQ ID NO: 26665 - DNA, 324 bp, Nostoc sp. PCC 7120; identical to SEQ ID NO: 6886
  CDS (1)..(324)

SEQ ID NO: 26666 - protein, 107 aa, Nostoc sp. PCC 7120; identical to SEQ ID NO: 6887

SEQ ID NO: 26667 - DNA, 309 bp, Arabidopsis thaliana (mouse-ear cress); identical to SEQ ID NO: 6888
  CDS (1)..(309)

SEQ ID NO: 26668 - protein, 102 aa, Arabidopsis thaliana (mouse-ear cress); identical to SEQ ID NO: 6889

SEQ ID NO: 26669 - DNA, 540 bp, Arabidopsis thaliana (mouse-ear cress); identical to SEQ ID NO: 6890
  CDS (1)..(540)

SEQ ID NO: 26670 - protein, 179 aa, Arabidopsis thaliana (mouse-ear cress); identical to SEQ ID NO: 6891

SEQ ID NO: 26671 - DNA, 327 bp, vaccinia virus; identical to SEQ ID NO: 6892
  CDS (1)..(327)

SEQ ID NO: 26672 - protein, 108 aa, vaccinia virus; identical to SEQ ID NO: 6893

SEQ ID NO: 26673 - DNA, 312 bp, Arabidopsis thaliana (mouse-ear cress); identical to SEQ ID NO: 6894
  CDS (1)..(312)

SEQ ID NO: 26674 - protein, 103 aa, Arabidopsis thaliana (mouse-ear cress); identical to SEQ ID NO: 6895

SEQ ID NO: 26675 - DNA, 309 bp, Arabidopsis thaliana (mouse-ear cress); identical to SEQ ID NO: 6896
  CDS (1)..(309)

SEQ ID NO: 26676 - protein, 102 aa, Arabidopsis thaliana (mouse-ear cress); identical to SEQ ID NO: 6897

SEQ ID NO: 26677 - DNA, 309 bp, Arabidopsis thaliana (mouse-ear cress); identical to SEQ ID NO: 6898
  CDS (1)..(309)

SEQ ID NO: 26678 - protein, 102 aa, Arabidopsis thaliana (mouse-ear cress); identical to SEQ ID NO: 6899

SEQ ID NO: 26679 - DNA, 393 bp, Arabidopsis thaliana (mouse-ear cress); identical to SEQ ID NO: 6900
  CDS (1)..(393)

SEQ ID NO: 26680 - protein, 130 aa, Arabidopsis thaliana (mouse-ear cress); identical to SEQ ID NO: 6901

SEQ ID NO: 26681 - DNA, 589 bp, Bos primigenius taurus (cattle); identical to SEQ ID NO: 6902
  CDS (36)..(356)

SEQ ID NO: 26682 - protein, 106 aa, Bos primigenius taurus (cattle); identical to SEQ ID NO: 6903

SEQ ID NO: 26683 - DNA, 309 bp, Arabidopsis thaliana (mouse-ear cress); identical to SEQ ID NO: 6904
  CDS (1)..(309)

SEQ ID NO: 26684 - protein, 102 aa, Arabidopsis thaliana (mouse-ear cress); identical to SEQ ID NO: 6905

SEQ ID NO: 26685 - DNA, 309 bp, Arabidopsis thaliana (mouse-ear cress); identical to SEQ ID NO: 6906
  CDS (1)..(309)

SEQ ID NO: 26686 - protein, 102 aa, Arabidopsis thaliana (mouse-ear cress); identical to SEQ ID NO: 6907

SEQ ID NO: 26687 - DNA, 575 bp, Oryza sativa (rice); identical to SEQ ID NO: 6908
  CDS (45)..(383)

SEQ ID NO: 26688 - protein, 112 aa, Oryza sativa (rice); identical to SEQ ID NO: 6909

SEQ ID NO: 26689 - DNA, 333 bp, Saccharomyces cerevisiae; identical to SEQ ID NO: 6910
  CDS (1)..(333)

SEQ ID NO: 26690 - protein, 110 aa, Saccharomyces cerevisiae; identical to SEQ ID NO: 6911

SEQ ID NO: 26691 - DNA, 612 bp, Saccharomyces cerevisiae; identical to SEQ ID NO: 6912
  CDS (1)..(612)

SEQ ID NO: 26692 - protein, 203 aa, Saccharomyces cerevisiae; identical to SEQ ID NO: 6913

SEQ ID NO: 26693 - DNA, 321 bp, Homo sapiens (man); identical to SEQ ID NO: 6914
  CDS (1)..(321)

SEQ ID NO: 26694 - protein, 106 aa, Homo sapiens (man); identical to SEQ ID NO: 6915

SEQ ID NO: 26695 - DNA, 583 bp, Ricinus communis (castor bean); identical to SEQ ID NO: 6916
  CDS (44)..(352)

SEQ ID NO: 26696 - protein, 102 aa, Ricinus communis (castor bean); identical to SEQ ID NO: 6917

SEQ ID NO: 26697 - DNA, 531 bp, Arabidopsis thaliana (mouse-ear cress); identical to SEQ ID NO: 6918
  CDS (1)..(531)

SEQ ID NO: 26698 - protein, 176 aa, Arabidopsis thaliana (mouse-ear cress); identical to SEQ ID NO: 6919

SEQ ID NO: 26699 - DNA, 698 bp, Mesembryanthemum crystallinum (common ice plant); identical to SEQ ID NO: 6920
  CDS (60)..(464)

SEQ ID NO: 26700 - protein, 134 aa, Mesembryanthemum crystallinum (common ice plant); identical to SEQ ID NO: 6921

SEQ ID NO: 26701 - DNA, 441 bp, Caenorhabditis elegans; identical to SEQ ID NO: 6922
  CDS (1)..(441)

SEQ ID NO: 26702 - protein, 146 aa, Caenorhabditis elegans; identical to SEQ ID NO: 6923

SEQ ID NO: 26703 - DNA, 361 bp, Schizosaccharomyces pombe; identical to SEQ ID NO: 6924
  CDS (24)..(329)

SEQ ID NO: 26704 - protein, 101 aa, Schizosaccharomyces pombe; identical to SEQ ID NO: 6925

SEQ ID NO: 26705 - DNA, 501 bp, Schizosaccharomyces pombe; identical to SEQ ID NO: 6926
  CDS (1)..(501)

SEQ ID NO: 26706 - protein, 166 aa, Schizosaccharomyces pombe; identical to SEQ ID NO: 6927

SEQ ID NO: 26707 - DNA, 309 bp, Arabidopsis thaliana (mouse-ear cress); identical to SEQ ID NO: 6928
  CDS (1)..(309)

SEQ ID NO: 26708 - protein, 102 aa, Arabidopsis thaliana (mouse-ear cress); identical to SEQ ID NO: 6929

SEQ ID NO: 26709 - DNA, 312 bp, Arabidopsis thaliana (mouse-ear cress); identical to SEQ ID NO: 6930
  CDS (1)..(312)

SEQ ID NO: 26710 - protein, 103 aa, Arabidopsis thaliana (mouse-ear cress); identical to SEQ ID NO: 6931

SEQ ID NO: 26711 - DNA, 391 bp, Arabidopsis thaliana (mouse-ear cress); identical to SEQ ID NO: 6932
  CDS (33)..(341)

SEQ ID NO: 26712 - protein, 102 aa, Arabidopsis thaliana (mouse-ear cress); identical to SEQ ID NO: 6933

SEQ ID NO: 26713 - DNA, 330 bp, Neurospora crassa; identical to SEQ ID NO: 6934
  CDS (1)..(330)

SEQ ID NO: 26714 - protein, 109 aa, Neurospora crassa; identical to SEQ ID NO: 6935

SEQ ID NO: 26715 - DNA, 533 bp, Fritillaria agrestis; identical to SEQ ID NO: 6936
  CDS (39)..(353)

SEQ ID NO: 26716 - protein, 104 aa, Fritillaria agrestis; identical to SEQ ID NO: 6937

SEQ ID NO: 26717 - DNA, 330 bp, Plasmodium yoelii yoelii; identical to SEQ ID NO: 6938
  CDS (1)..(330): m means a or c

SEQ ID NO: 26718 - protein, 109 aa, Plasmodium yoelii yoelii; identical to SEQ ID NO: 6939
  misc_feature (54)..(54): Xaa can be Asn or His

SEQ ID NO: 26719 - DNA, 294 bp, Bordetella bronchiseptica; identical to SEQ ID NO: 6940
  CDS (1)..(294)

SEQ ID NO: 26720 - protein, 97 aa, Bordetella bronchiseptica; identical to SEQ ID NO: 6941

SEQ ID NO: 26721 - DNA, 342 bp, Triticum aestivum; identical to SEQ ID NO: 6942
  CDS (1)..(342)

SEQ ID NO: 26722 - protein, 113 aa, Triticum aestivum; identical to SEQ ID NO: 6943

SEQ ID NO: 26723 - DNA, 324 bp, Aphelenchus avenae; identical to SEQ ID NO: 6944
  CDS (1)..(324)

SEQ ID NO: 26724 - protein, 107 aa, Aphelenchus avenae; identical to SEQ ID NO: 6945

SEQ ID NO: 26725 - DNA, 327 bp, Cowpox virus; identical to SEQ ID NO: 6946
  CDS (1)..(327)

SEQ ID NO: 26726 - protein, 108 aa, Cowpox virus; identical to SEQ ID NO: 6947

SEQ ID NO: 26727 - DNA, 495 bp, Oryza sativa; identical to SEQ ID NO: 6948
  CDS (1)..(495)

SEQ ID NO: 26728 - protein, 164 aa, Oryza sativa; identical to SEQ ID NO: 6949

SEQ ID NO: 26729 - DNA, 270 bp, Vibrio vulnificus; identical to SEQ ID NO: 6950
  CDS (1)..(270)

SEQ ID NO: 26730 - protein, 89 aa, Vibrio vulnificus; identical to SEQ ID NO: 6951

SEQ ID NO: 26731 - DNA, 525 bp, Arabidopsis thaliana; identical to SEQ ID NO: 6952
  CDS (1)..(525)

SEQ ID NO: 26732 - protein, 174 aa, Arabidopsis thaliana; identical to SEQ ID NO: 6953

SEQ ID NO: 26733 - DNA, 608 bp, Arabidopsis thaliana; identical to SEQ ID NO: 6954
  CDS (68)..(445)

SEQ ID NO: 26734 - protein, 125 aa, Arabidopsis thaliana; identical to SEQ ID NO: 6955

SEQ ID NO: 26735 - DNA, 340 bp, Arabidopsis thaliana; identical to SEQ ID NO: 6956
  CDS (1)..(309)

SEQ ID NO: 26736 - protein, 102 aa, Arabidopsis thaliana; identical to SEQ ID NO: 6957

SEQ ID NO: 26737 - DNA, 618 bp, Arabidopsis thaliana; identical to SEQ ID NO: 6958
  CDS (54)..(461)

SEQ ID NO: 26738 - protein, 135 aa, Arabidopsis thaliana; identical to SEQ ID NO: 6959

SEQ ID NO: 26739 - DNA, 420 bp, Populus tremula x Populus tremuloides; identical to SEQ ID NO: 6960
  CDS (1)..(420)

SEQ ID NO: 26740 - protein, 139 aa, Populus tremula x Populus tremuloides; identical to SEQ ID NO: 6961

SEQ ID NO: 26741 - DNA, 664 bp, Mus musculus; identical to SEQ ID NO: 6962
  CDS (37)..(507)

SEQ ID NO: 26742 - protein, 156 aa, Mus musculus; identical to SEQ ID NO: 6963

SEQ ID NO: 26743 - DNA, 508 bp, Tilia platyphyllos; identical to SEQ ID NO: 6964
  CDS (28)..(375)

SEQ ID NO: 26744 - protein, 115 aa, Tilia platyphyllos; identical to SEQ ID NO: 6965

SEQ ID NO: 26745 - DNA, 604 bp, Deschampsia antarctica; identical to SEQ ID NO: 6966
  CDS (85)..(426)

SEQ ID NO: 26746 - protein, 113 aa, Deschampsia antarctica; identical to SEQ ID NO: 6967

SEQ ID NO: 26747 - DNA, 327 bp, Plasmodium berghei; identical to SEQ ID NO: 6968
  CDS (1)..(327)

SEQ ID NO: 26748 - protein, 108 aa, Plasmodium berghei; identical to SEQ ID NO: 6969

SEQ ID NO: 26749 - DNA, 498 bp, Homo sapiens; identical to SEQ ID NO: 6970
  CDS (1)..(498)

SEQ ID NO: 26750 - protein, 165 aa, Homo sapiens; identical to SEQ ID NO: 6971

SEQ ID NO: 26751 - DNA, 456 bp, Theileria parva; identical to SEQ ID NO: 6972
  CDS (1)..(456)

SEQ ID NO: 26752 - protein, 151 aa, Theileria parva; identical to SEQ ID NO: 6973

SEQ ID NO: 26753 - DNA, 336 bp, Arabidopsis thaliana; identical to SEQ ID NO: 6974
  CDS (1)..(336)

SEQ ID NO: 26754 - protein, 111 aa, Arabidopsis thaliana; identical to SEQ ID NO: 6975

SEQ ID NO: 26755 - DNA, 383 bp, Mus musculus; identical to SEQ ID NO: 6976
  CDS (15)..(383)

SEQ ID NO: 26756 - protein, 122 aa, Mus musculus; identical to SEQ ID NO: 6977

SEQ ID NO: 26757 - DNA, 318 bp, Caenorhabditis elegans; identical to SEQ ID NO: 6978
  CDS (1)..(318)

SEQ ID NO: 26758 - protein, 105 aa, Caenorhabditis elegans; identical to SEQ ID NO: 6979

SEQ ID NO: 26759 - DNA, 324 bp, Trypanosoma brucei; identical to SEQ ID NO: 6980
  CDS (1)..(324)

SEQ ID NO: 26760 - protein, 107 aa, Trypanosoma brucei; identical to SEQ ID NO: 6981

SEQ ID NO: 26761 - DNA, 336 bp, Plasmodium falciparum; identical to SEQ ID NO: 6982
  CDS (1)..(336)

SEQ ID NO: 26762 - protein, 111 aa, Plasmodium falciparum; identical to SEQ ID NO: 6983

SEQ ID NO: 26763 - DNA, 654 bp, Homo sapiens; identical to SEQ ID NO: 6984
  CDS (11)..(505)

SEQ ID NO: 26764 - protein, 164 aa, Homo sapiens; identical to SEQ ID NO: 6985

SEQ ID NO: 26765 - DNA, 478 bp, Drosophila melanogaster; identical to SEQ ID NO: 6986
  CDS (48)..(392)

SEQ ID NO: 26766 - protein, 114 aa, Drosophila melanogaster; identical to SEQ ID NO: 6987

SEQ ID NO: 26767 - DNA, 351 bp, Drosophila melanogaster; identical to SEQ ID NO: 6988
  CDS (1)..(351)

SEQ ID NO: 26768 - protein, 116 aa, Drosophila melanogaster; identical to SEQ ID NO: 6989

SEQ ID NO: 26769 - DNA, 644 bp, Homo sapiens; identical to SEQ ID NO: 6990
  CDS (26)..(481)

SEQ ID NO: 26770 - protein, 151 aa, Homo sapiens; identical to SEQ ID NO: 6991

SEQ ID NO: 26771 - DNA, 572 bp, Gallus gallus; identical to SEQ ID NO: 6992
  CDS (47)..(352)

SEQ ID NO: 26772 - protein, 101 aa, Gallus gallus; identical to SEQ ID NO: 6993

SEQ ID NO: 26773 - DNA, 321 bp, Homo sapiens; identical to SEQ ID NO: 6994
  CDS (1)..(321)

SEQ ID NO: 26774 - protein, 106 aa, Homo sapiens; identical to SEQ ID NO: 6915

SEQ ID NO: 26775 - DNA, 531 bp, Lycopersicon esculentum; identical to SEQ ID NO: 6996
  CDS (45)..(371)

SEQ ID NO: 26776 - protein, 108 aa, Lycopersicon esculentum; identical to SEQ ID NO: 6997

SEQ ID NO: 26777 - DNA, 473 bp, Mus musculus; identical to SEQ ID NO: 6998
  CDS (9)..(332)

SEQ ID NO: 26778 - protein, 107 aa, Mus musculus; identical to SEQ ID NO: 6999

SEQ ID NO: 26779 - DNA, 575 bp, Sus scrofa; identical to SEQ ID NO: 7000
  CDS (24)..(344)

SEQ ID NO: 26780 - protein, 106 aa, Sus scrofa; identical to SEQ ID NO: 7001

SEQ ID NO: 26781 - DNA, 432 bp, Saccharomyces cerevisiae; identical to SEQ ID NO: 6880
  CDS (1)..(432)

SEQ ID NO: 26782 - protein, 143 aa, Saccharomyces cerevisiae; identical to SEQ ID NO: 6881

SEQ ID NO: 26783 - DNA, 441 bp, Caenorhabditis elegans; identical to SEQ ID NO: 6922
  CDS (1)..(441)

SEQ ID NO: 26784 - protein, 146 aa, Caenorhabditis elegans; identical to SEQ ID NO: 6923

SEQ ID NO: 26785 - DNA, 324 bp, Rattus norvegicus; identical to SEQ ID NO: 7006
  CDS (1)..(324)

SEQ ID NO: 26786 - protein, 107 aa, Rattus norvegicus; identical to SEQ ID NO: 7007

SEQ ID NO: 26787 - DNA, 378 bp, Arabidopsis thaliana; identical to SEQ ID NO: 7008
  CDS (1)..(378)

SEQ ID NO: 26788 - protein, 125 aa, Arabidopsis thaliana; identical to SEQ ID NO: 7009

SEQ ID NO: 26789 - DNA, 651 bp, Ashbya gossypii; identical to SEQ ID NO: 7010
  CDS (1)..(651)

SEQ ID NO: 26790 - protein, 216 aa, Ashbya gossypii; identical to SEQ ID NO: 7011

SEQ ID NO: 26791 - DNA, 336 bp, Ashbya gossypii; identical to SEQ ID NO: 7012
  CDS (1)..(336)

SEQ ID NO: 26792 - protein, 111 aa, Ashbya gossypii; identical to SEQ ID NO: 7013

SEQ ID NO: 26793 - DNA, 25 bp, Primer
atggagaccaatttttccttcgact

SEQ ID NO: 26794 - DNA, 26 bp, Primer
ctattgaaataccggcttcaatattt

SEQ ID NO: 26795 - DNA, 1017 bp, Saccharomyces cerevisiae; identical to SEQ ID NO: 13239
  CDS (1)..(1017)

SEQ ID NO: 26796 - protein, 338 aa, Saccharomyces cerevisiae; identical to SEQ ID NO: 13240

SEQ ID NO: 26797 - DNA, 903 bp, Chlamydophila pneumoniae, Chlamydia pneumoniae; identical to SEQ ID NO: 13241
  CDS (1)..(903)

SEQ ID NO: 26798 - protein, 300 aa, Chlamydophila pneumoniae, Chlamydia pneumoniae; identical to SEQ ID NO: 13242

SEQ ID NO: 26799 - DNA, 948 bp, Agrobacterium tumefaciens; identical to SEQ ID NO: 13243
  CDS (1)..(948)

SEQ ID NO: 26800 - protein, 315 aa, Agrobacterium tumefaciens; identical to SEQ ID NO: 13244

SEQ ID NO: 26801 - DNA, 876 bp, Chlamydia muridarum, Chlamydia trachomatis MoPn; identical to SEQ ID NO: 13245
  CDS (1)..(876)

SEQ ID NO: 26802 - protein, 291 aa, Chlamydia muridarum, Chlamydia trachomatis MoPn; identical to SEQ ID NO: 13246

SEQ ID NO: 26803 - DNA, 876 bp, Chlamydia trachomatis; identical to SEQ ID NO: 13247
  CDS (1)..(876)

SEQ ID NO: 26804 - protein, 291 aa, Chlamydia trachomatis; identical to SEQ ID NO: 13248

SEQ ID NO: 26805 - DNA, 1023 bp, Caenorhabditis elegans; identical to SEQ ID NO: 13249
  CDS (1)..(1023)

SEQ ID NO: 26806 - protein, 340 aa, Caenorhabditis elegans; identical to SEQ ID NO: 13250

SEQ ID NO: 26807 - DNA, 1228 bp, Arabidopsis thaliana (mouse-ear cress); identical to SEQ ID NO: 13251
  CDS (30)..(1094)

SEQ ID NO: 26808 - protein, 354 aa, Arabidopsis thaliana (mouse-ear cress); identical to SEQ ID NO: 13252

SEQ ID NO: 26809 - DNA, 975 bp, Schizosaccharomyces pombe; identical to SEQ ID NO: 13253
  CDS (1)..(975)

SEQ ID NO: 26810 - protein, 324 aa, Schizosaccharomyces pombe; identical to SEQ ID NO: 13254

SEQ ID NO: 26811 - DNA, 1086 bp, Giardia lamblia ATCC 50803; identical to SEQ ID NO: 13255
  CDS (1)..(1086)

SEQ ID NO: 26812 - protein, 361 aa, Giardia lamblia ATCC 50803; identical to SEQ ID NO: 13256

SEQ ID NO: 26813 - DNA, 1107 bp, Plasmodium yoelii yoelii; identical to SEQ ID NO: 13257
  CDS (1)..(1107)

SEQ ID NO: 26814 - protein, 368 aa, Plasmodium yoelii yoelii; identical to SEQ ID NO: 13258

SEQ ID NO: 26815 - DNA, 1068 bp, Neurospora crassa; identical to SEQ ID NO: 13259
  CDS (1)..(1068)

SEQ ID NO: 26816 - protein, 355 aa, Neurospora crassa; identical to SEQ ID NO: 13260

SEQ ID NO: 26817 - DNA, 879 bp, Chlamydophila caviae; identical to SEQ ID NO: 13261
  CDS (1)..(879)

SEQ ID NO: 26818 - protein, 292 aa, Chlamydophila caviae; identical to SEQ ID NO: 13262

SEQ ID NO: 26819 - DNA, 936 bp, Encephalitozoon cuniculi; identical to SEQ ID NO: 13263
  CDS (1)..(936)

SEQ ID NO: 26820 - protein, 311 aa, Encephalitozoon cuniculi; identical to SEQ ID NO: 13264

SEQ ID NO: 26821 - DNA, 918 bp, Encephalitozoon cuniculi; identical to SEQ ID NO: 13265
  CDS (1)..(918)

SEQ ID NO: 26822 - protein, 305 aa, Encephalitozoon cuniculi; identical to SEQ ID NO: 13266

SEQ ID NO: 26823 - DNA, 1317 bp, Arabidopsis thaliana; identical to SEQ ID NO: 13267
  CDS (44)..(1084)

SEQ ID NO: 26824 - protein, 346 aa, Arabidopsis thaliana; identical to SEQ ID NO: 13268

SEQ ID NO: 26825 - DNA, 1179 bp, Drosophila melanogaster; identical to SEQ ID NO: 13269
  CDS (151)..(1098)

SEQ ID NO: 26826 - protein, 315 aa, Drosophila melanogaster; identical to SEQ ID NO: 13270

SEQ ID NO: 26827 - DNA, 1552 bp, Mus musculus; identical to SEQ ID NO: 13271
  CDS (380)..(1522)

SEQ ID NO: 26828 - protein, 380 aa, Mus musculus; identical to SEQ ID NO: 13272

SEQ ID NO: 26829 - DNA, 1233 bp, Ashbya gossypii; identical to SEQ ID NO: 13273
  CDS (1)..(1233)

SEQ ID NO: 26830 - protein, 410 aa, Ashbya gossypii; identical to SEQ ID NO: 13274

SEQ ID NO: 26831 - DNA, 1368 bp, Oryza sativa; identical to SEQ ID NO: 13275
  CDS (60)..(1118)

SEQ ID NO: 26832 - protein, 352 aa, Oryza sativa; identical to SEQ ID NO: 13276

SEQ ID NO: 26833 - DNA, 873 bp, Parachlamydia sp; identical to SEQ ID NO: 13277
  CDS (1)..(873)

SEQ ID NO: 26834 - protein, 290 aa, Parachlamydia sp; identical to SEQ ID NO: 13278

SEQ ID NO: 26835 - DNA, 26 bp, Primer
atgaatagcgtaaaaagagtaaagct

SEQ ID NO: 26836 - DNA, 23 bp, Primer
ctaggccaaagacatcttagcca

SEQ ID NO: 26837 - DNA, 4195 bp, Saccharomyces cerevisiae; identical to SEQ ID NO: 5646
  CDS (654)..(2900)

SEQ ID NO: 26838 - protein, 748 aa, Saccharomyces cerevisiae; identical to SEQ ID NO: 5647

SEQ ID NO: 26839 - DNA, 2026 bp, Arabidopsis thaliana (mouse-ear cress); identical to SEQ ID NO: 5648
  CDS (1)..(1995)

SEQ ID NO: 26840 - protein, 664 aa, Arabidopsis thaliana (mouse-ear cress); identical to SEQ ID NO: 5649

SEQ ID NO: 26841 - DNA, 2070 bp, Arabidopsis thaliana (mouse-ear cress); identical to SEQ ID NO: 5650
  CDS (12)..(2039)

SEQ ID NO: 26842 - protein, 675 aa, Arabidopsis thaliana (mouse-ear cress); identical to SEQ ID NO: 5651

SEQ ID NO: 26843 - DNA, 2070 bp, Homo sapiens (man); identical to SEQ ID NO: 5652
  CDS (14)..(1996)

SEQ ID NO: 26844 - protein, 660 aa, Homo sapiens (man) [sequence omitted]

SEQ ID NO: 26845 - DNA, 2723 bp, Candida maltosa; identical to SEQ ID NO: 5654
  CDS (445)..(2619)

SEQ ID NO: 26846 - protein, 724 aa, Candida maltosa; identical to SEQ ID NO: 5655

SEQ ID NO: 26847 - DNA, 2975 bp, Candida maltosa; identical to SEQ ID NO: 5656
  CDS (406)..(2535)

SEQ ID NO: 26848 - protein, 709 aa, Candida maltosa; identical to SEQ ID NO: 5657

SEQ ID NO: 26849 - DNA, 2288 bp, Candida tropicalis; identical to SEQ ID NO: 5658
  CDS (153)..(2282)

SEQ ID NO: 26850 - protein, 709 aa, Candida tropicalis; identical to SEQ ID NO: 5659

SEQ ID NO: 26851 - DNA, 2845 bp, Candida tropicalis; identical to SEQ ID NO: 5660
  CDS (532)..(2661)

SEQ ID NO: 26852 - protein, 709 aa, Candida tropicalis; identical to SEQ ID NO: 5661

SEQ ID NO: 26853 - DNA, 2624 bp, Candida tropicalis; identical to SEQ ID NO: 5662
  CDS (457)..(2445)

SEQ ID NO: 26854 - protein, 662 aa, Candida tropicalis; identical to SEQ ID NO: 5663

SEQ ID NO: 26855 - DNA, 3741 bp, Rattus norvegicus (Norway rat); identical to SEQ ID NO: 5664
  CDS (74)..(2059)

SEQ ID NO: 26856 - protein, 661 aa, Rattus norvegicus (Norway rat); identical to SEQ ID NO: 5665

SEQ ID NO: 26857 - DNA, 1980 bp, Caenorhabditis elegans; identical to SEQ ID NO: 5666
  CDS (1)..(1980)

SEQ ID NO: 26858 - protein, 659 aa, Caenorhabditis elegans [sequence omitted]

SEQ ID NO: 26859 - DNA, 2273 bp, Hordeum vulgare (barley); identical to SEQ ID NO: 5668
  CDS (61)..(1992)

SEQ ID NO: 26860 - protein, 643 aa, Hordeum vulgare (barley); identical to SEQ ID NO: 5669

SEQ ID NO: 26861 - DNA, 2324 bp, Cucurbita sp. (cucurbit); identical to SEQ ID NO: 5670
  CDS (24)..(2096)

SEQ ID NO: 26862 - protein, 690 aa, Cucurbita sp. (cucurbit); identical to SEQ ID NO: 5671

SEQ ID NO: 26863 - DNA, 2040 bp, Caenorhabditis elegans; identical to SEQ ID NO: 5672
  CDS (1)..(2040)

SEQ ID NO: 26864 - protein, 679 aa, Caenorhabditis elegans; identical to SEQ ID NO: 5673

SEQ ID NO: 26865 - DNA, 1983 bp, Caenorhabditis elegans; identical to SEQ ID NO: 5674
  CDS (1)..(1983)

SEQ ID NO: 26866 - protein, 660 aa, Caenorhabditis elegans; identical to SEQ ID NO: 5675

SEQ ID NO: 26867 - DNA, 1989 bp, Caenorhabditis elegans; identical to SEQ ID NO: 5676
  CDS (1)..(1989)

SEQ ID NO: 26868 - protein, 662 aa, Caenorhabditis elegans; identical to SEQ ID NO: 5677

SEQ ID NO: 26869 - DNA, 2025 bp, Caenorhabditis elegans; identical to SEQ ID NO: 5678
  CDS (1)..(2025)

SEQ ID NO: 26870 - protein, 674 aa, Caenorhabditis elegans; identical to SEQ ID NO: 5679

SEQ ID NO: 26871 - DNA, 1806 bp, Caenorhabditis elegans; identical to SEQ ID NO: 5680
  CDS (1)..(1806)

SEQ ID NO: 26872 - protein, 601 aa, Caenorhabditis elegans; identical to SEQ ID NO: 5681

SEQ ID NO: 26873 - DNA, 2004 bp, Caenorhabditis elegans; identical to SEQ ID NO: 5682
  CDS (1)..(2004)

SEQ ID NO: 26874 - protein, 667 aa, Caenorhabditis elegans; identical to SEQ ID NO: 5683

SEQ ID NO: 26875 - DNA, 2004 bp, Caenorhabditis elegans; identical to SEQ ID NO: 5684
  CDS (1)..(2004)

SEQ ID NO: 26876 - protein, 667 aa, Caenorhabditis elegans; identical to SEQ ID NO: 5685

SEQ ID NO: 26877 - DNA, 1803 bp, Streptomyces coelicolor; identical to SEQ ID NO: 5686
  CDS (1)..(1803)

SEQ ID NO: 26878 - protein, 600 aa, Streptomyces coelicolor; identical to SEQ ID NO: 5687

SEQ ID NO: 26879 - DNA, 1926 bp, Streptomyces fradiae; identical to SEQ ID NO: 5688
  CDS (1)..(1926)

SEQ ID NO: 26880 - protein, 641 aa, Streptomyces fradiae; identical to SEQ ID NO: 5689

SEQ ID NO: 26881 - DNA, 2267 bp, Arabidopsis thaliana (mouse-ear cress); identical to SEQ ID NO: 5690
  CDS (8)..(2086)

SEQ ID NO: 26882 - protein, 692 aa, Arabidopsis thaliana (mouse-ear cress); identical to SEQ ID NO: 5691

SEQ ID NO: 26883 - DNA, 1995 bp, Arabidopsis thaliana (mouse-ear cress); identical to SEQ ID NO: 5692
  CDS (1)..(1995)

SEQ ID NO: 26884 - protein, 664 aa, Arabidopsis thaliana (mouse-ear cress); identical to SEQ ID NO: 5693

SEQ ID NO: 26885 - DNA, 2070 bp, Yarrowia lipolytica; identical to SEQ ID NO: 5694
  CDS (1)..(2070)

SEQ ID NO: 26886 - protein, 689 aa, Yarrowia lipolytica; identical to SEQ ID NO: 5695

SEQ ID NO: 26887 - DNA, 2103 bp, Yarrowia lipolytica; identical to SEQ ID NO: 5696
  CDS (1)..(2103)

SEQ ID NO: 26888 - protein, 700 aa, Yarrowia lipolytica; identical to SEQ ID NO: 5697

SEQ ID NO: 26889 - DNA, 2103 bp, Yarrowia lipolytica; identical to SEQ ID NO: 5698
  CDS (1)..(2103)

SEQ ID NO: 26890 - protein, 700 aa, Yarrowia lipolytica; identical to SEQ ID NO: 5699

SEQ ID NO: 26891 - DNA, 2106 bp, Yarrowia lipolytica; identical to SEQ ID NO: 5700
  CDS (1)..(2106)

SEQ ID NO: 26892 - protein, 701 aa, Yarrowia lipolytica; identical to SEQ ID NO: 5701

SEQ ID NO: 26893 - DNA, 2100 bp, Yarrowia lipolytica; identical to SEQ ID NO: 5702
  CDS (1)..(2100)

SEQ ID NO: 26894 - protein, 699 aa, Yarrowia lipolytica; identical to SEQ ID NO: 5703

SEQ ID NO: 26895 - DNA, 2365 bp, Phalaenopsis cv; identical to SEQ ID NO: 5704
  CDS (4)..(2103)

SEQ ID NO: 26896 - protein, 699 aa, Phalaenopsis cv; identical to SEQ ID NO: 5705

SEQ ID NO: 26897 - DNA, 1764 bp, Photorhabdus luminescens; identical to SEQ ID NO: 5706
  CDS (1)..(1764)

SEQ ID NO: 26898 - protein, 587 aa, Photorhabdus luminescens; identical to SEQ ID NO: 5707

SEQ ID NO: 26899 - DNA, 2085 bp, Anopheles gambiae str; identical to SEQ ID NO: 5708
  CDS (1)..(2085)

SEQ ID NO: 26900 - protein, 694 aa, Anopheles gambiae str; identical to SEQ ID NO: 5709

SEQ ID NO: 26901 - DNA, 3798 bp, Brachydanio rerio; identical to SEQ ID NO: 5710
  CDS (73)..(2151)

SEQ ID NO: 26902 - protein, 692 aa, Brachydanio rerio; identical to SEQ ID NO: 5711

SEQ ID NO: 26903 - DNA, 3977 bp, Mus musculus; identical to SEQ ID NO: 5712
  CDS (187)..(2289)

SEQ ID NO: 26904 - protein, 700 aa, Mus musculus; identical to SEQ ID NO: 5713

SEQ ID NO: 26905 - DNA, 1710 bp, Bacillus cereus; identical to SEQ ID NO: 5714
  CDS (1)..(1710)

SEQ ID NO: 26906 - protein, 569 aa, Bacillus cereus; identical to SEQ ID NO: 5715

SEQ ID NO: 26907 - DNA, 1710 bp, Bacillus anthracis; identical to SEQ ID NO: 5716
  CDS (1)..(1710)

SEQ ID NO: 26908 - protein, 569 aa, Bacillus anthracis; identical to SEQ ID NO: 5717

SEQ ID NO: 26909 - DNA, 1152 bp, Streptomyces avermitilis; identical to SEQ ID NO: 5718
  CDS (1)..(1152)

SEQ ID NO: 26910 - protein, 383 aa, Streptomyces avermitilis; identical to SEQ ID NO: 5719

SEQ ID NO: 26911 - DNA, 2022 bp, Streptomyces avermitilis; identical to SEQ ID NO: 5720
  CDS (1)..(2022)

SEQ ID NO: 26912 - protein, 673 aa, Streptomyces avermitilis; identical to SEQ ID NO: 5721

SEQ ID NO: 26913 - DNA, 1863 bp, Dictyostelium discoideum; identical to SEQ ID NO: 5722
  CDS (211)..(1863)

SEQ ID NO: 26914 - protein, 550 aa, Dictyostelium discoideum; identical to SEQ ID NO: 5723

SEQ ID NO: 26915 - DNA, 1866 bp, Dictyostelium discoideum; identical to SEQ ID NO: 5724
  CDS (214)..(1866)

SEQ ID NO: 26916 - protein, 550 aa, Dictyostelium discoideum; identical to SEQ ID NO: 5725

SEQ ID NO: 26917 - DNA, 1986 bp, Mus musculus; identical to SEQ ID NO: 5726
  CDS (1)..(1986)

SEQ ID NO: 26918 - protein, 661 aa, Mus musculus; identical to SEQ ID NO: 5727

SEQ ID NO: 26919 - DNA, 3977 bp, Mus musculus; identical to SEQ ID NO: 5712
  CDS (187)..(2289)

SEQ ID NO: 26920 - protein, 700 aa, Mus musculus; identical to SEQ ID NO: 5713

SEQ ID NO: 26921 - DNA, 2323 bp, Oryza sativa; identical to SEQ ID NO: 5730
  CDS (43)..(2052)

SEQ ID NO: 26922 - protein, 669 aa, Oryza sativa; identical to SEQ ID NO: 5731

SEQ ID NO: 26923 - DNA, 2466 bp, Mus musculus; identical to SEQ ID NO: 5732
  CDS (152)..(2197)

SEQ ID NO: 26924 - protein, 681 aa, Mus musculus; identical to SEQ ID NO: 5733

SEQ ID NO: 26925 - DNA, 2254 bp, Glycine max; identical to SEQ ID NO: 5734
  CDS (119)..(2116)

SEQ ID NO: 26926 - protein, 665 aa, Glycine max; identical to SEQ ID NO: 5735

SEQ ID NO: 26927 - DNA, 2263 bp, Glycine max; identical to SEQ ID NO: 5736
  CDS (140)..(2134)

SEQ ID NO: 26928 - protein, 664 aa, Glycine max; identical to SEQ ID NO: 5737

SEQ ID NO: 26929 - DNA, 2549 bp, Drosophila melanogaster; identical to SEQ ID NO: 5738
  CDS (337)..(2346)

SEQ ID NO: 26930 - protein, 669 aa, Drosophila melanogaster; identical to SEQ ID NO: 5739

SEQ ID NO: 26931 - DNA, 2371 bp, Homo sapiens; identical to SEQ ID NO: 5740
  CDS (79)..(1953)

SEQ ID NO: 26932 - protein, 624 aa, Homo sapiens; identical to SEQ ID NO: 5741

SEQ ID NO: 26933 - DNA, 2844 bp, Mus musculus; identical to SEQ ID NO: 5742
  CDS (209)..(2107)

SEQ ID NO: 26934 - protein, 632 aa, Mus musculus; identical to SEQ ID NO: 5743

SEQ ID NO: 26935 - DNA, 2028 bp, Arabidopsis thaliana; identical to SEQ ID NO: 5744
  CDS (1)..(2028)

SEQ ID NO: 26936 - protein, 675 aa, Arabidopsis thaliana; identical to SEQ ID NO: 5745

SEQ ID NO: 26937 - DNA, 2085 bp, Petroselinum crispum; identical to SEQ ID NO: 5746
  CDS (1)..(2085)

SEQ ID NO: 26938 - protein, 694 aa, Petroselinum crispum; identical to SEQ ID NO: 5747

SEQ ID NO: 26939 - DNA, 2464 bp, Drosophila melanogaster; identical to SEQ ID NO: 5748
  CDS (80)..(2161)

SEQ ID NO: 26940 - protein, 693 aa, Drosophila melanogaster; identical to SEQ ID NO: 5749

SEQ ID NO: 26941 - DNA, 2216 bp, Drosophila melanogaster; identical to SEQ ID NO: 5750
  CDS (56)..(2167)

SEQ ID NO: 26942 - protein, 703 aa, Drosophila melanogaster; identical to SEQ ID NO: 5751

SEQ ID NO: 26943 - DNA, 2137 bp, Drosophila melanogaster; identical to SEQ ID NO: 5752
  CDS (104)..(2137)

SEQ ID NO: 26944 - protein, 677 aa, Drosophila melanogaster; identical to SEQ ID NO: 5753

SEQ ID NO: 26945 - DNA, 2352 bp, Drosophila melanogaster; identical to SEQ ID NO: 5754
  CDS (319)..(2352)

SEQ ID NO: 26946 - protein, 677 aa, Drosophila melanogaster; identical to SEQ ID NO: 5755

SEQ ID NO: 26947 - DNA, 2142 bp, Drosophila melanogaster; identical to SEQ ID NO: 5756
  CDS (1)..(963)

SEQ ID NO: 26948 - protein, 320 aa, Drosophila melanogaster; identical to SEQ ID NO: 5757

SEQ ID NO: 26949 - DNA, 2378 bp, Pichia pastoris; identical to SEQ ID NO: 5758
  CDS (100)..(2259)

SEQ ID NO: 26950 - protein, 719 aa, Pichia pastoris; identical to SEQ ID NO: 5759

SEQ ID NO: 26951 - DNA, 2210 bp, Cavia porcellus; identical to SEQ ID NO: 5760
  CDS (40)..(2025)

SEQ ID NO: 26952 - protein, 661 aa, Cavia porcellus; identical to SEQ ID NO: 5761

SEQ ID NO: 26953 - DNA, 3445 bp, Homo sapiens; identical to SEQ ID NO: 5762
  CDS (272)..(2254)

SEQ ID NO: 26954 - protein, 660 aa, Homo sapiens; identical to SEQ ID NO: 5763

SEQ ID NO: 26955 - DNA, 3778 bp, Mus musculus; identical to SEQ ID NO: 5764
  CDS (81)..(2066): r means g or a, k means g or t/u

SEQ ID NO: 26956 - protein, 661 aa, Mus musculus; identical to SEQ ID NO: 5765
  misc_feature (277)..(277): Xaa can be Ala or Thr
  misc_feature (279)..(279): Xaa can be Gly or Val

SEQ ID NO: 26957 - DNA, 2039 bp, Phascolarctos cinereus; identical to SEQ ID NO: 5766
  CDS (52)..(2037)

SEQ ID NO: 26958 - protein, 661 aa, Phascolarctos cinereus; identical to SEQ ID NO: 5767

SEQ ID NO: 26959 - DNA, 2225 bp, Homo sapiens; identical to SEQ ID NO: 5768
  CDS (93)..(2138)

SEQ ID NO: 26960 - protein, 681 aa, Homo sapiens; identical to SEQ ID NO: 5769

SEQ ID NO: 26961 - DNA, 2139 bp, Oryctolagus cuniculus; identical to SEQ ID NO: 5770
  CDS (77)..(2122)

SEQ ID NO: 26962 - protein, 681 aa, Oryctolagus cuniculus; identical to SEQ ID NO: 5771

SEQ ID NO: 26963 - DNA, 2509 bp, Rattus norvegicus; identical to SEQ ID NO: 5772
  CDS (198)..(2243)

SEQ ID NO: 26964 - protein, 681 aa, Rattus norvegicus; identical to SEQ ID NO: 5773

SEQ ID NO: 26965 - DNA, 2415 bp, Homo sapiens; identical to SEQ ID NO: 5774
  CDS (71)..(2173)

SEQ ID NO: 26966 - protein, 700 aa, Homo sapiens; identical to SEQ ID NO: 5775

SEQ ID NO: 26967 - DNA, 2600 bp, Rattus norvegicus; identical to SEQ ID NO: 5776
  CDS (41)..(2143)

SEQ ID NO: 26968 - protein, 700 aa, Rattus norvegicus; identical to SEQ ID NO: 5777

SEQ ID NO: 26969 - DNA, 2178 bp, Candida tropicalis; identical to SEQ ID NO: 5778

SEQ ID NO: 26970 - protein, 718 aa, Candida tropicalis; identical to SEQ ID NO: 5779

SEQ ID NO: 26971 - DNA, 3670 bp, Xenopus laevis; identical to SEQ ID NO: 5780
  CDS (10)..(1995)

SEQ ID NO: 26972 - protein, 661 aa, Xenopus laevis; identical to SEQ ID NO: 5781

SEQ ID NO: 26973 - DNA, 2476 bp, Xenopus laevis; identical to SEQ ID NO: 5782
  CDS (69)..(2081)

SEQ ID NO: 26974 - protein, 670 aa, Xenopus laevis; identical to SEQ ID NO: 5783

SEQ ID NO: 26975 - DNA, 1953 bp, Mycobacterium paratuberculosis; identical to SEQ ID NO: 5784
  CDS (1)..(1953)

SEQ ID NO: 26976 - protein, 650 aa, Mycobacterium paratuberculosis; identical to SEQ ID NO: 5785

SEQ ID NO: 26977 - DNA, 2166 bp, Ashbya gossypii; identical to SEQ ID NO: 5786
  CDS (1)..(2166)

SEQ ID NO: 26978 - protein, 721 aa, Ashbya gossypii; identical to SEQ ID NO: 5787

SEQ ID NO: 26979 - DNA, 2025 bp, Caenorhabditis elegans; identical to SEQ ID NO: 5678
  CDS (337)..(2025)

SEQ ID NO: 26980 - protein, 562 aa, Caenorhabditis elegans; identical to SEQ ID NO: 5789

SEQ ID NO: 26981 - DNA, 25 bp, Primer
atgacgagacgtactactattaatc

SEQ ID NO: 26982 - DNA, 28 bp, Primer
tcacttgtttattttcgataaaatttcc

SEQ ID NO: 26983 - DNA, 1194 bp, Saccharomyces cerevisiae
  CDS (1)..(1194)
atgtcgcctttgagaaagacggttcctgaatttttggcacacttaaaatcactgccaatttcaaaaattgcaagcaacgatgtgttaacaatatgtgttggtaacgagtcagcagatatggactcaattgctagtgcaatcacttattcgtactgccaatacatatataatgaaggtacttactcggaggagaaaaagaaaggaagctttattgtcccaattatcgacattcctagagaagacctcagtttaagaagagacgtaatgtatgtcctagaaaaactgaaaattaaggaggaggaattattcttcattgaagatttaaagagcttgaagcaaaatgtctcccagggtactgaattaaactcttacttggtagataataacgatacaccaaagaatttgaaaaattatatagataacgtcgttggcattatagaccaccattttgacttgcaaaaacatttggatgctgaacctcggattgtaaaagtgtccggcagttgctcatcgctggtttttaactactggtatgaaaaattgcaaggtgaccgtgaagtggtgatgaacattgcaccacttttgatgggggccatcttaatagacacttcaaatatgaggcgcaaagtcgaggaaagtgataaattagctatcgagagatgccaagctgttcttagtggtgcggttaatgaagtgtctgcgcaaggtttagaggacagcagtgagttttataaagagataaaatcaagaaagaacgatattaaaggattttcggtaagcgatattctaaagaaggactacaaacaattcaatttccaaggaaagggacacaaagggttagagattggtctttcatcaatagtaaaaagaatgtcttggctattcaatgaacacggtggtgaagcagatttcgtcaaccaatgcagaagatttcaggcggagagggggctcgatgtattggttctgttgacttcatggaggaaagctggtgattcacacagagaattggtcatattgggagactctaacgtggtacgtgaactcattgaaagggttagcgacaagctccaacttcaattatttgggggcaatcttgatggaggtgtggcgatgtttaagcaactgaacgtcgaggccaccagaaagcaagtcgtcccctatttagaggaagcgtactcaaacctggaagagtga

SEQ ID NO: 26984 - protein, 397 aa, Saccharomyces cerevisiae
MSPLRKTVPEFLAHLKSLPISKIASNDVLTICVGNESADMDSIASAITYSYCQYIYNEGTYSEEKKKGSFIVPIIDIPREDLSLRRDVMYVLEKLKIKEEELFFIEDLKSLKQNVSQGTELNSYLVDNNDTPKNLKNYIDNVVGIIDHHFDLQKHLDAEPRIVKVSGSCSSLVFNYWYEKLQGDREVVMNIAPLLMGAILIDTSNMRRKVEESDKLAIERCQAVLSGAVNEVSAQGLEDSSEFYKEIKSRKNDIKGFSVSDILKKDYKQFNFQGKGHKGLEIGLSSIVKRMSWLFNEHGGEADFVNQCRRFQAERGLDVLVLLTSWRKAGDSHRELVILGDSNVVRELIERVSDKLQLQLFGGNLDGGVAMFKQLNVEATRKQVVPYLEEAYSNLEE

SEQ ID NO: 26985 - DNA, 906 bp, Vibrio cholerae
  CDS (1)..(906)
atgattttagtcgttggtcataaaaacccagacagtgacagtatttgtagcgcattagtggcggctgagcttttaaaagcgcgtggtttagaagcgaaggcggtacgccaaggtgaaatcaaccgtgaaacgcaacatattctgaatgtggcaggcgttgagcaaccagaattacgtaccagtgtggcgggcgaacaagtgtggttggtggattacaccgatttagcgcaagcaccggatgatctcaatcaagccgaaattcttgggattgtcgatcaccatcgtcttggtgatgtgatgacagtgaatccactggaagcgtggatttggcctgtcggttgtaccagcactattttgttcaatctgttcaaaatggaaaatgcagaaatcacacgcccactcgcgttactgatgatctctgccattttgtctgacacggttggctttgcctcaccaacctgcacgcaaaaagatcgtgatgcggtggctgagttagcggtattagcgggcattaccgatctggaaggctttatcaaagcgctactgattgcgaaaactgacattgaaggcttaagtgcggcgcagctggtcgaaaaagatcttaaagcttacccattcaatggacgtgagttggtggttggtcaggttgaactggctacgctagagcaagtcgcggatatgattgatgccttggaggcagatctgcaacgtcgttgtgatgaggaatcattggcgcttgcagcactgatgctgaccgacatcactaccgcgcaaactcgtctgctgtttaaaggagaatggtcagaaaaactggctaagcatgcaaaagacggcgtactgatgatggaaaacaccctaagtcgtaagaagcaaggttggccttggctacaaacggaactggcttga

SEQ ID NO: 26986 - protein, 301 aa, Vibrio cholerae
MILVVGHKNPDSDSICSALVAAELLKARGLEAKAVRQGEINRETQHILNVAGVEQPELRTSVAGEQVWLVDYTDLAQAPDDLNQAEILGIVDHHRLGDVMTVNPLEAWIWPVGCTSTILFNLFKMENAEITRPLALLMISAILSDTVGFASPTCTQKDRDAVAELAVLAGITDLEGFIKALLIAKTDIEGLSAAQLVEKDLKAYPFNGRELVVGQVELATLEQVADMIDALEADLQRRCDEESLALAALMLTDITTAQTRLLFKGEWSEKLAKHAKDGVLMMENTLSRKKQGWPWLQTELA

SEQ ID NO: 26987 - DNA, 969 bp, Archaeoglobus fulgidus
  CDS (1)..(969)
atggagcacgtggtttatgttgttggacacaagaatcccgatacagacagcgtctgttctgcaattgcctttgcctatctctggaacaagtggaaagagggcggaaatgtggccaagatgatgaagattgaggctgaagcgaaaccagtaatccagggagatgtgaatccggaaacgaagtacgttcttgagaagtttgggtttgaagtgcctgagattatgacgaacggtgagggcaagaaggttgccctcgttgaccacagcgagaaggcacagaccgtcgacggcatagacaaggctgaggttgttgcaatcgttgaccaccacaaaatcggggatgttaccaccccacagccaatactcttcgtcaacctgcctgtagggtgcactgcaactgtcataaagctgctgttcgacaagacgggagttgagattccaaaggatattgccggaattctgctctcctcgatactgagcgatacggtaatattcaagtcggcgacaacaaccgagcttgacaaggaggttgcagaggagctcgcgaagattgcaggaattgatgacttgacgaagttcggagtggagatcaaggccaagctttccgcagttgacgatttgacggccatggacatcataaagagggactacaaggacttcgacatgagcgggaagaaggttggtgtgggtcagattgagcttgttgacctctcgctaatagaaagcaggattgacgagatttacgaggcaatgaagaagatgaaggaggagggcggctacgccggaatcttcctgatgctgaccgacataatgaaagagggcacagagttgctggtggttacagactatccggaagttgtcgagaaggccttcggaaagaagcttgagggcaagagcgtgtggctggatggtgtgatgagcaggaaaaagcaggttgtaccgcccctcgaaaaagccttcgctgaactctaa

SEQ ID NO: 26988 - protein, 322 aa, Archaeoglobus fulgidus
MEHVVYVVGHKNPDTDSVCSAIAFAYLWNKWKEGGNVAKMMKIEAEAKPVIQGDVNPETKYVLEKFGFEVPEIMTNGEGKKVALVDHSEKAQTVDGIDKAEVVAIVDHHKIGDVTTPQPILFVNLPVGCTATVIKLLFDKTGVEIPKDIAGILLSSILSDTVIFKSATTTELDKEVAEELAKIAGIDDLTKFGVEIKAKLSAVDDLTAMDIIKRDYKDFDMSGKKVGVGQIELVDLSLIESRIDEIYEAMKKMKEEGGYAGIFLMLTDIMKEGTELLVVTDYPEVVEKAFGKKLEGKSVWLDGVMSRKKQVVPPLEKAFAEL

SEQ ID NO: 26989 - DNA, 933 bp, Clostridium acetobutylicum
  CDS (1)..(933)
atggaagatattatttatataactggacataaaaacccagatacagattcaatttgttcagcaatagcatactctgaattaaaaaacaaattaggtttcaatacagttccaggaaggcttggcaacataagccgtgaaacagaatttgctcttaattactttaaagccaatgctcctaaattattagagaatttgtctagtaatcaagatataataatagttgatcataatgaaagagctcaatcagtagataatttagaagatttacatttgcttgaaataatagatcatcacagaatagcagatattcaaacaagctaccctatattcttcagaaatgagcctgttggttgttcaagtacaattataggttcaatgtactttgaaaaaggtatagagccttcaaagagagctgctggtttaatgtgctctgctataatatcagatactcttttatttagatctccaactactacagctagagacaaagaagtcctaaaaaaattagctaaaatagcagatatagaccctgaaaagtatgcttcagaaatgtttaaggctggtacttctttgaagggaaaaacagtcgaagaaatattcaacagcgactacaaagcattcaaccttggagataaaaaaataggggtttctcaagtcacaactatggatatagaaggtttcgatgaatataaaaaagatatgttagcatatatgaataaaaaagttaaagacgaaaattttaatgcagtacttttacttcttacagatattataaaagaaggttctcttataatagctaccggagaaaatactgaccttgtaaataaagcctttaatgttgagcttaaagataatgcagtatatgttcccggaatactttcaagaaaaaaacaagtaataccacctttgacttctgccatagaaggaaaataa

SEQ ID NO: 26990 - protein, 310 aa, Clostridium acetobutylicum
MEDIIYITGHKNPDTDSICSAIAYSELKNKLGFNTVPGRLGNISRETEFALNYFKANAPKLLENLSSNQDIIIVDHNERAQSVDNLEDLHLLEIIDHHRIADIQTSYPIFFRNEPVGCSSTIIGSMYFEKGIEPSKRAAGLMCSAIISDTLLFRSPTTTARDKEVLKKLAKIADIDPEKYASEMFKAGTSLKGKTVEEIFNSDYKAFNLGDKKIGVSQVTTMDIEGFDEYKKDMLAYMNKKVKDENFNAVLLLLTDIIKEGSLIIATGENTDLVNKAFNVELKDNAVYVPGILSRKKQVIPPLTSAIEGK

SEQ ID NO: 26991 - DNA, 924 bp, Methanococcus jannaschii
  CDS (1)..(924)
atgagatatgtagtagggcacaaaaatccagatactgatagtatagcatcagctattgttttagcttacttcttagattgctatccagcaagattgggagatataaacccagaaacagagtttgttttgaggaagtttggagtcatggaaccagagttgatagaatcagctaaaggtaaagagattatcttagttgaccattcagaaaagagccaaagctttgatgatttagaagaagggaagttaatagctattatagaccaccacaaggttggtttaacaacaactgagccaattttatactatgctaagccagttggttcaacagctacagttatagctgaactctactttaaagatgctatagatttaattggaggtaagaagaaagagctaaaaccagatttagctgggcttttattgagtgcaattatatcagatacagttttgtttaaatcaccaacaacaactgacttagataaagagatggctaaaaaattagctgagattgctggaataagcaatatagaagagtttggaatggagattttaaaagctaagtcagttgttggtaagttaaagccagaagaaatcataaatatggactttaagaactttgatttcaatggaaagaaggttggaattgggcaggttgaggttatagatgttagtgaagttgagagtaaaaaagaagatatttataaattgttagaggagaagttgaaaaatgagggctatgatttaatcgtctttttgataactgatattatgaaagagggtagtgaggcattggttgttggaaataaggagatgtttgagaaagcatttaatgtcaaagttgaaggaaacagtgtattcttagaaggagttatgtcaagaaagaaacaggttgttccaccattggagagagcttataatggataa

SEQ ID NO: 26992 - protein, 307 aa, Methanococcus jannaschii
MRYVVGHKNPDTDSIASAIVLAYFLDCYPARLGDINPETEFVLRKFGVMEPELIESAKGKEIILVDHSEKSQSFDDLEEGKLIAIIDHHKVGLTTTEPILYYAKPVGSTATVIAELYFKDAIDLIGGKKKELKPDLAGLLLSAIISDTVLFKSPTTTDLDKEMAKKLAEIAGISNIEEFGMEILKAKSVVGKLKPEEIINMDFKNFDFNGKKVGIGQVEVIDVSEVESKKEDIYKLLEEKLKNEGYDLIVFLITDIMKEGSEALVVGNKEMFEKAFNVKVEGNSVFLEGVMSRKKQVVPPLERAYNG

SEQ ID NO: 26993 - DNA, 1215 bp, Drosophila melanogaster
  CDS (1)..(1215)
atgtgctttctacgatttttggcccaggccaggggcaccttgggacggcatctggcggaggcctcaccagttgcctgggctgctgctcccgacgtttccggccggaaattacatctggtaatgggcaacgaatcgtgtgacttggactccgccgtttcggccgtcactttggcttttgtctacgcagcgtcatcgggagcacgactatgtacctatactgaacattcctcgccgggactacccgttgaaaaccgaggtgggccacttgtttgtgaaatgtgggattgccgagcccgtgttgctcttccgagacgatattccccgggaagtggtccaggatgtgaacgttattctcgtggaccaccatgtaagccctgggcgccaaatgttactgaaattttggatcacaggcccttggaggacagcagtccatccttcaagcagctgccaacactctgccaactggacatagatgcctcggtgggttcctgcgccactctggtggcccagcggtatttggcagaggaccaaccccgatccactagcgtggcccagctgctgcacgccaccatcgtgctggacacaattaattttgcacccgcggccaagcgctacgggccaaaggacgaagccatggtacagaagttggagagcgagcttaaccgtaaggacgctcaaagaagtagcctttttgatgagctagtggctgcaagggcggatattagtaagctaactctcaccgaagttttgcgcaaggatatgaaggtcttgcaaaccgatcgtcaggtggttcccttagctggaatgcccatcctagtcagagattttgtggagaaaagcggcgccgaaaaagccgttcgcgagtttggcgtggagagtaaccttttggttatcctgggaatgtatgtatcacctgccgatggccaggtgcagcgtgacctggccttgatctctctctccggccaaggccaattcgttcaacgcgtccagcaagcactgatggagtctaacgatccaaaattggagttgcgacctcacgaggtggacacccgctttatgggcggctgcttcttgcgccaacacaacgtccaggccaccagaaagcacatcctgcccattgttaagcgagcgctgcttgaatgggaagcggatcacgcctgcgattgtgacgaggtgtacttcttcaaggagaagccgcagctgggactctcttaa

SEQ ID NO: 26994 - protein, 404 aa, Drosophila melanogaster
MCFLRFLAQARGTLGRHLAEASPVAWAAAPDVSGRKLHLVMGNESCDLDSAVSAVTLAFVYAASSGARLCTYTEHSSPGLPVENRGGPLVCEMWDCRARVALPRRYSPGSGPGCERYSRGPPCKPWAPNVTEILDHRPLEDSSPSFKQLPTLCQLDIDASVGSCATLVAQRYLAEDQPRSTSVAQLLHATIVLDTINFAPAAKRYGPKDEAMVQKLESELNRKDAQRSSLFDELVAARADISKLTLTEVLRKDMKVLQTDRQVVPLAGMPILVRDFVEKSGAEKAVREFGVESNLLVILGMYVSPADGQVQRDLALISLSGQGQFVQRVQQALMESNDPKLELRPHEVDTRFMGGCFLRQHNVQATRKHILPIVKRALLEWEADHACDCDEVYFFKEKPQLGLS

SEQ ID NO: 26995 - DNA, 1155 bp, Schizosaccharomyces pombe
  CDS (1)..(1155)
atgaaattaggcagatttttagaaaacggaagggagcaaatacgaaatctcctcttaaatgcttcgactgtatcgtctgccccgtcttttagctttgttagtggaaatgaatcagcagatcttgacagttgcgctagttcaatcgtatatgcgtattgcctgcaaagaaaacagctgggtaggattgtagtacctttttttaacattcctcgaaaggagctacgtcttaggcctgaactgtcttatttgttgaacttagcatcaatatcttccgatgatattgtctttttagatgatattgtaaaattaccaaaaagaatattcagtaatcctatttatttagttgatcacaattctttggaccgtaaagacctagaaaatttcaacggcagtatcgctggtattatagatcaccacaaagatgaagggggatccttacatgctgatccaagaatcattgaggaatgcggtagctgctgtactttagtttgccgatattttatgcctgtcattagatctctatatgattccaaagtatctgaacttcaccaaacagcaaccaaccttgctgttttggcacttggccctattttaattgatactggaaatttaaaaaatgaaaagactactgataccgatgttaaaatagtaaatgacttatgctcatttgtgccaaaagattgggttcgagatgagttttttgatactctgaaagagaaaaagaagagctgtaagggtttttcttttgatgatctactacgcagggatttaaaacagtattttccggacggaatagtcgtcaattatgccagtgttggaaagggattagattggatcaagaaaaaacgtctcggatgggaagatgaattgaaaagttttgccgaagtgcaaaattctgatttggtaattgttgggttatctctgagtaagaacgacgagtttggtcgtcaattgattttatacaagcgtactgaaaggggagctggtcttgccgattctttcttaaaacttagcaaacaaaatttaggattagaaattattgaagagaaagataatggcgacctcagtatgtggaatcaaagaaattccgctgctagcagaaagaaagtagttcccttacttatggactcagttaaacaagtcgcttcaaaatag

SEQ ID NO: 26996 - protein, 384 aa, Schizosaccharomyces pombe
MKLGRFLENGREQIRNLLLNASTVSSAPSFSFVSGNESADLDSCASSIVYAYCLQRKQLGRIVVPFFNIPRKELRLRPELSYLLNLASISSDDIVFLDDIVKLPKRIFSNPIYLVDHNSLDRKDLENFNGSIAGIIDHHKDEGGSLHADPRIIEECGSCCTLVCRYFMPVIRSLYDSKVSELHQTATNLAVLALGPILIDTGNLKNEKTTDTDVKIVNDLCSFVPKDWVRDEFFDTLKEKKKSCKGFSFDDLLRRDLKQYFPDGIVVNYASVGKGLDWIKKKRLGWEDELKSFAEVQNSDLVIVGLSLSKNDEFGRQLILYKRTERGAGLADSFLKLSKQNLGLEIIEEKDNGDLSMWNQRNSAASRKKVVPLLMDSVKQVASK

SEQ ID NO: 26997 - DNA, 1218 bp, Drosophila melanogaster
  CDS (1)..(1218)
atgtgctttctacgatttttggcccaggccaggggcaccttgggacggcatctggcggaggcctcaccagttgcctgggctgctgctcccgacgtttccggccggaaattacatctggtaatgggcaacgaatcgtgtgacttggactccgccgtttcggccgtcactttggcttttgtctacgcgcagcgtcatcgggagcacgactatgtacctatactgaacattcctcgccgggactacccgttgaaaaccgaggtgggccacttgtttgtgaaatgtgggattgccgagcccgtgttgctcttccgagacgatattccccgggaagtggtccaggatgtgaacgttattctcgtggaccaccatgtaagcccgctggcgccaaatgttactgaaattttggatcacaggcccttggaggacagcagtccatccttcaagcagctgccaacactctgccaactggacatagatgcctcggtgggttcctgcgccactctggtggcccagcggtatttggcagaggaccaaccccgatccactagcgtggcccagctgctgcacgccaccatcgtgctggacacaattaattttgcacccgcggccaagcgctacgggccaaaggacgaagccatggtacagaagttggagagcgagcttaaccgtaaggacgctcaaagaagtagcctttttgatgagctagtggctgcaagggcggatattagtaagctaactctcaccgaagttttgcgcaaggatatgaaggtcttgcaaaccgatcgtcaggtggttcccttagctggaatgcccatcctagtcagagattttgtggagaaaagcggcgccgaaaaagccgttcgcgagtttggcgtggagagtaaccttttggttatcctgggaatgtatgtatcacctgccgatggccaggtgcagcgtgacctggccttgatctctctctccggccaaggccaattcgttcaacgcgtccagcaagcactgatggagtctaacgatccaaaattggagttgcgacctcacgaggtggacacccgctttatgggcggctgcttcttgcgccaacacaacgtccaggccaccagaaagcacatcctgcccattgttaagcgagcgctgcttgaatgggaagcggatcacgcctgcgattgtgacgaggtgtacttcttcaaggagaagccgcagctgggactctcttaa

SEQ ID NO: 26998 - protein, 405 aa, Drosophila melanogaster
MCFLRFLAQARGTLGRHLAEASPVAWAAAPDVSGRKLHLVMGNESCDLDSAVSAVTLAFVYAQRHREHDYVPILNIPRRDYPLKTEVGHLFVKCGIAEPVLLFRDDIPREVVQDVNVILVDHHVSPLAPNVTEILDHRPLEDSSPSFKQLPTLCQLDIDASVGSCATLVAQRYLAEDQPRSTSVAQLLHATIVLDTINFAPAAKRYGPKDEAMVQKLESELNRKDAQRSSLFDELVAARADISKLTLTEVLRKDMKVLQTDRQVVPLAGMPILVRDFVEKSGAEKAVREFGVESNLLVILGMYVSPADGQVQRDLALISLSGQGQFVQRVQQALMESNDPKLELRPHEVDTRFMGGCFLRQHNVQATRKHILPIVKRALLEWEADHACDCDEVYFFKEKPQLGLS

SEQ ID NO: 26999 - DNA, 1239 bp, Debaryomyces hansenii CBS767
  CDS (1)..(1239)
atgtcagtaagatcgtatttagtcactctaaagaagcaattagagaccaactcaattaagtccccgttaagatttgttactggtaatcaatcggctgatttagattcagtaattagtgccattagttttgcatatttcaattataagaaggacgaatccttgttaatcccgttaattaatatatccagaactgactttaagttacggagggacattgttaccttattggattcctattcaataactgaggatagcttatatttcattgaagatttcaaaagaataactgcttccgatgttcctattgaattaacgttagttgatcactgtaacatccaaggggatgtattcactgactatctttctaaaggaaagctagatattgttgggattatagaccaccaccaggacgaatcagtatttttaaatgctaacccaagaataatacatagtaatgggtcttgttctgcgttagtctttaattattggtatgaccaatttagtaataaagatatcttctacgaaaaagataatgaaattgttcctttgttattaggatctttactaattgatacgtcaaatatgagccagaaggttgaagaaggtgatgttatcgcatttaaagaatatcaaaatattttacaaaagaatgaaattttactcaaagggttaggaaactatgcttgccaaagcactgataatattgaaaaattacttaagggatattataagcaaataaaagtagctaaaaaggatatgaaaggtttcaagttttatgatattttaaaaaaagattataaacaattcaaattcacctccagatgtaatgtgtctacagtggttggatttagctcaattggtaaatctttctattggttattgtcaaactattctatgcaagaaatatcagaaactttcaatgaaatcatgaaggattttaatttagatcttttaatcatgacgacttcctatactagacaagaaaatgatcaatacacaagagagttcagttatgctttcaactcaagcaatccacgtaaagatattttgttgcaattagcgaatttagctaacgatgaattgaaattagattccgatatatacaagcttgaaaatcttaacagttatctcgctgacttgggaaaaggtcaaacatttaagatctacaatcaaaacaacacagcagcttcaagaaagcaaatagttcctgttattaaggatattcttgagaataactag

SEQ ID NO: 27000 - protein, 412 aa, Debaryomyces hansenii CBS767
MSVRSYLVTLKKQLETNSIKSPLRFVTGNQSADLDSVISAISFAYFNYKKDESLLIPLINISRTDFKLRRDIVTLLDSYSITEDSLYFIEDFKRITASDVPIELTLVDHCNIQGDVFTDYLSKGKLDIVGIIDHHQDESVFLNANPRIIHSNGSCSALVFNYWYDQFSNKDIFYEKDNEIVPLLLGSLLIDTSNMSQKVEEGDVIAFKEYQNILQKNEILLKGLGNYACQSTDNIEKLLKGYYKQIKVAKKDMKGFKFYDILKKDYKQFKFTSRCNVSTVVGFSSIGKSFYWLLSNYSMQEISETFNEIMKDFNLDLLIMTTSYTRQENDQYTREFSYAFNSSNPRKDILLQLANLANDELKLDSDIYKLENLNSYLADLGKGQTFKIYNQNNTAASRKQIVPVIKDILENN

SEQ ID NO: 27001 - DNA, 1236 bp, Yarrowia lipolytica CLIB99
  CDS (1)..(1236)
atgaactgcacgatctcctgtcgcgagttctggtcgagggattcgagggcctggggggtgatagattccatgccagctcacaagctcttctgttcaaaatgtccatcactagctaccttggaaaagtggccgagaaatgggctgctatcaaggtctcctgcggcgttcaccatcgtctcgggtaatgagtcggccgacattgattcgtgtgtctcgtcggctctctacgcctacctgtcacagtcacagtccaaggttgacgtcttcccgctcatcaacatccccaagcaagacattctgctgcgacgagactttctgtggctgctggccaagctcaacatcaaggacaactcgttcctcttcctcgatgatctgaaccccgagctgctcaaacacgcctctctggctctcgtggatcacaacaaggtcaccgcctctctggcccagctcgacgacaaggtgattggtgtcattgaccaccacgaagacgagggactgtacaagtccgccgaccccagagtcgtcatcaagaacggatcgtgctcgtctctggtatacacctggtggaacaagacactcggcggtctcaatggcaccattgcctcggactctgccctcaatgagcttgccctggcccctcttctcatcgacacctccaacatgaagtccaaggtcgaggcccacgataccgaggcctacgagctcatcaccaaggctctgagtcgtatttctgcctttgccacatccaaggatgtcaagtcgttctacaagacactggacgagaagaagcgagacctgtcgggctttgacgccgtccagatgctccgaaaggactacaaagactgggccgaaaacggtgccaagctgggaatgagcactgtggttctggacctcagcaacatgctcaagcaggacccaaagttcttccccaagctccatgacttttgcgaggagcacaacgtgaccgtgcacgtgaccatgacctcgtacactgacgctgatactggcaaacacgcccgccagatgatcatttactcgcccaagggttgcaatgacggcgttcaaaagttcctcgacgcttctgccgaccttgaactcgagcccttttctgtggacgacagcggcatccctggtaagctgtgggtgttccagcagaacaacgctaaggccagccggaagcaggtggctcccaagctgcgatctgctctgtttggaactcacttctcgtctatctag

SEQ ID NO: 27002 - protein, 411 aa, Yarrowia lipolytica CLIB99
MNCTISCREFWSRDSRAWGVIDSMPAHKLFCSKCPSLATLEKWPRNGLLSRSPAAFTIVSGNESADIDSCVSSALYAYLSQSQSKVDVFPLINIPKQDILLRRDFLWLLAKLNIKDNSFLFLDDLNPELLKHASLALVDHNKVTASLAQLDDKVIGVIDHHEDEGLYKSADPRVVIKNGSCSSLVYTWWNKTLGGLNGTIASDSALNELALAPLLIDTSNMKSKVEAHDTEAYELITKALSRISAFATSKDVKSFYKTLDEKKRDLSGFDAVQMLRKDYKDWAENGAKLGMSTVVLDLSNMLKQDPKFFPKLHDFCEEHNVTVHVTMTSYTDADTGKHARQMIIYSPKGCNDGVQKFLDASADLELEPFSVDDSGIPGKLWVFQQNNAKASRKQVAPKLRSALFGTHFSSI

SEQ ID NO: 27003 - DNA, 1152 bp, Kluyveromyces lactis NRRL Y
  CDS (1)..(1152)
atggttggcaggcttgtaaagttcttaacacaattaaagggatcgcatgtgaacgcactgaaaaaatgcagcagtaaggacagttgtttcttaaatatagtctgcggaaacgaatctgcagatcttgatagtattgtcagcactatagcatatgcttatctcagcttccttaacgacccgtctgctcttctacttccagtaataaacattccaaaggaagatctaaaacttaggagagatgtttgttacttgttagactcacactcaatatcaagtgatttgctatattttaaagaagatttgcgtaattggagcaaactaccatcatgtgacatcaattgtgttcttgtggaccataacgacattccacatacgaataaggatgttttactaaatgttgttggcattgtagatcatcataaagatgttggtttacatacagaatcagttgaaacattctcaggaccaagaattattcaaactgcaggtagttgctccagtttggtgttcgactattggttcaaaatttcaaagagtaatgaacaagcatgtgccgctattaaagatgtggttccactactgcttggtgctcttctaatagatactgatgacatgaaacataaagtagagcacatcgacaccgtagcactcgaggaatacaaaaagctatcacaagaatctgtggatactaatcgactgtaccaaaagctaagagaagctaaagatgatataaacggtctatattttcatgatatcttaagaaaagattacaaggaattcaactttaatcccgaaacacgttgcggtatagcttcggtcgtgaaatcaattcaatggattgaaaggaggttcgataaagcaaatattgaaagtacctgtactaagtatatcgaagaaaatagtcttgacattcttgttttaatgactagtttcactgagaatgatatcttctcgaagcaaattgcttttcagattaaccccaaccgtgatccacagctgttgaaatcattagtcaatgacttggctccgaagctggatttggttaagattgagtcattatcatccaagtgctttgagtgctatgatcaaaaaaatactaaaatgagtagaaagcaagtggctccctttatcgaagagttcatacataagtag

SEQ ID NO: 27004 - protein, 383 aa, Kluyveromyces lactis NRRL Y
MVGRLVKFLTQLKGSHVNALKKCSSKDSCFLNIVCGNESADLDSIVSTIAYAYLSFLNDPSALLLPVINIPKEDLKLRRDVCYLLDSHSISSDLLYFKEDLRNWSKLPSCDINCVLVDHNDIPHTNKDVLLNVVGIVDHHKDVGLHTESVETFSGPRIIQTAGSCSSLVFDYWFKISKSNEQACAAIKDVVPLLLGALLIDTDDMKHKVEHIDTVALEEYKKLSQESVDTNRLYQKLREAKDDINGLYFHDILRKDYKEFNFNPETRCGIASVVKSIQWIERRFDKANIESTCTKYIEENSLDILVLMTSFTENDIFSKQIAFQINPNRDPQLLKSLVNDLAPKLDLVKIESLSSKCFECYDQKNTKMSRKQVAPFIEEFIHK

SEQ ID NO: 27005 - DNA, 1143 bp, Candida glabrata CBS138
  CDS (1)..(1143)
atgccaaatttacagcagttccttaaacaattgcgtactgtggaaattccacgattgataaaacaatcggtttcaaccttgaatatagtctgtggtaatgaatctgccgattttgattctgttgcttgtgccatttcatatgcctacttcgagcatgctaagagtgcccaaaatgtttatgtgcctataatcaatatcccaaaggaagaccttatgatgaggagagatataatgtttactttgaacaagctagacatctcacaagatcttttgttttttagagaagaccttatggaatataataaacaattcaacacaatcaacgcagtgattgttgatcacaacgaacttccaaaaccaaccaagcagctaataacagatgttattggtattattgatcaccatgcggataagcaattatatccgaatgccaatcctagaattatcacagttactggaagctgttcatcgctggtaactaacttctggagtaaaaacttagaaagtaacaagtaccatgaggctctcaacgactgtgcaccgctacttatttctgctggtcttctagatactgcaaatatgaaatataaagttgagaaccccgacgtagaagcattcaaacactatggtgatttgaatattcctctatttactcaattcgatagcgctttccgtgagttaagatcagccaaagacaatattgatggtttgacagtaaaacagttaatcaggaaggactataaggaatatgatttaatccctaagtctttggaatccaaaaaattaaactttggtgtgacttcaattgttgaaccggtagaggaactattcaaacgtttcaatagtaaagataattttttcaacagttgctataaatatagagaggaatatgatttagattgcttagtattactaacttcttggaatgaccctaaagagggcagattcagaagagagttgatcattattccaaaggatggtctttacgacactgtcgaaaatttgtgcaataatgcccccaaattggaactcaaagttttggataaagaaagccagaagtttgtaatctatgagcaattcgacttgagctcaagtagaaaaagaattatgccttatctgcaagacgtctactcaacaatttaa

SEQ ID NO: 27006 - protein, 380 aa, Candida glabrata CBS138
MPNLQQFLKQLRTVEIPRLIKQSVSTLNIVCGNESADFDSVACAISYAYFEHAKSAQNVYVPIINIPKEDLMMRRDIMFTLNKLDISQDLLFFREDLMEYNKQFNTINAVIVDHNELPKPTKQLITDVIGIIDHHADKQLYPNANPRIITVTGSCSSLVTNFWSKNLESNKYHEALNDCAPLLISAGLLDTANMKYKVENPDVEAFKHYGDLNIPLFTQFDSAFRELRSAKDNIDGLTVKQLIRKDYKEYDLIPKSLESKKLNFGVTSIVEPVEELFKRFNSKDNFFNSCYKYREEYDLDCLVLLTSWNDPKEGRFRRELIIIPKDGLYDTVENLCNNAPKLELKVLDKESQKFVIYEQFDLSSSRKRIMPYLQDVYSTI

SEQ ID NO: 27007 - DNA, 924 bp, Methanococcus maripaludis
  CDS (1)..(924)
atgatgtacgttgtaggccacaaaaatcctgattcagatagtatctgttctgcaatagcacttgcatattttttggatgcatttcctgcaagacttggagaactaaatccagaatcacagttcattttaaagagatttggattaatggaaccagaattaattaaaactgcaaaaggaaaagaattatttttagtagatcacgcagaaaaatcacaaaacctcgatgattttgacaaaggaaaattaatcggaattattgaccaccacaaaatcggtatttcaacaactgagccaattatttacctctcaaagccagttggatcaactgcaagcgtaatttcagaactctactttaggggaatactcgatattatcggcggaaaaaacaaggaattaaaagcagatattgcaggggttttactttcagcaatcctttcagatacattactctttaaatcgcctacagcaacaccacttgataaggaactcgcagaaaaattagcagacattgcaggaatttcagacattactgcatacggaatggaaatgctgactgcaaaatcaactgttggtaaaatgactccagaagaaattttacacatcgattataaaccatttgacatgagcggtaaaaaggtcggtatcggtcaagccgaagtaatcgatatgtccgaagttgcatccaaaaaagaagcaattcaaaatttaatcgatgaaatgattgaaaaagaaggatatgatatggtattattccttgtaacagacatcatgaaagaaggaagtgaagttttagttgcaggaaacaaatcctcttttgaaactgcatttgaacttaaattggatggaaaaagtgtatttattgatggactaatgtcaagaaagaaacaggtagttcctccgcttgaaaaatactattcaaattaa

SEQ ID NO: 27008 - protein, 307 aa, Methanococcus maripaludis
MMYVVGHKNPDSDSICSAIALAYFLDAFPARLGELNPESQFILKRFGLMEPELIKTAKGKELFLVDHAEKSQNLDDFDKGKLIGIIDHHKIGISTTEPIIYLSKPVGSTASVISELYFRGILDIIGGKNKELKADIAGVLLSAILSDTLLFKSPTATPLDKELAEKLADIAGISDITAYGMEMLTAKSTVGKMTPEEILHIDYKPFDMSGKKVGIGQAEVIDMSEVASKKEAIQNLIDEMIEKEGYDMVLFLVTDIMKEGSEVLVAGNKSSFETAFELKLDGKSVFIDGLMSRKKQVVPPLEKYYSN

SEQ ID NO: 27009 - DNA, 1152 bp, Trypanosoma cruzi
  CDS (1)..(1152)
atggctgccgtgataaatgactttttgaggggcggcgctgggattcttgctgcccgaatgccgtttacccttgtccttggcaacgacgggggcgatttggatagcatcattggctcaatttatttgtctctatacctggaaaaacatgccgatttgggaggtggaagttatattcccgcactaaactttgaaaaggaggatcttccgttgcgcaatgacgtcataaaattattttcaaagcatggtatagcaacggattacttgctttcagttaaaggaaagccaggtatttcaggttttttggatctaaaatcatcccaacccaatgtcgttttgtatgatcataacaagcttattcctgaacaaagattcctctgtgaacgtgtcgtcggtgttatagatcatcattttgatgagaaactatatttggattcttctagtcaatttcgaagaatagaatcaacaggttcagcttgtactcttgtcgcggaattgtttcaagaagcggaattgacggttccatgtccggagcttctcttagcgcccattgtacttgacaccgtaaactttgatccatctcaaaagaaagttacagaaaaggatataatgttatcccagtggcttataaaacaagcttctgattcaattgatccgaaaaagatttttttggagctgtcaacatggaaaaatgatatacttgctcttaccttcccccaacatttccgcagagactacaaggactttgaattttcatttgggaaaaacgaagacaaacacttgcaaataggaatcagtagcattgcttgtcgatttgatgagtttcttggcccaagtggaatgatgcatcttgcttctaactgtctcgattttttgctgccaaaaaagctggatgccttcctcctggcttttgctggagaaaggggatataaaaattattgccgacagctggcttttattgcaagggggatccttcttgaggcgctcaaagaatttgcagagagttcacctgagggtatttgtttcaccattatagacagagcagaactgaagggatggagactaatgtgttatgaattgagtgatccttccgtttcgcggaagcggctcgcaccatcactgatgaagttttttgcctcttggccaaaactgtaa

SEQ ID NO: 27010 - protein, 383 aa, Trypanosoma cruzi
MAAVINDFLRGGAGILAARMPFTLVLGNDGGDLDSIIGSIYLSLYLEKHADLGGGSYIPALNFEKEDLPLRNDVIKLFSKHGIATDYLLSVKGKPGISGFLDLKSSQPNVVLYDHNKLIPEQRFLCERVVGVIDHHFDEKLYLDSSSQFRRIESTGSACTLVAELFQEAELTVPCPELLLAPIVLDTVNFDPSQKKVTEKDIMLSQWLIKQASDSIDPKKIFLELSTWKNDILALTFPQHFRRDYKDFEFSFGKNEDKHLQIGISSIACRFDEFLGPSGMMHLASNCLDFLLPKKLDAFLLAFAGERGYKNYCRQLAFIARGILLEALKEFAESSPEGICFTIIDRAELKGWRLMCYELSDPSVSRKRLAPSLMKFFASWPKL

SEQ ID NO: 27011 - DNA, 1146 bp, Ashbya gossypii
  CDS (1)..(1146)
atgtccaattctattgcccagttcttgacctttttgcgtaaccaatacgtgaagaacctctcgcaaggggtacctctacggattgtgtgtggcaacgaatcagcggaccttgattcagtggcgtccgccatcgcatatgcgtacttcagctatgcctggaagccgactgagcctgtggtaccgataattagcatcccacaccacgatctcaagctccgcaaagatgtggagatggtgctcgagcacattggtgtttctgacaaaagtctattctttctcgaggatttacagaagtggaagatggatcatgggctcacaattgatggcgtgttggtcgatcacaatgagctacaagggccttgtaaagatctcattgatgaggttgtcggtgtaatcgatcaccacgaggatcagcggatatactatgaacaagtgaagaagacaaacgggccttacatcgtagcgcccaccggcagctgttcatcacacgttgtcaattattggaatggcattctcggatctagcgatcaatcgcagctaacagatgctctgacattatgcatgagcgcaatcatgatggacacatcgaagctcaagcataaagtagaggactcggacatgcaagcgtacgccatctgcaaaagcgtgttgaccaatatgaacgaggatgcgtactacaagcgcatgaaggcagcaaagaatgacgtagatggcttctcactcgatgagattcttcgtaaggactataaagagttggtgttcccgagccgcagtgcagatctacgtgttggcgtacctactgtcgtgcgctctttcgaatggatgcgcgagaagttcggcgacaatgggactacgaagctctggcacagtttccttctggagcataagttagatttcctcgtggtgctcacaattaagaaggccaacgagggtttgaaacgggagttggctatcatggccaactcctgcgaccgtgcgcagcaggtcgagttcttgatccaaagcctcaccccagagttgcagttgagcaagacctctgtcttctcccccggctcactcgtcattgagacgtgcgaccagagaatgctatctgccagtcgcaagcaaatagtacctctcctcaagagaaccgtcgccgagttatag

SEQ ID NO: 27012 - protein, 381 aa, Ashbya gossypii
MSNSIAQFLTFLRNQYVKNLSQGVPLRIVCGNESADLDSVASAIAYAYFSYAWKPTEPVVPIISIPHHDLKLRKDVEMVLEHIGVSDKSLFFLEDLQKWKMDHGLTIDGVLVDHNELQGPCKDLIDEVVGVIDHHEDQRIYYEQVKKTNGPYIVAPTGSCSSHVVNYWNGILGSSDQSQLTDALTLCMSAIMMDTSKLKHKVEDSDMQAYAICKSVLTNMNEDAYYKRMKAAKNDVDGFSLDEILRKDYKELVFPSRSADLRVGVPTVVRSFEWMREKFGDNGTTKLWHSFLLEHKLDFLVVLTIKKANEGLKRELAIMANSCDRAQQVEFLIQSLTPELQLSKTSVFSPGSLVIETCDQRMLSASRKQIVPLLKRTVAEL

SEQ ID NO: 27013 - DNA, 1041 bp, Vibrio vulnificus
  CDS (1)..(1041)
atgagaattattcgcaatagctggacgtcacttttcttggtgtcaaatccactcatttcaggtaaagtatgcccctttgtgagcaaccctgctttttggttaagcaggaataacgagacttggataggaaagataatgattctagttgtaggtcataaaaacccagacagtgacagtatttgtagtgctatcgtagccactgagctgctaaaagcgcgtggcgttgaagcgatgccgattcgtcaaggcgaaatcaaccgcgaaacacagcacattctagaagtggctggcgcagacgttcctgagctacgtacatcagtagccggtgaaacggtgtggttggtggattactcagatcttgcgcaagcgcctgatgatattgctgaagctgaagttgcgggtatcgttgaccatcaccgtcttggtgacgtcatgaccgtaaacccaatggaagcatggatctggcctgttggttgtaccaacaccgttctgttcaacatgttcaagattgaaggtcacgcgatctctgaaaaaatcgctaagctaatgatgtcggcaatcctgtctgacaccgttggttttgcttctccaacttgtacgcaaaaagacaaagatgccgttgcagagcttgcgcaaattgccggtgttaccgatgttgatgcgtttactaaagatctactgatcgcgaaaacaaatattgaaggtctatctgctgcacaattggtagagaaagatctgaaaggttacccattcaatggtcgtgacgtggttgtaggccaagttgaactggcaacgttagagcaagtagatggcatgatcgaagcactagaagcggacctacaacgtcgttgtgacgaagatggccttgcgtttgctgctgttatgctaactgacatcacgacagcttggactcgcttgatctacaaaggtgagtggtcagagaaactgactaagcatgaaaaagatggcctgctgatgatggaaaatacgctaagtcgtaagaagcaaggctggccttggcttcaagttgagcttgcgtaa

SEQ ID NO: 27014 - protein, 346 aa, Vibrio vulnificus
MRIIRNSWTSLFLVSNPLISGKVCPFVSNPAFWLSRNNETWIGKIMILVVGHKNPDSDSICSAIVATELLKARGVEAMPIRQGEINRETQHILEVAGADVPELRTSVAGETVWLVDYSDLAQAPDDIAEAEVAGIVDHHRLGDVMTVNPMEAWIWPVGCTNTVLFNMFKIEGHAISEKIAKLMMSAILSDTVGFASPTCTQKDKDAVAELAQIAGVTDVDAFTKDLLIAKTNIEGLSAAQLVEKDLKGYPFNGRDVVVGQVELATLEQVDGMIEALEADLQRRCDEDGLAFAAVMLTDITTAWTRLIYKGEWSEKLTKHEKDGLLMMENTLSRKKQGWPWLQVELA

SEQ ID NO: 27015 - DNA, 1269 bp, Neurospora crassa
  CDS (1)..(1269)
atggcgcccgcagcccgtgtctccctcaacaagttccttgtaacagctcgcaaggcgcttctcgcaccgccagcgcagcgtccaaaccctttggtcttcgtcataggaaacgaatcagcagacctcgactccctctgctcctcaatcctcctcgcctacttctgcacctaccgcaccacccctccgaccctccacatcccgctctccaacctcccgcaagccgacctcgccctgcgacctgagcttgccgccgtgttgaagcccgccggtctacacaccaatgaccttatcaccctcgatgggctgcccaaggacgacaatgtcacccccgaaaacactcaatggctactagtagaccacaacagcctcacaggcccgcttgccgcgcgcggttttgggggtccagaaaggataatagggtgcatagaccaccatgatgacgaaggcgttgttcccccgaccgtaaagccgaggatgattgagaagagcgggagttgcatgagtctggtggtggaatattgcaagcctgtctgggaggagctaagccgacttgaaagtgccgaagcgggggctacggacagccgggaagagtgggagtcgcagttggcccatctggcgctggcaccgatactgattgacacgacaaatttgacgagcaaggacaagacgacagagtgggatacgggggctgtggagtttttggaaggtcgtttgacacaaaaatcgcaacagacgagtgccaccagtggagggcaagaagggtatgacaggacagcctacttcaaccacatcacctccctcaaagaagaaatcgccgggctaagctaccgcgacattctgcgcaaggactacaaacggtgggaagacggcggactagcggtgggcatctcgacggtggtcaggggactcgagtacctcttgacggaaatcggagaccaaaaagagttcaccgaggcgttgcgggcctgggcgaaagagcaggagctggacattgcggcggtcatgacggtgtcaaatccggatgggaagttcaccagagagctgctcgtctgggcgttcaacgagcgggcggtcaaagttgtgaagcggtttgtggagaagcatggggaagaggggttgcagtttcagacgtggggcggtggaaagttggattcggatgatggaaaaggcgagtgggtcaggtgttggacgcagggacgggtggataagagcaggaagcaggtggcgcctatgttgagggatgcgatgaaggaggcggctaggctttga

SEQ ID NO: 27016 - protein, 422 aa, Neurospora crassa
MAPAARVSLNKFLVTARKALLAPPAQRPNPLVFVIGNESADLDSLCSSILLAYFCTYRTTPPTLHIPLSNLPQADLALRPELAAVLKPAGLHTNDLITLDGLPKDDNVTPENTQWLLVDHNSLTGPLAARGFGGPERIIGCIDHHDDEGVVPPTVKPRMIEKSGSCMSLVVEYCKPVWEELSRLESAEAGATDSREEWESQLAHLALAPILIDTTNLTSKDKTTEWDTGAVEFLEGRLTQKSQQTSATSGGQEGYDRTAYFNHITSLKEEIAGLSYRDILRKDYKRWEDGGLAVGISTVVRGLEYLLTEIGDQKEFTEALRAWAKEQELDIAAVMTVSNPDGKFTRELLVWAFNERAVKVVKRFVEKHGEEGLQFQTWGGGKLDSDDGKGEWVRCWTQGRVDKSRKQVAPMLRDAMKEAARL

SEQ ID NO: 27017 - DNA, 1152 bp, Trypanosoma brucei
  CDS (1)..(1152)
atgacggcagtggtgaatgagttccttaagcgcggtgtacgagcgttagcagctcgccaggattccgttcttgtgatgggtaacgaaggaggtgacatggacaccgtgattggctctatatttctggcgatgtacctggaaaagcgtgacgtatttggtgttggtagttacgttcctgtactaaacttcgaaaaggatgacttaccactgcgacaagatgtggttaagttactgtcacgacacaacgtttctacagacagtatttactcagtcaagcaaagtgggaatggtgtggatttcctggacctacatcaaatgaagcttcccatcgttttgtatgatcacaacaagctaagtcctgagcaggtttatttgggagaaaggatcgtgggtgtggtcgaccatcacgaagatgagcaactatacgtggatcagaccaaatgcctccgaaggatttgcaagacgggttcggcttgcacccttgttgcagaacttttcaacgaggcggggttggaggttccgtgccctgagctcctcttagccccaattgtagtagatactgtaaactttgaaccgtcgcaaaagagggtaactgaacgagacattttggcctccaggctgctggttgggcgggacgattgcggcgactacctgacgggcatgtttaaagaactaatggcgtggaaaaatgatatccactgcctcactgttcctcagcacctacggcgggactataaaaactttgaatttccctttattagtgctgaaaacaagatattgcgagttggaataagcagtatttcgtgtcgttctgacgaattactatccgtccatggtgtgagtagtgtgtcatcaaattgcattgaattcatcaaacagaggtcaatcgacatgcttctcttgaccttcgctggtgaaagaactccagggagttactgtcgtcagttaggtgttgttgcgaaggatgagggactcgcggctctgcaagcctattgtaagaaatcacccagcgggctcgactttactcttctggaggatgtaacagttaatgagtgggccttttcaatttacgagctgagcgacccttccgtgtctcggaaaaagttggttccatcgctgactagttttttgtcagtgtggaacaatttgtaa

SEQ ID NO: 27018 - protein, 383 aa, Trypanosoma brucei
MTAVVNEFLKRGVRALAARQDSVLVMGNEGGDMDTVIGSIFLAMYLEKRDVFGVGSYVPVLNFEKDDLPLRQDVVKLLSRHNVSTDSIYSVKQSGNGVDFLDLHQMKLPIVLYDHNKLSPEQVYLGERIVGVVDHHEDEQLYVDQTKCLRRICKTGSACTLVAELFNEAGLEVPCPELLLAPIVVDTVNFEPSQKRVTERDILASRLLVGRDDCGDYLTGMFKELMAWKNDIHCLTVPQHLRRDYKNFEFPFISAENKILRVGISSISCRSDELLSVHGVSSVSSNCIEFIKQRSIDMLLLTFAGERTPGSYCRQLGVVAKDEGLAALQAYCKKSPSGLDFTLLEDVTVNEWAFSIYELSDPSVSRKKLVPSLTSFLSVWNNL

SEQ ID NO: 27019 - DNA, 1362 bp, Homo sapiens
  CDS (1)..(1362)
atggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggtaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtga

SEQ ID NO: 27020 - protein, 453 aa, Homo sapiens [sequence omitted]

SEQ ID NO: 27021 - DNA, 906 bp, Vibrio parahaemolyticus
  CDS (1)..(906)
atgattctagttgtaggtcataagaacccagacagtgacagtatttgtagtgcactagttgcaacagaacttctaaaggcgcgtggcgttgaagcaatgccaattcgtcagggcgaaatcaaccgtgaaactcagcacattcttgaagtagctggcgcagaagttccagaacttcgcacttcagtagcgggtgaaaccgtttggctagtagactactcagatctagcgcaagcaccagacgacatcgctgaagctgaaatcgcgggtatcgttgaccaccaccgtctaggtgacgtgatgacagtgaacccaatggaagcatggatctggcctgttggctgtactaacacagtactattcaacatgttcaagattgaaggtcacgagatcaagcctcaaatcgctaagctaatgatgtcagcaatcctatctgacacagtaggcttcgcttctccaacttgtacacaaaaagacaaagatgctgttgctgagctagctgcaatcgctgacgtacaagatgtggatgcattcacgaaagatcttctaattgctaagacaaacatcgaaggtctatctgcggctcaactcgttgaaaaggaccttaaaggttacccattcaacggtcgtgacgtagtggttggtcaggttgaacttgcaactcttgagcaagttgacggtatgatcgaagcactagaagcagacctagaatctcgttgtgagaaagataacctagcgttcgctgctgttatgctaacagacatcacaactgctcaaactcgtcttctatacaaaggtgagtgggctgagaaacttgttaagcacgagaaagacggcatgctaatgatggaaaatacactaagccgtaagaagcaaggttggccttggcttcaaactgagctagcgtaa

SEQ ID NO: 27022 - protein, 301 aa, Vibrio parahaemolyticus
MILVVGHKNPDSDSICSALVATELLKARGVEAMPIRQGEINRETQHILEVAGAEVPELRTSVAGETVWLVDYSDLAQAPDDIAEAEIAGIVDHHRLGDVMTVNPMEAWIWPVGCTNTVLFNMFKIEGHEIKPQIAKLMMSAILSDTVGFASPTCTQKDKDAVAELAAIADVQDVDAFTKDLLIAKTNIEGLSAAQLVEKDLKGYPFNGRDVVVGQVELATLEQVDGMIEALEADLESRCEKDNLAFAAVMLTDITTAQTRLLYKGEWAEKLVKHEKDGMLMMENTLSRKKQGWPWLQTELA

SEQ ID NO: 27023 - DNA, 1365 bp, Mus musculus
  CDS (1)..(1365)
atggaggactacctgcaggactgtcgagccgctttgcaggattccaggcctctacatgtcgtgctgggaaatgaagcctgcgacttagactccatggtgtctgctctcgccttggccttctacctaacaaagacgtctgaagctgaagacatctttataccagttttaaatataaagcgttctgagcttcctctgcgcggggacaatgtcttctttctccaggaggttaagattccagagccagccctgatcttccgggacgagattgacctcctagccctgcaccaggctggccagctcaccctcatccttgttgaccaccatattttacccaaaagcgatgcagctctggaggaggccgtagcagaggtgctggaccaccgaccaattgagcagaaatactgtcctccctgtcacgtttcagttgagctggtggggtcctgtgccaccctggtgacagagagaatcctgcagggggcaccagagaccttggacagacaaactgcagccctactgcatggaaccatcatcctggactgtgtcaacatggataccaacattgggaaggcaaccccaaaggacagcaaatatgtggaagaactggaagcccttttcccagatctgcccaaaagaaaggacatatttgattccctgcagaaggccaagtttgacgtctcaggactgaccactgaacagatgctcagaaaggaccagaagacagtctacagacagggcaccaaggtggcaatcagtgcaatctacatggacttgaaggcctttctgcagcggacagacctcttcacagatctcagttctttctgccatgatcacagctatgatgccctggttgccatgactatctttttcaacactcaaaatgagccagtacggcaattagctatcttctgtccacacgaggcacttcgaatgacaatctgtggcatcctggaacgatccacctccccacccctgaagctgacacctatcccaagcacctcccctaacctccaggcctatcaccaaggcaacacccaggtctctcggaagaagctgctgcctgtgctccaggaagccctctccgcatatcttgactcagcgaagatggcttcggggcagtctgaggtagctgtgggtatgtctagggagcaggtggacaaggacttggacaaggcaagtaactccctgatttctgggctgagtcaagatgaggaagaccctccgctgccacccacgcctatgaacagcttggtggatgagtgccctctggatcaggggctgcctaagttctccgctgaggctgtctttgagaagtgcagtcagatctcactatcccagtctgccagagcctgcacatcaaataagtga

SEQ ID NO: 27024 - protein, 454 aa, Mus musculus
MEDYLQDCRAALQDSRPLHVVLGNEACDLDSMVSALALAFYLTKTSEAEDIFIPVLNIKRSELPLRGDNVFFLQEVKIPEPALIFRDEIDLLALHQAGQLTLILVDHHILPKSDAALEEAVAEVLDHRPIEQKYCPPCHVSVELVGSCATLVTERILQGAPETLDRQTAALLHGTIILDCVNMDTNIGKATPKDSKYVEELEALFPDLPKRKDIFDSLQKAKFDVSGLTTEQMLRKDQKTVYRQGTKVAISAIYMDLKAFLQRTDLFTDLSSFCHDHSYDALVAMTIFFNTQNEPVRQLAIFCPHEALRMTICGILERSTSPPLKLTPIPSTSPNLQAYHQGNTQVSRKKLLPVLQEALSAYLDSAKMASGQSEVAVGMSREQVDKDLDKASNSLISGLSQDEEDPPLPPTPMNSLVDECPLDQGLPKFSAEAVFEKCSQISLSQSARACTSNK

SEQ ID NO: 27025 - DNA, 921 bp, Shewanella oneidensis
  CDS (1)..(921)
atgcctatgtacgttgtcggtcacaaaatccccgattctgattcaatctgtggtgctatcgcgttagcttatttaaaaaaccaaatcggtgaagaagccgttgccgcacgtttaggtgagttatcacccgaaaccgctttcattctagagcgttttggctttgaagcaccagaatacaaaaccagttatgcaggcgagcaggtttacattgttgaccactctgaactgactcaagcgccggacgatatcgccaaagcgactatcgtgggtattgtggatcaccacaaactgggcgatctgaccactgataccccattagagtgctggatccgcccagttggttgcagcaacacagtgatcaaaatgatgtatgacttttaccaagtcgccatccctaaaaacatcgctggtattatgatgtgcgccatcctgagcgacactgtgatcttcaaatcgcccacctgcaccactgctgacattcgctgcgtagaagccttggccgaaatcgctggcatcgaagactataaagccctgggcatggaaatgttcaaagtgaaatcagccgttgaaggcacgccagcacgcgacctcgtgatgcgcgatttcaaagacttcaacatgaacggtaacttagtcggtatcggccagttagaagtgattgatctgtcagtctttgatgcaatcaaagccgaactagaagccgatatcaaagctctgaaagttgaaggcaaccgccacagcgtactgttactgctgaccgacatcatgaaagaaggctcagagctgttagtggtttcggatgatgccgaactgattaaccgtgcctacggtaaaactcctgtcgatggcaaagtgtggttagatggcgtattaagccgtaagaaacaagtggtaccacaactgcaagcagctttcgcttaa

SEQ ID NO: 27026 - protein, 306 aa, Shewanella oneidensis
MPMYVVGHKIPDSDSICGAIALAYLKNQIGEEAVAARLGELSPETAFILERFGFEAPEYKTSYAGEQVYIVDHSELTQAPDDIAKATIVGIVDHHKLGDLTTDTPLECWIRPVGCSNTVIKMMYDFYQVAIPKNIAGIMMCAILSDTVIFKSPTCTTADIRCVEALAEIAGIEDYKALGMEMFKVKSAVEGTPARDLVMRDFKDFNMNGNLVGIGQLEVIDLSVFDAIKAELEADIKALKVEGNRHSVLLLLTDIMKEGSELLVVSDDAELINRAYGKTPVDGKVWLDGVLSRKKQVVPQLQAAFA

SEQ ID NO: 27027 - DNA, 1131 bp, Plasmodium falciparum
  CDS (1)..(1131)
atgtcaagtaataataatttgaatgaggaagaagaaatattgtttttctatgaagatcccaaatcttttgatgagaaaaatttatatgaagtaaatcgagcaccatggttttatcatctgattaatgtcctgggattaactaaggacaattttatggaaataaaacatatggtagaagataaaaagaacaacatattgaatcttattaattataaatcatataccgataactatttgaaaaaaaatgacaccatgaaaaatatgttatgtgcatatttatattcttgtaaaacatcattatatgaatattctaaaaatataaattctgaacaaaatattcatttcgtttttacctttgggaatataacagcagatttggattcggtgtgctcatcaattatttatagtttttttttgttcatatggtactcattaaagacaaatttaattgggaaaaaaaaagacgaccccttaatgttttttatacctgttattaatattaagaagaatgatatgaaacttaaaatattgattatatggtggttggaaaaatgtgggattgaaaatcctgaggagcttctaatatttaatgatgacctaaatttattagaagttttaaaaaatgatactaagtatgatacctgtttggtcgattttaacaagtcagaaaataactgcgtatataatataaataatataaaatcgattatcgaccatcacatattaaatgaagaaatgaaaaataaaaaaataaccaaatctgtgtttccaatatatgtgtgtagctgtatggttataatagcttatttttataaatattcgagtgaatttctaggaatttctcttttgaatagagatataatgtggctaatatatggaacaatgttaaaagattctaataattttccaaaagatgattttcgtaaaagatggatacaatcggatttaaatatttatttatctatgaagaaatattttagaatacctgatataatggatatatatattacacagaaatttaataatatcagattttcaatcgacctaaaaaaatttggaatagagaatttattatttgttgattacaaggattataattatgacatccaagggaaaaaattcactgtatga

SEQ ID NO: 27028 - protein, 376 aa, Plasmodium falciparum
MSSNNNLNEEEEILFFYEDPKSFDEKNLYEVNRAPWFYHLINVLGLTKDNFMEIKHMVEDKKNNILNLINYKSYTDNYLKKNDTMKNMLCAYLYSCKTSLYEYSKNINSEQNIHFVFTFGNITADLDSVCSSIIYSFFLFIWYSLKTNLIGKKKDDPLMFFIPVINIKKNDMKLKILIIWWLEKCGIENPEELLIFNDDLNLLEVLKNDTKYDTCLVDFNKSENNCVYNINNIKSIIDHHILNEEMKNKKITKSVFPIYVCSCMVIIAYFYKYSSEFLGISLLNRDIMWLIYGTMLKDSNNFPKDDFRKRWIQSDLNIYLSMKKYFRIPDIMDIYITQKFNNIRFSIDLKKFGIENLLFVDYKDYNYDIQGKKFTV

SEQ ID NO: 27029 - DNA, 24 bp, Primer
atgtcgcctttgagaaagacggtt

SEQ ID NO: 27030 - DNA, 23 bp, Primer
tcactcttccaggtttgagtacg

SEQ ID NO: 27031 - DNA, 354 bp, Saccharomyces cerevisiae; identical to SEQ ID NO: 14354
  CDS (1)..(354)

SEQ ID NO: 27032 - protein, 117 aa, Saccharomyces cerevisiae; identical to SEQ ID NO: 14355

SEQ ID NO: 27033 - DNA, 23 bp, Primer
atggcggttgcgatcaaaaagga

SEQ ID NO: 27034 - DNA, 28 bp, Primer
tcaattgataaatgtactttcaatgatg

SEQ ID NO: 27035 - DNA, 1470 bp, Saccharomyces cerevisiae; identical to SEQ ID NO: 3866
  CDS (1)..(1470)

SEQ ID NO: 27036 - protein, 489 aa, Saccharomyces cerevisiae; identical to SEQ ID NO: 3867

SEQ ID NO: 27037 - DNA, 1215 bp, Bacillus subtilis; identical to SEQ ID NO: 3868
  CDS (1)..(1215)

SEQ ID NO: 27038 - protein, 404 aa, Bacillus subtilis; identical to SEQ ID NO: 3869

SEQ ID NO: 27039 - DNA, 1224 bp, Methanobacterium thermoautotrophicum; identical to SEQ ID NO: 3870
  CDS (1)..(1224)

SEQ ID NO: 27040 - protein, 407 aa, Methanobacterium thermoautotrophicum; identical to SEQ ID NO: 3871

SEQ ID NO: 27041 - DNA, 1176 bp, Archaeoglobus fulgidus; identical to SEQ ID NO: 3872
  CDS (1)..(1176)

SEQ ID NO: 27042 - protein, 391 aa, Archaeoglobus fulgidus; identical to SEQ ID NO: 3873

SEQ ID NO: 27043 - DNA, 1479 bp, Xylella fastidiosa; identical to SEQ ID NO: 3874
  CDS (1)..(1479)

SEQ ID NO: 27044 - protein, 492 aa, Xylella fastidiosa; identical to SEQ ID NO: 3875

SEQ ID NO: 27045 - DNA, 1545 bp, Arabidopsis thaliana (mouse-ear cress); identical to SEQ ID NO: 3876
  CDS (1)..(1545)

SEQ ID NO: 27046 - protein, 514 aa, Arabidopsis thaliana (mouse-ear cress); identical to SEQ ID NO: 3877

SEQ ID NO: 27047 - DNA, 1287 bp, Salmonella enterica subsp. enterica serovar Typhi; identical to SEQ ID NO: 3878
  CDS (1)..(1287)

SEQ ID NO: 27048 - protein, 428 aa, Salmonella enterica subsp. enterica serovar Typhi; identical to SEQ ID NO: 3879

SEQ ID NO: 27049 - DNA, 1206 bp, Listeria monocytogenes; identical to SEQ ID NO: 3880
  CDS (1)..(1206)

SEQ ID NO: 27050 - protein, 401 aa, Listeria monocytogenes; identical to SEQ ID NO: 3881

SEQ ID NO: 27051 - DNA, 1413 bp, Nostoc sp. PCC 7120; identical to SEQ ID NO: 3882
  CDS (1)..(1413)

SEQ ID NO: 27052 - protein, 470 aa, Nostoc sp. PCC 7120; identical to SEQ ID NO: 3883

SEQ ID NO: 27053 - DNA, 1296 bp, Yersinia pestis; identical to SEQ ID NO: 3884
  CDS (1)..(1296)

SEQ ID NO: 27054 - protein, 431 aa, Yersinia pestis; identical to SEQ ID NO: 3885

SEQ ID NO: 27055 - DNA, 1206 bp, Listeria innocua; identical to SEQ ID NO: 3886
  CDS (1)..(1206)

SEQ ID NO: 27056 - protein, 401 aa, Listeria innocua; identical to SEQ ID NO: 3887

SEQ ID NO: 27057 - DNA, 1320 bp, Deinococcus radiodurans; identical to SEQ ID NO: 3888
  CDS (1)..(1320)

SEQ ID NO: 27058 - protein, 439 aa, Deinococcus radiodurans; identical to SEQ ID NO: 3889

SEQ ID NO: 27059 - DNA, 1266 bp, Bacillus halodurans; identical to SEQ ID NO: 3890
  CDS (1)..(1266)

SEQ ID NO: 27060 - protein, 421 aa, Bacillus halodurans; identical to SEQ ID NO: 3891

SEQ ID NO: 27061 - DNA, 1239 bp, Methanobacterium thermoautotrophicum; identical to SEQ ID NO: 3892
  CDS (1)..(1239)

SEQ ID NO: 27062 - protein, 412 aa, Methanobacterium thermoautotrophicum; identical to SEQ ID NO: 3893

SEQ ID NO: 27063 - DNA, 1305 bp, Neisseria meningitidis; identical to SEQ ID NO: 3894
  CDS (1)..(1305)

SEQ ID NO: 27064 - protein, 434 aa, Neisseria meningitidis; identical to SEQ ID NO: 3895

SEQ ID NO: 27065 - DNA, 1329 bp, Pseudomonas aeruginosa; identical to SEQ ID NO: 3896
  CDS (1)..(1329)

SEQ ID NO: 27066 - protein, 442 aa, Pseudomonas aeruginosa; identical to SEQ ID NO: 3897

SEQ ID NO: 27067 - DNA, 1533 bp, Caulobacter crescentus; identical to SEQ ID NO: 3898
  CDS (1)..(1533)

SEQ ID NO: 27068 - protein, 510 aa, Caulobacter crescentus; identical to SEQ ID NO: 3899

SEQ ID NO: 27069 - DNA, 1167 bp, Archaeoglobus fulgidus; identical to SEQ ID NO: 3900
  CDS (1)..(1167)

SEQ ID NO: 27070 - protein, 388 aa, Archaeoglobus fulgidus; identical to SEQ ID NO: 3901

SEQ ID NO: 27071 - DNA, 1533 bp, Ureaplasma urealyticum; identical to SEQ ID NO: 3902
  CDS (1)..(1533)

SEQ ID NO: 27072 - protein, 510 aa, Ureaplasma urealyticum; identical to SEQ ID NO: 3903

SEQ ID NO: 27073 - DNA, 1566 bp, Ureaplasma urealyticum; identical to SEQ ID NO: 3904
  CDS (1)..(1566)

SEQ ID NO: 27074 - protein, 521 aa, Ureaplasma urealyticum; identical to SEQ ID NO: 3905

SEQ ID NO: 27075 - DNA, 1530 bp, Sulfolobus solfataricus; identical to SEQ ID NO: 3906
  CDS (1)..(1530)

SEQ ID NO: 27076 - protein, 509 aa, Sulfolobus solfataricus; identical to SEQ ID NO: 3907

SEQ ID NO: 27077 - DNA, 1272 bp, Aquifex aeolicus; identical to SEQ ID NO: 3908
  CDS (1)..(1272)

SEQ ID NO: 27078 - protein, 423 aa, Aquifex aeolicus; identical to SEQ ID NO: 3909

SEQ ID NO: 27079 - DNA, 1434 bp, Mycobacterium tuberculosis; identical to SEQ ID NO: 3910
  CDS (1)..(1434)

SEQ ID NO: 27080 - protein, 477 aa, Mycobacterium tuberculosis; identical to SEQ ID NO: 3911

SEQ ID NO: 27081 - DNA, 1308 bp, Thermotoga maritima; identical to SEQ ID NO: 3912
  CDS (1)..(1308)

SEQ ID NO: 27082 - protein, 435 aa, Thermotoga maritima; identical to SEQ ID NO: 3913

SEQ ID NO: 27083 - DNA, 1242 bp, Lactococcus lactis subsp. lactis; identical to SEQ ID NO: 3914
  CDS (1)..(1242)

SEQ ID NO: 27084 - protein, 413 aa, Lactococcus lactis subsp. lactis; identical to SEQ ID NO: 3915

SEQ ID NO: 27085 - DNA, 1218 bp, Clostridium acetobutylicum; identical to SEQ ID NO: 3916
  CDS (1)..(1218)

SEQ ID NO: 27086 - protein, 405 aa, Clostridium acetobutylicum; identical to SEQ ID NO: 3917

SEQ ID NO: 27087 - DNA, 1350 bp, Agrobacterium tumefaciens; identical to SEQ ID NO: 3918
  CDS (1)..(1350)

SEQ ID NO: 27088 - protein, 449 aa, Agrobacterium tumefaciens; identical to SEQ ID NO: 3919

SEQ ID NO: 27089 - DNA, 1479 bp, Saccharomyces cerevisiae; identical to SEQ ID NO: 3920
  CDS (1)..(1479)

SEQ ID NO: 27090 - protein, 492 aa, Saccharomyces cerevisiae; identical to SEQ ID NO: 3921

SEQ ID NO: 27091 - DNA, 1500 bp, Saccharomyces cerevisiae; identical to SEQ ID NO: 3922
  CDS (1)..(1500)

SEQ ID NO: 27092 - protein, 499 aa, Saccharomyces cerevisiae; identical to SEQ ID NO: 3923

SEQ ID NO: 27093 - DNA, 1524 bp, Synechocystis sp.; identical to SEQ ID NO: 3924
  CDS (1)..(1524)

SEQ ID NO: 27094 - protein, 507 aa, Synechocystis sp.; identical to SEQ ID NO: 3925

SEQ ID NO: 27095 - DNA, 1602 bp, Oryza sativa (rice); identical to SEQ ID NO: 3926
  CDS (1)..(1602)

SEQ ID NO: 27096 - protein, 533 aa, Oryza sativa (rice); identical to SEQ ID NO: 3927

SEQ ID NO: 27097 - DNA, 1515 bp, Arabidopsis thaliana (mouse-ear cress); identical to SEQ ID NO: 3928
  CDS (1)..(1515)

SEQ ID NO: 27098 - protein, 504 aa, Arabidopsis thaliana (mouse-ear cress); identical to SEQ ID NO: 3929

SEQ ID NO: 27099 - DNA, 1545 bp, Lycopersicon esculentum (tomato); identical to SEQ ID NO: 3930
  CDS (1)..(1545)

SEQ ID NO: 27100 - protein, 514 aa, Lycopersicon esculentum (tomato); identical to SEQ ID NO: 3931

SEQ ID NO: 27101 - DNA, 1506 bp, Arabidopsis thaliana (mouse-ear cress); identical to SEQ ID NO: 3932
  CDS (1)..(1506)

SEQ ID NO: 27102 - protein, 501 aa, Arabidopsis thaliana (mouse-ear cress); identical to SEQ ID NO: 3933

SEQ ID NO: 27103 - DNA, 1605 bp, Caenorhabditis elegans; identical to SEQ ID NO: 3934
  CDS (1)..(1605)

SEQ ID NO: 27104 - protein, 534 aa, Caenorhabditis elegans; identical to SEQ ID NO: 3935

SEQ ID NO: 27105 - DNA, 1347 bp, Streptomyces coelicolor; identical to SEQ ID NO: 3936
  CDS (1)..(1347)

SEQ ID NO: 27106 - protein, 448 aa, Streptomyces coelicolor; identical to SEQ ID NO: 3937

SEQ ID NO: 27107 - DNA, 1539 bp, Schizosaccharomyces pombe; identical to SEQ ID NO: 3938
  CDS (1)..(1539)

SEQ ID NO: 27108 - protein, 512 aa, Schizosaccharomyces pombe; identical to SEQ ID NO: 3939

SEQ ID NO: 27109 - DNA, 1425 bp, Rhizobium etli; identical to SEQ ID NO: 3940
  CDS (1)..(1425)

SEQ ID NO: 27110 - protein, 474 aa, Rhizobium etli; identical to SEQ ID NO: 3941

SEQ ID NO: 27111 - DNA, 1311 bp, Azotobacter vinelandii; identical to SEQ ID NO: 3942
  CDS (1)..(1311)

SEQ ID NO: 27112 - protein, 436 aa, Azotobacter vinelandii; identical to SEQ ID NO: 3943

SEQ ID NO: 27113 - DNA, 1482 bp, Azorhizobium caulinodans; identical to SEQ ID NO: 3944
  CDS (1)..(1482)

SEQ ID NO: 27114 - protein, 493 aa, Azorhizobium caulinodans; identical to SEQ ID NO: 3945

SEQ ID NO: 27115 - DNA, 1317 bp, Azospirillum brasilense; identical to SEQ ID NO: 3946
  CDS (1)..(1317)

SEQ ID NO: 27116 - protein, 438 aa, Azospirillum brasilense; identical to SEQ ID NO: 3947

SEQ ID NO: 27117 - DNA, 1314 bp, Wolinella succinogenes; identical to SEQ ID NO: 3948
  CDS (1)..(1314)

SEQ ID NO: 27118 - protein, 437 aa, Wolinella succinogenes; identical to SEQ ID NO: 3949

SEQ ID NO: 27119 - DNA, 1320 bp, Photorhabdus luminescens (subsp. laumondii); identical to SEQ ID NO: 3950
  CDS (1)..(1320)

SEQ ID NO: 27120 - protein, 439 aa, Photorhabdus luminescens (subsp. laumondii); identical to SEQ ID NO: 3951

SEQ ID NO: 27121 - DNA, 1437 bp, Gloeobacter violaceus; identical to SEQ ID NO: 3952
  CDS (1)..(1437)

SEQ ID NO: 27122 - protein, 478 aa, Gloeobacter violaceus; identical to SEQ ID NO: 3953

SEQ ID NO: 27123 - DNA, 1311 bp, Chromobacterium violaceum; identical to SEQ ID NO: 3954
  CDS (1)..(1311)

SEQ ID NO: 27124 - protein, 436 aa, Chromobacterium violaceum; identical to SEQ ID NO: 3955

SEQ ID NO: 27125 - DNA, 1479 bp, Neurospora crassa; identical to SEQ ID NO: 3956
  CDS (1)..(1479)

SEQ ID NO: 27126 - protein, 492 aa, Neurospora crassa; identical to SEQ ID NO: 3957

SEQ ID NO: 27127 - DNA, 1365 bp, Neurospora crassa; identical to SEQ ID NO: 3958
  CDS (1)..(1365)

SEQ ID NO: 27128 - protein, 454 aa, Neurospora crassa; identical to SEQ ID NO: 3959

SEQ ID NO: 27129 - DNA, 1533 bp, Neurospora crassa; identical to SEQ ID NO: 3960
  CDS (1)..(1533)

SEQ ID NO: 27130 - protein, 510 aa, Neurospora crassa; identical to SEQ ID NO: 3961

SEQ ID NO: 27131 - DNA, 1473 bp, Synechococcus sp. (strain WH8102); identical to SEQ ID NO: 3962
  CDS (1)..(1473)

SEQ ID NO: 27132 - protein, 490 aa, Synechococcus sp. (strain WH8102); identical to SEQ ID NO: 3963

SEQ ID NO: 27133 - DNA, 1590 bp, Rhodopirellula baltica; identical to SEQ ID NO: 3964
  CDS (1)..(1590)

SEQ ID NO: 27134 - protein, 529 aa, Rhodopirellula baltica; identical to SEQ ID NO: 3965

SEQ ID NO: 27135 - DNA, 1479 bp, Prochlorococcus marinus (strain MIT 9313); identical to SEQ ID NO: 3966
  CDS (1)..(1479)

SEQ ID NO: 27136 - protein, 492 aa, Prochlorococcus marinus (strain MIT 9313); identical to SEQ ID NO: 3967

SEQ ID NO: 27137 - DNA, 1509 bp, Prochlorococcus marinus; identical to SEQ ID NO: 3968
  CDS (1)..(1509)

SEQ ID NO: 27138 - protein, 502 aa, Prochlorococcus marinus; identical to SEQ ID NO: 3969

SEQ ID NO: 27139 - DNA, 1497 bp, Oryza sativa (Rice); identical to SEQ ID NO: 3970
  CDS (1)..(1497)

SEQ ID NO: 27140 - protein, 498 aa, Oryza sativa (Rice); identical to SEQ ID NO: 3971

SEQ ID NO: 27141 - DNA, 1557 bp, Lotus japonicus; identical to SEQ ID NO: 3972
  CDS (1)..(1557)

SEQ ID NO: 27142 - protein, 518 aa, Lotus japonicus; identical to SEQ ID NO: 3973

SEQ ID NO: 27143 - DNA, 1233 bp, Bacillus cereus (strain ATCC 14579 / DSM 31); identical to SEQ ID NO: 3974
  CDS (1)..(1233)

SEQ ID NO: 27144 - protein, 410 aa, Bacillus cereus (strain ATCC 14579 / DSM 31); identical to SEQ ID NO: 3975

SEQ ID NO: 27145 - DNA, 1311 bp, Streptomyces avermitilis; identical to SEQ ID NO: 3976
  CDS (1)..(1311)

SEQ ID NO: 27146 - protein, 436 aa, Streptomyces avermitilis; identical to SEQ ID NO: 3977

SEQ ID NO: 27147 - DNA, 1341 bp, Streptomyces avermitilis; identical to SEQ ID NO: 3978
  CDS (1)..(1341)

SEQ ID NO: 27148 - protein, 446 aa, Streptomyces avermitilis; identical to SEQ ID NO: 3979

SEQ ID NO: 27149 - DNA, 1461 bp, Oryza sativa (japonica cultivar-group); identical to SEQ ID NO: 3980
  CDS (1)..(1461)

SEQ ID NO: 27150 - protein, 486 aa, Oryza sativa (japonica cultivar-group); identical to SEQ ID NO: 3981

SEQ ID NO: 27151 - DNA, 1440 bp, Oryza sativa (japonica cultivar-group); identical to SEQ ID NO: 3982
  CDS (1)..(1440)

SEQ ID NO: 27152 - protein, 479 aa, Oryza sativa (japonica cultivar-group); identical to SEQ ID NO: 3983

SEQ ID NO: 27153 - DNA, 1455 bp, Xylella fastidiosa (strain Temecula1 / ATCC 700964); identical to SEQ ID NO: 3984
  CDS (1)..(1455)

SEQ ID NO: 27154 - protein, 484 aa, Xylella fastidiosa (strain Temecula1 / ATCC 700964); identical to SEQ ID NO: 3985

SEQ ID NO: 27155 - DNA, 1326 bp, Pseudomonas syringae (pv. tomato); identical to SEQ ID NO: 3986
  CDS (1)..(1326)

SEQ ID NO: 27156 - protein, 441 aa, Pseudomonas syringae (pv. tomato); identical to SEQ ID NO: 3987

SEQ ID NO: 27157 - DNA, 1338 bp, Pseudomonas syringae (pv. tomato); identical to SEQ ID NO: 3988
  CDS (1)..(1338)

SEQ ID NO: 27158 - protein, 445 aa, Pseudomonas syringae (pv. tomato); identical to SEQ ID NO: 3989

SEQ ID NO: 27159 - DNA, 1332 bp, Pseudomonas putida (strain KT2440); identical to SEQ ID NO: 3990
  CDS (1)..(1332)

SEQ ID NO: 27160 - protein, 443 aa, Pseudomonas putida (strain KT2440); identical to SEQ ID NO: 3991

SEQ ID NO: 27161 - DNA, 1317 bp, Lactobacillus plantarum; identical to SEQ ID NO: 3992
  CDS (1)..(1317)

SEQ ID NO: 27162 - protein, 438 aa, Lactobacillus plantarum; identical to SEQ ID NO: 3993

SEQ ID NO: 27163 - DNA, 1533 bp, Bradyrhizobium japonicum; identical to SEQ ID NO: 3994
  CDS (1)..(1533)

SEQ ID NO: 27164 - protein, 510 aa, Bradyrhizobium japonicum; identical to SEQ ID NO: 3995

SEQ ID NO: 27165 - DNA, 1251 bp, Staphylococcus epidermidis; identical to SEQ ID NO: 3996
  CDS (1)..(1251)

SEQ ID NO: 27166 - protein, 416 aa, Staphylococcus epidermidis; identical to SEQ ID NO: 3997

SEQ ID NO: 27167 - DNA, 1236 bp, Streptococcus mutans; identical to SEQ ID NO: 3998
  CDS (1)..(1236)

SEQ ID NO: 27168 - protein, 411 aa, Streptococcus mutans; identical to SEQ ID NO: 3999

SEQ ID NO: 27169 - DNA, 1371 bp, Oceanobacillus iheyensis; identical to SEQ ID NO: 4000
  CDS (1)..(1371)

SEQ ID NO: 27170 - protein, 456 aa, Oceanobacillus iheyensis; identical to SEQ ID NO: 4001

SEQ ID NO: 27171 - DNA, 1293 bp, Leptospira interrogans; identical to SEQ ID NO: 4002
  CDS (1)..(1293)

SEQ ID NO: 27172 - protein, 430 aa, Leptospira interrogans; identical to SEQ ID NO: 4003

SEQ ID NO: 27173 - DNA, 1287 bp, Escherichia coli O6; identical to SEQ ID NO: 4004
  CDS (1)..(1287)

SEQ ID NO: 27174 - protein, 428 aa, Escherichia coli O6; identical to SEQ ID NO: 4005

SEQ ID NO: 27175 - DNA, 1326 bp, Corynebacterium efficiens; identical to SEQ ID NO: 4006
  CDS (1)..(1326)

SEQ ID NO: 27176 - protein, 441 aa, Corynebacterium efficiens; identical to SEQ ID NO: 4007

SEQ ID NO: 27177 - DNA, 1320 bp, Corynebacterium efficiens; identical to SEQ ID NO: 4008
  CDS (1)..(1320)

SEQ ID NO: 27178 - protein, 439 aa, Corynebacterium efficiens; identical to SEQ ID NO: 4009

SEQ ID NO: 27179 - DNA, 1302 bp, Brucella suis; identical to SEQ ID NO: 4010
  CDS (1)..(1302)

SEQ ID NO: 27180 - protein, 433 aa, Brucella suis; identical to SEQ ID NO: 4011

SEQ ID NO: 27181 - DNA, 1296 bp, Bifidobacterium longum; identical to SEQ ID NO: 4012
  CDS (1)..(1296)

SEQ ID NO: 27182 - protein, 431 aa, Bifidobacterium longum; identical to SEQ ID NO: 4013

SEQ ID NO: 27183 - DNA, 1392 bp, Acetobacter diazotrophicus (Gluconacetobacter diazotrophicus); identical to SEQ ID NO: 4014
  CDS (1)..(1392)

SEQ ID NO: 27184 - protein, 463 aa, Acetobacter diazotrophicus (Gluconacetobacter diazotrophicus); identical to SEQ ID NO: 4015

SEQ ID NO: 27185 - DNA, 1818 bp, Medicago truncatula (Barrel medic); identical to SEQ ID NO: 4016
  CDS (47)..(1531)

SEQ ID NO: 27186 - protein, 494 aa, Medicago truncatula (Barrel medic); identical to SEQ ID NO: 4017

SEQ ID NO: 27187 - DNA, 1654 bp, Phytophthora infestans (Potato late blight fungus); identical to SEQ ID NO: 4018
  CDS (16)..(1572)

SEQ ID NO: 27188 - protein, 518 aa, Phytophthora infestans (Potato late blight fungus); identical to SEQ ID NO: 4019

SEQ ID NO: 27189 - DNA, 1332 bp, Chlorobium tepidum; identical to SEQ ID NO: 4020
  CDS (1)..(1332)

SEQ ID NO: 27190 - protein, 443 aa, Chlorobium tepidum; identical to SEQ ID NO: 4021

SEQ ID NO: 27191 - DNA, 2716 bp, Chlamydomonas reinhardtii; identical to SEQ ID NO: 4022
  CDS (26)..(1654)

SEQ ID NO: 27192 - protein, 542 aa, Chlamydomonas reinhardtii; identical to SEQ ID NO: 4023

SEQ ID NO: 27193 - DNA, 2568 bp, Chlamydomonas reinhardtii; identical to SEQ ID NO: 4024
  CDS (106)..(1845)

SEQ ID NO: 27194 - protein, 579 aa, Chlamydomonas reinhardtii; identical to SEQ ID NO: 4025

SEQ ID NO: 27195 - DNA, 1296 bp, Dictyostelium discoideum (Slime mold); identical to SEQ ID NO: 4026
  CDS (1)..(1296)

SEQ ID NO: 27196 - protein, 431 aa, Dictyostelium discoideum (Slime mold); identical to SEQ ID NO: 4027

SEQ ID NO: 27197 - DNA, 1434 bp, Hebeloma cylindrosporum; identical to SEQ ID NO: 4028
  CDS (1)..(1434)

SEQ ID NO: 27198 - protein, 477 aa, Hebeloma cylindrosporum; identical to SEQ ID NO: 4029

SEQ ID NO: 27199 - DNA, 1251 bp, Staphylococcus aureus (strain MW2); identical to SEQ ID NO: 4030
  CDS (1)..(1251)

SEQ ID NO: 27200 - protein, 416 aa, Staphylococcus aureus (strain MW2); identical to SEQ ID NO: 4031

SEQ ID NO: 27201 - DNA, 1476 bp, Xanthomonas campestris (pv. campestris); identical to SEQ ID NO: 4032
  CDS (1)..(1476)

SEQ ID NO: 27202 - protein, 491 aa, Xanthomonas campestris (pv. campestris); identical to SEQ ID NO: 4033

SEQ ID NO: 27203 - DNA, 1365 bp, Azoarcus sp. BH72; identical to SEQ ID NO: 4034
  CDS (1)..(1365)

SEQ ID NO: 27204 - protein, 454 aa, Azoarcus sp. BH72; identical to SEQ ID NO: 4035

SEQ ID NO: 27205 - DNA, 1430 bp, Azoarcus sp. BH72; identical to SEQ ID NO: 4036
  CDS (24)..(1430)

SEQ ID NO: 27206 - protein, 468 aa, Azoarcus sp. BH72; identical to SEQ ID NO: 4037

SEQ ID NO: 27207 - DNA, 1317 bp, Pseudomonas stutzeri (Pseudomonas perfectomarina); identical to SEQ ID NO: 4038
  CDS (1)..(1317)

SEQ ID NO: 27208 - protein, 438 aa, Pseudomonas stutzeri (Pseudomonas perfectomarina); identical to SEQ ID NO: 4039

SEQ ID NO: 27209 - DNA, 2195 bp, Chlamydomonas reinhardtii; identical to SEQ ID NO: 4040
  CDS (28)..(1647)

SEQ ID NO: 27210 - protein, 539 aa, Chlamydomonas reinhardtii; identical to SEQ ID NO: 4041

SEQ ID NO: 27211 - DNA, 1494 bp, Oryza sativa (japonica cultivar-group); identical to SEQ ID NO: 4042
  CDS (1)..(1494)

SEQ ID NO: 27212 - protein, 497 aa, Oryza sativa (japonica cultivar-group); identical to SEQ ID NO: 4043

SEQ ID NO: 27213 - DNA, 1883 bp, Oryza sativa (japonica cultivar-group); identical to SEQ ID NO: 4044
  CDS (87)..(1580)

SEQ ID NO: 27214 - protein, 497 aa, Oryza sativa (japonica cultivar-group); identical to SEQ ID NO: 4045

SEQ ID NO: 27215 - DNA, 1437 bp, Emericella nidulans (Aspergillus nidulans); identical to SEQ ID NO: 4046
  CDS (1)..(1437)

SEQ ID NO: 27216 - protein, 478 aa, Emericella nidulans (Aspergillus nidulans); identical to SEQ ID NO: 4047

SEQ ID NO: 27217 - DNA, 1635 bp, Emericella nidulans (Aspergillus nidulans); identical to SEQ ID NO: 4048
  CDS (1)..(1635)

SEQ ID NO: 27218 - protein, 544 aa, Emericella nidulans (Aspergillus nidulans); identical to SEQ ID NO: 4049

SEQ ID NO: 27219 - DNA, 1215 bp, Methanosarcina acetivorans; identical to SEQ ID NO: 4050
  CDS (1)..(1215)

SEQ ID NO: 27220 - protein, 404 aa, Methanosarcina acetivorans; identical to SEQ ID NO: 4051

SEQ ID NO: 27221 - DNA, 1209 bp, Methanosarcina acetivorans; identical to SEQ ID NO: 4052
  CDS (1)..(1209)

SEQ ID NO: 27222 - protein, 402 aa, Methanosarcina acetivorans; identical to SEQ ID NO: 4053

SEQ ID NO: 27223 - DNA, 2239 bp, Methanosarcina mazei (Methanosarcina frisia); identical to SEQ ID NO: 4054
  CDS (537)..(1730)

SEQ ID NO: 27224 - protein, 397 aa, Methanosarcina mazei (Methanosarcina frisia); identical to SEQ ID NO: 4055

SEQ ID NO: 27225 - DNA, 1446 bp, Neurospora crassa; identical to SEQ ID NO: 4056
  CDS (1)..(1446)

SEQ ID NO: 27226 - protein, 481 aa, Neurospora crassa; identical to SEQ ID NO: 4057

SEQ ID NO: 27227 - DNA, 2689 bp, Tuber borchii (White truffle); identical to SEQ ID NO: 4058
  CDS (386)..(1837)

SEQ ID NO: 27228 - protein, 483 aa, Tuber borchii (White truffle); identical to SEQ ID NO: 4059

SEQ ID NO: 27229 - DNA, 1311 bp, Ralstonia solanacearum (Pseudomonas solanacearum); identical to SEQ ID NO: 4060
  CDS (1)..(1311)

SEQ ID NO: 27230 - protein, 436 aa, Ralstonia solanacearum (Pseudomonas solanacearum); identical to SEQ ID NO: 4061

SEQ ID NO: 27231 - DNA, 1356 bp, Rhizobium meliloti (Sinorhizobium meliloti); identical to SEQ ID NO: 4062
  CDS (1)..(1356)

SEQ ID NO: 27232 - protein, 451 aa, Rhizobium meliloti (Sinorhizobium meliloti); identical to SEQ ID NO: 4063

SEQ ID NO: 27233 - DNA, 1655 bp, Lotus japonicus; identical to SEQ ID NO: 4064
  CDS (37)..(1497)

SEQ ID NO: 27234 - protein, 486 aa, Lotus japonicus; identical to SEQ ID NO: 4065

SEQ ID NO: 27235 - DNA, 1497 bp, Oryza sativa (Rice); identical to SEQ ID NO: 4066
  CDS (1)..(1497)

SEQ ID NO: 27236 - protein, 498 aa, Oryza sativa (Rice); identical to SEQ ID NO: 4067

SEQ ID NO: 27237 - DNA, 1479 bp, Hebeloma cylindrosporum; identical to SEQ ID NO: 4068
  CDS (1)..(1479)

SEQ ID NO: 27238 - protein, 492 aa, Hebeloma cylindrosporum; identical to SEQ ID NO: 4069

SEQ ID NO: 27239 - DNA, 1416 bp, Hebeloma cylindrosporum; identical to SEQ ID NO: 4070
  CDS (1)..(1416)

SEQ ID NO: 27240 - protein, 471 aa, Hebeloma cylindrosporum; identical to SEQ ID NO: 4071

SEQ ID NO: 27241 - DNA, 1771 bp, Ustilago maydis (Smut fungus); identical to SEQ ID NO: 4072
  CDS (149)..(1735)

SEQ ID NO: 27242 - protein, 528 aa, Ustilago maydis (Smut fungus); identical to SEQ ID NO: 4073

SEQ ID NO: 27243 - DNA, 1557 bp, Sulfolobus tokodaii; identical to SEQ ID NO: 4074
  CDS (1)..(1557)

SEQ ID NO: 27244 - protein, 518 aa, Sulfolobus tokodaii; identical to SEQ ID NO: 4075

SEQ ID NO: 27245 - DNA, 1356 bp, Rhizobium loti (Mesorhizobium loti); identical to SEQ ID NO: 4076
  CDS (1)..(1356)

SEQ ID NO: 27246 - protein, 451 aa, Rhizobium loti (Mesorhizobium loti); identical to SEQ ID NO: 4077

SEQ ID NO: 27247 - DNA, 1296 bp, Rhodospirillum rubrum; identical to SEQ ID NO: 4078
  CDS (1)..(1296)

SEQ ID NO: 27248 - protein, 431 aa, Rhodospirillum rubrum; identical to SEQ ID NO: 4079

SEQ ID NO: 27249 - DNA, 1473 bp, Dictyostelium discoideum (Slime mold); identical to SEQ ID NO: 4080
  CDS (37)..(1428)

SEQ ID NO: 27250 - protein, 463 aa, Dictyostelium discoideum (Slime mold); identical to SEQ ID NO: 4081

SEQ ID NO: 27251 - DNA, 1494 bp, Schizosaccharomyces pombe (Fission yeast); identical to SEQ ID NO: 4082
  CDS (1)..(1494)

SEQ ID NO: 27252 - protein, 497 aa, Schizosaccharomyces pombe (Fission yeast); identical to SEQ ID NO: 4083

SEQ ID NO: 27253 - DNA, 1797 bp, Lotus japonicus; identical to SEQ ID NO: 4084
  CDS (76)..(1581)

SEQ ID NO: 27254 - protein, 501 aa, Lotus japonicus; identical to SEQ ID NO: 4085

SEQ ID NO: 27255 - DNA, 1491 bp, Arabidopsis thaliana (Mouse-ear cress); identical to SEQ ID NO: 4086
  CDS (1)..(1491)

SEQ ID NO: 27256 - protein, 496 aa, Arabidopsis thaliana (Mouse-ear cress); identical to SEQ ID NO: 4087

SEQ ID NO: 27257 - DNA, 1554 bp, Schizosaccharomyces pombe (Fission yeast); identical to SEQ ID NO: 4088
  CDS (1)..(1554)

SEQ ID NO: 27258 - protein, 517 aa, Schizosaccharomyces pombe (Fission yeast); identical to SEQ ID NO: 4089

SEQ ID NO: 27259 - DNA, 1476 bp, Xanthomonas axonopodis (pv. citri), and; identical to SEQ ID NO: 4090
  CDS (1)..(1476)

SEQ ID NO: 27260 - protein, 491 aa, Xanthomonas axonopodis (pv. citri), and; identical to SEQ ID NO: 4091

SEQ ID NO: 27261 - DNA, 1482 bp, Prochlorococcus sp. (strain PCC 9511); identical to SEQ ID NO: 4092
  CDS (1)..(1482)

SEQ ID NO: 27262 - protein, 493 aa, Prochlorococcus sp. (strain PCC 9511); identical to SEQ ID NO: 4093

SEQ ID NO: 27263 - DNA, 1317 bp, Corynebacterium glutamicum (Brevibacterium flavum); identical to SEQ ID NO: 4094
  CDS (1)..(1317)

SEQ ID NO: 27264 - protein, 438 aa, Corynebacterium glutamicum (Brevibacterium flavum); identical to SEQ ID NO: 4095

SEQ ID NO: 27265 - DNA, 1690 bp, Ustilago violacea (Smut fungus) (Microbotryum violaceum); identical to SEQ ID NO: 4096
  CDS (19)..(1500)

SEQ ID NO: 27266 - protein, 493 aa, Ustilago violacea (Smut fungus) (Microbotryum violaceum); identical to SEQ ID NO: 4097

SEQ ID NO: 27267 - DNA, 1658 bp, Arabidopsis thaliana (Mouse-ear cress); identical to SEQ ID NO: 4098
  CDS (63)..(1490): n means a or g or c or t/u

SEQ ID NO: 27268 - protein, 475 aa, Arabidopsis thaliana (Mouse-ear cress); identical to SEQ ID NO: 4099

SEQ ID NO: 27269 - DNA, 1359 bp, Corynebacterium glutamicum (Brevibacterium flavum); identical to SEQ ID NO: 4100
  CDS (1)..(1359)

SEQ ID NO: 27270 - protein, 452 aa, Corynebacterium glutamicum (Brevibacterium flavum); identical to SEQ ID NO: 4101

SEQ ID NO: 27271 - DNA, 1751 bp, Lycopersicon esculentum (Tomato); identical to SEQ ID NO: 4102
  CDS (56)..(1522)

SEQ ID NO: 27272 - protein, 488 aa, Lycopersicon esculentum (Tomato); identical to SEQ ID NO: 4103

SEQ ID NO: 27273 - DNA, 1671 bp, Arabidopsis thaliana (Mouse-ear cress); identical to SEQ ID NO: 4104
  CDS (10)..(1569)

SEQ ID NO: 27274 - protein, 519 aa, Arabidopsis thaliana (Mouse-ear cress); identical to SEQ ID NO: 4105

SEQ ID NO: 27275 - DNA, 1659 bp, Lycopersicon esculentum (Tomato); identical to SEQ ID NO: 4106
  CDS (179)..(1561)

SEQ ID NO: 27276 - protein, 460 aa, Lycopersicon esculentum (Tomato); identical to SEQ ID NO: 4107

SEQ ID NO: 27277 - DNA, 1603 bp, Ustilago maydis (Smut fungus); identical to SEQ ID NO: 4108
  CDS (91)..(1554)

SEQ ID NO: 27278 - protein, 487 aa, Ustilago maydis (Smut fungus); identical to SEQ ID NO: 4109

SEQ ID NO: 27279 - DNA, 1470 bp, Geobacter sulfurreducens; identical to SEQ ID NO: 4110
  CDS (1)..(1470)

SEQ ID NO: 27280 - protein, 489 aa, Geobacter sulfurreducens; identical to SEQ ID NO: 4111

SEQ ID NO: 27281 - DNA, 1221 bp, Geobacter sulfurreducens; identical to SEQ ID NO: 4112
  CDS (1)..(1221)

SEQ ID NO: 27282 - protein, 406 aa, Geobacter sulfurreducens; identical to SEQ ID NO: 4113

SEQ ID NO: 27283 - DNA, 1656 bp, Triticum aestivum (Wheat); identical to SEQ ID NO: 4114
  CDS (93)..(1505)

SEQ ID NO: 27284 - protein, 470 aa, Triticum aestivum (Wheat); identical to SEQ ID NO: 4115

SEQ ID NO: 27285 - DNA, 1278 bp, Mycobacterium paratuberculosis; identical to SEQ ID NO: 4116
  CDS (1)..(1278)

SEQ ID NO: 27286 - protein, 425 aa, Mycobacterium paratuberculosis; identical to SEQ ID NO: 4117

SEQ ID NO: 27287 - DNA, 1440 bp, Mycobacterium paratuberculosis; identical to SEQ ID NO: 4118
  CDS (1)..(1440)

SEQ ID NO: 27288 - protein, 479 aa, Mycobacterium paratuberculosis; identical to SEQ ID NO: 4119

SEQ ID NO: 27289 - DNA, 1236 bp, Bacillus cereus ATCC 10987; identical to SEQ ID NO: 4120
  CDS (1)..(1236)

SEQ ID NO: 27290 - protein, 411 aa, Bacillus cereus ATCC 10987; identical to SEQ ID NO: 4121

SEQ ID NO: 27291 - DNA, 1332 bp, Rhodopseudomonas palustris; identical to SEQ ID NO: 4122
  CDS (1)..(1332)

SEQ ID NO: 27292 - protein, 443 aa, Rhodopseudomonas palustris; identical to SEQ ID NO: 4123

SEQ ID NO: 27293 - DNA, 1443 bp, Rhodopseudomonas palustris; identical to SEQ ID NO: 4124
  CDS (1)..(1443)

SEQ ID NO: 27294 - protein, 480 aa, Rhodopseudomonas palustris; identical to SEQ ID NO: 4125

SEQ ID NO: 27295 - DNA, 21 bp, Primer
atggctcggggtgacggacat

SEQ ID NO: 27296 - DNA, 25 bp, Primer
tcatgcttcttttgcgtgatgcaat

SEQ ID NO: 27297 - protein, 45 aa, consensus; identical to SEQ ID NO: 13776
  MISC_FEATURE (1)..(45): consensus for the disclosure of xaa see table XV

SEQ ID NO: 27298 - protein, 493 aa, consensus; identical to SEQ ID NO: 13777
  MISC_FEATURE (1)..(493): Xaa in all positions is any amino acid.

SEQ ID NO: 27299 - protein, 15 aa, consensus
  MISC_FEATURE (1)..(15): consensus for the disclosure of xaa see table XV
GXVKWFXXXKGXGFX

SEQ ID NO: 27300 - protein, 13 aa, consensus
  MISC_FEATURE (1)..(13): consensus for the disclosure of xaa see table XV
XXFXHXXXXXXXX

SEQ ID NO: 27301 - protein, 20 aa, consensus
  MISC_FEATURE (1)..(20): consensus for the disclosure of xaa see table XV
XXXLXXXXXVXXXXXXXXXG

SEQ ID NO: 27302 - protein, 62 aa, consensus
  MISC_FEATURE (1)..(62): Xaa in all positions is any amino acid
GXVKWFNXXKGFGFIXXXXGXXXDXFXHXXXIXXXGXXXXLXEGQXVXFXXXXGXXGXXXXA

SEQ ID NO: 27303 - protein, 71 aa, consensus; identical to SEQ ID NO: 22551
  MISC_FEATURE (1)..(71): consensus for the disclosure of xaa see table XV

SEQ ID NO: 27304 - protein, 1274 aa, consensus; identical to SEQ ID NO: 22552
  MISC_FEATURE (1)..(1274): Xaa in all Positions is any amino acid

SEQ ID NO: 27305 - protein, 98 aa, consensus; identical to SEQ ID NO: 18676
  MISC_FEATURE (1)..(98): consensus for the disclosure of xaa see table XV

SEQ ID NO: 27306 - protein, 47 aa, consensus; identical to SEQ ID NO: 18677
  MISC_FEATURE (1)..(47): consensus for the disclosure of xaa see table XV

SEQ ID NO: 27307 - protein, 117 aa, consensus; identical to SEQ ID NO: 18678
  MISC_FEATURE (1)..(117): consensus for the disclosure of xaa see table XV

SEQ ID NO: 27308 - protein, 75 aa, consensus; identical to SEQ ID NO: 18679
  MISC_FEATURE (1)..(75): consensus for the disclosure of xaa see table XV

SEQ ID NO: 27309 - protein, 97 aa, consensus
  MISC_FEATURE (1)..(97): Xaa in all positions is any amino acid
MAXWXGXYXSPYAEHGKKSEQVKKITVSIPXKVLXXLTXERTRRQXNNLRHATNSELLCEAFLHAXTGQPLPXDXDLXKXRXDXIPXXAKXXMXXXG

SEQ ID NO: 27310 - protein, 97 aa, consensus
  MISC_FEATURE (1)..(97): Xaa in all positions is any amino acid
MXXWXGXYXSPYAEHGKKXXQVKKITVSIPXKVLXXLTXERTRRQXXXLRHATNSELLCEAFLHAXTGQPLPXDXDXXKXXXDXXPXXAKXXMXXXG

SEQ ID NO: 27311 - protein, 11 aa, consensus
  MISC_FEATURE (1)..(11): consensus for the disclosure of xaa see table XV
XXXXXXXXXXX

SEQ ID NO: 27312 - protein, 14 aa, consensus
  MISC_FEATURE (1)..(14): consensus for the disclosure of xaa see table XV
XXPXXXXXXXXXGX

SEQ ID NO: 27313 - protein, 80 aa, consensus; identical to SEQ ID NO: 7429
  MISC_FEATURE (1)..(80): Xaa in all positions is any amino acid.

SEQ ID NO: 27314 - protein, 35 aa, consensus; identical to SEQ ID NO: 13778
  MISC_FEATURE (1)..(35): consensus for the disclosure of xaa see table XV

SEQ ID NO: 27315 - protein, 20 aa, consensus
  MISC_FEATURE (1)..(20): consensus for the disclosure of xaa see table XV
DVXXXXXXXDXXXDHHXXXX

SEQ ID NO: 27316 - protein, 9 aa, consensus
  MISC_FEATURE (1)..(9): consensus for the disclosure of xaa see table XV
SSXGXXXXX

SEQ ID NO: 27317 - protein, 15 aa, consensus
  MISC_FEATURE (1)..(15): consensus for the disclosure of xaa see table XV
XXXXXXXXXDXXDNG

SEQ ID NO: 27318 - protein, 42 aa, consensus; identical to SEQ ID NO: 13782
  MISC_FEATURE (1)..(42): consensus for the disclosure of xaa see table XV

SEQ ID NO: 27319 - protein, 344 aa, consensus; identical to SEQ ID NO: 13783
  MISC_FEATURE (1)..(344): Xaa in all positions is any amino acid.

SEQ ID NO: 27320 - protein, 19 aa, consensus
  MISC_FEATURE (1)..(19): consensus for the disclosure of xaa see table XV
  for the disclosure of the amendment in position 4 see table XVI
XXXXEXXXGXXXXXXXXXX

SEQ ID NO: 27321 - protein, 607 aa, consensus; identical to SEQ ID NO: 5815
  MISC_FEATURE (1)..(607): Xaa in all positions is any amino acid
  for the disclosure of the amendment in position 223 see table XVI

SEQ ID NO: 27322 - protein, 19 aa, consensus
  MISC_FEATURE (1)..(19): consensus for the disclosure of xaa see table XV
VXGXXXXDXDXXXXXXXXX

SEQ ID NO: 27323 - protein, 65 aa, consensus
  MISC_FEATURE (1)..(65): consensus for the disclosure of xaa see table XV
XXDXXXXXXXXXXXXXXXXXXXXXXXXDHXXXXXXXXXXXXXXXXXXXXXXXXXGXXXXXXXXXX

SEQ ID NO: 27324 - protein, 88 aa, consensus
  MISC_FEATURE (1)..(88): consensus for the disclosure of xaa see table XV
XXXXXXXXDXXXXXXXXXXXXXXDXXXXXXXXXXXXXXXXXXXXXXXXXXXXXXXXXXXXXXXXXXXXXXXXXXXXXXXXXXXXXDXK

SEQ ID NO: 27325 - protein, 26 aa, consensus
  MISC_FEATURE (1)..(26): consensus for the disclosure of xaa see table XV
XXXGXXXXXXXXXXXXXXXXXXXXXX

SEQ ID NO: 27326 - protein, 16 aa, consensus
  MISC_FEATURE (1)..(16): consensus for the disclosure of xaa see table XV
XXXXXXXXXXXXXXXX

SEQ ID NO: 27327 - protein, 22 aa, consensus
  MISC_FEATURE (1)..(22): consensus for the disclosure of xaa see table XV
XXXXXXXXXHXXXGXXXXXXXX

SEQ ID NO: 27328 - protein, 547 aa, consensus; identical to SEQ ID NO: 18717
  MISC_FEATURE (1)..(547): Xaa in all positions is any amino acid.

SEQ ID NO: 27329 - DNA, 1404 bp, Escherichia coli K12
  CDS (1)..(1404)
atgaaaaatgccaatcatcgattcttcctgagggaacgacttatgaaactaaagaccacattgttcggcaatgtatatcagtttaaggatgtaaaagaggtgctggctaaagccaacgaactgcgttcgggggatgtgctggcgggcgtcgcagcggcaagctcacaggagcgcgtggcggcaaagcaggtgttgtcggaaatgaccgtagcggacatccgcaataatccggtgattgcctatgaagatgactgcgtgacgcggctgattcaggacgatgttaacgaaacggcctacaaccagattaaaaactggagcatcagcgaactgcgtgagtatgtgctgagcgatgaaaccagcgtggacgacattgcctttacccgcaaagggctgacctcggaagtggtcgcggcggtagcgaagatttgctccaacgcggacctgatctacggcgcgaagaaaatgccggtaatcaaaaaggccaataccaccatcggtattccgggcacctttagcgcccgtttgcagccaaatgacacccgtgacgacgtgcaaagtatcgccgcgcaaatctacgaagggctttccttcggggtgggcgatgcggtgatcggcgttaacccggtgactgacgacgtggaaaacttaagccgcgtgttggataccatctatggcgtgatcgacaaattcaacatcccaactcagggctgtgtactggcgcacgtcaccacccagatcgaagcgatccgtcgtggcgcaccgggcgggctgattttccagagtatctgtggcagcgaaaaagggctgaaagagtttggcgtggagctggcgatgctcgacgaagcgcgcgcagtgggcgcggagttcaaccgtatcgccggggaaaactgcctctacttcgaaaccggacaaggctctgcgctatccgctggcgctaacttcggcgcagaccaggtaacgatggaagcacgtaactacgggctggcgcgtcattacgatccgtttatcgtcaacaccgtggtcggctttattgggccggagtatctctacaacgaccgccagattatccgtgctggcttagaagatcactttatgggcaagctgagcggcatctctatgggctgtgactgctgttataccaaccacgctgacgctgaccagaacctcaacgaaaacctgatgatcctgctcgccaccgcaggctgcaactacatcatggggatgccgctgggtgatgacatcatgctcaactaccagaccaccgcattccacgataccgccactgtgcgtcagttactcaacctgcgcccgtcaccggagtttgaacgctggctggaaagcatgggcattatggcaaacggtcgcctgaccaaacgggcgggcgatccgtcactgttcttctga

SEQ ID NO: 27330 - protein, 467 aa, Escherichia coli K12
MKNANHRFFLRERLMKLKTTLFGNVYQFKDVKEVLAKANELRSGDVLAGVAAASSQERVAAKQVLSEMTVADIRNNPVIAYEDDCVTRLIQDDVNETAYNQIKNWSISELREYVLSDETSVDDIAFTRKGLTSEVVAAVAKICSNADLIYGAKKMPVIKKANTTIGIPGTFSARLQPNDTRDDVQSIAAQIYEGLSFGVGDAVIGVNPVTDDVENLSRVLDTIYGVIDKFNIPTQGCVLAHVTTQIEAIRRGAPGGLIFQSICGSEKGLKEFGVELAMLDEARAVGAEFNRIAGENCLYFETGQGSALSAGANFGADQVTMEARNYGLARHYDPFIVNTVVGFIGPEYLYNDRQIIRAGLEDHFMGKLSGISMGCDCCYTNHADADQNLNENLMILLATAGCNYIMGMPLGDDIMLNYQTTAFHDTATVRQLLNLRPSPEFERWLESMGIMANGRLTKRAGDPSLFF

SEQ ID NO: 27331 - DNA, 2526 bp, Salmonella typhimurium
  CDS (141)..(1499)
accgcaacttccgctggcggtcatcgatgaggtggtcgtgcgggcgggagactatatcgacattggtacgcctctttttggcggatcggttgtgccggtgacgtgaaatcactcgcatttccttcctgagggaacgacttatgaaactaaagaccacattgttcggcaatgtttatcagtttaaggatgtaaaagaggtactggctaaagccaacgaactgcgttcgggggatgtgctggccggggttgccgcggcaagttcgcaggagcgcgtagcggcaaaacaggtactgtcggaaatgacggtggcggatatccgcaacaatccggtgattgcctatgaagaggactgcgtgacgcgcctgattcaggacgacgtcaacgaaacggcctataaccggattaaaaactggagcatcagcgaactgcgtgaatacgtgctgagcgatgaaacctccgtggacgacatcgcgtttacccgcaaaggcctgacctccgaagtggtggcggcagtagcgaaaatctgctccaacgctgacctgatctacggcggcaagaaaatgccggtgatcaaaaaagccaataccaccatcggtattccgggcacctttagctgccgtttgcagccgaacgatacccgtgacgatgtacagagtatcgccgcgcaaatctacgaagggctttctttcggcgcaggcgatgcggtgatcggcgttaacccggtgaccgatgacgtggagaacctgacccgcgtgctcgacaccgtttacgcgttatcgataaattcaatattccgacccagggctgcgtgctggcgcacgtcaccacccagatcgaagcgattcgtcgcggcgcccgggcggactgattttccagagcatttgcggcacgagaagggcttaaaagagttcggcgtcgagctggccatgctcgacgaagcgcgggctgtgggggcggagttcaaccgcatcgccggggaaaactgcctgtactttgaaaccgggcaagggtctgcgctctccgcaggcgcgaactttggtgccgaccaggtgacgatggaagcgcgtaactacgggctggcgcgccactacgatccgttcctggtgaacaccgtggtgggctttatcgggccggagtatctctacaacgacaggcagattatccgcgccggtctcgaagatcactttatgggcaagctgagcggcatctcgatgggctgcgactgctgctataccaaccatgccgacgccgaccagaaccttaacgaaaacctgatgattctgctcgccactgccggctgtaactacatcatggggatgccgctcggcgacgacatcatgctcaactaccagaccaccgctttccacgataccgccaccgtccgtcagttgctgaatttacggccgtcgccggagtttgaacgctggctggaaacgatgggcattatggcaaacggtcgtctgaccaaacgggcgggcgatccgtcactgttcttctgatgacgcggggataacaccatggatcaaaaacagattgaagaaattgtacgtagcgtgatggcgtcaatgggacaggacgtaccgcagcccgccgcgccgtcaacgcaggaaggcgcaaagccgcagtgcgccgcgccgacggtgaccgaaacgtgcgcgctggatttaggttccgcggaggcaaaagcctggattggcgtcgagaacccacatcgtgcggacgtgctgaccgaactgcgtcgcagtactgcggcacgcgtcttgtacggggcgtgccgggccgcgtccgcgcacccaggcgctgttgcgttcctggcggatcactcccgttcgaaagataccgtgctcaaagaagtgccggaagagtgggtaaaagcgcaagggctgctggaagtgcgttcggaagagtgggtaaaagcgcaagggctgctggaagtgcgttcggagatcagcgacaaaaacctgtacctgacgcgcccggatatggggcgtcgcctgagcccggaagccattgacgcgctgaagtcacagtgcgtgatgaacccggatgtgcaggtagtggtctccgatggcctctctacggatgcgatcaccgccaactatgaagagatcctgccgccgttgcttgccggtctgaagcaggccgggctgaacgtcggcacgccgttctttgtgcgctatggccgtgtgaagattgaagatcagattggcgaaattctcggcgcgaaggtcgtcatcctgctggtaggcgaacgtccggggctggggcagtcggaaagcctttcctgctacgcggtctattccccgcgcgtggcaccaccgtcgaggccgacagaacctgtatttcaaacattcatcagggggggacgccgccagtagaagccgccgccgtgattgtggatttggccaaacggatgctggagcatgaaagcgtccggcatcaacatgtacccggttaaggagacatcatgcctgcattagatttaattcgaccttcacgtgactgccatagcgcgtgattgcctcc

SEQ ID NO: 27332 - protein, 452 aa, Salmonella typhimurium
MKLKTTLFGNVYQFKDVKEVLAKANELRSGDVLAGVAAASSQERVAAKQVLSEMTVADIRNNPVIAYEEDCVTRLIQDDVNETAYNRIKNWSISELREYVLSDETSVDDIAFTRKGLTSEVVAAVAKICSNADLIYGGKKMPVIKKANTTIGIPGTFSCRLQPNDTRDDVQSIAAQIYEGLSFGAGDAVIGVNPVTDDVENLTRVLDTVYALSINSIFRPRAACWRTSPPRSKRFVAAPGRTDFPEHLRHEKGLKEFGVELAMLDEARAVGAEFNRIAGENCLYFETGQGSALSAGANFGADQVTMEARNYGLARHYDPFLVNTVVGFIGPEYLYNDRQIIRAGLEDHFMGKLSGISMGCDCCYTNHADADQNLNENLMILLATAGCNYIMGMPLGDDIMLNYQTTAFHDTATVRQLLNLRPSPEFERWLETMGIMANGRLTKRAGDPSLFF

SEQ ID NO: 27333 - DNA, 1362 bp, Salmonella enterica subsp. enterica serovar Typhi
  CDS (1)..(1362)
atgaaactaaagaccacattgttcggcaatgtttatcagtttaaggatgtaaaagaggtactggctaaagccaacgaactgcgttcgggggatgtgctggccggggttgccgcggcaagttcgcaggagcgcgtagcggcaaaacaggtactgtcggaaatgacggtggcggatatccgcaacaatccggtgattgcctatgaagaggactgcgtgacgcgcctgattcaggatgacgtcaacgaaacggcctataatcggattaaaaactggagcatcagcgaactgcgcgaatacgtactgagcgatgaaacctccgtggacgacatcgcgtttacccgcaaaggcctgacctccgaagtggtggcggcagtggcgaaaatctgctccaacgccgacctgatctacggcggtaagaaaatgccggtgatcaaaaaagccaataccaccatcggtattccgggcacctttagctgccgtttgcagccgaacgatacccgtgacgatgtgcagagtatcgccgcgcaaatctacgaagggctttctttcggcgcaggcgatgcggtgatcggcgttaacccggtgaccgatgacgtggagaacctgacccgcgtgctcgacaccgtttacggcgttatcgataaattcaatattccgacccagggctgcgtgctggcgcacgtcaccacccagattgaagcgattcgtcgcggcgcgccaggcggactgattttccagagcatttgcggcagcgagaagggcttaaaagagttcggtgtcgagctggcaatgctcgacgaagcgcgggcagtgggggcggagttcaaccgcatcgccggggaaaactgcctgtactttgaaaccggacagggctcggcgctgtcggctggtgcgaactttggtgccgaccaggtgacgatggaagcgcgtaactacgggctggctcgctactacgatccgttcctggtgaacaccgtggtgggctttatcgggccggagtatctctacaacgacaggcagattatccgcgccggtctcgaagatcactttatgggcaagctgagcggcatctcgatgggctgcgactgctgctataccaaccatgccgacgccgaccagaaccttaacgaaaacctgatgattctgctcgccactgccggctgtaactacatcatggggatgccgctcggcgacgacatcatgctcaactaccagactaccgctttccacgataccgccaccgtccgtcagttgctgaatttacggccgtcgccggagtttgaacgctggctggaaacgatgggcattatggcaaacggtcgtctgaccaaacgggcgggcgatccgtcactgttcttctga

SEQ ID NO: 27334 - protein, 453 aa, Salmonella enterica subsp. enterica serovar Typhi
MKLKTTLFGNVYQFKDVKEVLAKANELRSGDVLAGVAAASSQERVAAKQVLSEMTVADIRNNPVIAYEEDCVTRLIQDDVNETAYNRIKNWSISELREYVLSDETSVDDIAFTRKGLTSEVVAAVAKICSNADLIYGGKKMPVIKKANTTIGIPGTFSCRLQPNDTRDDVQSIAAQIYEGLSFGAGDAVIGVNPVTDDVENLTRVLDTVYGVIDKFNIPTQGCVLAHVTTQIEAIRRGAPGGLIFQSICGSEKGLKEFGVELAMLDEARAVGAEFNRIAGENCLYFETGQGSALSAGANFGADQVTMEARNYGLARYYDPFLVNTVVGFIGPEYLYNDRQIIRAGLEDHFMGKLSGISMGCDCCYTNHADADQNLNENLMILLATAGCNYIMGMPLGDDIMLNYQTTAFHDTATVRQLLNLRPSPEFERWLETMGIMANGRLTKRAGDPSLFF

SEQ ID NO: 27335 - DNA, 1365 bp, Listeria monocytogenes
  CDS (1)..(1365)
atgattttaaaaacgaatttattcggccatacataccagttcaaatccatcactgatgtgttggcaaaagcaaacgaagaaaaatcgggcgaccgtttagccggagttgctgctgaatctgcagaagaacgtgtagctgcaaaagtggtgctttctaaaatgacgcttggagatttacgtaataatccggttgtcccatatgaaacagatgaggtaacacgtattattcaagaccaagtaaatgaccgtatccatgattccatcaaaaactggacagtggaagaattacgggaatggattttagaccataaaacaacagatgctgacattaaacgtgttgcacgcggcctaacatcagaaattattgctgctgttacaaaattaatgtccaatctagatttaatttatggcgcgaaaaaaatccgtgtaatcgcacatgcgaatacaacaatcggtcttcctggaactttctccgctagactacaaccaaaccatccaactgatgatcctgatggtatccttgcttcattaatggaaggattaacttacgggattggggatgcggtaatcggacttaacccagtagatgattctactgatagcgttgttcgtttacttaataaatttgaagaattccgcagcaaatgggatgtgccaacacaaacttgtgtgcttgcacacgtgaagactcaaatggaagcaatgcgtcgcggcgctccaactggtcttgtattccaatctatcgcaggttctgaaaaaggtaatacagctttcggttttgacggagcaactattgaagaagctagacaattagcccttcaaagtggtgctgcgactggaccaaacgtaatgtactttgaaacaggacaaggttctgaactttcttctgacgcccatttcggcgtagaccaagtaacaatggaagctcgttgttatggattcgcgaagaaatttgatccattcctagtaaatacagtagttggatttattgggcctgagtatctatatgattccaaacaagtaattcgcgccggtcttgaagatcactttatggggaaattaactggtatttccatgggctgtgacgtatgttacacaaaccatatgaaagccgaccaaaacgacgtagaaaacttatcagtacttctaactgcagcaggatgtaactttatcatgggtattcctcatggtgatgacgttatgcttaactaccaaacaactggttaccacgaaacagccactttacgtgaattatttggcttaaaaccaatcaaagaatttgatcagtggatggaaaaaatgggattcagcgaaaatggtaaattaactagccgtgctggagatgcatctattttcctaaaataa

SEQ ID NO: 27336 - protein, 454 aa, Listeria monocytogenes
MILKTNLFGHTYQFKSITDVLAKANEEKSGDRLAGVAAESAEERVAAKVVLSKMTLGDLRNNPVVPYETDEVTRIIQDQVNDRIHDSIKNWTVEELREWILDHKTTDADIKRVARGLTSEIIAAVTKLMSNLDLIYGAKKIRVIAHANTTIGLPGTFSARLQPNHPTDDPDGILASLMEGLTYGIGDAVIGLNPVDDSTDSVVRLLNKFEEFRSKWDVPTQTCVLAHVKTQMEAMRRGAPTGLVFQSIAGSEKGNTAFGFDGATIEEARQLALQSGAATGPNVMYFETGQGSELSSDAHFGVDQVTMEARCYGFAKKFDPFLVNTVVGFIGPEYLYDSKQVIRAGLEDHFMGKLTGISMGCDVCYTNHMKADQNDVENLSVLLTAAGCNFIMGIPHGDDVMLNYQTTGYHETATLRELFGLKPIKEFDQWMEKMGFSENGKLTSRAGDASIFLK

SEQ ID NO: 27337 - DNA, 1356 bp, Clostridium acetobutylicum
  CDS (1)..(1356)
atgaatttaaaaacaacattgtttaatacaacttataaatttaaagatataaaggatgtacttgcaaaagcgaatgaaaaaaaatctggagatgaaatggcaggtattgcggcaagtggagcaagagaaagagttgcagcaaaaactgttttagcagatataacactagaagaattaagaaacaatcctgtggtatcttatgaaaaagatgaaattacaagagtaatacaggattctgttgatgaagagcagtataaaaaaattaaggcattaacagttggtgaatttagagagtttttacttgaaaatgatgaagataagataaaggaaataagggatggattaacctcagagatgattgcagcagtaacaaagcttatgagtaatatggatcttgtatacgcagctcaaaaaatttgtaatacagctaaatgcaacacaactataggtagaagaggaactttttcttcaagacttcaacctaatcatccaactgataatcctcaaggtattatggcatcattgattgatggaataagctatggagtgggagatgcagttataggattaaatccagtagcagatactatagaaagtgtatctgatgtgcttaaggtatttaatgactttactagaaaatggagaataccaactcaaaattgtgtgcttgctcatataacaacccaaatggaggccttaaaaaatggagttccgattgatttaatgtttcaaagtatagcaggttctgaaattgcaaataaagattttggaataagtgtagccttattagatgaagcttatgaacttatgaaaactaaaaaaagctccaaaggacctaattttatgtattttgaaacaggacaaggcacggaactatcgtcggaaggtaataacagagcagatcaacttgtgatggaagcaagatgctatgggttagctaaaagatataaaccgtttcttgtaaatacagttgtaggttttattggacctgaatatttatatgatggaaagcaagttataagagcaggtttggaggatcattttatgggaaagcttacaggtttatcaatgggagttgatacatgctacacaaatcatatgaaagcggatcaaaatgatcttgaaaatttagctatgcttcttttagcagctaattgtaactaccttatggggataccttgtggagatgatgtaatgcttatgtatcaatcttcaagctatcatgatatagcaactttgagggaaatatcagataaaagaccaataaaagaatttgaaaaaagaatggaagaattagggataatgaagaacggtaaattaacaagaaatgccggtgatccttcaatatttatgtag

SEQ ID NO: 27338 - protein, 451 aa, Clostridium acetobutylicum
MNLKTTLFNTTYKFKDIKDVLAKANEKKSGDEMAGIAASGARERVAAKTVLADITLEELRNNPVVSYEKDEITRVIQDSVDEEQYKKIKALTVGEFREFLLENDEDKIKEIRDGLTSEMIAAVTKLMSNMDLVYAAQKICNTAKCNTTIGRRGTFSSRLQPNHPTDNPQGIMASLIDGISYGVGDAVIGLNPVADTIESVSDVLKVFNDFTRKWRIPTQNCVLAHITTQMEALKNGVPIDLMFQSIAGSEIANKDFGISVALLDEAYELMKTKKSSKGPNFMYFETGQGTELSSEGNNRADQLVMEARCYGLAKRYKPFLVNTVVGFIGPEYLYDGKQVIRAGLEDHFMGKLTGLSMGVDTCYTNHMKADQNDLENLAMLLLAANCNYLMGIPCGDDVMLMYQSSSYHDIATLREISDKRPIKEFEKRMEELGIMKNGKLTRNAGDPSIFM

SEQ ID NO: 27339 - DNA, 1395 bp, Pseudomonas aeruginosa
  CDS (1)..(1395)
atggcacgtttcacccatagcgtcggcggcgaaacctaccgcttcgacagcctcaaggacgtgatggccaaggccagccccgcgcgctccggcgatttcctcgccggcgtcgcggcgagcaacgacggcgagcgggtcgccgcgcagatggccctggccgacatcccgctcaaacacttcctcgacgaggcgctgattccctacgaggacgacgaggtcacccgcctgatcatcgacacccaccagcgcgacgccttcgccccggtgtcccatctcaccgtcggcggcttccgcgactggctgctcggcgacgccgccgacgaggccagcctgcgcgccctggctccgggcctgacgccggaaatggcagcggcggtatcgaagatcatgcgtgtccaggatctggtcctggtggcgcagaagatccgcgtggtcacccgcttccgcaacaccctcggccttcgcggccggctctccacccgcctgcaaccgaaccacccgaccgacgacccggccggaatcgccgcgagcatcctcgacggcctgctgttcggcaatggcgacgcgatgctcgggatcaatcctgccaccgacagcatggcctcgatctgcgccctgctggagatgctcgacgcgatcatccagcgctacgagattcctacccaggcctgcgtgctgacccacgtcaccagctccatcgaggcgatcaaccgcggcgtgccgctggacctggtgttccagtcgatcgccggcaccgaggcggccaatgccagcttcggcatcagcctgaagatcctccaggaaggctacgaggccgggctcagccagaagcgcggcaccctaggcaacaacctgatgtacttcgagaccggccagggcagcgcgctctcggccaacgcccaccacggcgtcgaccagcagacctgcgagacccgcgcctatgcggtggctcgtcacttcaagccgttcctggtgaacaccgtggtcggcttcatcggtcccgagtacctgtacaacggcaagcagatcatccgcgccggcctggaagaccacttctgcggcaagctgctcggcgtgccgatgggttgcgacatctgctacaccaaccatgccgaggccgaccaggacgacatggacatgctcctgaccctgctgggcgtcgccgggatcaacttcatcatgggcattcccggctccgacgacgtgatgctcaactaccagaccacctccttccacgacgccctctatgcgcgccagacgctgggcctgaagccggcgccggaattcgaggactggttgcagcggatgggaatcttcacccaggccgacgggcgcatccgcttcggtgacgagttaccgccggcgttccgccaggccctggcgcaactggcctga

SEQ ID NO: 27340 - protein, 464 aa, Pseudomonas aeruginosa
MARFTHSVGGETYRFDSLKDVMAKASPARSGDFLAGVAASNDGERVAAQMALADIPLKHFLDEALIPYEDDEVTRLIIDTHQRDAFAPVSHLTVGGFRDWLLGDAADEASLRALAPGLTPEMAAAVSKIMRVQDLVLVAQKIRVVTRFRNTLGLRGRLSTRLQPNHPTDDPAGIAASILDGLLFGNGDAMLGINPATDSMASICALLEMLDAIIQRYEIPTQACVLTHVTSSIEAINRGVPLDLVFQSIAGTEAANASFGISLKILQEGYEAGLSQKRGTLGNNLMYFETGQGSALSANAHHGVDQQTCETRAYAVARHFKPFLVNTVVGFIGPEYLYNGKQIIRAGLEDHFCGKLLGVPMGCDICYTNHAEADQDDMDMLLTLLGVAGINFIMGIPGSDDVMLNYQTTSFHDALYARQTLGLKPAPEFEDWLQRMGIFTQADGRIRFGDELPPAFRQALAQLA

SEQ ID NO: 27341 - DNA, 1425 bp, Rhodococcus erythropolis
  CDS (1)..(1425)
atgagtcgcgggatggccaagtatcaccagcaggtatccggaaccaactactcgttcgacggtctcgtcgatctgatggcaaaagcgacaccactgcggtcgggtgacgaactagccggttgcgcggcaagctccgatgctgaacgtgctgctgcccaatgggttctggctgatcttccgttgactgtgttcctcgaagatctgttggttccgtacgaggacgacgaggtgacccggctcatcatcgacagccacgatcgcctcgcatttgcgccggtggcccacctgactgttggcggattacgggactggctgctcgagactgcgtcggcgccggaagcttcagcacgcttgtctgccgtgagtcccggtctgacccccgagatggttgccgcggtcagcaagatcatgcgcaatcaggacctgatcgccgtcgccaaggccatcacggtcaccgcggggttccgcactaccatcggactgcctggacggctgagcacccgactccagccaaaccacccgacggacgatccacgcggcattgcggcggccacattggacggtctcctgatgggatgtggcgacgccgtcatcggcatcaaccctgcgacggattcaccccaggccacctcggatctgctccacctgctcgacgacatccgtcagcgattcgagatcccgactcagtcgtgcgtgctctctcacgtgaccaccacgatcggactgatcgaatcgggggtgccggtcgatcttgtcttccaatcgattgccggtaccgaaggcgccaattccggtttcggagtgaacattccgctactgcgcgaaggtaacgaggccggacgctccttgaaccgcggaacggtcggcaacaacgtcatgtacctcgagacagggcaggggtccgccctcagttcaggtgcccactacggcaccggcggagccccggtcgatcagcagacactcgagaccagggcatacgccgtggctcgagatctcgagccgctgctggtcaacacggtggtcggtttcatcggtcccgagtacctctacgacggcaagcagatcattcgcgcgggcttggaggatcacttctgcggaaaactcctcgggctgccgatgggagtggacgtctgctacaccaaccacgccgaagccgatcaagacgacatggacaacctcctcaccttgctgggcgtcgccggcgcggcgttcgtgatcgcggtgcccggcgccgacgacgtgatgctcggctatcaaagtctggcgttccacgacgcgctgtatgtgcgtaaggtcctcggtttgcagcccgccccggagttcgagacctggctccacaatttggggatgaccgacgcaaacggtcgggttcttccgatcgacgccgaaatgtcgccgctgcgggctttgacggtgaactcatga

SEQ ID NO: 27342 - protein, 474 aa, Rhodococcus erythropolis
MSRGMAKYHQQVSGTNYSFDGLVDLMAKATPLRSGDELAGCAASSDAERAAAQWVLADLPLTVFLEDLLVPYEDDEVTRLIIDSHDRLAFAPVAHLTVGGLRDWLLETASAPEASARLSAVSPGLTPEMVAAVSKIMRNQDLIAVAKAITVTAGFRTTIGLPGRLSTRLQPNHPTDDPRGIAAATLDGLLMGCGDAVIGINPATDSPQATSDLLHLLDDIRQRFEIPTQSCVLSHVTTTIGLIESGVPVDLVFQSIAGTEGANSGFGVNIPLLREGNEAGRSLNRGTVGNNVMYLETGQGSALSSGAHYGTGGAPVDQQTLETRAYAVARDLEPLLVNTVVGFIGPEYLYDGKQIIRAGLEDHFCGKLLGLPMGVDVCYTNHAEADQDDMDNLLTLLGVAGAAFVIAVPGADDVMLGYQSLAFHDALYVRKVLGLQPAPEFETWLHNLGMTDANGRVLPIDAEMSPLRALTVNS

SEQ ID NO: 27343 - DNA, 1272 bp, Symbiobacterium thermophilum
  CDS (1)..(1272)
atgatcctcaagacgaccctgcgcggccaggtctaccagttccgatcggtcaaggaggtgctcgccaaggccaacgagctgcgctcgggcgacgtgctcgccgggatcgcagcggagaccgaggcggagcgggtggccgccaagcacgtcctcgccaacctgaccctggaggacctgcgcaacaacccggtcatcccctacgaggaagacgaggtcacccgggtcatccaggacgcggtcaacgagcacgtgtaccggcagatcaagggatggaccgtcgccgagctgcgggagtacatcctctcggacaaggccgacgcccaggagatccagcggatcagccggggcctgacgtcggagatggtcgcggcggtggccaagctctgctccaacctggacctgatctacggcgccagcaagatgcacaacgtcgtgcagtgcaacaccaccatcggcctgcccggcacgctcgcgatgcggctgcagcccaacgaccccgtggactccatcgacggcatcatgccccagatcatggaagggctctcctacggcatcggcgacgcggtgatcggcatcaacccggtcaacgacgatcccgagtcggtctcccggctgctgtgggcggtttacgagttcatggaaaagtggcggatcccgacgcagcagtgcgtgctcgcccacgtgacgacccagatgcgctgcatccgggacggggcccccgtcggcctggtgttccagtccatcgccggctcggagaaggccatggaggccttcggcgtctcggtggagatgctggacgaggccctggagctggtgcgcaagtacggttccgccaaggggcccaacctgatgtacttcgagaccgggcagggatcggagctttcggccgacgcgcaccacggcgccgaccaggtcacgctggaggcccggtgctacggcctggccaagcggtaccagccgctcctggtcaacaccgtcgtcgggttcatcggcccggagtacctctacgacgccaagcaggtcatccgcgccggcctggaagacgtgttcatgggcaagctcaccggcatctccatgggctgcgacgtctgctacaccaaccacatgaaggcggatcagcacgacatcgagaacctggccgtcctgctgaccgccgcgggcgtcaactacttcatcggcgtgccgatgggcgacgacccgatgctcaactaccagtgcggcgcgttccacgacggcgcggccccgtggcgcatcaccagatccagaccatga

SEQ ID NO: 27344 - protein, 423 aa, Symbiobacterium thermophilum
MILKTTLRGQVYQFRSVKEVLAKANELRSGDVLAGIAAETEAERVAAKHVLANLTLEDLRNNPVIPYEEDEVTRVIQDAVNEHVYRQIKGWTVAELREYILSDKADAQEIQRISRGLTSEMVAAVAKLCSNLDLIYGASKMHNVVQCNTTIGLPGTLAMRLQPNDPVDSIDGIMPQIMEGLSYGIGDAVIGINPVNDDPESVSRLLWAVYEFMEKWRIPTQQCVLAHVTTQMRCIRDGAPVGLVFQSIAGSEKAMEAFGVSVEMLDEALELVRKYGSAKGPNLMYFETGQGSELSADAHHGADQVTLEARCYGLAKRYQPLLVNTVVGFIGPEYLYDAKQVIRAGLEDVFMGKLTGISMGCDVCYTNHMKADQHDIENLAVLLTAAGVNYFIGVPMGDDPMLNYQCGAFHDGAAPWRITRSRP

SEQ ID NO: 27345 - DNA, 1383 bp, Rhodopseudomonas palustris
  CDS (1)..(1383)
atgatctatcgccacagcatcggcaacgtctcgttcgtgttcgatgacctgcgcgacctgctcgccaaggcgagcccgccgcgctccggcgatcgcctcgccggcatcgctgccgacagcgccgagcagatggtggcggcgcggatggcgctggcgaacctgccgctgcggcaatttctctccgaaatggtgatcccgtacgaagccgacgaggtgacgcggctgatcgcggaccgtcatgacgcagcggcgttcgcgcctgtggcgtcgctcaccgtcggcggcttccgcgactggctgctgtcggacgccgcgacgcctgtggcgttggctgcgctggcgccgggcctgacgcccgagatggtcgccgcggtgtccaagctgatgcgcaatcaggatctgatcctagtggcgaagaagtgcagcgtggtcacccgcttccgcaacaccatcggattgcctgggcggatgagtgtgcggctgcagcccaaccatccgttcgatgatgcccgcggcatcaccgcgtcgattctcgatggcctgctgcttggcgccggcgacgcctgcatcggcatcaatccggcgagcgacgatccggcggtgctcggccaattggtgcggctgctcgacgacatcatcgcgcacctggcaattccgacccagggttgcgtgctgacccacgtcaccaccacgctacgcctgatcgagcagggcgcgccggtcgatctgacgttccagtcgatcgccggcacagaagccgccaaccgcagcttcggcatcgatctggcgctgctcgccgaagcccatcaggcgacgttggcgcagaagcgcggcacggtcggcgacaacgtgatgtatttcgagaccgggcagggctcggcgctgtcggcgaatgcgcatcacggcgtcgatcagcagacctgcgaggcacgggcctatgcggtggcgcgggcattctctccgttgctggtcaacagcgtggtcggcttcatcggtccggaatatctgtacgacggcaagcagatcgtgcgcgctggccttgaggatcatttctgcggcaagctgcttggcctgccgctcggggtcgacatctgctacaccaaccatgccgaagcggatcaggacgacatggacacgctgctcacgctgcttgcagccgccggcgtcaatttcatcatgggcgtgccgggcgctgacgacgtgatgctgaactaccagtcgacctcgtttcacgatgcgttgtacgtccgcgatctgttcggcctgaagcgcgcgccggaatttgacgattggcttatccgggccggtttttccggtcccgatcaccgcccgctgacggatggtgccctgctgccggaaatcgcggcgcggctgatcgcctga

SEQ ID NO: 27346 - protein, 460 aa, Rhodopseudomonas palustris
MIYRHSIGNVSFVFDDLRDLLAKASPPRSGDRLAGIAADSAEQMVAARMALANLPLRQFLSEMVIPYEADEVTRLIADRHDAAAFAPVASLTVGGFRDWLLSDAATPVALAALAPGLTPEMVAAVSKLMRNQDLILVAKKCSVVTRFRNTIGLPGRMSVRLQPNHPFDDARGITASILDGLLLGAGDACIGINPASDDPAVLGQLVRLLDDIIAHLAIPTQGCVLTHVTTTLRLIEQGAPVDLTFQSIAGTEAANRSFGIDLALLAEAHQATLAQKRGTVGDNVMYFETGQGSALSANAHHGVDQQTCEARAYAVARAFSPLLVNSVVGFIGPEYLYDGKQIVRAGLEDHFCGKLLGLPLGVDICYTNHAEADQDDMDTLLTLLAAAGVNFIMGVPGADDVMLNYQSTSFHDALYVRDLFGLKRAPEFDDWLIRAGFSGPDHRPLTDGALLPEIAARLIA

SEQ ID NO: 27347 - DNA, 1362 bp, Photorhabdus luminescens
  CDS (1)..(1362)
atgaaattgaaaacgcagctttttggtaagacctatcagtttaaagatgtcaaacaggtgctggcaatggcgaacgaattgcgttccggggatgtgctagccggggtagcggccgaaagttcccaacaacgcgtagcggctaaacatgtcctctcggaaatgacgattgcggatattcgcatgaatccgatcattccttatgaagaggattgcgtgactcgcattattcaggatgacattaacgaaattgcctacgccggtataaaaaactggagcattggtgaactacgcgaatacatactcagcgatgatacccgcgtggatgatatcgcctttctgcgtaaaggaatcagttccgaagtcgttgccgccgtggcaaaaatcagctccaatgcggatctgatctatggcgcgaaaaaaatgccggtgatcaaaaaagccaacaccaccattgggacgccgggaacattcagcgcccggctgcaacctaacgatacccgcgacgatgtacaaagcattttggcccaaatttacgaaggactatcgtttggcgtgggtgatgcagttatcggcgtcaacccggtaaccgacgatgtagaaaacctcacccgtgtactagataccctctatgaggtaatcgacaaattttccatcccaacacagggctgtgtcttagctcatgtcacgacccagatagaagccattaagcgtggtgcaccgggcggtttgattttccaaagtatttgcggtagtgaaaaagggctaaaagagtttggcgtagaattggctatgttagatgaagcacgtgccgttggcgcggaatattgccgtcttgctggcgataactgcctctatcttgaaaccggacaaggctctgctctctccgccggtgctcactttggcgctgatcaagtgacaatggaggcacgaaactacggtttagcacgccactatgacccatttctggtcaataccgttgtcggtttcatcgggccggaatacctctacaatgatcgccagattatccgtgccggattagaagatcactttatgggaaaactcagcggtgtctcaatgggatgtgactgctgctataccaaccacgcagattccgatcaaaaccagaatgaaaacctgatgatcctgctggcaaccgcaggatgtaatttcatcatgggcatgccgctcggtgatgacattatgctcaactaccagacatcggctttccatgataccgccactatccgccatctgctcaatctgcgcccatcacccgagtttgaacgctggctggaacagatggggctgatggcaaatggccgcttaacatcacgggcgggcgatgcatcgttctttttctga

SEQ ID NO: 27348 - protein, 453 aa, Photorhabdus luminescens
MKLKTQLFGKTYQFKDVKQVLAMANELRSGDVLAGVAAESSQQRVAAKHVLSEMTIADIRMNPIIPYEEDCVTRIIQDDINEIAYAGIKNWSIGELREYILSDDTRVDDIAFLRKGISSEVVAAVAKISSNADLIYGAKKMPVIKKANTTIGTPGTFSARLQPNDTRDDVQSILAQIYEGLSFGVGDAVIGVNPVTDDVENLTRVLDTLYEVIDKFSIPTQGCVLAHVTTQIEAIKRGAPGGLIFQSICGSEKGLKEFGVELAMLDEARAVGAEYCRLAGDNCLYLETGQGSALSAGAHFGADQVTMEARNYGLARHYDPFLVNTVVGFIGPEYLYNDRQIIRAGLEDHFMGKLSGVSMGCDCCYTNHADSDQNQNENLMILLATAGCNFIMGMPLGDDIMLNYQTSAFHDTATIRHLLNLRPSPEFERWLEQMGLMANGRLTSRAGDASFFF

SEQ ID NO: 27349 - DNA, 1383 bp, Chromobacterium violaceum
  CDS (1)..(1383)
atgagccacgccatcgccataggcccgcgaacctaccgcttcgccgacttgaaaacgctgctggcgcgcgccagtcccctgcgctccggcgaccagctggccggcgtcgccgccgccagcgccgaagagcgggtggcggcgcagatgtgcctggccgacttgccgctgaaggtctttctcaaccaggcggtgattccgtacgaggaggacgaggtcacccggctgatcctggacagccatgaccaggccgccttcgccgccgtatcgcacctgaccgtcggcggcctgcgcgactggctgctgtccgacgccgccaccgcggaaacgctggcggcgctggcgcccggcctcacgccggaaatggcggcggcggtgtccaagctgatgcgcaaccaggacctggtgctggcggcgaggaaatgccgcgtcgtcaccgccttccgcaacacccagggactgcccggccgcatgggcgtgcggctgcagcccaatcatccggccgacgacgcgcgcgccatcgccgccgcgacgctggacggcctgctgtacggcgccggcgacgcggtgatcggcatcaacccggccggcgacagcccggacgacatccggagcttgctgacgctgctggacgaggtgcgccagcgctacgccatccctacccagagctgcgtgctcacccacgtcaccagcacgctggacctgatgcgccggggcgcgccggtggatctggtgttccagtccatcgccggcactcagaaggccaacgccggcttcggcgtcagcctcgccgtgctggacgaggcgcatcaggcggcgcgggagctgaagcgcggcacggtgggcgacaatgtgatgtatttcgaaaccggccagggcagcgcgctgtcggccaacgcccactggggcgtggaccaacagacctgcgaggcgcgcgcctacgcggtggcgcggcgctactcgcccttgctggtcaacaccgtggtcggcttcatcggcccggaatacctgtacaacggcaagcagatcatccgcgccggactggaagaccatttctgcggcaagctgctgggcctgccgatgggctgcgacatctgctacaccaaccacgccgaagccgaccaggacgatatggacgcgctgttgacgctgctgggcgcggccggcgtgcatttcatcatcggcgtgcccggcgccgacgacatcatgctgggctatcagagcacctccttccacgacgcgctctacctgcgcaatgtgctgggactcaagcgcgcgccggagttcgaagactggctggaaacgatggagatcacccgcggcggcaggctgctgccgcaggacaggcggcaacggctgctggcgatgatggagggcgtggcgtga

SEQ ID NO: 27350 - protein, 460 aa, Chromobacterium violaceum
MSHAIAIGPRTYRFADLKTLLARASPLRSGDQLAGVAAASAEERVAAQMCLADLPLKVFLNQAVIPYEEDEVTRLILDSHDQAAFAAVSHLTVGGLRDWLLSDAATAETLAALAPGLTPEMAAAVSKLMRNQDLVLAARKCRVVTAFRNTQGLPGRMGVRLQPNHPADDARAIAAATLDGLLYGAGDAVIGINPAGDSPDDIRSLLTLLDEVRQRYAIPTQSCVLTHVTSTLDLMRRGAPVDLVFQSIAGTQKANAGFGVSLAVLDEAHQAARELKRGTVGDNVMYFETGQGSALSANAHWGVDQQTCEARAYAVARRYSPLLVNTVVGFIGPEYLYNGKQIIRAGLEDHFCGKLLGLPMGCDICYTNHAEADQDDMDALLTLLGAAGVHFIIGVPGADDIMLGYQSTSFHDALYLRNVLGLKRAPEFEDWLETMEITRGGRLLPQDRRQRLLAMMEGVA

SEQ ID NO: 27351 - DNA, 1395 bp, Streptomyces avermitilis
  CDS (1)..(1395)
atgagcacgtacaccgcccgcctcggcggccgcacccactccttcccctccctcgcggcgctgctcgccgccgcgagccccgagcggtccggggaccggctggccgggctcgccgccgactccgccgaggcgcgggtcgccgcgcggtgggcgctggcggaggtgccgctcgcgcggttcctcgccgagccggtgatcccgtacgaggacgacgacgtgacccggctgatcgtggacacccacgacgcgcgggcgttcgcgccggtggccggtctttgcgtcggcgagttcagggagtggctgctgtcggacgcggcggacgccgggtcgctggccgcgctcgcccccgggctcacgcccgagatggtggcggcggtctccaagctgatgggcaacgcggacctggtcgcggtcgcgcgcaaggcgcgggtggtgacggcgttccgctcgaccatcggcctgccggggcggctggcgacccggttgcagcccaatcaccccacggacgacccggccggtgtcgccgccgccctgctggacggactgctcctcggctccggtgacgcggtgatcggcatcaacccggcgacggacagcccgaaggcggtacgggacctgctggagctgctggacggagtgatccggcgctacgccatccccacccagtcgtgcgtcctgtgccatgtcacgacgagcatcgacctgatggagcgcggcgcccccgtcgacctggtcttccagtccatcgcgggcacgcaggcggcgaacgcgtccttcggggtcacgctgggtctgctcgacgaggcgtacgacgcggcgcgtgggctcggccgggggacggccgggcagaacgcgctgtacttcgagacgggccagggcagcgccctgtcggcgaacgcgcaccacggggtggaccagcagacggtcgaggcacgggcgtacgcggtggcccgccgctacgacccgctcctcgtcaacacggtcgtcggcttcatcggcccggagtacctgtacgacggccggcagatcctgcgggccgcgctggaggaccacttctgcggcaagctgctcggcctgccgatgggcctggacatctgctacacgaaccacgccgacgcggacgacgacgacatcgcgacgatgctgacgatgctcggtgtcgccggggcgtcgttcgtgatctgcacaccgggcggcgacgacatcatgctgaactaccagtcggcctcgtaccacgacgcgctgtatctgcgggaggtgctggggctgcgcccggcaccggagttcgaggactggctgtcgcgcatcggcctgctggacgatgccggggcgatccgggacgtgacgggcacggcgcatccgctgacggcgatcgggcgggagctggccgcatga

SEQ ID NO: 27352 - protein, 464 aa, Streptomyces avermitilis
MSTYTARLGGRTHSFPSLAALLAAASPERSGDRLAGLAADSAEARVAARWALAEVPLARFLAEPVIPYEDDDVTRLIVDTHDARAFAPVAGLCVGEFREWLLSDAADAGSLAALAPGLTPEMVAAVSKLMGNADLVAVARKARVVTAFRSTIGLPGRLATRLQPNHPTDDPAGVAAALLDGLLLGSGDAVIGINPATDSPKAVRDLLELLDGVIRRYAIPTQSCVLCHVTTSIDLMERGAPVDLVFQSIAGTQAANASFGVTLGLLDEAYDAARGLGRGTAGQNALYFETGQGSALSANAHHGVDQQTVEARAYAVARRYDPLLVNTVVGFIGPEYLYDGRQILRAALEDHFCGKLLGLPMGLDICYTNHADADDDDIATMLTMLGVAGASFVICTPGGDDIMLNYQSASYHDALYLREVLGLRPAPEFEDWLSRIGLLDDAGAIRDVTGTAHPLTAIGRELAA

SEQ ID NO: 27353 - DNA, 1365 bp, Enterococcus faecalis
  CDS (1)..(1365)
atgattttaaaaaccaaactatttggcaaagtctatcaatttacatccgttaaagaagtcttagccaaagccaatgaagaaaagtctggcgacaagttagctggcgtagctgctaattcagccgaagaacgcgtggcagcaaaagtcgttttatcggaattgtccttaaatgacttgtttaacaatcccgtcgttgattatgacgaagacgaagtgacacgcattattattgaccaagtcaatatgcgaatttttgaaagtattaaacattggacagttgcagaattacgcgaatttatcttatcttcggaaacaaccgattttgatatcaaacgaatttcccgtggactcacttcagaaatgattgctgctgtctgtaaattaatgtccaacatggatctaattgttggcgcaaaaaaaatcaatattgaaaaaaccgccaacacaacaattggccgtcccggaactttttcaaatcgtttacagccaaaccatccaaccgataatgtcgatggcattatggcatcagttatggaaggtctttcttatggcgccggtgatgccttaattggtttgaatcctgttgatgattctacagaaagtgttaaacggatcttaaacaaatttgaagagttccgcagtgaatgggaaattccaacacaaacttgcgtgcttgctcacgtaacgacacaaatggaagccatgcgtcaaggcgcgccaactggcttagtctttcaatccatcgctggttcagaaaaaggaaacactgcatttggtttaaatgcagaaattttagctgaagcacaagatttagcgcttcacagtggtcaagcagctggtcctaatgtgatgtattttgaaacaggtcaaggctcagaactttcttctgaagcgaactttggcgcagaccaagtcacaatggaagcgcgttgttatggcttagccaaaaaatttgatccgtatattgtaaataccgttgtcggctttattggaccagaatatctttacgattcaaaacaagtcatccgcgctggtttagaagatcatttcatgggcaaattaactggaatttcaatgggctgtgatgtctgctacaccaaccatatgaaagctgatcaaaatgatatggaaaacttagcaatgttattagcaacagctggttgtacgtatatcatggggattcctcatggcgatgatgtcatgttaaattatcaaacaactgggttccatgaaactgcgacgattcgtgaaacattaggcttacgtccaattaaagaatttgaagaatggatggaaaaaatgggcttaatggaaaacggaaaattaacaagtcgcgctggcgatgcatctgtatttattaaataa

SEQ ID NO: 27354 - protein, 454 aa, Enterococcus faecalis
MILKTKLFGKVYQFTSVKEVLAKANEEKSGDKLAGVAANSAEERVAAKVVLSELSLNDLFNNPVVDYDEDEVTRIIIDQVNMRIFESIKHWTVAELREFILSSETTDFDIKRISRGLTSEMIAAVCKLMSNMDLIVGAKKINIEKTANTTIGRPGTFSNRLQPNHPTDNVDGIMASVMEGLSYGAGDALIGLNPVDDSTESVKRILNKFEEFRSEWEIPTQTCVLAHVTTQMEAMRQGAPTGLVFQSIAGSEKGNTAFGLNAEILAEAQDLALHSGQAAGPNVMYFETGQGSELSSEANFGADQVTMEARCYGLAKKFDPYIVNTVVGFIGPEYLYDSKQVIRAGLEDHFMGKLTGISMGCDVCYTNHMKADQNDMENLAMLLATAGCTYIMGIPHGDDVMLNYQTTGFHETATIRETLGLRPIKEFEEWMEKMGLMENGKLTSRAGDASVFIK

SEQ ID NO: 27355 - DNA, 1395 bp, Pseudomonas syringae
  CDS (1)..(1395)
atggcgagcttttcccattctgtcggtgcgcagacgtaccgcttcgacagcctcaaagaagtcatggccaaggccagccccgcgcgttccggtgattatctggccgaagtcgcggcgcaaaatgatgccgagcgggttgccgcgcaaatggcgctggccaatattccccttaagcattttcttgaagaagctctgatcccttacgaacaggacgaagtcacccgcctgatcatcgacacccacgacaaactgaccttcgcgccggtcagccacctgaccgtcggcggttttcgtgactggttgctcagcgatcaggccgacgaaaccagcctgcgcgcgctggcgccgggcctgacgcccgagatggcggctgccgtttcaaaaatcatgcgcgtgcaggatctgatcctggtggcgcagaagatccgcgtcgtcacccgctttcgcaacaccatgggcctgcgtggccggctgtctacccgtttgcaacctaatcacccgactgacgacccatccgggattgccgccagcgtgctggacggcctgctgtacggcaacggcgatgccatgatcggcatcaacccggctaccgacagcacctcaagcatcgtcgcgctgctggagatgctcgacgccatcatccagcgctatgacatcccgacccagtcctgcgtgctgacccacgtcaccacctccatcgaggtgatcaaccgtggcgtgccggtcgatctggtcttccagtcgatcaccggtacggaagccgccaacgccagcttcggcatcaacctcaagctgctgcaggaaggctatgaagcagggctgagcctgaaccgcggtaccctcgggcaaaacctgatgtatttcgagaccggtcagggcagcgcgctctcggccaacgcccatcacggcgtcgaccaacagacctgcgaaacccgcgcctacgccgtcgcccggcatttcaacccgtttctggtcaataccgtggtcggtttcatcggcccggagtacctgtacaacggcaagcagatcattcgcgccggcctggaggatcatttctgcggcaagttgctgggcgtgccgatgggctgcgacatctgttacaccaaccacgccgaagccgatcaggacgacatggacaccctgctgacactgctgggcgtcgccggcatcaatttcatcatgggcatccccggctccgacgacatcatgctcaactaccagaccacctcgttccacgacgcgctatacgcccgccagagcctgggcctgcgtccggcaccggaatacgaagcctggctggagaaaatgggcatcttcactcagacagacggccgcgttcgcttcggtgacagcctgccgcctgcctttcgtcaggcactggcgcacctcgcatga

SEQ ID NO: 27356 - protein, 464 aa, Pseudomonas syringae
MASFSHSVGAQTYRFDSLKEVMAKASPARSGDYLAEVAAQNDAERVAAQMALANIPLKHFLEEALIPYEQDEVTRLIIDTHDKLTFAPVSHLTVGGFRDWLLSDQADETSLRALAPGLTPEMAAAVSKIMRVQDLILVAQKIRVVTRFRNTMGLRGRLSTRLQPNHPTDDPSGIAASVLDGLLYGNGDAMIGINPATDSTSSIVALLEMLDAIIQRYDIPTQSCVLTHVTTSIEVINRGVPVDLVFQSITGTEAANASFGINLKLLQEGYEAGLSLNRGTLGQNLMYFETGQGSALSANAHHGVDQQTCETRAYAVARHFNPFLVNTVVGFIGPEYLYNGKQIIRAGLEDHFCGKLLGVPMGCDICYTNHAEADQDDMDTLLTLLGVAGINFIMGIPGSDDIMLNYQTTSFHDALYARQSLGLRPAPEYEAWLEKMGIFTQTDGRVRFGDSLPPAFRQALAHLA

SEQ ID NO: 27357 - DNA, 1395 bp, Pseudomonas putida
  CDS (1)..(1395)
atggcaagtttcgtacacacggtcggccatctggtctaccgcttcgacagcctcaaggaagtgatggccaaggccagcccggcacgctccggggactgcctggcaggcgtggcggccagcaacgacgccgagcgcgtcgccgcgcagatggcgttggccaacattccgctgacgcactttctcaatgaagcactgatcccttacgaagcagatgaagtgacccgcctgatcatcgacacccacgatgcccaggccttcgccccggtcagccacctgaccgtgggtggcctgcgtgactggctgctgagcgaggaagccaacgaagacagcctgcgcgccctggcgcccgggttgaccccggaaatggccgctgccgtgtcgaagatcatgcgcgtgcaggacctggtgctggtggcgcagaaaatccgcgtggtcacccggttccgcggcaccatgggcctgcgcgggcgcctgtcgacccggctgcaacccaaccacccgacagacgaaccggccggtattgccgccagcattctcgacggcttgctgtacggcaacggcgacgccatgatcggcatcaacccggccaccgacagcatcgcttcgatctgcgccctgctggaaatgctcgacgccatcatccagcgctacgacatccccacccagtcctgcgtgctgacccacgtcaccacctcgatcgaagcgatcaaccgcggcgtgccactggacctggtgttccagtccatcgccggcacagaggcggccaacgccggcttcggcatcaacctgaacgtgttgcaggaaggctacgaagcagggctgtcgctgaaacgtggcaccctcgggcagaacctgatgtatttcgaaaccggccagggcagcgcgctctcggccaacgcccaccacggcgtcgaccagcagacctgcgaaacccgcgcctatgccgtggctcgtcacttcaagccgttcctggtcaacaccgtggtcggtttcattggcccggaatacctgtacaacggcaagcagatcatccgcgccggcctcgaagaccatttctgcggcaaactgctgggcgtgccgatgggttgcgatatctgctacaccaaccatgccgaagccgatcaggacgacatggacaccttgttgacgctgctgggggtggccggcatcaacttcatcatgggcatccccggctccgacgacatcatgctcaactaccagaccacctcgttccatgacgcgttgtacgcgcgccagaccctgggcctgaagcccgggccggaattcgaggcatggctggcccgcaccggtatcttcacccaggccgatggccgggtgcgcttcggtgacaacctgccgccggccttccgccaggccttggcacagcttgcatag

SEQ ID NO: 27358 - protein, 464 aa, Pseudomonas putida
MASFVHTVGHLVYRFDSLKEVMAKASPARSGDCLAGVAASNDAERVAAQMALANIPLTHFLNEALIPYEADEVTRLIIDTHDAQAFAPVSHLTVGGLRDWLLSEEANEDSLRALAPGLTPEMAAAVSKIMRVQDLVLVAQKIRVVTRFRGTMGLRGRLSTRLQPNHPTDEPAGIAASILDGLLYGNGDAMIGINPATDSIASICALLEMLDAIIQRYDIPTQSCVLTHVTTSIEAINRGVPLDLVFQSIAGTEAANAGFGINLNVLQEGYEAGLSLKRGTLGQNLMYFETGQGSALSANAHHGVDQQTCETRAYAVARHFKPFLVNTVVGFIGPEYLYNGKQIIRAGLEDHFCGKLLGVPMGCDICYTNHAEADQDDMDTLLTLLGVAGINFIMGIPGSDDIMLNYQTTSFHDALYARQTLGLKPGPEFEAWLARTGIFTQADGRVRFGDNLPPAFRQALAQLA

SEQ ID NO: 27359 - DNA, 1377 bp, Clostridium tetani
  CDS (1)..(1377)
atgagaaaagtgatacttaaaactaagttatttggaaagatatatcagtttaaagatgttaaagaagtattagcaaaagccaatgaagaaaagtcaggagacaaactagcgggggtagctgctaattcagctcaagaaagaattgcagcaaaggttgtattaagtaatctaactgttgcagatttaagaaacaatccagttgttccctatgaaactgatgaaattacaagaattatacaagactctgtaaatgaaaagatatatggagaagttaaaaattggactatttcagagctaagagaatggatactaaatgaaaatacaacaggagctcaaataaaaagaatatctagaggattaacaagtgaagttattgcaggtgttgcaaaacttatgtccaacctagacttaatatatggagcgaacaaaataaaaataacagctcattgtaatactactataggagaaaatggaaggttatctgcaagattacaacctaaccatccaacagatgatgttgatggaatagtagcatctttattagaaggattaagctttggtataggggatgcacttataggattaaatccagttgatgatactactggaagtgtagtaagagtattaaagaaatttgaagagataaaacaaaaatatgaaataccaacacaaaactgtgtattagctcatgtaacaactcaaatggaagctataaaaaagggagctcccacagatttaatattccaaagcatagcgggttcagaaaaaggaaatgcagcttttggaattacagcagatttaattgaggaagctagacaattagcattaaccgaaggtacagcagctggtccaaatgttatgtactttgaaacaggacaaggttcagagctatcagcagaggcacattttggtgctgaccaggtaacaatggaagctagatgttatggatttgctaaaaaatatgaaccttttgtagttaatacagtagttggatttataggacctgagtacctatatgatagcaaagaagttataagagcaggacttgaagatcactttatgggtaaattaactggtatatcaatgggatgcgatgtttgctatacaaatcatatgaaagcagaccaaaatgatgcagaaaatttagcagtattactttcaacagcaggatgcaattactttatgggaatacctcatggagatgacgtaatgcttaactatcaaactacaggatatcatgaaacagcaagtttaagagagttattaaataaaagaccaatagttgaatttgaaggttggttagaaaagtggggattcatgaaagatggaaaattaacatcaaaagcaggagatgcttctgtgtttcttaaaaagtag

SEQ ID NO: 27360 - protein, 458 aa, Clostridium tetani
MRKVILKTKLFGKIYQFKDVKEVLAKANEEKSGDKLAGVAANSAQERIAAKVVLSNLTVADLRNNPVVPYETDEITRIIQDSVNEKIYGEVKNWTISELREWILNENTTGAQIKRISRGLTSEVIAGVAKLMSNLDLIYGANKIKITAHCNTTIGENGRLSARLQPNHPTDDVDGIVASLLEGLSFGIGDALIGLNPVDDTTGSVVRVLKKFEEIKQKYEIPTQNCVLAHVTTQMEAIKKGAPTDLIFQSIAGSEKGNAAFGITADLIEEARQLALTEGTAAGPNVMYFETGQGSELSAEAHFGADQVTMEARCYGFAKKYEPFVVNTVVGFIGPEYLYDSKEVIRAGLEDHFMGKLTGISMGCDVCYTNHMKADQNDAENLAVLLSTAGCNYFMGIPHGDDVMLNYQTTGYHETASLRELLNKRPIVEFEGWLEKWGFMKDGKLTSKAGDASVFLKK

SEQ ID NO: 27361 - DNA, 1527 bp, Bradyrhizobium japonicum
  CDS (1)..(1527)
atgcagaacgaagatggacgcggcgttaacgcgcctttgtccttggtcgaaagaaaggtaagttatttcagcgtcttgatccgaaggtatagtttcaggatagtcctggagtcggcctttggccgacgaaccccggaggggaccttggtctatcgccataccatcgacgccacgacctatgccttcccggatctgcgcgacctgctcgccaaggcgacgccgccgcgctccggcgaccggctggccggaattgccgctgccagcgccgagcagatgatcgcggcgcggatggcgctcgcggatgttccgctcggacagttcttgcaggaagcgctcatcccctacgagaccgacgaggtcacccgcctcgtcatcgacagccatgacgcaagggcctttgcgccggtggcctcgctcacggtcggcgccttccgcgactggctgctgtcggacgcagcgacgcccgagatcctgcgcaagctcgcccccggcatcacgccggaaatggcggccgcggtctcgaaactgatgcgcaaccaggatttgatcctggcggcgcggaaatgcgaggtgaccaccgccttccgcaacaccatcgggctgaagggccggatgagcacgcggctccagcccaaccatccgttcgacgatgccaggggcatcaccgcctcgatcctcgacggcatcctgctgggggccggcgatgcctgcatcggcatcaatcccgccagcgacgacccgaccgtcatcgcccaattgctgcgcctgctcgacgagatcatcgcgcggctgaagcttccgacgcaaggctgcgtgctcacccatgtcacgacgacgctgtcgctgatcgggcagggcgtgccggtcgacctcgtcttccagtcggtcgccggcaccgaggccgccaaccgtagctttggcgtcgatctcgacttgctccgggaggcgcaggaggccgggcggtcgcagcggcgcggcacggtcgggcagaacgtgatgtatttcgagaccggccagggttcggcgctgtccgccaatgcccatcacggcgtcgaccagcagacctgcgaggcgcgcgcctatgcggtcgcacgcgcctatgccccgctgctggtcaacagcgtggtcggcttcatcggcccggaatatctctacgacggcaaggaaatcatccgggcggggctggaggatcatttttgcggcaagctgctcggcctgccgctcggggtcgacatctgctacaccaaccacgccgaggcagaccaggacgacatggataacctgctgacgctgctcgccgccgccggcgtcaccttcatcatgggcgtccccggcgccgacgacgtcatgctgaattaccagtctacgtcttttcacgacgcgctctatgtccgcgacgtcttcggtttgcgccgcgcgccggaattcgacgactggctggcgcagtcgggcatcgtgggcgccgatttccgccttgccggcgatgcaggcctgctgcccgattttgcctcccggctgatcgcctga

SEQ ID NO: 27362 - protein, 508 aa, Bradyrhizobium japonicum
MQNEDGRGVNAPLSLVERKVSYFSVLIRRYSFRIVLESAFGRRTPEGTLVYRHTIDATTYAFPDLRDLLAKATPPRSGDRLAGIAAASAEQMIAARMALADVPLGQFLQEALIPYETDEVTRLVIDSHDARAFAPVASLTVGAFRDWLLSDAATPEILRKLAPGITPEMAAAVSKLMRNQDLILAARKCEVTTAFRNTIGLKGRMSTRLQPNHPFDDARGITASILDGILLGAGDACIGINPASDDPTVIAQLLRLLDEIIARLKLPTQGCVLTHVTTTLSLIGQGVPVDLVFQSVAGTEAANRSFGVDLDLLREAQEAGRSQRRGTVGQNVMYFETGQGSALSANAHHGVDQQTCEARAYAVARAYAPLLVNSVVGFIGPEYLYDGKEIIRAGLEDHFCGKLLGLPLGVDICYTNHAEADQDDMDNLLTLLAAAGVTFIMGVPGADDVMLNYQSTSFHDALYVRDVFGLRRAPEFDDWLAQSGIVGADFRLAGDAGLLPDFASRLIA

SEQ ID NO: 27363 - DNA, 1410 bp, Xanthomonas campestris
  CDS (1)..(1410)
atgagtggatttgccttcagtgccggcggcgagcgcttccgcttcgccgatctgaaggacctgctggccaaggccacgcccgcgcgctcgggcgatcagttggccgggctggcggcccactccgaattgcagcgtgtcgccgcgcagatggcgctcgcggagctgccgctgcggcatttcctcgacgaggcggtggtgccgtatgaaagtgatgaggtcacgcgcctgatcgtcgatcagcacgatgctgccgcgtttgcgccggtggcgcacctcaccgttggcgggtttcgcgattggctgctgggcgcgcaggccgacgacgccgcgctggcggcattggcaccggggctgatgccggaaatggtggccgccgtctccaaactgatgcgggtgcaggacttgatcctggtcgcgcagaaaacccgcgtggtcacccgcttccgcaacacgctggggttgcgtggccgcctgtccacgcgcctgcagcccaaccatcccaccgacgatgccaccggcattgccgccagcgtgctggatggcctgctgtacggcaacggcgatgcggtgatcggcatcaatccggccagcgacagcctggccgcgaccaccgcgctgctgcgcatgctcgatgcggtgatcactggctacggcatccccacccaggcgtgcgtgctcgcgcatatcaccaccaccatcgatgcgatcaaccgcggcgtgccggtggacctggtgttccagtccattgccggcaccgaagcggccaacaccagcttcggcatcaacctggcgttgctgcagggagggctggacgcgggcttgtcgcaacagcgcggcagcgtgggcaacaacgtgatgtatttcgaaaccggccagggcagcgcgctgtcggccaatgcgcatcatggcgtggatcaacagacctgcgaggtgcgtgcctacgcagtggcgcgccagttcaacccgctgctggtcaataccgtggtgggcttcatcggcccggaatatctctacgacggcaaacagatcatccgtgcgggactggaggaccatttctgcggcaagctgcttggcgtgccgatgggctgcgacatctgctacaccaaccatgccgaagccgatcaggacgacatggacatgctgctgaccctgctcggcaccgccggcatcaacttcatcatgggcattccgggctcggacgatgtgatgctcaactaccagaccacctccttccacgacgcgctgtacgcgcggcaggcgctaggcctgcgccccgcgccggagttcgaacactggctggacacgcaaggcatcctgcgcctgcgcgatggccggttcgaattgggcagtgagatgccggcgccgtttcgcaaggcgctgtcacagctggatgcggagcaacgcggatga

SEQ ID NO: 27364 - protein, 469 aa, Xanthomonas campestris
MSGFAFSAGGERFRFADLKDLLAKATPARSGDQLAGLAAHSELQRVAAQMALAELPLRHFLDEAVVPYESDEVTRLIVDQHDAAAFAPVAHLTVGGFRDWLLGAQADDAALAALAPGLMPEMVAAVSKLMRVQDLILVAQKTRVVTRFRNTLGLRGRLSTRLQPNHPTDDATGIAASVLDGLLYGNGDAVIGINPASDSLAATTALLRMLDAVITGYGIPTQACVLAHITTTIDAINRGVPVDLVFQSIAGTEAANTSFGINLALLQGGLDAGLSQQRGSVGNNVMYFETGQGSALSANAHHGVDQQTCEVRAYAVARQFNPLLVNTVVGFIGPEYLYDGKQIIRAGLEDHFCGKLLGVPMGCDICYTNHAEADQDDMDMLLTLLGTAGINFIMGIPGSDDVMLNYQTTSFHDALYARQALGLRPAPEFEHWLDTQGILRLRDGRFELGSEMPAPFRKALSQLDAEQRG

SEQ ID NO: 27365 - DNA, 1410 bp, Xanthomonas axonopodis
  CDS (1)..(1410)
atgagcggctttgccttcaccgcaggcggcgagcgttttcggtttgccgatctgaagcagctgctggccaaggcgacgccggcacgctccggcgaccagctggccggccttgccgccgactccggcctgcagcgcgtcgccgcacagatggcgctggccgatctaccgctgcagcatttcctgcaggaggcggtggtgccttatgaagcagacgaagtcacccggctgatcatcgaccagcacgatgccgttgcatttgccgctgtggcgcatctcaccgtgggcggcttccgcgattggctgctgagtgcgcaggccgacgaagccgcattgaccgcattggcacccggcctgacgccggaaatggtggccgcggtgtccaaattgatgcgggtgcaggacctgatcctggtggcgcagaaaacccgggtcgtcacccgctttcgcaacacgctggggttgcgcggacgcctgtcgacgcgcctgcagcccaaccaccccaccgatgacgccaccggcattgccgccagcgtgctcgacggcttgttgtacggcaacggcgacgcggtgatcggcatcaacccggccagcgacagcctggccgcaaccacggccttgttgcgcatgctcggtgcggtgatcagcggttatcggatccccacgcaatcgtgcgtgctagcgcacatcaccaccaccatcgaagcgatcggtcgtggcgtgccggtggatctggtgtttcagtcgatcgccggcaccgaagcggccaacgccagcttcggcatcaatctggccttgctgcaggaaggttacgaagcgggcctgtcgctgcgccgcggcaacgtcggcgataacgtgatgtatttcgaaaccggccagggcagcgcgttgtcggccaatgcgcaccacggcgtggatcaacagacctgcgaggtgcgcgcctatgcggtggcgcgccactacaaaccgctgctggtgaacaccgtggttggcttcatcgggccggaatatctctacgacggcaagcagatcatccgcgccgggctggaggatcacttctgcggcaagttgctcggcgtgccgatgggctgcgacatctgctacaccaatcatgccgaggccgatcaggacgacatggatatgttgctcaccctgctcggtactgccggcatcaatttcatcatgggcattcccggctcggacgatgtgatgctgaactaccagaccacctcgtttcacgatgcgctgtatgcacgccaggcgctcggcctgcgcgctgcgcccgagttcgaacagtggctggagcagcacgacatcctgcagctgcgcgatggccgcttcgaacttggtagcgacgtaccggcgccatttcggcgtgcattggcacaggccagcggtagagcggcgccatga

SEQ ID NO: 27366 - protein, 469 aa, Xanthomonas axonopodis
MSGFAFTAGGERFRFADLKQLLAKATPARSGDQLAGLAADSGLQRVAAQMALADLPLQHFLQEAVVPYEADEVTRLIIDQHDAVAFAAVAHLTVGGFRDWLLSAQADEAALTALAPGLTPEMVAAVSKLMRVQDLILVAQKTRVVTRFRNTLGLRGRLSTRLQPNHPTDDATGIAASVLDGLLYGNGDAVIGINPASDSLAATTALLRMLGAVISGYRIPTQSCVLAHITTTIEAIGRGVPVDLVFQSIAGTEAANASFGINLALLQEGYEAGLSLRRGNVGDNVMYFETGQGSALSANAHHGVDQQTCEVRAYAVARHYKPLLVNTVVGFIGPEYLYDGKQIIRAGLEDHFCGKLLGVPMGCDICYTNHAEADQDDMDMLLTLLGTAGINFIMGIPGSDDVMLNYQTTSFHDALYARQALGLRAAPEFEQWLEQHDILQLRDGRFELGSDVPAPFRRALAQASGRAAP

SEQ ID NO: 27367 - DNA, 1368 bp, Fusobacterium nucleatum
  CDS (1)..(1368)
atgatactaagtgttgagctatttgaccatgtttacaatttttcttctttaaaggaagttatggcaaaagctaatgaaaaaaaatctggagatacacttgcaggtattgcagcaagttcatcaaaagaaagagtggcagctaaggttgttttatcaaaaattaccttaaaggatttaaaagaaaatccagcagttccttatgaggaagatgaagttacaagaatcattatagatgacttaaatcttcaaatttatgacgaaataaaagattggacagtttctgatctaagagaatggcttttaagcgaagaagctacaccatcaaaaattaattggataagaagaggtcttacatcagaaatgatagcagcagtagcaaagttaatgtctaatatggatttaatagtggcagctaaaaagattgaagttcgtgcacattgtaacacaacaattggaggatatgatactcttgcagtgagattacaaccaaatcatacaacagatgaccctgatgggataatgatttctactcttgaaggattaagttatggaataggggatgctgttatagggttaaacccagttgatgatagtgttgacagtgttatggcagttatggaaagattccataaaataaaaactgaatatcaaattcctactcaaacttgtgtattagcacacgttactacacaaatggaagctattaaaagaggagcgaaggtagatatgatattccaaagtatagcaggttccgaaaaagggaatgaagcatttggaataactggagccatgatagaagaagcaagacaactaggtttaaaatatggtacagcagcaggaccaaacataatgtattttgaaacaggacaaggttcagaactatcatcagatgcacataatggagcagaccaagttacaatggaagctagatgttatggatttgcaaaaagattccaaccattcctagtaaatacagttgttggatttataggaccagaatatctatacgatagtaaacaagttataagagcaggtttagaagatcactttatgggtaaattacatggtttaccaatgggagttgatgtatgttacacaaaccacatgaaagcagaacaaagtgatgttgaaattcttgccacattattaactgctgctggatgtaattactttatgggagtaccagcaggggacgatataatgcttaactatcaaacaacaggattccatgataatcaaagtttaagagaactatttggaaaacaaccaattaaggaatttaaagaatggttagtaaaatatggatttatgacagaagatggaaaattaacagagaaggctggagatccttcagtatttcttaaataa

SEQ ID NO: 27368 - protein, 455 aa, Fusobacterium nucleatum
MILSVELFDHVYNFSSLKEVMAKANEKKSGDTLAGIAASSSKERVAAKVVLSKITLKDLKENPAVPYEEDEVTRIIIDDLNLQIYDEIKDWTVSDLREWLLSEEATPSKINWIRRGLTSEMIAAVAKLMSNMDLIVAAKKIEVRAHCNTTIGGYDTLAVRLQPNHTTDDPDGIMISTLEGLSYGIGDAVIGLNPVDDSVDSVMAVMERFHKIKTEYQIPTQTCVLAHVTTQMEAIKRGAKVDMIFQSIAGSEKGNEAFGITGAMIEEARQLGLKYGTAAGPNIMYFETGQGSELSSDAHNGADQVTMEARCYGFAKRFQPFLVNTVVGFIGPEYLYDSKQVIRAGLEDHFMGKLHGLPMGVDVCYTNHMKAEQSDVEILATLLTAAGCNYFMGVPAGDDIMLNYQTTGFHDNQSLRELFGKQPIKEFKEWLVKYGFMTEDGKLTEKAGDPSVFLK

SEQ ID NO: 27369 - DNA, 1368 bp, Clostridium perfringens
  CDS (1)..(1368)
atgattttaaaaacaaaattatttggaaaagtctatgctttcaaatctttaaatgaggttatggctaaggcaaacgaagagaaatcaggagatagattagctggattagcagcagagtcttcagaagaaagagtagcagcaaaggttgtattatcaaatataactttagaggatttaagaaataacccagcagttccttatgaaatagatgaggtaactagaataattcaagatgatgtaaatgaaaaaatatacaatgaaataaaacattggacagtatctgaatttagagagtggatattagatgaaaatacaacaggtgctgatataagaagaatttcaagaggtttaacttctgaaatggtagcagctgtagcaaaattaatgtctaatatggacttaatatatggagcaagaaaaataaaggtaacagctcactgtaacacaacaataggtgaaaaaggaactttatctgcaagacttcaaccaaaccatccaacagatgatccagatggaataatggcttcattattagaaggattaacttttggtgttggagatgcagttttaggattaaacccagttgatgactctgttgagagtgttactaaagtattaaagagatttgatgaaataaaaagaaaatttaaaataccaactcaaacttgtgtactagctcacgtaacaactcaaatggaagctataagacaaggggcacctacagacctaatattccaatcaatagcaggttctgaaaagggaaatgaagcttttggatttaatgcagcaactatagaagaagctagacaattagctttaaaacaagggacggctacaggaccaaatgtaatgtactttgaaacaggacaaggttcagagctttcatcagatgctcaccatggagttgaccaagtaactatggaagctagatgttatggattcgctaagagattccaaccattcttagttaacacagttgttggattcataggaccagagtatttatatgattcaaaacaagttataagagcaggtcttgaagaccacttcatgggtaaattaacaggaataccaatgggatgtgatgcatgttatacaaaccacatgaaagcagaccaaaatgatatagaaaacttagctgtattattaacaacagcaggatgtacttatttcatgggaattccacatggagatgacgtaatgcttaactatcaaactacaggataccatgaaacagcagctttaagagaaatgtttggattaacagctattaaagagttccaagattggttagttgaaatgggattcgtagacgaaaatggaaagcttactaaaaaagcaggagatgcatctgtacttttaggatag

SEQ ID NO: 27370 - protein, 455 aa, Clostridium perfringens
MILKTKLFGKVYAFKSLNEVMAKANEEKSGDRLAGLAAESSEERVAAKVVLSNITLEDLRNNPAVPYEIDEVTRIIQDDVNEKIYNEIKHWTVSEFREWILDENTTGADIRRISRGLTSEMVAAVAKLMSNMDLIYGARKIKVTAHCNTTIGEKGTLSARLQPNHPTDDPDGIMASLLEGLTFGVGDAVLGLNPVDDSVESVTKVLKRFDEIKRKFKIPTQTCVLAHVTTQMEAIRQGAPTDLIFQSIAGSEKGNEAFGFNAATIEEARQLALKQGTATGPNVMYFETGQGSELSSDAHHGVDQVTMEARCYGFAKRFQPFLVNTVVGFIGPEYLYDSKQVIRAGLEDHFMGKLTGIPMGCDACYTNHMKADQNDIENLAVLLTTAGCTYFMGIPHGDDVMLNYQTTGYHETAALREMFGLTAIKEFQDWLVEMGFVDENGKLTKKAGDASVLLG

SEQ ID NO: 27371 - DNA, 1395 bp, Ralstonia solanacearum
  CDS (1)..(1395)
atggcccgtttctcccacaccctcggtcacgagacctaccgcttcgacaacctgcgggacgtgctggccaaggccagcccggcccgttccggcgatgcgctggccggcatcgcggcggccagcgcggccgagcgcgtggcggcgcagatggcgctggccgagatcccgctgaggcacttcctcgatgaagccgtcatcccgtacgaggcggacgaggtcacccggctgatcgtcgacacgcacgatgcggccgccttcgcgccggtcagccacctcaccgtcggcgatttccgcgactggctgctgggcgatgcggcggacgaagccgcgctggccgcgctggcgccgggcctgacgcccgagatggcggcggcggtgtccaagctgatgcgggtgcaggacctgatcctggtggcgcagaagacgcgcgtggtcacgcgctttcgcaacaccatcggcctgcgcgggcgcatggccacgcgcctgcagcccaaccacccgaccgacgacccggccggcattgccgccagcctgctcgacggcctgatgtacggcagcggcgatgcggtgatcggcgtcaatccggtgtccgacagcaccgctgccatctgcgacctgctggggatgctcgacgccgtgatccggcgctacgacattcccacccaggcctgcgtgctgacgcacgtgacgaccaccctcgaggcgatccgtcgcggcatgccggtggacctcgtgttccagtccatcgccggcaccgaggcggccaatgcgagctttggcgtgagcctggcgctgctgcacgaggcgcgcgacgcggcgcttggcctgcaacgcggcaccgtgggcgacaacgtgatgtatttcgagaccggccagggcagcgcgctgtcggccaacgcgcaccacggcgtcgaccagcagacctgcgaggcgcgtgcctacgcggtggcgcggcgcttccggccgttgctggtcaacaccgtggtcggcttcatcgggccggagtacctgtacgacggcaagcagatcctgcgcgcggggctggaggaccacttctgcggcaagctgctcggcgtgccgatgggctgcgacatctgctacaccaaccacgccgaggccgaccaggacgacatggacacgctgctcacgctgctgggcgcggccggagtcaactacatcatgggcattcccggctccgacgacgtgatgctgaactaccagaccacctcgttccacgatgcgctctacgtgcgccgcgtgctcggcctgcggcccgcgccggaattcgaggattggctcgcgcgcatgggcatctgcacggcgggcgatggccgcatcgccctggccgacggtctgcccgatccgttccgccgggcggtggcgcaactggcatga

SEQ ID NO: 27372 - protein, 464 aa, Ralstonia solanacearum
MARFSHTLGHETYRFDNLRDVLAKASPARSGDALAGIAAASAAERVAAQMALAEIPLRHFLDEAVIPYEADEVTRLIVDTHDAAAFAPVSHLTVGDFRDWLLGDAADEAALAALAPGLTPEMAAAVSKLMRVQDLILVAQKTRVVTRFRNTIGLRGRMATRLQPNHPTDDPAGIAASLLDGLMYGSGDAVIGVNPVSDSTAAICDLLGMLDAVIRRYDIPTQACVLTHVTTTLEAIRRGMPVDLVFQSIAGTEAANASFGVSLALLHEARDAALGLQRGTVGDNVMYFETGQGSALSANAHHGVDQQTCEARAYAVARRFRPLLVNTVVGFIGPEYLYDGKQILRAGLEDHFCGKLLGVPMGCDICYTNHAEADQDDMDTLLTLLGAAGVNYIMGIPGSDDVMLNYQTTSFHDALYVRRVLGLRPAPEFEDWLARMGICTAGDGRIALADGLPDPFRRAVAQLA

SEQ ID NO: 27373 - DNA, 1392 bp, Agrobacterium rhizogenes
  CDS (1)..(1392)
atgtattcgatcatacttggacgcgagcgccatgtcttcgccgacctgaaatcggtcatggcctgtgcctcgccactcaagtcaggcgatgtgcttgcgggggttgcagcgtcaagcaacgagcggcgggtggctgcccgctgcctgcttgccgacatgccgctcaagacattcctggaggatttgttgatcccctacgaagccgacgaggtcagccggttgatcatcgatcgccacgacccaattgcctttgcgccggtttcacatatgacggtcggcgagtttcgcaattggcttctctcctacgacgcgacaaccgaaaggctggcagcactcgcgacgggcctaacgccggaaatggtcgcggcggtctccaagatcatgcgcaatcacgatctgatcaccgttgccggtaaatgtaacgtggtcactgccttccgctccaccatcggcctgcagggcaggctgtcgagccggctccagcccaaccacccgaccgacgatccagaaggcgtcgccggttcgacattggacggccttctctacggaatcggcgatgcggtgatcggcataaatcccgccaccgacaacctcgatgcctgcaccaggttgatggtccttttcgaccggctgcgcgagcggttcgagattcccacccaatcctgcgtgctgactcatgtcaccacttccatcaaggcgatcgaggccggggcgccgctcgatgttgtgttccagtcgattgccggcaccgaggctgccaacaatggtttcggcgtcgatctcgccgttctcagggaaggcaatgaggccgcgctgtcgatgaagcgcggcagcgtcggaaacaacgtgatgtatctggagaccggtcagggcagcgctctttcggcagatgcacatcacggcgtggatgaacagacggtcgaggtgcgggcttacgcagtcgcacgtgaactccgcccgctgctcgtcaacaccgtggtcggtttcattggaccggaatatctgttcgacgccaaacagatcattcgcgccgggctagaggatcatttctgcggaaaactgctcggtgtgccgatgggggtcgatgtctgctataccaaccatgccgaggcagaccaggacgacatggacaatctgatggtgctgttgaccgtcgcgggcgtcagtttcatgattgccgtgcccggcgctgatgacgtcatgctcaactaccagagcctgtcttatcacgatatcgtcggcctcaggcaccagttcaatcgtccgccggcgcccgaatttgaggcctggctcaatcgcatgggcatgcttgatcactcgggccggctggcgcccgccagcgcctcgggccaattctctcgcaatctcttgagctacggggtgtccgcatga

SEQ ID NO: 27374 - protein, 463 aa, Agrobacterium rhizogenes
MYSIILGRERHVFADLKSVMACASPLKSGDVLAGVAASSNERRVAARCLLADMPLKTFLEDLLIPYEADEVSRLIIDRHDPIAFAPVSHMTVGEFRNWLLSYDATTERLAALATGLTPEMVAAVSKIMRNHDLITVAGKCNVVTAFRSTIGLQGRLSSRLQPNHPTDDPEGVAGSTLDGLLYGIGDAVIGINPATDNLDACTRLMVLFDRLRERFEIPTQSCVLTHVTTSIKAIEAGAPLDVVFQSIAGTEAANNGFGVDLAVLREGNEAALSMKRGSVGNNVMYLETGQGSALSADAHHGVDEQTVEVRAYAVARELRPLLVNTVVGFIGPEYLFDAKQIIRAGLEDHFCGKLLGVPMGVDVCYTNHAEADQDDMDNLMVLLTVAGVSFMIAVPGADDVMLNYQSLSYHDIVGLRHQFNRPPAPEFEAWLNRMGMLDHSGRLAPASASGQFSRNLLSYGVSA

SEQ ID NO: 27375 - DNA, 27 bp, Primer
atgaaaaatgccaatcatcgattcttc

SEQ ID NO: 27376 - DNA, 24 bp, Primer
ttagaagaacagtgacggatcgcc

SEQ ID NO: 27377 - DNA, 927 bp, Escherichia coli K12
  CDS (1)..(927)
atgtctgagcagtttttgtatttcttgcagcagatgtttaacggcgtcacgctgggcagtacttacgcgctgattgccatcggctacaccatggtttacggcattatcggcatgatcaacttcgcccacggcgaggtttacatgatcggcagctacgtctcatttatgatcatcgccgcactgatgatgatgggcattgataccggctggctgctggtagcggcgggattcgtcggcgcaatcgtcattgccagcgcctacggctggagtatcgaacgggtggcttaccgcccggtgcgtaactctaagcgcctgattgcactcatctcggcaatcggtatgtccatcttcctgcaaaactacgtcagcctgactgaaggttcgcgcgacgtggcgctgcccagcttgtttaatggtcagtgggtagtgggtcatagcgaaaacttctctgcctctattaccaccatgcaggcggtgatctggattgtcaccttcctcgccatgctggcgctgacgattttcattcgttattcccgtatggggcgcgcctgccgtgcctgcgccgaagatctgaaaatggcgagcctgcttggcattaacaccgaccgggtgattgctttgacctttgtgattggcgcggcgatggcggcggtggcgggcgtactgctcggtcagttctacggcgtcattaacccctatatcggctttatggccgggatgaaagcctttaccgctgcggtgctcggtgggattggcagcattccgggagcgatgattggcgggctgattctggggattgcggaggcgctctcttctgcctacctgagtacggaatataaagatgtggtctcattcgccctgctgattctggtgctgctggtgatgccgaccggtattctgggtcgcccggaggtagagaaagtatga

SEQ ID NO: 27378 - protein, 308 aa, Escherichia coli K12
MSEQFLYFLQQMFNGVTLGSTYALIAIGYTMVYGIIGMINFAHGEVYMIGSYVSFMIIAALMMMGIDTGWLLVAAGFVGAIVIASAYGWSIERVAYRPVRNSKRLIALISAIGMSIFLQNYVSLTEGSRDVALPSLFNGQWVVGHSENFSASITTMQAVIWIVTFLAMLALTIFIRYSRMGRACRACAEDLKMASLLGINTDRVIALTFVIGAAMAAVAGVLLGQFYGVINPYIGFMAGMKAFTAAVLGGIGSIPGAMIGGLILGIAEALSSAYLSTEYKDVVSFALLILVLLVMPTGILGRPEVEKV

SEQ ID NO: 27379 - DNA, 1017 bp, Archaeoglobus fulgidus
  CDS (1)..(1017)
atggtccgagttcgtgatgcttctaacgatcgtggcgattctaattgtcaagccaacgggtctgttcggggtggaagaatgaggataacaagggcctttaacgcgctggctttgattgtcgctgcggtcatgccgttcattcttccggaggcgtacctttacatcctcggcctcgcgtacattttcgcaataatggttatcagctgggacctcatggtaggctacacggggcaggtgaacctgggccacacaacctttgtggggcttggagcttacgttgcagcaattctgcagactcctataagggcggggctgtcgctgcatccggcattggcaataataaccggcggtgttgttgcggcaggagttgggctttcaattggtattatcacgctcagactcagaggctactacttttccctggttacggcaatacttccgctcgtcttcatgcagacggtcttcatctggagggagctttttggtggtgaggaaggatttgcgatagagaacacgatgctcacaacaaccgtggagaagtactacttcagccttgcagttctcgtcgtgtccttagtcgtaatgaagaaggtggtggacagcaggattgggctgaggtttatggctttgagggacagcgaggagcttgccgagagtctgggaataaacgcgaccaaatacaaggttctcgccttcgcgctaagctccttctttgcgggaattgctggagcgatggtcgttaactaccgcgttaccgtaagtccggagctttacggagtacctttgatgctgctgataatcctctcagccgttctcggaggactggggactctttacggccctcttgctggagccatagtaatttaccttgcgaagaactggtggctcggacagatcattcgaacgctctctctccctataaacgacgacatcgtcctctacgcccttctgatagccgtcggaattctgatgccggaaggtctttaccacaaggtaaaagtcaataagcagaagtaa

SEQ ID NO: 27380 - protein, 338 aa, Archaeoglobus fulgidus
MVRVRDASNDRGDSNCQANGSVRGGRMRITRAFNALALIVAAVMPFILPEAYLYILGLAYIFAIMVISWDLMVGYTGQVNLGHTTFVGLGAYVAAILQTPIRAGLSLHPALAIITGGVVAAGVGLSIGIITLRLRGYYFSLVTAILPLVFMQTVFIWRELFGGEEGFAIENTMLTTTVEKYYFSLAVLVVSLVVMKKVVDSRIGLRFMALRDSEELAESLGINATKYKVLAFALSSFFAGIAGAMVVNYRVTVSPELYGVPLMLLIILSAVLGGLGTLYGPLAGAIVIYLAKNWWLGQIIRTLSLPINDDIVLYALLIAVGILMPEGLYHKVKVNKQK

SEQ ID NO: 27381 - DNA, 894 bp, Archaeoglobus fulgidus
  CDS (1)..(894)
atgatgattgaaataaattatttcatgaacctgctcttagggggactcgtagtggggttcatttatgccctaacggcactggggattacaataatctacggtattttgcagattccggatttctcccacgggaacagatacatgatcggtgcttacgcgggattccttgcagcctcagtagctggcagcatgcttgaaatcagctatgttgctgcaattctcggtgcagtagcagtctcttccgtaattgccgttctgagctaccttttcgtttacaagagattgctaagtgctcctcacataacgtcattcattgcagcaataggtcttttaatgctgctggaaggattcgccctggcagtcttcggtccgagataccagcgcattcacacacccttcgactacatggttgttattggagcactgagaattaacgcgcagaggcttatcgtccttttctgctccatcgccgccatagcgtctctgctgtactttttgagaaggacggtaaccggaatagctctcgaggctgttgctcaatcgccaataggagcgaagctcgttggaatcaacaccgataagatgacgctaatagcctttgccattgccggggcgcttgcaggtttcgcagcggcattaattgctccaataactcttgtgtatcctataatgggtgctgagctcaacttgaaggccttcgtaatctgcgtcgttggtgggcttgggaacatcccgggtgccatagccggagggctggtcctcggaattgttgaatccctctacggcggttattttgacatcaggtggaaaaacctcgttgcgtttgggattcttgtcgccatcctgattctcaagccagaaggtctgtttggtaagaaggagaggagagcatga

SEQ ID NO: 27382 - protein, 297 aa, Archaeoglobus fulgidus
MMIEINYFMNLLLGGLVVGFIYALTALGITIIYGILQIPDFSHGNRYMIGAYAGFLAASVAGSMLEISYVAAILGAVAVSSVIAVLSYLFVYKRLLSAPHITSFIAAIGLLMLLEGFALAVFGPRYQRIHTPFDYMVVIGALRINAQRLIVLFCSIAAIASLLYFLRRTVTGIALEAVAQSPIGAKLVGINTDKMTLIAFAIAGALAGFAAALIAPITLVYPIMGAELNLKAFVICVVGGLGNIPGAIAGGLVLGIVESLYGGYFDIRWKNLVAFGILVAILILKPEGLFGKKERRA

SEQ ID NO: 27383 - DNA, 1278 bp, Pseudomonas aeruginosa
  CDS (1)..(1278)
atgagcaacgagacttccatcgatctcaagcagtgcgtcctcgatgccgtgctctccgggttgatcgccctggtggtgttcggccccatcgtcggcgtggtcctcgacggctacggcttcaacctgcattacgagcgggtcggctggatcatcgcgatcgtgatggccgggcgcttcctgctcagcctctacctgcagacccgcggcgggcgcgccgtgctggagcgcttcgagggggctggcagcggcgtccacgtcctgccgccgggctacaagacccgcttgcgctggatcgtgccgctgatcctggtggccgcggtgatcttcccgttcttcgccagcaagtacctgctggcggtggtcatcctcggcctgatctacgtgctgctgggcctgggcctgaacatcgtggtcggcctcgccgggctgctcgacctcggctacgtggccttctacgccatcggcgcctatggcctggcgctgggctaccagtacctcggcctgggcttctggaccgtcctgccgctggccgcgctgaccgccgcggtggccggggcgatcctcggcttcccggtgttgcgcatgcatggcgactacctggcgatcgtcaccctgggcttcggcgagatcatccgcctggtactgaacaactggctgtccttcaccggcgggccgaacggcatgccggcgccggcgccgaccttcctcggcctggagttcggccgccgggccaaggatggcggggtgccgatccacgagttcctcggcatcgcctacaaccccaacatgaagttcctgttcatctacgtggtgctgttcctggtcgtgctgctggtgctctacatcaagcaccggctgacccggatgccggtcgggcgcgcctgggaggcgctgcgcgaggacgagatcgcctgtcgcgcgatgggcctcaaccatgtgctggtgaaactctcggcgttcatgctcggcgcctccaccgcgggactggccggggtgttcttcgccagctaccagggcttcgtcaacccgtcctcgttcaacttcttcgagtcggcgctgatcctcgccatcgtcgtgctcggcggcatgggctcgacggtcggggtggtgatcgccgccttcgtcctcaccgtggcgccggagctgctgcgcagcttcgccgacatccgcgtgctgctgctcgggatactcatggtggtgatgatgatctggcggccgcgcgggctgatccgcatcagccgggtgggcttcgccccgcgcaagggggtggcgccatga

SEQ ID NO: 27384 - protein, 425 aa, Pseudomonas aeruginosa
MSNETSIDLKQCVLDAVLSGLIALVVFGPIVGVVLDGYGFNLHYERVGWIIAIVMAGRFLLSLYLQTRGGRAVLERFEGAGSGVHVLPPGYKTRLRWIVPLILVAAVIFPFFASKYLLAVVILGLIYVLLGLGLNIVVGLAGLLDLGYVAFYAIGAYGLALGYQYLGLGFWTVLPLAALTAAVAGAILGFPVLRMHGDYLAIVTLGFGEIIRLVLNNWLSFTGGPNGMPAPAPTFLGLEFGRRAKDGGVPIHEFLGIAYNPNMKFLFIYVVLFLVVLLVLYIKHRLTRMPVGRAWEALREDEIACRAMGLNHVLVKLSAFMLGASTAGLAGVFFASYQGFVNPSSFNFFESALILAIVVLGGMGSTVGVVIAAFVLTVAPELLRSFADIRVLLLGILMVVMMIWRPRGLIRISRVGFAPRKGVAP

SEQ ID NO: 27385 - DNA, 957 bp, Streptococcus pneumoniae
  CDS (1)..(957)
atgaaggaaaatttaaaagttaatattctatggttactccttttgttagctggctatagcttgattagtgtactggtttcagtcggagtacttaatctattctatgtacagattttacaacaaattggaattaatattattttggctgttggtctcaacttaatcgttggtttttcaggacaattttcacttggtcatgctggtttcatggcgattggtgcctatgcagcagctattattggttctaaatcaccaacctacggtgccttctttggagctatgcttgtaggggctttgctttcaggagcagttgccttacttgtcggcattccaaccttgcgcttgaagggggactatcttgcggtagcaactctaggtgtttctgaaattatccgtatctttatcatcaatggtggaagccttacaaatggtgcggcaggtatcttagggattcctaactttacaacttggcaaatggtttacttctttgtcgtgattacaaccattgcaaccttgaacttcttgcgtagcccaattggtcgttcaaccctctctgttcgtgaagatgaaatcgctgctgagtcagttggggttaatacgactaaaattaaaatcatcgcttttgtctttggtgccattactgcaagtattgctgggtcacttcaggcaggatttatcgggtctgttgtaccgaaagattacaccttcatcaactcaatcaacgttttgattattgttgtatttggtggactcggttccattacaggtgcgattgtttcggctattgttctgggaattttgaatatgcttctccaagatgttgctagtgtgcgtatgattatttacgctttggccttggtattggtaatgattttcagaccaggtggactccttggaacatgggaactgagcctatcacgtttctttaaaaaatctaagaaggaggaacaaaactaa

SEQ ID NO: 27386 - protein, 318 aa, Streptococcus pneumoniae
MKENLKVNILWLLLLLAGYSLISVLVSVGVLNLFYVQILQQIGINIILAVGLNLIVGFSGQFSLGHAGFMAIGAYAAAIIGSKSPTYGAFFGAMLVGALLSGAVALLVGIPTLRLKGDYLAVATLGVSEIIRIFIINGGSLTNGAAGILGIPNFTTWQMVYFFVVITTIATLNFLRSPIGRSTLSVREDEIAAESVGVNTTKIKIIAFVFGAITASIAGSLQAGFIGSVVPKDYTFINSINVLIIVVFGGLGSITGAIVSAIVLGILNMLLQDVASVRMIIYALALVLVMIFRPGGLLGTWELSLSRFFKKSKKEEQN

SEQ ID NO: 27387 - DNA, 999 bp, Brucella melitensis
  CDS (1)..(999)
atggaccgctcccctgttcgagctgaacttccaatcacggaccagaccatggatcagattctctttgccgtattgaacggcgcgatctacggattgctgctgttcatggtttcggcgggtctcaccctcattttcggcatgatgggggttctcaacttcgcacatgcttccttctatatgatgggagcctatttcgcttacacgcttcagccgcttaccggcttctggcttgcaatcctgattgcgcccgtgatcgtcggcattgtcggcattgtcggcgttctggttgaacgcttcattttgcgccgtgtccacgctttcggccatgcgcatgaattgctggtcacgttcggcctctcggtggtcattgctgaagtcatcaagattttctacggcaatttcgccgtcgaataccgcattcccgcagcactgcaattttcggctttcgatcttggcggggtgagctatccattctaccgcctgttcataggtgccgtggcgctggtgatgttcctgctgatctatctgctgctcacgcgcacccgcatcggcatcgtcgttcgctcggcaatctatcgcccgcgcatggtggaggcgctcggccacaatgttccgctggtcttcatgggcgtgttcggcgtcggcgcattccttgccggccttgccggttcggtggcgggcgcgttctatacgacaaacccgaacatggcgctggaactgggcgtcatggtcttcgtggtcgtcgtcgtgggcgggcttggctcgcttggcggagccatgtttgcttcgcttctgatcggcattctttcctccgtcgccgttggcgtgaaggtctcgatcgcaagcctcctcgattatgtggggcttggcgattatgcccgtgaaatcggcggcgtgctgacgctggaagtctccagcattgcagccaccctgccattcttcctgatgcttatcgttctcctggtacgtccaagcggactgttcggggcaaaggagtaa

SEQ ID NO: 27388 - protein, 332 aa, Brucella melitensis
MDRSPVRAELPITDQTMDQILFAVLNGAIYGLLLFMVSAGLTLIFGMMGVLNFAHASFYMMGAYFAYTLQPLTGFWLAILIAPVIVGIVGIVGVLVERFILRRVHAFGHAHELLVTFGLSVVIAEVIKIFYGNFAVEYRIPAALQFSAFDLGGVSYPFYRLFIGAVALVMFLLIYLLLTRTRIGIVVRSAIYRPRMVEALGHNVPLVFMGVFGVGAFLAGLAGSVAGAFYTTNPNMALELGVMVFVVVVVGGLGSLGGAMFASLLIGILSSVAVGVKVSIASLLDYVGLGDYAREIGGVLTLEVSSIAATLPFFLMLIVLLVRPSGLFGAKE

SEQ ID NO: 27389 - DNA, 942 bp, Agrobacterium tumefaciens
  CDS (1)..(942)
atggacgaggcgatttccagcatcgagagcgcactggccttctgggattatgcgcagaatgtctggtatggcctgtcgctcggttccgtgctgctgctggccgccatcggccttgccatcaccttcggcgtgatgggcatcatcaacatggcacatggcgagatggtgatgatcggcgcttactccaccttcatggtgcaggaagtgatccgcagtcacttccccggcctgttcgactggtcgctggcgattgccttgccagtcgcctttctggtgacaggttttgtcggcctcgtgatggaacgaggcgtcatccgcttcctctacgggcggcctttggaaacgctgctcgccacctggggcatctcgctgatgttgcaacagggcgtacgctccattttcggccccaccaaccgggaggttggcagccccggctggatgtccggctccttcagcgtcggttatctcaatttcacctggaaccgggtgtggatcgtctgcttctcgctgtcggtgttcttcgcgctgctggtgcttctgaagcgctccgccttcggtctgcagatgcgcgccgtgactcagaaccgccgcatggcctcctccatgggcattcgcacgccctgggtggatgccttcaccttcgcgctcggttcaggcgttgccgggcttgccggcgttgcgctatcgcagatcgacaatgtctcgcccaatctcggccagagctacatcatcgacagtttcatggtggtggtgttcggcggcgtcggcaatctctggggaacgctggtgggtgcattgtcgctcggcgtgctcaacaagttcctcgagccgacggtgggcgccgtgctcggcaagatcctcgtgctcgttctcatcatcctgttcatccagaagcggccgcgcggtctcttcgcactcaagggaagggcgatcgaagcatga

SEQ ID NO: 27390 - protein, 313 aa, Agrobacterium tumefaciens
MDEAISSIESALAFWDYAQNVWYGLSLGSVLLLAAIGLAITFGVMGIINMAHGEMVMIGAYSTFMVQEVIRSHFPGLFDWSLAIALPVAFLVTGFVGLVMERGVIRFLYGRPLETLLATWGISLMLQQGVRSIFGPTNREVGSPGWMSGSFSVGYLNFTWNRVWIVCFSLSVFFALLVLLKRSAFGLQMRAVTQNRRMASSMGIRTPWVDAFTFALGSGVAGLAGVALSQIDNVSPNLGQSYIIDSFMVVVFGGVGNLWGTLVGALSLGVLNKFLEPTVGAVLGKILVLVLIILFIQKRPRGLFALKGRAIEA

SEQ ID NO: 27391 - DNA, 897 bp, Agrobacterium tumefaciens
  CDS (1)..(897)
atggcttatttcctgcaacaattgctgaatgccgtgccggtcgcagccctctatgcggttctggccttcggctacgccatcgccttctcggtcacgaaacgcgccgatgtgacctatggcgccatctttgccttcgccgggcagacttgcctgctttttgctgacttcggctggaaccggctgtggctggttctgccggcaacattggcgctgggggcaggggccggcctgttcggcgggctttgggccgcgggtctcatcggtagggcggtcatgcggccgctggcaaaggcctctcccaacgcggtgaccgtggcctccatcggcgtgctgattgcgctcacggaaagcgcaaggctcgccgccgatacaaggcaattatggctgccgccgcttttgtcgcagccagtacgtttctggatcgagggcggctttgccgtcaccctgacaccgattcagatgttgaatacagccgtcttctgccttctcattctcacaggttcgctttatctcggccgttccgctttcggcaggcgctggaaggccgtgtcggacgatgcctttgccgcctcgctcctgggggtgaacgcgagcaggatatttctgctgtcctattgcgcggcgggtctcgtggcagccatcgccggcgtgctcgccacgttttattacggcaccatggattttggcgccggtctcgtttttggcctgaaagtcgtgctgatctcggcggcgggcggatatgccagcccgctcatctgcggcctgggggcggcagccatcggttttgcggaaacattctgggtcggttacggccccgtcgcctggcgggatgcggcggttcttgccttgctggttggctggctcatcgtcatgcgcagccgggttgaagcagcttag

SEQ ID NO: 27392 - protein, 298 aa, Agrobacterium tumefaciens
MAYFLQQLLNAVPVAALYAVLAFGYAIAFSVTKRADVTYGAIFAFAGQTCLLFADFGWNRLWLVLPATLALGAGAGLFGGLWAAGLIGRAVMRPLAKASPNAVTVASIGVLIALTESARLAADTRQLWLPPLLSQPVRFWIEGGFAVTLTPIQMLNTAVFCLLILTGSLYLGRSAFGRRWKAVSDDAFAASLLGVNASRIFLLSYCAAGLVAAIAGVLATFYYGTMDFGAGLVFGLKVVLISAAGGYASPLICGLGAAAIGFAETFWVGYGPVAWRDAAVLALLVGWLIVMRSRVEAA

SEQ ID NO: 27393 - DNA, 1035 bp, Agrobacterium tumefaciens
  CDS (1)..(1035)
atggacgcgacaattgccactttcctgatccaggacggcgtcaccaacggcgcgatttatgcgctgctgggccttgccatcgttctggttttctcggtcacgcgggtgatcttcattccgcagggtgagttcgtcgcccatggcgctttgaccctggcgctgctggatgccggccgtgtgccgggcacgctgaacctgctgctgtgcatgggcgtcgtcgctcttgtgctggatctgtgggcaatgcggcgggacatgcgccttccgcgactgttgcaggcgcttgccgtcaaccttgccctgcccggcgcgatttacgggctcgtcgcaattctggcgcccatgcagctcccctcgttcctgcgtgccatgattaccatcgcgatcatcgcgcccatgggatattacgtctatcgcatcgcctaccggccgctttccgatgcttccgttctcgttctgctgattgcctccgtcggtgtgcatctggcgttgatgggcctcgggctcgctttcttcggtccggaaggcctgcgcgcggcggcgctcagtgatggtggtttcacgctggggccaatgctcgttactgcccagagcattttcatctatctcgcgaccatcctcgtcatgatcggtctttacctgtttttcgaaaagacactgctcggcaaggcgctgaaagcaacggcgatcaaccggctcggcgcccgtctcgtcggtgttcgaacggaactcaccggcgtcaccgcctttgtgctggccgcagccatagccgcgatttcgggcgtattgatcgggccaatcacgaccatcttctacgatacgggcttcctcattggtctcaagggttttgtcgctgccattctcggcggcatggcgagctttcccgtcacggcggttgcggcggtgggcgttggactcatcgaggctttcgcctccttttttgctagcgacttcaaggagatcatcgtgttcggcctcatcgtgcccgttttgatctggctttccttcggcgcaagccatcatgaggaagagtga

SEQ ID NO: 27394 - protein, 344 aa, Agrobacterium tumefaciens
MDATIATFLIQDGVTNGAIYALLGLAIVLVFSVTRVIFIPQGEFVAHGALTLALLDAGRVPGTLNLLLCMGVVALVLDLWAMRRDMRLPRLLQALAVNLALPGAIYGLVAILAPMQLPSFLRAMITIAIIAPMGYYVYRIAYRPLSDASVLVLLIASVGVHLALMGLGLAFFGPEGLRAAALSDGGFTLGPMLVTAQSIFIYLATILVMIGLYLFFEKTLLGKALKATAINRLGARLVGVRTELTGVTAFVLAAAIAAISGVLIGPITTIFYDTGFLIGLKGFVAAILGGMASFPVTAVAAVGVGLIEAFASFFASDFKEIIVFGLIVPVLIWLSFGASHHEEE

SEQ ID NO: 27395 - DNA, 864 bp, Brucella melitensis
  CDS (1)..(864)
atgaatcttttcttacagatcgtcatcaatggcattcttctgggcgggctctatgccatcatggcgcagggcctcgctctggtctggggcgtgctgaacatcgtcaacctcgcccacggcacgatgattatgctgggtggttacgttacctggctggtatttgccaattttggcatcgatccattcatcggcgtatttgcagcagcagccgtgatgttctgtttcggttacgccctgcaacgctgcgtcctcaatcttgtcgcacgcgggccgatgtttaatgcgctgctcatcacattcggcattgaaattatctttacagacgtggcgcaacacgtcttctcggccgattttcgcgctattattccctcctattcggcggtgaatttcaacgtctacggcatcaccatcccgctgatgaacctgctcgccttcatcgcagccttcgtggtttccggcttcatgttctttttcatgatgacgacgaaactcggccgcgccattcgcgccacggcgcaaaacctcaccgcagcacggctttacggtgttgaaccgcgccatctttatgccgtcacctttggcatcggtgtggcaatcgctggtgttgcgggcgggctttacgcaaccgtcaaccagctcaatccctatatcggtgtgccgctgacggccaaaagcttcgcaatcaccatcattggcggcctcgacaatccgctcggcgtcatcctgggtgggctgatcctcggtgtcatcgaatcccttaccgtgctctatctcggcgacacttaccgcaacgtggtcagcttcagtattctcgttctcgtactgatcattcggcccggtgggcttttggggaaaacggcatga

SEQ ID NO: 27396 - protein, 287 aa, Brucella melitensis
MNLFLQIVINGILLGGLYAIMAQGLALVWGVLNIVNLAHGTMIMLGGYVTWLVFANFGIDPFIGVFAAAAVMFCFGYALQRCVLNLVARGPMFNALLITFGIEIIFTDVAQHVFSADFRAIIPSYSAVNFNVYGITIPLMNLLAFIAAFVVSGFMFFFMMTTKLGRAIRATAQNLTAARLYGVEPRHLYAVTFGIGVAIAGVAGGLYATVNQLNPYIGVPLTAKSFAITIIGGLDNPLGVILGGLILGVIESLTVLYLGDTYRNVVSFSILVLVLIIRPGGLLGKTA

SEQ ID NO: 27397 - DNA, 924 bp, Brucella melitensis
  CDS (1)..(924)
atgggtggcttctctatggaatatttcttccagcaggtgatcaacgggcttgcgctcggttcgatttatggcctgatcgccatcggttatacgatggtctatggcattatcggcatgatcaactttgctcatggcgatatcttcatgctcggcgcgttcatggcgctgattgttttcctcattatcacgaccttcatcggaatgctgccggttgcactgatgctgcttttgatgatgatcgtcgccatgcttctgacgggtctgtggagctgggcgatcgagcgcgtggcctatcaaccgctgcgtggttcgttccgccttgcgccgctgatcacggctatcggcatgtcgattgccttgtcgaacttcgttcaggtcacgcagggtccgcgcaacaagccggttccccagcttctgaatggttcctacgagctgttcggcagcggcggcacgatctcgctcaagcagatcgtggtgatcgtggttacggcaatattgctcacgatcttctggtatgtcgtcaaccgcacctcgctggggcgcgcgcaaagggcttgcgagcaggatcgcaagatggcggcccttcttggcatcaatgtcgaccgtgtcatctcgctcaccttcgtgatgggcgccatgctggcggccgtagccgggacgctttacctctccttctatggcgtgatttcgttcgctgacgggttcatccccggtgtgaaggcgttcacggcggcggttctgggcggcatcggctcgcttccgggggctgttgtcggcgggttgcttatcggtctcatcgaagcgttgtggtcggcctatttctcgatcgactacaaggacgtcgccgcgttctcgatcctggctatcgtgctgatcttcatgccgtccggcattcttggccgacctgacgtcgaaaaggtgtaa

SEQ ID NO: 27398 - protein, 307 aa, Brucella melitensis
MGGFSMEYFFQQVINGLALGSIYGLIAIGYTMVYGIIGMINFAHGDIFMLGAFMALIVFLIITTFIGMLPVALMLLLMMIVAMLLTGLWSWAIERVAYQPLRGSFRLAPLITAIGMSIALSNFVQVTQGPRNKPVPQLLNGSYELFGSGGTISLKQIVVIVVTAILLTIFWYVVNRTSLGRAQRACEQDRKMAALLGINVDRVISLTFVMGAMLAAVAGTLYLSFYGVISFADGFIPGVKAFTAAVLGGIGSLPGAVVGGLLIGLIEALWSAYFSIDYKDVAAFSILAIVLIFMPSGILGRPDVEKV

SEQ ID NO: 27399 - DNA, 927 bp, Yersinia pestis
  CDS (1)..(927)
atgtcagagcagtttttatattttctgcagcagatgttcaacggtattacgttgggcagcacttatgcgctgatcgccattggttataccatggtgtacggcattatcggcatgatcaactttgctcacggcgaagtatatatgatcagcagttacgtctcatttatcgtgatcgccgcattaatgatggtggggatcgatgccagttggctgttgattggttgcgctttcctagtgtcgattgtgatcgccagtacttacggctggagcattgaacgggtagcctataagccagttcgtcgctctaagcgcctgatcgcgctgatttcggcgatcggcatgtctattttcctacagaactatgtcagcttgacgcaaggttcacgggatttggcattacccagtctggtcaccgggcagtggaccttaggtgagagtaatggctttgctgcgacgatcagcaccatgcagctgacgatttggattgtcaccttcttggccatgttggcgctgactctgtttatccgttattcacgaatgggccgtgcttgccgcgcctgtgccgaagatttgaaaatggccagtttactgggcattaacactgaccgggttatctcgctgacttttgtgattggcgcactgatggccgctgtcgcgggtgtgttactcggccagttctacggggtgatcaatccctatattggctttatggcagggatgaaagcattcactgccgcagtattaggcggtattggcagtattccgggcgcaatgattggtggtttggttctcggtgtggctgaagcactgacctccgcttatctcagcactgaatacaaagatgcggtttcattcgcgctgctgattgtggtgttgttagtgatgcctaccgggattttaggccgtccggaggttgaaaaagtatga

SEQ ID NO: 27400 - protein, 308 aa, Yersinia pestis
MSEQFLYFLQQMFNGITLGSTYALIAIGYTMVYGIIGMINFAHGEVYMISSYVSFIVIAALMMVGIDASWLLIGCAFLVSIVIASTYGWSIERVAYKPVRRSKRLIALISAIGMSIFLQNYVSLTQGSRDLALPSLVTGQWTLGESNGFAATISTMQLTIWIVTFLAMLALTLFIRYSRMGRACRACAEDLKMASLLGINTDRVISLTFVIGALMAAVAGVLLGQFYGVINPYIGFMAGMKAFTAAVLGGIGSIPGAMIGGLVLGVAEALTSAYLSTEYKDAVSFALLIVVLLVMPTGILGRPEVEKV

SEQ ID NO: 27401 - DNA, 867 bp, Nostoc sp. PCC 7120
  CDS (1)..(867)
atggacatacaaacgattcaactgattgtcaatggtattgctgtaggtagtattatcgctcttgcagctgtgggactgactttaacttatggaattttacggttgtctaattttgcccacggtgatttcttaactttaggggcttatctgactttttttgtcaacacttttggggtaaatatttggttatcgatgatagtggcagtagtgggaacggtgggagtaatgttactgtcagaaaaattgctatggtctagaatgcgctcgattcgagctaattccactactcttattattatctcaattgggctggcattattcctgcgtaacgggattattttaatttggggtggcaggaaccaaaattataatttacccatcacccccgccttagatattttcggagtgaaagtaccacaaaatcaattgctggtgttggcattggcagtattatccatcggcgcactgcactacctcttacaaaacacaaaaattggtaaggcgatgcgtgctgttgctgacgatttggatttagccaaggtttcaggtattgatgtagagcaagtaattttttggacttggctaattgccggcacagtcacctctttaggtggcagtatgtatggcttaattacggcagtgcgtcccaatatgggttggttcttgattctgccgctattcgcttctgtaatcttgggcggtattggcaacccttacggtgcgatcgccgcagcttttatcattggtattgttcaagaagttagtacacccttcttaggttcccaatacaaacaaggtgtagccctactaatcatgattttggtgttgctcattcgtcctaaaggtttatttaaaggcacgatgtga

SEQ ID NO: 27402 - protein, 288 aa, Nostoc sp. PCC 7120
MDIQTIQLIVNGIAVGSIIALAAVGLTLTYGILRLSNFAHGDFLTLGAYLTFFVNTFGVNIWLSMIVAVVGTVGVMLLSEKLLWSRMRSIRANSTTLIIISIGLALFLRNGIILIWGGRNQNYNLPITPALDIFGVKVPQNQLLVLALAVLSIGALHYLLQNTKIGKAMRAVADDLDLAKVSGIDVEQVIFWTWLIAGTVTSLGGSMYGLITAVRPNMGWFLILPLFASVILGGIGNPYGAIAAAFIIGIVQEVSTPFLGSQYKQGVALLIMILVLLIRPKGLFKGTM

SEQ ID NO: 27403 - DNA, 951 bp, Nostoc sp. PCC 7120
  CDS (1)..(951)
atggatattagtgtatttttacaacaattattgaatgggttatctattggcagcgtttatgcaatctttgccttaggttatacattggtttattccattttgggaattattaatttagcacatggggcaatttttactctgggagcatattttacttatgctcttatgggtggaacctttgggtttaatggtttgctggctaacgctactttgccgatacaattaccatttgctatggcattgattatgggtagtagtttagctggtttagtgggagtagcaatggaaagaattgcttttcaacctttacgaaaaaaaggatctgacaccttactaactgtggtttctagcttaggggtagcagtggtaattgtgaacctaattcaatatttagtaggtgcagaaagttatacatttccagcaaatacttttgggaatttacccccagcgtttaactttggaactttggaaaaaccgattcctattcgtagcgtacaggtggtaatttttactgtatctgttgtgattgtggctattcttacttactttattaatcgtactaaatacggtaaagcaattcaggcgatcgccgaagatgccactactgctagtttattaggtatcaatagcgatcgctttattgtcttaactttttttatcagcagttttctcgctggcttggcgggtacattagtcgcttctagtgtaagcattgcaggcccttattttgggattggctttgggttgcggggtttagcggtgattgttttgggtggcttaggtagcattcctggcgcagtgctgggaggtttactgattggtgtggttgaggcgctggttccctctgattactctggttataaagacgctgtagctttcggcattttgtttatcatgctattagttagaccccaaggattattaggtcgtcggtttattcagaaagtctga

SEQ ID NO: 27404 - protein, 316 aa, Nostoc sp. PCC 7120
MDISVFLQQLLNGLSIGSVYAIFALGYTLVYSILGIINLAHGAIFTLGAYFTYALMGGTFGFNGLLANATLPIQLPFAMALIMGSSLAGLVGVAMERIAFQPLRKKGSDTLLTVVSSLGVAVVIVNLIQYLVGAESYTFPANTFGNLPPAFNFGTLEKPIPIRSVQVVIFTVSVVIVAILTYFINRTKYGKAIQAIAEDATTASLLGINSDRFIVLTFFISSFLAGLAGTLVASSVSIAGPYFGIGFGLRGLAVIVLGGLGSIPGAVLGGLLIGVVEALVPSDYSGYKDAVAFGILFIMLLVRPQGLLGRRFIQKV

SEQ ID NO: 27405 - DNA, 903 bp, Agrobacterium tumefaciens
  CDS (1)..(903)
atggagtattttatccagcagctcatcaacgggctgactcttggatcgatctatggcctcatcgctatcggctacacgatggtttacggcatcatcggcatgatcaacttcgcccatggcgatattttcatgcttggcggctttgccgcgctgatcgtatttctgatcgcaacatcgtttttcgccggcattccggtggcgcttcttctgcttttgatgatgatcgtcgccatgctgatgaccggcctgtggaactgggtgatcgagcgtgttgcctaccgcccgctcagaggttccttccgccttgcgccgctgatcactgccatcggcatgtcgatcgcgctgtccaacttcattcaggtcacccagggcccgcgcaacaagccgatcccgtcgatggtgacggaaagctatcatttcggcgccatcaccgtgtcgctgaagcagctgatcatcatggtcgttacctcggtactgcttttcgccttctggtatatcgtcaacaagaccccgctcggccgggcgcagcgcgccaccgagcaggaccgcaagatggccgcccttttgggggttgatgtggacaagacgatttccatcaccttcatcatgggtgcggcgctggctgcggtcgcgggcaccatgtatctgatgtattacggtgttgcttcgttcagcgacggcttcgttcccggcgtcaaggccttcaccgcggccgtcctcggcggcatcggctcgcttccgggcgccgttcttggtggcctgctgatcggtctcatcgaatcactgtggtcggcctatttctccattgcctacaaggatgttgcggcattcggcatcctggcattcgtgctgatcttcaagccgaccggtattctcggtcgtccggaagtcgagaaggtgtga

SEQ ID NO: 27406 - protein, 300 aa, Agrobacterium tumefaciens
MEYFIQQLINGLTLGSIYGLIAIGYTMVYGIIGMINFAHGDIFMLGGFAALIVFLIATSFFAGIPVALLLLLMMIVAMLMTGLWNWVIERVAYRPLRGSFRLAPLITAIGMSIALSNFIQVTQGPRNKPIPSMVTESYHFGAITVSLKQLIIMVVTSVLLFAFWYIVNKTPLGRAQRATEQDRKMAALLGVDVDKTISITFIMGAALAAVAGTMYLMYYGVASFSDGFVPGVKAFTAAVLGGIGSLPGAVLGGLLIGLIESLWSAYFSIAYKDVAAFGILAFVLIFKPTGILGRPEVEKV

SEQ ID NO: 27407 - DNA, 924 bp, Pseudomonas aeruginosa
  CDS (1)..(924)
atgcccgagatttatcattacctacaacaattggttaacggcctgaccgtcggcagcacctatgcgctgatcgcgatcggctacaccatggtctacggcatcatcggcatgatcaacttcgcccacggcgaggtgtacatgatcggctcgtacatcgccttcatcgccatcaccctgctggcgatgatggggctggacagcgttccgctgatgatgctcgccgcattcgccgccagcatcatcgtcaccagtgctttcggctacagcatcgagcgggtcgcctaccgcccgttgcgcggcggcaaccgcctgatcccgctgatctccgcgatcggcatgtcgatcttcctgcagaacgccgtgatgctctcgcaggactccaaggaaaaggccatcccgaccctgctgcccggcaacttcgtgttcggcgaaagcagcatgaacggcgtggtgatctcctatatgcagatcctgatcttcgtcgtcaccttcctggtgatgttcggcctcaccctgttcatctcccgttcccgcctgggccgcgcctgccgcgcctgcgccgaggacctgaagatgaccaacctgctgggtatcaacagcaacaacatcatcgccctcaccttcgtcatcggcgccgccctggccgccgtcgccgcggtgctgctgggcatgcagtacggcgtgatcaaccccgggatcggcttcctcgccgggatcaaggcgttcaccgccgcggtgctcggcggcatcggtagcatccccggcgccatgctcggcggcctgctgctgggcgtcgccgaagccttcggcgccgacgtgttcggcgaccagtacaaggacgtggtggccttcggcctgctgatcctggtgctgctgttccgacctaccggcatcctcggtcgtccggaggtggaaaaagtatga

SEQ ID NO: 27408 - protein, 307 aa, Pseudomonas aeruginosa
MPEIYHYLQQLVNGLTVGSTYALIAIGYTMVYGIIGMINFAHGEVYMIGSYIAFIAITLLAMMGLDSVPLMMLAAFAASIIVTSAFGYSIERVAYRPLRGGNRLIPLISAIGMSIFLQNAVMLSQDSKEKAIPTLLPGNFVFGESSMNGVVISYMQILIFVVTFLVMFGLTLFISRSRLGRACRACAEDLKMTNLLGINSNNIIALTFVIGAALAAVAAVLLGMQYGVINPGIGFLAGIKAFTAAVLGGIGSIPGAMLGGLLLGVAEAFGADVFGDQYKDVVAFGLLILVLLFRPTGILGRPEVEKV

SEQ ID NO: 27409 - DNA, 798 bp, Aeropyrum pernix
  CDS (1)..(798)
atgggtcttgccatgatctggggcgttatggagatcattaacttcgcgcatggcgattttatgatgcttggagctctggcagcctactatgcgttcacgctaatggggttagaccccttggctggtggtgtattagcgtttgtaatggtgttcgcactgggtgtgggggtgcagcgcggcgttataaataggatattagatgctccgttattgacgcagatagccgctacattcgctgtcctccttataatacggtatggggtgcaggctgtcctgggcccctacactaggaggcttgtcacgtggtatcaggactattacgtggggctgggattcactactgtacccctctctaagcttcttatattcctggtatcactcgtcatattggccctactatatatattgctgaacaggactgacatggggatagccattagggctacatcacagaataggatggtggcgcagctgatgggaataaatgtatctagggtttacgacgtaaccttcgggattggtgtcggtgtagctgcagtagggggcgccctggtagcgttgttctacccaatattccctgagatggggggattcttcgcgttaatagcatttatagcggtcgtcctcggaggctttggcaacgtgtatggagcctatgtgggaggtttgattataggcgttacggagagtgttagcgcgttatttatagagcccgcattgaaggatgtagtagccttcctactattcatactcatcataatgattaagccgacaggattatttggtaggggtgaatga

SEQ ID NO: 27410 - protein, 265 aa, Aeropyrum pernix
MGLAMIWGVMEIINFAHGDFMMLGALAAYYAFTLMGLDPLAGGVLAFVMVFALGVGVQRGVINRILDAPLLTQIAATFAVLLIIRYGVQAVLGPYTRRLVTWYQDYYVGLGFTTVPLSKLLIFLVSLVILALLYILLNRTDMGIAIRATSQNRMVAQLMGINVSRVYDVTFGIGVGVAAVGGALVALFYPIFPEMGGFFALIAFIAVVLGGFGNVYGAYVGGLIIGVTESVSALFIEPALKDVVAFLLFILIIMIKPTGLFGRGE

SEQ ID NO: 27411 - DNA, 885 bp, Aeropyrum pernix
  CDS (1)..(885)
atggccggcctcctggagcagtgggggaacctggttttccagggcgtcctcatggggctcctatactccctcatagccctaggctacaacatcgtctacagggtcaacaagtccataaacttcgcagtacccgaggttgtgctactagcagcctacctggcttggatagcctcgatagccacgggcaacctcctggcggctgtggccatagctctagccgccagcatcgccgtcagcatggccatggagaggttcgtcgcgaagcctctgctaggccgtccccccatagccttgattggagcaaccctgggactattctacatgcttaagggtgttgtcctaatagttggaaagggcgaggtcgcggtactccccttctaccccgaagtgtacaggctgggcttcctgacgctcggcacaaacgatgttatagcccttctaggctcgatagccgtgctagccggcatcatcgtcctccataggaaaactagcttcggcgctgctatgaggggtgtggcggaggacgcagagggcgcagccgcctacgggctccctgtgaggaggctcatgctggccggctgggctcttgccggcctcgtgagcggcctcgcagccctcctcctctcaatcaaaacacaggtgtcgccggacctcgagttcttcgcgataatagccctagcagctagccttatagcgggtctcgacagcctgggaggaatagtcgtgggaggcgtcttcctcggcctggccgagcagatagccagcaaaactctggacccctacctgcccggtatagggagggatatcgcgttcttcatactattcctagtactcctagtcaagccctacggcctcttcggcagtgagaggatagagaggctctag

SEQ ID NO: 27412 - protein, 294 aa, Aeropyrum pernix
MAGLLEQWGNLVFQGVLMGLLYSLIALGYNIVYRVNKSINFAVPEVVLLAAYLAWIASIATGNLLAAVAIALAASIAVSMAMERFVAKPLLGRPPIALIGATLGLFYMLKGVVLIVGKGEVAVLPFYPEVYRLGFLTLGTNDVIALLGSIAVLAGIIVLHRKTSFGAAMRGVAEDAEGAAAYGLPVRRLMLAGWALAGLVSGLAALLLSIKTQVSPDLEFFAIIALAASLIAGLDSLGGIVVGGVFLGLAEQIASKTLDPYLPGIGRDIAFFILFLVLLVKPYGLFGSERIERL

SEQ ID NO: 27413 - DNA, 1065 bp, Aeropyrum pernix
  CDS (1)..(1065)
atggttgacgttaaggtagtgtttgacatgctcgcatactcgggggtcatagcactcctgagcctgggcataacgcttgcatacataacaaccagggtgttcaacttcgcccacccaaggatagccaacgtgggggcctatgcggccgccgcctccatggcactctatgtggacctggtgcgtgacgagggtataggccggtttaaagtctcgctaggccccctcgaggttacagggctggtggcgcccgacgttctagccgtcgggatagtgttcgcggtcatagccgggattatcactgcgctagccgaatactacctcgtcctcaggcccctgatagagaggggcgccgacttcctgaagcttatgatagcaacacttgctttcgacttcttcgtcatagcaacactgttcatcctcgggacacacatatccgtcaaggagctggtcagcggagtcttcggaagggagaccacaagcctttctctacacgccttcgacgccagaatcgacctagccgtgctaggctataagctgagagggattatgctgttctccttcctaggaagcctagccatagccctaatgctctacatactactcttcaagaccaagctgggcgtaaagatgagggcctccatagagaacccctccctggccgaggtcctcggcataaacgtgcagcaggtgtacactatagcctggataataagcggggccacggcagggttcgccgggttccttatactgttcatgggcgacatcgtgaagcccgtgacagcgtcgagcccggccgacgagataatagtgagcgccttcgcaggcagcatagttggcggggtcaacagcgtgttcggctccatagggggaggcttcataataggcgctgtggagatactgatatcctcagttataacagacgtcactggcatagacgttaccagatacaacaagatgctctcgatgctggcagtagccctgaccctactcttcgcgccgcagggactggccgctctatactccgaaaagattcaggccaggcttcccaggctgaggggaggctag

SEQ ID NO: 27414 - protein, 354 aa, Aeropyrum pernix
MVDVKVVFDMLAYSGVIALLSLGITLAYITTRVFNFAHPRIANVGAYAAAASMALYVDLVRDEGIGRFKVSLGPLEVTGLVAPDVLAVGIVFAVIAGIITALAEYYLVLRPLIERGADFLKLMIATLAFDFFVIATLFILGTHISVKELVSGVFGRETTSLSLHAFDARIDLAVLGYKLRGIMLFSFLGSLAIALMLYILLFKTKLGVKMRASIENPSLAEVLGINVQQVYTIAWIISGATAGFAGFLILFMGDIVKPVTASSPADEIIVSAFAGSIVGGVNSVFGSIGGGFIIGAVEILISSVITDVTGIDVTRYNKMLSMLAVALTLLFAPQGLAALYSEKIQARLPRLRGG

SEQ ID NO: 27415 - DNA, 1047 bp, Deinococcus radiodurans
  CDS (1)..(1047)
atgcgtcggccgtccggcggcagcgctcccggtgggcgctcgccccgggcggccccgacgttgggggtggcaatggaacccagtcagctgatccagaatctggtcaacggcctggcgatcggcagcgtctacgcgattttcgcgctgggctacacgctgatcttctcgattctgggcatcatcaatttcgcgcagggggccgtgtttacgctgggcgcctacctgacctacaccctggtgtcggggcagttcgagaacaacgggctgctcaagggcatcaatctctttcccgacggctcaccgctggcaggcaatccctgggcctttgggctcgccaccctgctcggctcggcgctggcgggtttgatcgcggtggtgatcgagcgcctcgccttccggcccatgcgggcgcgcggggccgagccgctgctggcgctggtgagcagcctgggggtggcgctggtgatcgtcaacctcattcaactgctcgtcggcgccgagagctacagcttcccggccaatgcctacggcgagtttccgcccgcgctgacctttcatgtgggcgacaaggtggtggcggtccgcaccgtgcaactggtgattttcgccgtcagcatggtgatgctgggcattctgggctacgtcatcgggcgcaccaagatcggcaaggcgttgcgggcggtggccgaaaatcccggcacggcgagcctgctcggcatcagcgtggaccgctacgtgctgatcacttttttcctctcgggctttttgggtgggctggcgggcacgctggtgtcgctggcgttcggcatcggcgggccgtacttcgggcaggccttcgggctcaaggggctggcggtcatcgtgctcggcgggctgggcagcattcccggcgcggtgctcggcggtctggtgatcggcctggccgaggcgttcgtgcccgccgactacagcgcctacaaggacgcggtggccttcgcgctgctgtttatcgtgctgctgctgcggccccaggggctgctcggcaaggcccaggttcagaaggtgtga

SEQ ID NO: 27416 - protein, 348 aa, Deinococcus radiodurans
MRRPSGGSAPGGRSPRAAPTLGVAMEPSQLIQNLVNGLAIGSVYAIFALGYTLIFSILGIINFAQGAVFTLGAYLTYTLVSGQFENNGLLKGINLFPDGSPLAGNPWAFGLATLLGSALAGLIAVVIERLAFRPMRARGAEPLLALVSSLGVALVIVNLIQLLVGAESYSFPANAYGEFPPALTFHVGDKVVAVRTVQLVIFAVSMVMLGILGYVIGRTKIGKALRAVAENPGTASLLGISVDRYVLITFFLSGFLGGLAGTLVSLAFGIGGPYFGQAFGLKGLAVIVLGGLGSIPGAVLGGLVIGLAEAFVPADYSAYKDAVAFALLFIVLLLRPQGLLGKAQVQKV

SEQ ID NO: 27417 - DNA, 918 bp, Pseudomonas aeruginosa
  CDS (4)..(918)
aaaatggacggcatcttcctccagcaaatgatcaacgggctgaccctcggctcggtctacggcctcatcgccatcggctacaccatggtctacggcatcatcggcatgatcaacttcgcccacggcgaggtgtacatgatctccgcctacctgtcggccatcgcccttgccctgctggccttcttcggcctgcagaacttcccgctgctgatcctcggcaccttgctgttcaccgtgctggtgacctgcacctacggctgggtgatcgagcgcatcgcctacaagccgctgcgcaactccacgcgcctggcgccgctgatctcggcgatcggcatgtcgctgatcctgcagaactacgtgcaggtggcgcagggaccgcgccagcaggggatcccgaccctgctcgacggcgccctgaaattccacgtcggcgacggtttcgtccagctcacctacaccaagctgttcatcctgatcgcttcgctgatcggcatggcggtgctgacctacgtgatccgctacaccaagctcgggcgcatgtgccgggcgacccagcaggaccgcaagatggcttcgatcctggggatcaacaccgaccgggtgatctcctacgtgttcgtcatcggcgcagcgatggccgccctggccggggtgctgatcaccatgaactacggcaccttcgacttctacgccggcttcatcatcggcatcaaggcgttcaccgcggcggtgctcggcggcatcggctcgctgcccggggcgatgctcggcggcctggtgctgggagtggccgaggcgcagttctcggggatggtcaacaccgactacaaggacgtgttcgccttctcgttgctggtactgatcctgatcttccgtccccagggcctgctcggccgcccgcagatcgccaaggtgtaa

SEQ ID NO: 27418 - protein, 304 aa, Pseudomonas aeruginosa
MDGIFLQQMINGLTLGSVYGLIAIGYTMVYGIIGMINFAHGEVYMISAYLSAIALALLAFFGLQNFPLLILGTLLFTVLVTCTYGWVIERIAYKPLRNSTRLAPLISAIGMSLILQNYVQVAQGPRQQGIPTLLDGALKFHVGDGFVQLTYTKLFILIASLIGMAVLTYVIRYTKLGRMCRATQQDRKMASILGINTDRVISYVFVIGAAMAALAGVLITMNYGTFDFYAGFIIGIKAFTAAVLGGIGSLPGAMLGGLVLGVAEAQFSGMVNTDYKDVFAFSLLVLILIFRPQGLLGRPQIAKV

SEQ ID NO: 27419 - DNA, 954 bp, Pseudomonas aeruginosa
  CDS (1)..(954)
atgcgcatcgccgccgccaccagcctggcccaggtcaagcgccggctgctggtcggcgacctgctcggccaggccttcagtggcctgtcgctgggctcgatcctgctgctcgcggcgctcggcctggcgatcacctacggcctgctcggggtgatcaacatggcccacggcgaaatgctcatgctcggcgcctactccacctacgtggtgcaactgctgttccagcgcctggcgccggaatggctggcgctctacccgttgctggcgctaccggtggcgttctgcgtcagcgccgccatcggcatggccctggagcgcacggtgatccgccatctctacggccggccactggaaaccctgctcgccacctggggcatcagcctggtgctgatccaactggtgcggatgctgttcggcgcgcagaacgtcgaggtagccaacccggcctggctgtccggcggcatccaggtgctgccgaacctggtgctgccgtggaaccgtatcgtcatcatcggcttcgccctgttcgtgctgctcctcacctggctgctgctgaaccgcacgcggctcggcctgaacgtccgcgcggtgacccagaaccgcaacatggcggcctgctgcggggtgcccacagggcgcgtggacatgctcgccttcggtctcggctcgggcatcgccgggctcggcggggtagccctgtcgcaggtcggcaacgtcggcccggacctcggccagggctacatcatcgactccttcctggtggtggtgctcggcggcgtcggccagctcgccggcagcgtcctcgccgccttcggcctcggcgtggcgaacaagatcctcgaaccgcagatcggcgcggtgctgggcaagatcctgatcctcgcgctgatcgtcctgttcatccagaaacgcccgcagggactgttcgccctgaaagggagggtcatcgattga

SEQ ID NO: 27420 - protein, 317 aa, Pseudomonas aeruginosa
MRIAAATSLAQVKRRLLVGDLLGQAFSGLSLGSILLLAALGLAITYGLLGVINMAHGEMLMLGAYSTYVVQLLFQRLAPEWLALYPLLALPVAFCVSAAIGMALERTVIRHLYGRPLETLLATWGISLVLIQLVRMLFGAQNVEVANPAWLSGGIQVLPNLVLPWNRIVIIGFALFVLLLTWLLLNRTRLGLNVRAVTQNRNMAACCGVPTGRVDMLAFGLGSGIAGLGGVALSQVGNVGPDLGQGYIIDSFLVVVLGGVGQLAGSVLAAFGLGVANKILEPQIGAVLGKILILALIVLFIQKRPQGLFALKGRVID

SEQ ID NO: 27421 - DNA, 894 bp, Bacillus halodurans
  CDS (1)..(894)
atgatcgtacaactttttaacggtataagcttaggctccattcttcttttaatcgctcttgggcttgccataacgttcggaatgatgcgagtcattaacatggcacacggggaattaattatggttggagcctatgctacttacgttgttcagcttctttttagtcaatatgttcctccggcttattttgatctttactttttactcgcagtcccgttatcgtttgtcatttcagctcttatcggtattctcattgaacttaccgttattcgccacttatacggccgacctctagatagtttattagccacgtttggtgttggactcatcttgcaacaaacagcgcggacaatctttggggcaccaaatgtaggcgtccaaagcccatcgtttttacgtggcgggctagagattgccggagtgacactccctttctctcggttgtttattatcactctcgtcctcgtaagcttttgtttgttagcctggtttttttataaaactcggaatggccgaaaaattcgcggggtgatgcaaaaccggagcatggccacatgtttagggatctctacacgcaaagtggatgtgatgacatttgcgattggttctggttgtgctggtttagctggtgctgcactgacgctgttagggccgatcgggccaaccatcggtacctattatattgtagatgcctttatggtcgtcgttgttggcggggtcggcatgttagtaggaacggtggctggtgcgttaggaatcgggatgtttaacaccttatttgaatattggacgaatgcctctttaggaaaagtactcgtctttgcctgcatcattctctttttacaatggcgcccgcaaggcttgttttccttaccaactcgttctttagattaa

SEQ ID NO: 27422 - protein, 297 aa, Bacillus halodurans
MIVQLFNGISLGSILLLIALGLAITFGMMRVINMAHGELIMVGAYATYVVQLLFSQYVPPAYFDLYFLLAVPLSFVISALIGILIELTVIRHLYGRPLDSLLATFGVGLILQQTARTIFGAPNVGVQSPSFLRGGLEIAGVTLPFSRLFIITLVLVSFCLLAWFFYKTRNGRKIRGVMQNRSMATCLGISTRKVDVMTFAIGSGCAGLAGAALTLLGPIGPTIGTYYIVDAFMVVVVGGVGMLVGTVAGALGIGMFNTLFEYWTNASLGKVLVFACIILFLQWRPQGLFSLPTRSLD

SEQ ID NO: 27423 - DNA, 1254 bp, Pseudomonas aeruginosa
  CDS (1)..(1254)
atgagccagtccctcaagcgcgcgctgttcagcgccctcctcgtgatcctggtgtcctatccgatcctaggcctgaagctgcgcaccgtcggcatcaagctcgaggtcctcggcgccgatgcgcagaccctctggaccatcgccgcggccgccctggccatgttcgtctggcagctgttccgcgaccgcatcccgctcaagctgggtcgcggcgtcggctacaaggtcaacggcagcggcctgaagaacttcctcagcctgccatcgacccagcgctgggcggtcctcgccctggtcgtggtggctttcgtctggccgttcttcgcctcgcgcggggcggtggacatcgccaccctgatcctgatctacgtgatgctcggcatcggcctgaacatcgtggtcggcctggccggcctgctcgatctcggctacgtcggcttctacgcggtaggtgcctacacctacgcgctgctcgccgagtacgccgggttcggcttctggaccgccctgccgatcgccgggatgatggccgcgctgttcggcttcctcctcggcttcccggtgctgcgcctgcgcggcgactacctggcgatcgtgaccctcggcttcggcgagatcatccgcatcctgctgcgcaacatgaccgagatcaccggcggccccaacggcatcggctcgatccccaagccgaccctgttcggcctgaccttcgaacgccgcgcgccggaaggcatgcagaccttccacgagttcttcggcatcgcctacaacaccaactacaaggtcatcctgctctacgtggtggccctgctgctggtgctgctggccctgttcgtgatcaaccggctgatgcgcatgccgatcggtcgcgcctgggaagcgctgcgcgaggacgaagtggcctgccgcgctctcggtctcaacccgaccatcgtcaagctctccgccttcaccatcggcgccagcttcgccggtttcgccggcagcttcttcgccgcccgccagggcctggtgacgcctgagtccttcaccttcatcgagtcggcgatgatccttgcgatcgtcgtgctcggcggcatgggttcgcagctcggcgtgatactcgccgcggtggtgatggtgctgctccaggaaatgcgcgggttcaacgaataccgcatgctgatcttcggcctgaccatgatcgtgatgatgatctggcgtccccagggactgctgccgatgcaacgcccgcacctggagctgaagccatga

SEQ ID NO: 27424 - protein, 417 aa, Pseudomonas aeruginosa
MSQSLKRALFSALLVILVSYPILGLKLRTVGIKLEVLGADAQTLWTIAAAALAMFVWQLFRDRIPLKLGRGVGYKVNGSGLKNFLSLPSTQRWAVLALVVVAFVWPFFASRGAVDIATLILIYVMLGIGLNIVVGLAGLLDLGYVGFYAVGAYTYALLAEYAGFGFWTALPIAGMMAALFGFLLGFPVLRLRGDYLAIVTLGFGEIIRILLRNMTEITGGPNGIGSIPKPTLFGLTFERRAPEGMQTFHEFFGIAYNTNYKVILLYVVALLLVLLALFVINRLMRMPIGRAWEALREDEVACRALGLNPTIVKLSAFTIGASFAGFAGSFFAARQGLVTPESFTFIESAMILAIVVLGGMGSQLGVILAAVVMVLLQEMRGFNEYRMLIFGLTMIVMMIWRPQGLLPMQRPHLELKP

SEQ ID NO: 27425 - DNA, 936 bp, Agrobacterium tumefaciens
  CDS (1)..(936)
atgtcgggccgccaagagcggcccgtctccggcccggatgggcatcgctgcaccgggaggagttttttcagcatgcagacggtcttcagcatcctcatcgatgcgcttgcctatggcatggtcctgttcatcatctccatcggcctttccgtcacaatggggctgatgcgggtggtcaatctggcacacggcgcgttcgcgatgatcggcggttatctcgcgtcttatgccgcccacggcctcggccttggttatgcgatggcgatcctcgttgcgattgtcggcaccatcgtcatcgccataccgctcgaacgtttcctctatcgccgcatctatggcgcgccagagctgacgcaggtgctgatgaccatcggcatcaccttctgcatcatcggcatcgccaattacgtcttcggccccacattgaagaccattcctctgccgcagcagctcgccggccccaccgatctcggcttccgcaccatcgccacccatcgcatcttcgccattgcctgcgggctggccgtggccggcgcgctgtggttcaccttcgaaaagaccgccttcggtatcaagctgcgtgccgccgtcgataatgccgccatggcggcggcactcggcgtgcgcacggaaatcatctatgccgtcagctttgccatcgccgtcggccttgccgcgatgggcggcgtcatcggcgcggaactgctgccggtcgaaccctattacgcgctgcgctacatggtcaccttcctcgtggtggtttcggtcggcggcgcgggctccatacccggcgcgctgatcgcctgcctgctgctcggcgcgatcgatacgaccgggcggtatctcgccccggaatatggcgagttcttcttttatctggcggtcatcgtgatcatcaccttgttcccgcgcggccttctcggaagggcgaaatga

SEQ ID NO: 27426 - protein, 311 aa, Agrobacterium tumefaciens
MSGRQERPVSGPDGHRCTGRSFFSMQTVFSILIDALAYGMVLFIISIGLSVTMGLMRVVNLAHGAFAMIGGYLASYAAHGLGLGYAMAILVAIVGTIVIAIPLERFLYRRIYGAPELTQVLMTIGITFCIIGIANYVFGPTLKTIPLPQQLAGPTDLGFRTIATHRIFAIACGLAVAGALWFTFEKTAFGIKLRAAVDNAAMAAALGVRTEIIYAVSFAIAVGLAAMGGVIGAELLPVEPYYALRYMVTFLVVVSVGGAGSIPGALIACLLLGAIDTTGRYLAPEYGEFFFYLAVIVIITLFPRGLLGRAK

SEQ ID NO: 27427 - DNA, 948 bp, Methanococcus jannaschii
  CDS (1)..(948)
atggtcaagcttttactaaaagatttaggtgagaaaatgattttagaaggagctattatatactccaaccttttggttttgttggctttgggattaactctaacttatataacaacaaacgttccaaactttgctcagggaagttatgcgatagttgggagttatgttgctttaacattattaaagttgtttggtatttgtccttatctttctttaccagttttatttgttgttggggcaattgttggtttaataacttatttagctttaaagcccttgataaaaagaaatgcctctgtagagattttaatgattgcaactcttgctatagatttaatattattgggtgttattggggcttactctgaaatattaagtcaaattgttggttctactcaagcaaaattcgtttttgcaaacttggatttttcattatttggatttaaaggaattttatttgtttcaaccttcgtagttatactactattaattggactttatctcctcctgtataaaacaaagtttggtattgctttgagagcttcaatggagaatccttcattagctcaaactatgggaattgatgttgaaaaaacaagattattttcttggattctttctggagctttagctggagttgctggtgggcttttacctttcatgcaagagattgttccagccactggggatttaattattatttcaatctttgcggcaagtattgttggaggtttaaggcatataagtggagcattaatagggggctatataattggaatatctgagagtttaataacttattatttagcatcagcatttggaacaggatttttggtttatggaaaggttatctccttaataataatgatagcaacattattaatagcaccttatggaattactggagtcgattggaaaaagttaaaaagattattatctacttcataa

SEQ ID NO: 27428 - protein, 315 aa, Methanococcus jannaschii
MVKLLLKDLGEKMILEGAIIYSNLLVLLALGLTLTYITTNVPNFAQGSYAIVGSYVALTLLKLFGICPYLSLPVLFVVGAIVGLITYLALKPLIKRNASVEILMIATLAIDLILLGVIGAYSEILSQIVGSTQAKFVFANLDFSLFGFKGILFVSTFVVILLLIGLYLLLYKTKFGIALRASMENPSLAQTMGIDVEKTRLFSWILSGALAGVAGGLLPFMQEIVPATGDLIIISIFAASIVGGLRHISGALIGGYIIGISESLITYYLASAFGTGFLVYGKVISLIIMIATLLIAPYGITGVDWKKLKRLLSTS

SEQ ID NO: 27429 - DNA, 900 bp, Thermotoga maritima
  CDS (1)..(900)
atggtattctttctccagaatctcttcaacggaatcatgctcggaggtttgtacgcgctcatagcgattggttacaccatggtttatggtattctgaggctcatcaatttcgcccatggcgatgttatgatgatgggtgtctacttcgccttctacgctgctactcttctttctctgaatccacttttttctgccatcgtagcgatcctcggagcagcgctattgggttttctcatagacagagttgcttacaaacctctgagaaacgctcccaggatttccgctcttatcaccgctatcggagtttctttcttccttgagagtctcgctgtggtcgtttttggagccattcccaagtcttttctgaaggtcttcaaggacaggaccatactgaacaaagtgctgactgtagcgggagccagaataccactcctcacgttcctcgtgatcttcatcaccgccgtcattctgatagtcctgttcttcatcgtttatagaacgaagatcggtatggctatgagagcgatttccatggatattccaacgactgccctcatgggtgtcaacgtggacgccgtcatcggtttcacgtttgccctcggttcggcactcgctgctgcgagtgggatcatgtgggcaatgagatttccgaacgtacatccttacatgggtttcatgccaggtctcaaggctttcattgcggcggtgtttggaggaataggttcgatccccggagctgttctcggtggcgttcttctcggtctcattgagatattcctcgcagcttatttcccagctgttatgggttaccgggatgcgttcgctttcatcatcctgatcatcatactgctcgtgaaaccttctggacttctcggtaaaaaaatcgtggaaaaggtgtga

SEQ ID NO: 27430 - protein, 299 aa, Thermotoga maritima
MVFFLQNLFNGIMLGGLYALIAIGYTMVYGILRLINFAHGDVMMMGVYFAFYAATLLSLNPLFSAIVAILGAALLGFLIDRVAYKPLRNAPRISALITAIGVSFFLESLAVVVFGAIPKSFLKVFKDRTILNKVLTVAGARIPLLTFLVIFITAVILIVLFFIVYRTKIGMAMRAISMDIPTTALMGVNVDAVIGFTFALGSALAAASGIMWAMRFPNVHPYMGFMPGLKAFIAAVFGGIGSIPGAVLGGVLLGLIEIFLAAYFPAVMGYRDAFAFIILIIILLVKPSGLLGKKIVEKV

SEQ ID NO: 27431 - DNA, 1614 bp, Sinorhizobium meliloti
  CDS (1)..(1614)
atgtaccgcatcatcccaaccgtgctggctgccctgttccttttcgttgcgatggctccggggcttcgcgcggaagagggactgcgcgatctggtgaacgcgctcggcgaggcgaagctgtccgagatggacgagcatatcgcggcactggcgaagaccggaaagcccgaagtcgtcgccatcctcgaggcgctcggggaaggcgagctctatgcgcgcaaggcggacggccaggtcttgttgacgaaggagagcggttcgaacctgacccttacggatccgatctccggcgacagcgccggcgaagcgccgaaggcggcactttcgaagatcagggtgaacaacagcgtgcggcgcgccgtgcgcaccgccctcggcagcctgacgctcctcagccccgatcgcaatcagcgcctcagggccgcgcagtcggtgctgcaatcgcccgatgccgacgcgctcggcgtcatcgagaatgcactggctgccgagaaggatggagccgttcgtgcggttctcgaacaggcgcgcgccacgatgctgcttctctccgaccggccggtcgaggagaagaaggaggcggtgcggctgctggaggaaaacggcggccgcgaggcgctgccgatcctttctgccgcgctcggctctgccgacgaaagcctgaagccggacatcgaggcggcgctcgccagcatcgaacaggcgcaagccttctggaatgcgggccagaacatatggtacggcctgtcgctcggctcggtgctgctcttggcggcgatcggtctcgccatcaccttcggcgtcatgggcatcatcaacatggcgcatggcgagatggtgatgctcggggcctatacgaccttcctcgttcaagatgtcgtgcgcacctcctttcctcatcttttcgagtggtccttggcgatcgcgctgccgctcgcctttcttgttacaggcgccgtgggcctcgcactggaacgcggcgtcatccgctttctctacgggcgcccgctcgaaacgctgcttgccacctggggcatatcgctcatcctccagcagacggtgcggacgatcttcggccccaccaaccgtgaggtcggcaatccgtcctggatgtccggcgccttcgagctcggcggactggcgatcacctggaaccgtctctggatcatcgtctttgcgcttgcggtgtttgcggcacttctctttctgctcaagaagacgccgatgggcctgcagatgcgcgcggtaacgcagaaccggcgcatggcctcttccatgggcatccgcacgccctgggtcgatgcgctgaccttcgcgctcggctccggcatcgccggcattgcgggtgtggcgctttcgcagatcgacaacgtctcgccgaacctcgggcagggctacataatcgacagcttcatggtcgtggtcttcggcggcgtcggcaatctctggggcacgcttgtcggcgccttctcgctcggcatcctcaacaagttcctggagccctatgccggcgccgtgctcggcaagatcctcgtgctcgtgctgatcatcctcttcatccagaagcggccgcgcgggctcttcgcactcaagggccgggcggtggaagcatga

SEQ ID NO: 27432 - protein, 537 aa, Sinorhizobium meliloti
MYRIIPTVLAALFLFVAMAPGLRAEEGLRDLVNALGEAKLSEMDEHIAALAKTGKPEVVAILEALGEGELYARKADGQVLLTKESGSNLTLTDPISGDSAGEAPKAALSKIRVNNSVRRAVRTALGSLTLLSPDRNQRLRAAQSVLQSPDADALGVIENALAAEKDGAVRAVLEQARATMLLLSDRPVEEKKEAVRLLEENGGREALPILSAALGSADESLKPDIEAALASIEQAQAFWNAGQNIWYGLSLGSVLLLAAIGLAITFGVMGIINMAHGEMVMLGAYTTFLVQDVVRTSFPHLFEWSLAIALPLAFLVTGAVGLALERGVIRFLYGRPLETLLATWGISLILQQTVRTIFGPTNREVGNPSWMSGAFELGGLAITWNRLWIIVFALAVFAALLFLLKKTPMGLQMRAVTQNRRMASSMGIRTPWVDALTFALGSGIAGIAGVALSQIDNVSPNLGQGYIIDSFMVVVFGGVGNLWGTLVGAFSLGILNKFLEPYAGAVLGKILVLVLIILFIQKRPRGLFALKGRAVEA

SEQ ID NO: 27433 - DNA, 1080 bp, Thermotoga maritima
  CDS (1)..(1080)
atgatgaagatggagaagaaactatctgcacgaacgaacttcattctcacggttgttttcctgatcttcatggcccttcttctctatctggctgatagatacatggacagctacaagctgagagtagtgaggctcatcgccatatacggtatcatggcggtgagtttgaacctgataaacggtatcacgggtatcttttctcttggacacgccggtttcatcttgataggtgcttatacggcgtctcttctcacactttcaccagagcagaaagcgatgtcttttataatagagccgatcgttccctggcttgcgaacgcgcacaccgacttcttcaccgccacagtggcaggcggtgttctggcagccgtcttcgcttttctcatagggtggccggttttgaggctttccggtgattacctcgcgatagcgtcccttgggttcgcagaggtgataaggatcatcgctctcaacgccatcagcatcacaaacggccctctcggtctcaagggaattccggaatactcaaacatctggtggtgttacggctggctattcgtaacggttctgttcatggcaagccttgtgaacagtagctacggaagagctttgaaggccatcagagaagaccgcatagcagccgaagccatgggaataaatgttttcaaacatcagcttctttctttcgtcataggagccttctttgcgggtgtttctggttcgctctacgcgcactggctcaccacgatagatcccagaacgaccacactcggtcccatgctcactttctacgttctcatcatgatagttctgggtggactcggcagtatttccggttcgctcataggagccgctctcttcgctatactcttcgagtggctcagggatctggaagagcctttcacgttcttcggcatacacgttcccggtataaagggaatgaggatcctcgtgatatccgccattttcatccttgtgatgatcttctggcagaggggtatcatgggaagagaagaactcacctggaacaacctttacagatggctctttgctcgtcgcaggggtggtgaagagaaatga

SEQ ID NO: 27434 - protein, 359 aa, Thermotoga maritima
MMKMEKKLSARTNFILTVVFLIFMALLLYLADRYMDSYKLRVVRLIAIYGIMAVSLNLINGITGIFSLGHAGFILIGAYTASLLTLSPEQKAMSFIIEPIVPWLANAHTDFFTATVAGGVLAAVFAFLIGWPVLRLSGDYLAIASLGFAEVIRIIALNAISITNGPLGLKGIPEYSNIWWCYGWLFVTVLFMASLVNSSYGRALKAIREDRIAAEAMGINVFKHQLLSFVIGAFFAGVSGSLYAHWLTTIDPRTTTLGPMLTFYVLIMIVLGGLGSISGSLIGAALFAILFEWLRDLEEPFTFFGIHVPGIKGMRILVISAIFILVMIFWQRGIMGREELTWNNLYRWLFARRRGGEEK

SEQ ID NO: 27435 - DNA, 858 bp, Deinococcus radiodurans
  CDS (1)..(858)
atgaccacagttttgcaacaacttttcaacgcgctcgcgctcggcggggtgtacgccctggtcgcgctggggctgacgctggtctacggcgtgatgaaaattcccaacttcgcccacggcggactgtacatgctcggcgcttacctttcttacgcgggcatcagctcgctggggctggggtacgtgcccgcgctgctgctctctgccgtcgtcgtggcgctgctcgctgccctgatggaacgggtcattttcttcccgctgcgcaacgcgccgcacgtgcagcccatgattgccgcgctgggcgtgctgttttttctggaagccggggtgcagctcatctggggcgccgacttcaagcaggtggccgagccaatcccaggcatcctcaatatcggcggcgtcacgatcacctggcagcgcctgatcgtgctcgtcgccagcgtggtcgccatgctggggctgaacttcttcctgcgccgcaccctgaccggcgccaccatcgaggcgatggcgcaaaaccgtgagggcgcacggctcgtcggcatcaacaccgggcgggtcgggatgctcaccttcgccatctcgggggcactcgcggccatcggggcatctctcatcgcgcccatcgtgtcggtcaccccggcgatgggtgaaatcatgaacctcaaggtcttcgccatcatcatcctgggcggcatgggcagcattcccggcgccatcgtgggggcttttttgctcgccttcgctgaagtgttcggcggctacatcaacctcgactttgctgaggtcatcggcttcgcggtgctggtggtcgtgctcgccattcgtccgcagggcctgttccggagggccgcatga

SEQ ID NO: 27436 - protein, 285 aa, Deinococcus radiodurans
MTTVLQQLFNALALGGVYALVALGLTLVYGVMKIPNFAHGGLYMLGAYLSYAGISSLGLGYVPALLLSAVVVALLAALMERVIFFPLRNAPHVQPMIAALGVLFFLEAGVQLIWGADFKQVAEPIPGILNIGGVTITWQRLIVLVASVVAMLGLNFFLRRTLTGATIEAMAQNREGARLVGINTGRVGMLTFAISGALAAIGASLIAPIVSVTPAMGEIMNLKVFAIIILGGMGSIPGAIVGAFLLAFAEVFGGYINLDFAEVIGFAVLVVVLAIRPQGLFRRAA

SEQ ID NO: 27437 - DNA, 1053 bp, Campylobacter jejuni
  CDS (1)..(1053)
atgatggttagaattaaggtttcacatttaatctttttaattgcttcaattatttttattttcatttctccttatatttttggggattatggattaaacattgttaatcaaattgctatttttattattttggctgtgagttacaatcttattaatggtgtaactggacaattttcactagaacccaatggatttgttgcgattggagcttatgcggctgctttagttcttttaagtgctgatgcaaaaaatgatcagttttttttagatggtcctagttcttttattttagctatccattcaaattcctttattctagctttaattgtggctggaatttgttcatctttacttgccctgattttggcttttgctgtatttcgcgtgagaggggattatttggctattgtaactttaggctttggaataattattaaaatagctgctattaattttccttctattactaatggctcaagagggctggtagatattccacaattttccacgatctattggacaggtggtattgctattgtagcggttattttaattttaaatatagtttattctaaatatggtcgtgcaatgaaggctataagagatgatgaagatgctgcaagcgctatgggaataaatactttttggataaaaactttagcttttagcacttcagcatttttagaaggtgtaggtggcggacttttagcttgtctgttgactaccgtatctccaactcaatttgattttttacttacttttcagcttttgattattattgttttaggtggacttggttctactacaggtgctattataggtgcgatattggttattggtggaagtgagtggcttagatttttagatgagttaaatataaaaatagattctttaaatcttgatatccaatcaacgccagggcttagaatggttgttttttctattgttctgattttagtaatgctttttgcaagaaaaggcataatgggttattatgagttgagtgatgtgattagagggattaaaaagcgttttaaaaggagcaaaaaatga

SEQ ID NO: 27438 - protein, 350 aa, Campylobacter jejuni
MMVRIKVSHLIFLIASIIFIFISPYIFGDYGLNIVNQIAIFIILAVSYNLINGVTGQFSLEPNGFVAIGAYAAALVLLSADAKNDQFFLDGPSSFILAIHSNSFILALIVAGICSSLLALILAFAVFRVRGDYLAIVTLGFGIIIKIAAINFPSITNGSRGLVDIPQFSTIYWTGGIAIVAVILILNIVYSKYGRAMKAIRDDEDAASAMGINTFWIKTLAFSTSAFLEGVGGGLLACLLTTVSPTQFDFLLTFQLLIIIVLGGLGSTTGAIIGAILVIGGSEWLRFLDELNIKIDSLNLDIQSTPGLRMVVFSIVLILVMLFARKGIMGYYELSDVIRGIKKRFKRSKK

SEQ ID NO: 27439 - DNA, 918 bp, Sulfolobus solfataricus
  CDS (1)..(918)
atgatagatcctctgattataaatacaatagtttacggttcgattcttggtttatcaagtctctccctaactttaacttacttaacaactaaagtacctaatttcgctcacggtatctttctgttgtttggttcctatatgacctttaccatagccgaagtcttaaaacagaatccgtacatttcgctacctatcgcattcttattaggtggggcaattgcattactccaatactatggtgtgttactgccgttaagtatgagaggtggcggtttagtatcacaaatggttgctactctagccttttccattttactgtatggaggattaaacgcatatgcaagttatcttggctatgtgtataatgtgcaatctagagatgtaacgctaggattcttagattacgaaataggagggattagagctgttttcctaatttccatcatcttagcaatagcattcatactctcactttatatcttcttgaataagactagattaggaatatccattagggctacagttgagaactcgtcactagctgaaagcatgggtataaacacgaaactagttaaggcgatttcttggtttttagctggaggtatagcaagtactgccggctccttatatcctctacaatttgtattttcacctacattagcgtactcgatattactaagtatattcgcagcaagtgtactaggaggtctaatgagcctattcggtggattcattggtggattcattgagggattcatagaaaaatacatcatgactgaattatcaatctatctgtctccactaataggagtgagtcctttcgttattaaccagtattcaacactggttcctcttatagtagtagcagcagttctcctgatagctccaaacggaattatgggagtgagggtgaaataa

SEQ ID NO: 27440 - protein, 305 aa, Sulfolobus solfataricus
MIDPLIINTIVYGSILGLSSLSLTLTYLTTKVPNFAHGIFLLFGSYMTFTIAEVLKQNPYISLPIAFLLGGAIALLQYYGVLLPLSMRGGGLVSQMVATLAFSILLYGGLNAYASYLGYVYNVQSRDVTLGFLDYEIGGIRAVFLISIILAIAFILSLYIFLNKTRLGISIRATVENSSLAESMGINTKLVKAISWFLAGGIASTAGSLYPLQFVFSPTLAYSILLSIFAASVLGGLMSLFGGFIGGFIEGFIEKYIMTELSIYLSPLIGVSPFVINQYSTLVPLIVVAAVLLIAPNGIMGVRVK

SEQ ID NO: 27441 - DNA, 1050 bp, Deinococcus radiodurans
  CDS (1)..(1050)
atggatatttttgaccccaccatttttcccatcctgaccaccgacgggctgacgaacggcgcggtgtacgcgctgctttcgctggcgctggtgctggtgtttgccgtgacccgcgtgatttttattccgcagggcgaattcgtgatgttcggggcgctgacgctggcgagcctgcaagcaggaaaggtgcccggcacgctgaaactggtactggcgctgctcgccctgagcgtgattctgaacgtggtacagtcgctgcgcgccgggcacactcaagcggcgctgcgaagtgtcctgattggcctgggcgcctgggcgctgctgtgggcgctgaccggctggctcgcgccgctcaaggcgccactggcggtgcaggtgctgctgacgctgctgctcgtcgtgccgctggggccgctgctttaccgcgtggtgtaccagccgcttcgcaacgccaccgtgctggtgctgctcatcgcctcggtcgcgctgcacctcgcgctcaccgggctggggcttgcgttcttcggcgccgagggcagcaacacgcccgccttcgtcagcggtgatctccacatcggcagcttttcgctgagttaccagaacctgctcgtcatggtcgtttcgctggcgctgatggcgggcctcgccgtctttttcgagcgcacgctgctcggcaaggcgctgcgggccaccgccgtgaaccggctgggcgcgcggctggtgggcattcggcccgagttcgccgggtcactcgcctttacggtggcggccttgatgggcgtgctgagcggcctgctcatcggccccaagttccccatcgggtacgacaccggcttcctcatcggtctcaagggctttgtcggcgcgattatcggcgggctggcgtcttttccgctggccgccatcggggcgctgctggtgggcctcatcgagagttacgccagtttcagcctcagccagtggaaagaagtcatcgtgttcaccctgattttgccggtgctgctgtggcgttccctctccacccggcaccatgacgaggaggaagagtga

SEQ ID NO: 27442 - protein, 349 aa, Deinococcus radiodurans
MDIFDPTIFPILTTDGLTNGAVYALLSLALVLVFAVTRVIFIPQGEFVMFGALTLASLQAGKVPGTLKLVLALLALSVILNVVQSLRAGHTQAALRSVLIGLGAWALLWALTGWLAPLKAPLAVQVLLTLLLVVPLGPLLYRVVYQPLRNATVLVLLIASVALHLALTGLGLAFFGAEGSNTPAFVSGDLHIGSFSLSYQNLLVMVVSLALMAGLAVFFERTLLGKALRATAVNRLGARLVGIRPEFAGSLAFTVAALMGVLSGLLIGPKFPIGYDTGFLIGLKGFVGAIIGGLASFPLAAIGALLVGLIESYASFSLSQWKEVIVFTLILPVLLWRSLSTRHHDEEEE

SEQ ID NO: 27443 - DNA, 903 bp, Deinococcus radiodurans
  CDS (1)..(903)
atggacctgaccttccttgccaaccaactgttcaccgggctctcggtggcgtccatcctgctgctggcggcgctggggctggcgctgaccttcgggctgatgcgggtcatcaacatggcgcacggcgaatttctgatggtgggcggttacctgacctacctcgcggcccgctggaccggccccgccctgggcgacggctacctgtgggtcgcttttccgctcgccttcgtgggcacggcgctgctgggcgccctgctggaagtgctggtcatccggcggctctacgggcgcccgctcgacacgctgctggcaaccttcggcatcagcttgatcctgcaacaggccgcgcggcaggtgttcggcagcacgggcgtgccggtcacggctcccgcctggctgtcgggcagcgtgacgctgggcgccgtgaccatgccgggcagccgcctgttcgtcatcgcgctttccctgctggtgatcggcgcggtgtggtggctgctctcgcgcacccgcttcggcatggtggtgcgggcggtcaaccagaaccgtgagatggcggcggcgctgggcgtcaacacccgggcactcgacctgctcgtcttttccctcggcgcgggcattgcgggggtggcgggcgtgggcctcgcgctgcttgccccagttaaccctaccgtcggcgcggcgtacatggtcaatgcctttctcgtcgtggtggtcggcggcgtgggcagcgtgctcggcgcgggcgtcgcggccatattgctcggcagcctcacggcgttggccgagggcctgaccagcgagagcctcgcgcaggccgcgctgctggtgctggtggtggcgttcttgcagtggaaaccgcgcggcctgtttcccaccgagtcccgcgctctggaggacgcatga

SEQ ID NO: 27444 - protein, 300 aa, Deinococcus radiodurans
MDLTFLANQLFTGLSVASILLLAALGLALTFGLMRVINMAHGEFLMVGGYLTYLAARWTGPALGDGYLWVAFPLAFVGTALLGALLEVLVIRRLYGRPLDTLLATFGISLILQQAARQVFGSTGVPVTAPAWLSGSVTLGAVTMPGSRLFVIALSLLVIGAVWWLLSRTRFGMVVRAVNQNREMAAALGVNTRALDLLVFSLGAGIAGVAGVGLALLAPVNPTVGAAYMVNAFLVVVVGGVGSVLGAGVAAILLGSLTALAEGLTSESLAQAALLVLVVAFLQWKPRGLFPTESRALEDA

SEQ ID NO: 27445 - DNA, 897 bp, Campylobacter jejuni
  CDS (1)..(897)
atggattctactttatttttacaacaacttgttaatggacttagtttgggcagtatgtatgctcttattgctgttggctatacgatggtttatggtgtgttaagacttattaattttgctcacggcgatattatgatggttggtgcttatgcggctcttttttgcatgactaatctaaatgttccttttctaggagctttgtctttagcaatgatttttgctgcttgtgttggaatagctacagatagaatcgcttataaacctttaagacaggctcctagaatttcattgttgattacagcaatcggtattagttttttcttgcaaaatctttttaatatgctttttacttcaacacctagaacttttacaccgccaagttattttgaggaaagtgttaattttggtggagtgataacaacttatggttctttaatggttcctgctcttacatttgttattttaatagcagtgttatggattttgtataaaagcaaatatggtatagctattcgtgctttggcatttgatatacaaacagtaaatttaatgggtatagatgcaaatcgtattattgctatagtttttgccctaggttcagctttggcagcagttgggggtgttttttgggctgcaaattattactctgttgaacctactatgggaactttaataggtttaaaagcttttgctgctgcagttttaggaggtataggttctgtagtaggtgcagttttgggtggacttattataggatttactgaagttgttgttgtggctttttttccagatttatcaggctttaaagatgcatttgcttttatttttttggtgtttatattgttatttaggcctacgggaattttaggtataaattttgaaaagagtaggttttaa

SEQ ID NO: 27446 - protein, 298 aa, Campylobacter jejuni
MDSTLFLQQLVNGLSLGSMYALIAVGYTMVYGVLRLINFAHGDIMMVGAYAALFCMTNLNVPFLGALSLAMIFAACVGIATDRIAYKPLRQAPRISLLITAIGISFFLQNLFNMLFTSTPRTFTPPSYFEESVNFGGVITTYGSLMVPALTFVILIAVLWILYKSKYGIAIRALAFDIQTVNLMGIDANRIIAIVFALGSALAAVGGVFWAANYYSVEPTMGTLIGLKAFAAAVLGGIGSVVGAVLGGLIIGFTEVVVVAFFPDLSGFKDAFAFIFLVFILLFRPTGILGINFEKSRF

SEQ ID NO: 27447 - DNA, 939 bp, Archaeoglobus fulgidus
  CDS (1)..(939)
atggatactatttcatctttcgagatcgtcaaaaatattatcgaagggtctctcatatactccaaccttctcgtattgctgagcatagggctcaccattacctacataactacggcagttcccaacttcgcgcaggggagcttcgcaatatttggctcatacgtggccctgaccatgctgaggctttttggcatccacccctacgcttctttgcccgttgcttttgcacttggcggtttgcttggcattgcaacctacatcctcatcctgcgcccgctcatcaggcgcggcgcctccgtagtgattttgatgattgcaacgctggcctttgacttgattctccttggcattattggctcatactctgaaactctcgcaaccataaccagaaaatccgcctcgaagttcacctttatcccgacagacttcaagatgttttccttctccgcctcactcttcgtttcttccctggttataattattgttctcgcatcactcgtaacgctgctttacaaaacaaagttcggagttgccctgagggcctcgatggagaaccccgctctggctgaggtgatgggtgtcaatgtggagtacacgaggctcttctcgtggtttctttcaggcgctttggctgcgatggcggggtgtctgctgccattcaagtacgaaatagttccgagcacgggtgcaatcatcattgtctccatatttgcttcgagcattgtcggggggctttcaacaatctacggagcattgctcggaggctacataataggattttcggagacaagtgttacttacgcactttcctctgtgttcggaacaggagttttgctctacggcagagttgtttcgttgctggtgctagtcgcaacacttatcctcgcccccaagggccttacaggtgtgaagtggaggaggttgctatggagcagataa

SEQ ID NO: 27448 - protein, 312 aa, Archaeoglobus fulgidus
MDTISSFEIVKNIIEGSLIYSNLLVLLSIGLTITYITTAVPNFAQGSFAIFGSYVALTMLRLFGIHPYASLPVAFALGGLLGIATYILILRPLIRRGASVVILMIATLAFDLILLGIIGSYSETLATITRKSASKFTFIPTDFKMFSFSASLFVSSLVIIIVLASLVTLLYKTKFGVALRASMENPALAEVMGVNVEYTRLFSWFLSGALAAMAGCLLPFKYEIVPSTGAIIIVSIFASSIVGGLSTIYGALLGGYIIGFSETSVTYALSSVFGTGVLLYGRVVSLLVLVATLILAPKGLTGVKWRRLLWSR

SEQ ID NO: 27449 - DNA, 1071 bp, Deinococcus radiodurans
  CDS (1)..(1071)
atgccaagctcccccgctgacttttttgggccggggagcgcaccgggggcggcttatgccgcaggcgaacgaaaggaaactatggacataaacacggtgctcacgattctggctcaggtcttcgtcggcggcctgagcctcggcgtgctgtacgccatcatcgcgctgggctacacgatggtgtacggcgtgctgcaactgatcaacttcgcgcactcggaggtctttatcaccgggggcgtggtcgcctacttcgtctttgaggcgctcaaggagtcgcccatgaacgggctgctcaagctgctgatcgcggcgctcgcggcgatggccgtgtcgggcgggctcaacgtgctgatcgagcgcctcgcctaccggcccattcggggagcgcagcgcttggtgcccttgattaccgccatcggcgtgtcgctgattttgcaagacctgctgcgcctcatcgtcggcctacgcgggctgttcgacctcagcgtgacgctgccgcagggctttgccgaccccatcaccaaagtcggcggggtgaacatctcggtgctgaacttgcaggtcaaggacatcatcctgatcgtggtggccgggctgatgctcatagggctcaacctgctcgtcaaccacacccggctgggccgcgccattcgcgccgtggcgcacgaccggcagacgtcgggcctgatgggcatcgactcgaaccgcatcatcagcttgaccttcttgatcgggggcgcgctgggcggcctcggcggggcgatgttcgccatgaaatatcaagcactcaacgcctactcgggcatggtgccgggcatcaaggcctttacggcggcggtgctcggcggcatcggcaacattcccggcgcggtgctcggcgggctggtgctcggctggctcgaaacgctgctcggcaccattgacctctttcaggtggtgccggggctgggctggctgaaatacatcacttccgactacaaagacctcggcgccttcttagcgctgctgctgattctctttttcaagcctgccggtctgctcggcaaggccaccacggagaaggtgtaa

SEQ ID NO: 27450 - protein, 356 aa, Deinococcus radiodurans
MPSSPADFFGPGSAPGAAYAAGERKETMDINTVLTILAQVFVGGLSLGVLYAIIALGYTMVYGVLQLINFAHSEVFITGGVVAYFVFEALKESPMNGLLKLLIAALAAMAVSGGLNVLIERLAYRPIRGAQRLVPLITAIGVSLILQDLLRLIVGLRGLFDLSVTLPQGFADPITKVGGVNISVLNLQVKDIILIVVAGLMLIGLNLLVNHTRLGRAIRAVAHDRQTSGLMGIDSNRIISLTFLIGGALGGLGGAMFAMKYQALNAYSGMVPGIKAFTAAVLGGIGNIPGAVLGGLVLGWLETLLGTIDLFQVVPGLGWLKYITSDYKDLGAFLALLLILFFKPAGLLGKATTEKV

SEQ ID NO: 27451 - DNA, 864 bp, Sinorhizobium meliloti
  CDS (1)..(864)
atgcaaaccatcttcagcatagccgtcgatgcgctcgcctatggcacggtgctgttcgtgatctcgatcggcctttcggtcacgctcggcctcatgcgcgtcgtcaatcttgcccacggggcctttgcgatgatcggcggctatatcgcatcctatgcggcgcgtgatctcgggctcggctacggcgccgcggtgctgatcgcggtcttcggcacgatcgtcatcgccatcccgatcgagcgcctgctctaccgccgcatctacggtcagccggagctgactcaggtgctgatgacgatcggcatcaccttctgcatcatcggcattgccaactacgtcttcgggccgactctcaagacgatcccgctgccgccgagccttgagggctccgccgatctcggcttccgttcgatcgccgtgcaccggatattcgcgatcgtctgcggcctcgccgttgccggagccctctggtttgccatcgagaagacggccttcggggtgaaactcagggccgccgtcgacaatgcggcgatggcggcggcactcggagtgcgcacggaggtcgtctatgccgtgagtttcgccgtcgccgtgggccttgccgcgttcggcggcgtcgtcggcgcggaactgctgccggtcgagccctattatgcgctcagatacatggtcaccttcctggtggtcgtttccgtcggcggtgcggggtcgatcccgggtgcgcttgccgcctgcctgctgcttggcggcatcgatacgacggggcgctatctcatgccggaattcggggaattcttcttctatctcgccgtcatcgccatcgtctgcgtatttccgcgcggccttgccgggaggattaagtag

SEQ ID NO: 27452 - protein, 287 aa, Sinorhizobium meliloti
MQTIFSIAVDALAYGTVLFVISIGLSVTLGLMRVVNLAHGAFAMIGGYIASYAARDLGLGYGAAVLIAVFGTIVIAIPIERLLYRRIYGQPELTQVLMTIGITFCIIGIANYVFGPTLKTIPLPPSLEGSADLGFRSIAVHRIFAIVCGLAVAGALWFAIEKTAFGVKLRAAVDNAAMAAALGVRTEVVYAVSFAVAVGLAAFGGVVGAELLPVEPYYALRYMVTFLVVVSVGGAGSIPGALAACLLLGGIDTTGRYLMPEFGEFFFYLAVIAIVCVFPRGLAGRIK

SEQ ID NO: 27453 - DNA, 855 bp, Archaeoglobus fulgidus
  CDS (1)..(855)
atgatcgagacgctggtcaagatagccgtatttggtgctgtggtggggggaatctgggggctcgtcgcctcaggattctccctaatttttggtgtgtcgaggattctgaacttcgcccacggtgcagcattcgtcagctccgcctttctggcatacgctctcataagcgaggggtacaacctttaccttgccatcctcgcaggcttgctgctttcagcgctaatcggtttggcggtttacgcattaacaaagcctgtgagggatagggaggtcatggttatcatcctgacgctcgcattcgcccttctggtgcagcaagtactcttggttttgtacggggacagaggcgtatccatcgagccatttgtaagcgggtttgcagagatagggggtgttaaggttacctatatgagaattctttcatttgtcctagcggtcctctgcctcactgcgcttgaggtttttgtgacgagaaccaagctcggaaagaaggttatagctacagctcaggacagcagagcggccatgatggtagggattgacatcgaaaagatatttctccttgtgatggttctttcatccgtccttgcaggattcgctgggattctctacgcccagatatttgcagtcagtcccgaagtctccctgagggctttaatttacgccttcgccatcgtaattctcggtgggcttggcagccttaggggcagtgttgttgcatcgttcatagtgggatacattctcgtgacgacgataaccttcctcggagcgagatggtccgagttcgtgatgcttctaacgatcgtggcgattctaattgtcaagccaacgggtctgttcggggtggaagaatga

SEQ ID NO: 27454 - protein, 284 aa, Archaeoglobus fulgidus
MIETLVKIAVFGAVVGGIWGLVASGFSLIFGVSRILNFAHGAAFVSSAFLAYALISEGYNLYLAILAGLLLSALIGLAVYALTKPVRDREVMVIILTLAFALLVQQVLLVLYGDRGVSIEPFVSGFAEIGGVKVTYMRILSFVLAVLCLTALEVFVTRTKLGKKVIATAQDSRAAMMVGIDIEKIFLLVMVLSSVLAGFAGILYAQIFAVSPEVSLRALIYAFAIVILGGLGSLRGSVVASFIVGYILVTTITFLGARWSEFVMLLTIVAILIVKPTGLFGVEE

SEQ ID NO: 27455 - DNA, 972 bp, Archaeoglobus fulgidus
  CDS (1)..(972)
atgaactggaagtttgtttatcccgtaattttgattctggcagtgcttctgccgctgacaggttcgtcttatgcgctcaggatttcaacgctgttcataatatacacaatagctgccatggggctgaacataataatcggatacacaggccaagcttctctggctcagggagctttttacggtcttggagcctacgttagcgccttgcttgtgcttaacggctggtctttctgggcgtcagtgatcgtggcaatcgccttcgtggcctttgtggcgttcctgataggtctaatgactctcagacttaagggtgcgtactttgccattgccacgctcttattcaacgtcataatctatgaagttgtggacaagtgggatgaggttaccagagggccgagggggctttttggcatcccttctccgtcaattgagcttagcggtatttcaatcagtttcagtggaacctacaacttttactacctcatgctggccgttctgatcgtcatgactctcctttactggcttataatcaggtcctccttcggcagcataatagttgcaatcagagagaatgagctattggccgagtacgcaggggtaaatcttacgaagttcaaggttgcctctttcgtcttaagtgccatcttcgccgctgttgctggagccttctactctgcatacatcggcagcatctttccagatattacgagcttcgttaacagctttgcattcctcaccgctatcatctttggaggcgctggaactatgcttggaccgttcataggaaccgccgttgttacgctgataaacgaggtcttcttcacactcgctcagtacacagtcctcgttcagggaatcgtattccttttggcgattctgttcatgccaaaaggagttatgggggcttactactctagaaaggccgagaagggagaaaaacttcccaaaagggctcttgtaggtaagttctga

SEQ ID NO: 27456 - protein, 323 aa, Archaeoglobus fulgidus
MNWKFVYPVILILAVLLPLTGSSYALRISTLFIIYTIAAMGLNIIIGYTGQASLAQGAFYGLGAYVSALLVLNGWSFWASVIVAIAFVAFVAFLIGLMTLRLKGAYFAIATLLFNVIIYEVVDKWDEVTRGPRGLFGIPSPSIELSGISISFSGTYNFYYLMLAVLIVMTLLYWLIIRSSFGSIIVAIRENELLAEYAGVNLTKFKVASFVLSAIFAAVAGAFYSAYIGSIFPDITSFVNSFAFLTAIIFGGAGTMLGPFIGTAVVTLINEVFFTLAQYTVLVQGIVFLLAILFMPKGVMGAYYSRKAEKGEKLPKRALVGKF

SEQ ID NO: 27457 - DNA, 870 bp, Streptococcus pneumoniae
  CDS (1)..(870)
atgctccaacaactcgtaaatggtttgattctaggtagtgtttacgcgctgttagccctaggatataccatggtttacggaattatcaagctcatcaacttcgcccatggtgatatttatatgatgggagcctttatcggttatttcttgatcaattctttccaaatgaatttctttgtagcgcttattgtagctatgctagcgacagctattcttggtgtcgtgattgagtttcttgcttaccgacctttgcgccactctactcgtattgctgttttgattacggctattggggtttctttcctattggagtatggaatggtctatctggttggtgccaatacccgtgccttccctcaagcgattcaaacagttcgatatgatttgggaccaattagcttaacaaatgtgcagttaatgattttggccatttccttgattttgatgattttgttacaagtcattgtccaaaagactaagatggggaaagccatgcgtgcagtatcagtagatagcgacgcggcgcaattgatggggatcaatgtaaaccgtacgattagctttaccttcgctttgggttctgctcttgcgggtgcggctggtgttctgattgctctttattataactctcttgagcctttgatgggggttactccaggtcttaaatctttcgttgccgcagtacttggtggtatcggaattattcctggtgcggctcttggtggctttgtgattggtctattggaaacctttgcgactgcctttgggatgtcagatttccgtgatgccattgtttatggaatcttgttgttgatcttgattgtccgcccagctggtatccttggtaagaatgtgaaagagaaggtgtag

SEQ ID NO: 27458 - protein, 289 aa, Streptococcus pneumoniae
MLQQLVNGLILGSVYALLALGYTMVYGIIKLINFAHGDIYMMGAFIGYFLINSFQMNFFVALIVAMLATAILGVVIEFLAYRPLRHSTRIAVLITAIGVSFLLEYGMVYLVGANTRAFPQAIQTVRYDLGPISLTNVQLMILAISLILMILLQVIVQKTKMGKAMRAVSVDSDAAQLMGINVNRTISFTFALGSALAGAAGVLIALYYNSLEPLMGVTPGLKSFVAAVLGGIGIIPGAALGGFVIGLLETFATAFGMSDFRDAIVYGILLLILIVRPAGILGKNVKEKV

SEQ ID NO: 27459 - DNA, 888 bp, Agrobacterium tumefaciens
  CDS (1)..(888)
atgacgatgatcttcggcattccaattcaggccctgctcgggcaattgctgatcggcctgatcaacggctcgttttatgcgctgctgtcgctcggccttgccgtcattttcggcctgctgcgcgtcatcaattttgcccatggggcgcaatatatgctcggggcttttgtcgccttcctcggcctgcaatatttcggcatcaatttctggatggcgctcatcgttacgccgctcgtcgtcgcgcttttcggtgcgatcgtcgaacgtttcatgctgtcgcggctttatgatctcgatccgctttacgggctgcttttcaccttcggtctggcgctggtggtggaaggcacgttccgctggctttatggtgcggcgggccagccctattcggtgccgcgtgagcttgccggcggcaccaatctcggcttcatgttcctgccgaattatcgcgccttcgttgtcgtcatttcgctggtcgcctgcatcgccacctgggcgttgatcgaaaagacgcggctcggctcctatctgcgggcggcgacggaaaatccgacgctggtgcaggctttcggcatcaacgtgccggtgctgctgacgctgacttatgcgctgggtgccggccttgccgggttcaccggcgtgctggccgcacccatctatcaggtctcgccgctgatgggcaccaacctcatcatcgtcgttttcgccgtggtcgtcgtcggcggcatggggtcgatcatgggtgccatcgtcaccggttacatgctgggtatcgccgaaggcctgaccaaggtgttttaccctgaggcctccaatatcgtcatcttcgtcatcatggcctttgtgctgctcatccgccccgccggacttttcggaaaggacgcctga

SEQ ID NO: 27460 - protein, 295 aa, Agrobacterium tumefaciens
MTMIFGIPIQALLGQLLIGLINGSFYALLSLGLAVIFGLLRVINFAHGAQYMLGAFVAFLGLQYFGINFWMALIVTPLVVALFGAIVERFMLSRLYDLDPLYGLLFTFGLALVVEGTFRWLYGAAGQPYSVPRELAGGTNLGFMFLPNYRAFVVVISLVACIATWALIEKTRLGSYLRAATENPTLVQAFGINVPVLLTLTYALGAGLAGFTGVLAAPIYQVSPLMGTNLIIVVFAVVVVGGMGSIMGAIVTGYMLGIAEGLTKVFYPEASNIVIFVIMAFVLLIRPAGLFGKDA

SEQ ID NO: 27461 - DNA, 1278 bp, Escherichia coli
  CDS (1)..(1278)
atgaaaccgatgcatattgcaatggcgctgctctctgccgcgatgttctttgtgctggcgggcgtctttatgggcgtgcaactggagctggatggcaccaaactggtggtcgacacggcttcggatgtccgttggcagtgggtgtttatcggcacggcggtggtctttttcttccagcttttgcgaccggctttccagaaagggttgaaaagcgtttccggaccgaagtttattctgcccgccattgatggctccacggtgaagcagaaactgttcctcgtggcgctgttggtgcttgcggtggcgtggccgtttatggtttcacgcgggacggtggatattgccaccctgaccatgatctacattatcctcggtctcgggctgaacgtggttgttggtctttctggtctgctggtgctggggtacggcggtttttacgccatcggcgcttacacttttgcgctgctcaatcactattacggcttgggcttctggacctgcctgccgattgctggattaatggcagcggcggcgggcttcctgctcggttttccggtgctgcgtttgcgcggtgactatctggcgatcgttaccctcggtttcggcgaaattgtgcgcatattgctgctcaataacaccgaaattaccggcggcccgaacggaatcagtcagatcccgaaaccgacactcttcggactcgagttcagccgtaccgctcgtgaaggcggctgggacacgttcagtaatttctttggcctgaaatacgatccctccgatcgtgtcatcttcctctacctggtggcgttgctgctggtggtgctaagcctgtttgtcattaaccgcctgctgcggatgccgctggggcgtgcgtgggaagcgttgcgtgaagatgaaatcgcctgccgttcgctgggcttaagcccgcgtcgtatcaagctgactgcctttaccataagtgccgcgtttgccggttttgccggaacgctgtttgcggcgcgtcagggctttgtcagcccggaatccttcacctttgccgaatcggcgtttgtgctggcgatagtggtgctcggcggtatgggctcgcaatttgcggtgattctggcggcaattttgctggtggtgtcgcgcgagttgatgcgtgatttcaacgaatacagcatgttaatgctcggtggtttgatggtgctgatgatgatctggcgtccgcagggcttgctgcccatgacgcgcccgcaactgaagctgaaaaacggcgcagcgaaaggagagcaggcatga

SEQ ID NO: 27462 - protein, 425 aa, Escherichia coli
MKPMHIAMALLSAAMFFVLAGVFMGVQLELDGTKLVVDTASDVRWQWVFIGTAVVFFFQLLRPAFQKGLKSVSGPKFILPAIDGSTVKQKLFLVALLVLAVAWPFMVSRGTVDIATLTMIYIILGLGLNVVVGLSGLLVLGYGGFYAIGAYTFALLNHYYGLGFWTCLPIAGLMAAAAGFLLGFPVLRLRGDYLAIVTLGFGEIVRILLLNNTEITGGPNGISQIPKPTLFGLEFSRTAREGGWDTFSNFFGLKYDPSDRVIFLYLVALLLVVLSLFVINRLLRMPLGRAWEALREDEIACRSLGLSPRRIKLTAFTISAAFAGFAGTLFAARQGFVSPESFTFAESAFVLAIVVLGGMGSQFAVILAAILLVVSRELMRDFNEYSMLMLGGLMVLMMIWRPQGLLPMTRPQLKLKNGAAKGEQA

SEQ ID NO: 27463 - DNA, 861 bp, Synechocystis sp
  CDS (1)..(861)
atggatctatcacagttaatctttaatggcattgcggtgggaagcattatcgccctgggggcagtggggttgaccctgacctatggcattttacgcctgtctaattttgcccatggtgattttatgactttggcggcctatttaacttggtgggccaacaccagcggcattaatttgtggttatccatggccctgggttgtgtcggtaccatcattgccatgttcattggtgaatggttgctctggaagcccatgcgggcccggcgggctacggcaacaacgctgatcattatttccattggtctagccctatttctccgcaacggcatcctcttgatctggggtggcaataaccaaaattaccgagtgcccattgtccctgcccaggattttatgggcattaaatttgagtattaccgtctactggtcattgctatggcgatcgccgccatggtggtgttgcatttgattttgcaaaggacgaaagtgggcaaagcgatgcgggccgtggcggacaatgttgatctggcgaaagtatccggcatcaacgtggaatgggtagtgatgtggacctgggtaatgaccgcagtgttaacagccctaggaggatccatgtatggcctgatgaccaccctgaaaccgaatatggggtggtttttgattttgcccatgtttgcttcggtgattctagggggcattggtaatccctacggggcgatcgccggggggataattattggcgtagcccaggaagtgagcgtgccttggtttggcaccagttacaaaatgggggtggcattgctgttgatgatcatcattttgttcattcgtccccaaggtttgtttaaaggcactcaataa

SEQ ID NO: 27464 - protein, 286 aa, Synechocystis sp
MDLSQLIFNGIAVGSIIALGAVGLTLTYGILRLSNFAHGDFMTLAAYLTWWANTSGINLWLSMALGCVGTIIAMFIGEWLLWKPMRARRATATTLIIISIGLALFLRNGILLIWGGNNQNYRVPIVPAQDFMGIKFEYYRLLVIAMAIAAMVVLHLILQRTKVGKAMRAVADNVDLAKVSGINVEWVVMWTWVMTAVLTALGGSMYGLMTTLKPNMGWFLILPMFASVILGGIGNPYGAIAGGIIIGVAQEVSVPWFGTSYKMGVALLLMIIILFIRPQGLFKGTQ

SEQ ID NO: 27465 - DNA, 1167 bp, Synechocystis sp
  CDS (1)..(1167)
atgtcagtactcctagaaggcatttttaacggtttaagcacaagttcagtgttactgattgctgccctgggtttggcgatcgtctttggtctgatgggggtaattaacctggcccatggggaattgatgatgttgggcgcttacagcacctttgtggtgcaaaacctcttccagagcctcggtgacccttggtttgacctctacatttttgccgctctgcccgttgctttcctggtggcggcgatcgccggtctagttttggaaagacaggttatccgctacttgtacggccgaccgctggaaacattgctggccacctggggggtgagcctgattttgcaacagtttgtccgcagtgtgaactggattatggtgctggtggtgggtatatttttgcttttatatttcggtggcacctggttaattaaacgccaggccggtggcaaaccttggttagggaaagcccaagtcatccttttctttctctcagcggcgatctccggcattagtggttttgtggtggcccaggccaattctcccctgtggaatcgggcttggtttggagctaggaacgtcaatgttagtgcccccacttggttgcggggggggcttgccattggcactttccaggtaccctacaccaggatttttataattttcctgactctgctctgtttactggcggtgtatctaattttctaccgttctaattggggactgagaattcgagccgttacccaaaaccggggtatgagtgcttgtttgggtattcccactgggcaggtggatgctttgacctttgcccttggttctggcctagcgggcattgcaggctgtgccattagttttctgggggcggtggggcccaacattggtcaaaactacattatcaataccttcatggtggtggtggtagggggcgtaggtaacctactcggaaccattattgcttccctggcgatcggtgtatccagtgacttgattggtagtggcaccctgattcgtttattccccccagagggagcattgcaacctctgtacgaattttttaccttttttgccaccaccagtatggccagggttttagtcttcgccctgattatcctttttctgcaaatcaagccagcgggtattttccctcccaaaggccggacggcggaattgtag

SEQ ID NO: 27466 - protein, 388 aa, Synechocystis sp
MSVLLEGIFNGLSTSSVLLIAALGLAIVFGLMGVINLAHGELMMLGAYSTFVVQNLFQSLGDPWFDLYIFAALPVAFLVAAIAGLVLERQVIRYLYGRPLETLLATWGVSLILQQFVRSVNWIMVLVVGIFLLLYFGGTWLIKRQAGGKPWLGKAQVILFFLSAAISGISGFVVAQANSPLWNRAWFGARNVNVSAPTWLRGGLAIGTFQVPYTRIFIIFLTLLCLLAVYLIFYRSNWGLRIRAVTQNRGMSACLGIPTGQVDALTFALGSGLAGIAGCAISFLGAVGPNIGQNYIINTFMVVVVGGVGNLLGTIIASLAIGVSSDLIGSGTLIRLFPPEGALQPLYEFFTFFATTSMARVLVFALIILFLQIKPAGIFPPKGRTAEL

SEQ ID NO: 27467 - DNA, 1233 bp, Synechocystis sp
  CDS (1)..(1233)
atgcaaaattctgcccccccttctggttctcccctggccaaactgctgaagaagttgggttggaatgactatgcgttgttcgggtcagtgttggtttttgcctgtattcccctgatcatcgcagttttatctttgtccgatggaggcccaagtcaatggctgttgaataattttcctttcctacggctcaggttgatggggcgttttctgtctttggctattattgccctgggcattgacctaatttggggctacacggggttactcagtttaggtcatggcatattttttgcccttgggggttatgcctttgccatgtatctcaatctccagttaccggaagggcaattacctgaattttttggtctctacggggtggataaactgccactgatttggcaacctttccattcgttacccgttactgtattggccatggtgttggtgccaggggcgatcgccgccctgttgggttatttaatttttcgtaaccgcatcaagggtgtatatttttcgattttgacccaggcggctctgttggtgttttacaactttttcaacgggcaacagaaattaattaacggtactaatggcttaaaaactgatacagaaagaatttttggttacctagccagttccgacggagtccaactggtattttatgaagtcaccgtcctggctctgttattggtttatattctttgccgttggcttactagtgggcgctttggccgcatcctcgtagccattcgggacgatgaaaccagggtaagatttaccggttacgatcccactggcttcaaggtgttggtatttggcatttccggggcgatcgccggtctgtcgggggggctatacacagtgcaaacggggattattactccgagcattatggatgtggccttttccattgaaatggtcatttgggttgcggttggcggcagggctaccctagtgggggctgtgttgggaaccctgttggtgcgcctagcccagagcagtttgagcgagcagtttcccgaggtttggctgtttttccaaggggctttgttcctgattgtagttactgtgcttcccaacggcattgtcggttggtggcaagaacagggcattgtgcaactcaggaatttgttccgaggtaaaccccagttggccacctttcctagtttggaagaagatcctttggtgcaggaagaacgcaaacagtttgaaggagagtctaaggaaccgtaa

SEQ ID NO: 27468 - protein, 410 aa, Synechocystis sp
MQNSAPPSGSPLAKLLKKLGWNDYALFGSVLVFACIPLIIAVLSLSDGGPSQWLLNNFPFLRLRLMGRFLSLAIIALGIDLIWGYTGLLSLGHGIFFALGGYAFAMYLNLQLPEGQLPEFFGLYGVDKLPLIWQPFHSLPVTVLAMVLVPGAIAALLGYLIFRNRIKGVYFSILTQAALLVFYNFFNGQQKLINGTNGLKTDTERIFGYLASSDGVQLVFYEVTVLALLLVYILCRWLTSGRFGRILVAIRDDETRVRFTGYDPTGFKVLVFGISGAIAGLSGGLYTVQTGIITPSIMDVAFSIEMVIWVAVGGRATLVGAVLGTLLVRLAQSSLSEQFPEVWLFFQGALFLIVVTVLPNGIVGWWQEQGIVQLRNLFRGKPQLATFPSLEEDPLVQEERKQFEGESKEP

SEQ ID NO: 27469 - DNA, 933 bp, Streptomyces coelicolor
  CDS (1)..(933)
atgaacgaactgccgcagcagctggtcaacggcctgctactgggatccatgtacgggctcgtcgccatcggctacacaatggtctacggcatcgtccagctcatcaacttcgcccacggcgagatcttcatgaccggtgccttcggcgcactcacggtctacatgtacatcctgcccgacggcacctccatgctgatcgccctgcccctgatgctcatcggcgcggtgatcgtctccaccaccgtcgccgtcggggcggaacggttcgcctatcgccccctgcgcggcgcaccccggctcgcgcccctcatcaccgcgatcggcctctccctcgccctgcagcaggcggtgtgggcctggtacccggacgcgaagtccgcgcggcccttcccgcagatcgacggcgggcccttccacatcggcaacgtcaccctccagaccggcgacatcttcctgttcgtcgtcgccccggtgagcatggccatcctcggcttcttcgtgatgcgcacccgcaccggacggggtatgcaggccaccgcccaggacccggacaccgccaagctgatgggcgtcgacacggaccgcatcatcgtgatcgccttcgccctcggcgccgtcttcgccgccgtcggaggcgtcgcctacggcctcaggtacggccagatcgagttcaagatgggcttcatcctcggtctcaaggccttcacggcggcggtcctcggcggcatcggcaacatctacggcgccatgatcggcggtgtcgtcctcggcgtcgccgagaccctggccaccgcctacatcgccgacgtccccggcctggacaagttcggcagccagtcctgggcggacgtctgggccttcatcctcctcatcctcgtgctgttgttcaggccacagggcctgctcggcgaacgcgttgcggacagggcgtga

SEQ ID NO: 27470 - protein, 310 aa, Streptomyces coelicolor
MNELPQQLVNGLLLGSMYGLVAIGYTMVYGIVQLINFAHGEIFMTGAFGALTVYMYILPDGTSMLIALPLMLIGAVIVSTTVAVGAERFAYRPLRGAPRLAPLITAIGLSLALQQAVWAWYPDAKSARPFPQIDGGPFHIGNVTLQTGDIFLFVVAPVSMAILGFFVMRTRTGRGMQATAQDPDTAKLMGVDTDRIIVIAFALGAVFAAVGGVAYGLRYGQIEFKMGFILGLKAFTAAVLGGIGNIYGAMIGGVVLGVAETLATAYIADVPGLDKFGSQSWADVWAFILLILVLLFRPQGLLGERVADRA

SEQ ID NO: 27471 - DNA, 861 bp, Rhodopseudomonas palustris
  CDS (1)..(861)
atgagtcttattctgatccaggcgctgaacggcctacagaccgggctggtgattttcctggccgccagcggcctgaccctggtgttcggcattctcggcgtcatcaatctctcgcacggctcgttctacatgctcggcgcctatttggcgctctcgctgaccggcatgttcggcgatgtctttctggcgctggtcgccggcatcccgctcgccttcctgcttggtctggcgatcgagtggctgttcatccgccatctctacgaccgcgaccacctgcagcaggtgctgctgaccttcgcgctgatcctgatcttcaatgaatttcagcaagtggtgtgggggtcgtatccgcactcgatcccggcgccgagctatctggccaacagcgtccggctcaccgaaggtctgagttacccggtctatcgattggcgctgatggcgatctgcgtcgcgctggcgattgcgatggcgctggtgatccagaagacccggatcggccgcctgatccgtgccgccgagtccaatcgcgagatggtcgaagcgctcggcttcgactcgcggctgatcttccggatggtgttcgccaccggtgtcgcactcgccgccaccgccggcatgctcgcggccccaatcgagagcgcctatccgggcatcggcgatcgcgtgctgatcgtctcgttcgtggttgtggtgatcggcggcatcggttcggtacgcggcgctttcattggatcgctgctgatcggcatggccgacgccttcggcaaggtgttcctaccgcagttctccagcatcatcatctacgcgttgatggcgctggtgctggtgatacgcccggccgggctgttcgggcgggcctga

SEQ ID NO: 27472 - protein, 286 aa, Rhodopseudomonas palustris
MSLILIQALNGLQTGLVIFLAASGLTLVFGILGVINLSHGSFYMLGAYLALSLTGMFGDVFLALVAGIPLAFLLGLAIEWLFIRHLYDRDHLQQVLLTFALILIFNEFQQVVWGSYPHSIPAPSYLANSVRLTEGLSYPVYRLALMAICVALAIAMALVIQKTRIGRLIRAAESNREMVEALGFDSRLIFRMVFATGVALAATAGMLAAPIESAYPGIGDRVLIVSFVVVVIGGIGSVRGAFIGSLLIGMADAFGKVFLPQFSSIIIYALMALVLVIRPAGLFGRA

SEQ ID NO: 27473 - DNA, 918 bp, Methylophilus methylotrophus
  CDS (1)..(918)
atgtttggttattcgatggcagatataggcaatattgtggtgatgcagggcttttccggcctgagcatgtttacagtgttgctgctgatggcacttggtctcgcgattattttcgggcagatgggtgtgattaacatggcacatggcgagtttatgaccataggcgcctacaccaccgtactcatttcaaaagtagcagccagttacggcttcacggattactacttcgtgtttgccattgcgattgccttcttgctggccttcgcggtcggttactttgttgaattcattatgatcaggcacttgtataagcggccgctggatacgctactggccacctggggcttgaatctggtcatgcaacaaattttccgctcttcattcggcgccaaagaagtgagtgccgaactgcctgagtggatgctgggctctttcaagccaacccctgatattgatatcccgattaacggggtattcgtgatggtgctggcggcgctagtgactttcggtgtctacatgtttatgtacaaatcccgctggggcttgcgtgtacgtgccacggtgcagaaccgtaccatggctggcgcagtagggattaatacagccaaagttgaccgcgtcacttttgccctgggctgcggcattgccgggattgccggtgctgcatttaccaccattgcctctactggcccgaccacagggaccttgtatatcgtggacagctttatggtcgtggtatttggtggcgcagccagcattgtcgggacgattgcttccgccttcgggattgcccaggcgcaatcgatactgcaattctttatgaccagctctatgggtaaggtctccaccttgctcgtcatcgtcaccatcctgatgatgaaaccggaaggtctgtttgcctccaaactgcgtaaataa

SEQ ID NO: 27474 - protein, 305 aa, Methylophilus methylotrophus
MFGYSMADIGNIVVMQGFSGLSMFTVLLLMALGLAIIFGQMGVINMAHGEFMTIGAYTTVLISKVAASYGFTDYYFVFAIAIAFLLAFAVGYFVEFIMIRHLYKRPLDTLLATWGLNLVMQQIFRSSFGAKEVSAELPEWMLGSFKPTPDIDIPINGVFVMVLAALVTFGVYMFMYKSRWGLRVRATVQNRTMAGAVGINTAKVDRVTFALGCGIAGIAGAAFTTIASTGPTTGTLYIVDSFMVVVFGGAASIVGTIASAFGIAQAQSILQFFMTSSMGKVSTLLVIVTILMMKPEGLFASKLRK

SEQ ID NO: 27475 - DNA, 1845 bp, Pseudomonas aeruginosa
  CDS (1)..(1845)
atgaccgaccaggaggagacatctgacaacactggtattttcccagctgttgaatgggctgcaatacggcgtcctgctgtttttgctggccgccgggtgacgctggtgttcggcatcatgagcttcgtgaaccttgctcacgggtcgctctatatgctgggcgcctactttgcggcactcacattcaaaaataccgactccctgacgctggctttttttgcggccattttcggcagcattgccgtaggcgttattcttgagcgcctggctgtatcaaggctttactcgcgagaccacctcgaccatgtgctggtgactttcggcatggtgctcttcttcaacgagatggtgcaaattctctggggcacacaacagtatttcttgcctgtccctgcgtggctcgatagtacggtcagtattttcggcataaattaccccgcttatcgctttgccattatcgtggttgggcttttggtggcggtaggcgctcacgcggttattaacaaaactcgtctgggtatgctgatacgagccggttctgttaaccccaaaatggttggcgctcttggcgtcaacattaagtttctgaacgccttgttgtttggtttgggggcggcattggcggggctggctggcgtaatggccagtccaatcctgtcgattcagtccggcatgggcgatccggtacttatcacgacgcttgtcgtcatcgttattgggggtattggttcggttagcggtgctttttacgccgcattaatcgtcggtgttgtcgacacgctcggccgtgcattcttacccatgattttgcgcgaattcatggcgcgagacattgccaatgctgcagggcccgcaatcgcctcaatgcttatttatgtcctgatggcggttgtgcttgcgcttcgcccacaaggactgtttcggcgcccggagataacgatgacgcaaacaacaccattcaagttaagtacgctggttcccgtcgcaattattcttttgttggcgctggtgcctttttggggttatttcaccgacagcactttttacgtcgcgttctatgcgcgtgtgcttatttacgctatcgcagtggttgcgctaaacatcgccttagggtttggcgggttggtcagccttggtcacgcgttgtttatgggtatcggtgcatacagcgtcgccataccgtcgttctacggcattgacagtggctgggtgcatctgttcatttgccttctgggcagcggtctgttgggttacatcaccggcgcgatcagtctgcgcactacaggcatcgggttcatcatgatcacgctggcgtttgctcagatggggtacttcctgtttgtcagtcttaagcagtacgggggcgacgacggcacaagcattgccaataccagcaaaatgcttgggctcgattttggcggtgtctataccgtttacgtgtggcgtttgtgctgctggtgctgtcaacctggtggacggcaaagctgcgtgtctcgccttttggcatggtcttgcgtggcgcacgccaaaacatccgtcgtgttaacgctatcggtttccaggcgcataatatttgttggtgtcttacgtgctgtcggcaatgctgtgctcggtggcggggttcttgctggccaatctcaatgccttcgcgtcacccaccaccttatcctggattatttcaggcgatctggtggttatgctggtactgggcggcattggtaccgtatttggcccgttgttaggggcacttgcgttcttgggtctcgaagaagtgctgaaaatgtttacaacgcattggttggccgtgtttggtctggccattgttgtgattggcctggtgggtaa

SEQ ID NO: 27476 - protein, 614 aa, Pseudomonas aeruginosa
MTDQEETSDNTGIFPAVEWAAIRRPAVFAGRRVTLVFGIMSFVNLAHGSLYMLGAYFAALTFKNTDSLTLAFFAAIFGSIAVGVILERLAVSRLYSRDHLDHVLVTFGMVLFFNEMVQILWGTQQYFLPVPAWLDSTVSIFGINYPAYRFAIIVVGLLVAVGAHAVINKTRLGMLIRAGSVNPKMVGALGVNIKFLNALLFGLGAALAGLAGVMASPILSIQSGMGDPVLITTLVVIVIGGIGSVSGAFYAALIVGVVDTLGRAFLPMILREFMARDIANAAGPAIASMLIYVLMAVVLALRPQGLFRRPEITMTQTTPFKLSTLVPVAIILLLALVPFWGYFTDSTFYVAFYARVLIYAIAVVALNIALGFGGLVSLGHALFMGIGAYSVAIPSFYGIDSGWVHLFICLLGSGLLGYITGAISLRTTGIGFIMITLAFAQMGYFLFVSLKQYGGDDGTSIANTSKMLGLDFGGVYTVYVWRLCCWCCQPGGRQSCVSRLLAWSCVAHAKTSVVLTLSVSRRIIFVGVLRAVGNAVLGGGVLAGQSQCLRVTHHLILDYFRRSGGYAGTGRHWYRIWPVVRGTCVLGSRRSAENVYNALVGRVWSGHCCDWPGG

SEQ ID NO: 27477 - DNA, 1860 bp, Symbiobacterium thermophilum
  CDS (1)..(1860)
atggcggcgcctttgcgatctggaacccgtaggagggggagcatgctggaccagctgatcaacggcctggtggttggcaacctctacgccctcacggcggtgggcatcacccagatctacggcgtggccaacgtgatcaacttcgcccacggctccctctacatggtcggcgccttcgtgggctggatggcggtcacctggctgggcctgccgctactgcccaccctgctgctcgtgctcgtcgcctcggccctgctggggctggcggtggagcgggtcgccatccgccccttcgccggttctggccggacggtgctgctgctcaccaccatcgccgcggggctcgtcctggagcaggcggcccagctgatatgggggccggagaccaaggccttccacacccccttcgccgacgtgcgggtccgggtgggcggcggcttcctctcctccctggacctggtgatcctggctgtgggcttgaccaccgctctggcgctctggctcttcctgaagcggtcccgcctgggctgggcggtccgggccaccgcccaggaccgggaggccgccctgcagatgggcgtcgacgtgaaccaggtcagccgggtcagcttcgccatggccggcgccctggccggggtgagcgggctcctggtggggctgtactaccacagcgtctaccccaccatgggcttctccgcgagcctgaagggattcacggcggccctgctgggcggattgggcaacatccccggcgcgctggtgggggcgtacctgctgggaacggcggagtcgctggcggtggcctggctgggctccacctggcgcgacctggtgggcatcggactgctgctcggcgtgctgcttttccgccccaacggcctgttcgcggccgcccgggcgctgctgcccgagcccactgccggcactttcatcccgatcgggcggccgctgcctatcccccggtgggcgctgcccgcggcgggggccgtcgccctggccctgccgctggtggtgcggaacgggtactggctgcaggtgctggcgaccgcctggatcttcggcctgctggccatcagcctcaacctgattgccgggacggccgggcagatctccctcgggcacgccggcttcctggccctgggggcgtacgcctcggccatcctcaccacccggctgcagtggcccttcctgctgtcgctggctgtcgcgcccgtcatcgccgccgccgtcggcgtggtgctttgctacccggccctgcggctccgggggcagtacctggcggtggccaccatcggcctgggccaggggatcgcgctggtggcgctcaactggacggcactgacccgggggcccctgggcatcagcaacatcgccccgcctggcctcttcggagtggagatcacctcggccgcggggttctactggctgaccctgaccctgctgctgggcggcatctgggtggcggagcggctctccggctcgtacctgggccgggcgctgcgggccgtgcgggaggacgaggtggccgcccgggcgtacggggtggggctggagcggtacaagtccatcgccttcggcctcagcgccttcatcgcgggcctcgccggcgtcctgctggcgcacgcctacacctacatcgcgccggacacgttcacccacgcgatgtcgctgcaggtgctgacgatggtggtgctgggcgggctggacaacaccatcggcgccgtggcgggggccctcgccctgatcgtcatccccgagtccgcccggttcctggcggagtaccggttcctggtctacggcctgctgcttctggtcatgctcaggttccggccccggggcctcctgagcgccgcatcgtga

SEQ ID NO: 27478 - protein, 619 aa, Symbiobacterium thermophilum
MAAPLRSGTRRRGSMLDQLINGLVVGNLYALTAVGITQIYGVANVINFAHGSLYMVGAFVGWMAVTWLGLPLLPTLLLVLVASALLGLAVERVAIRPFAGSGRTVLLLTTIAAGLVLEQAAQLIWGPETKAFHTPFADVRVRVGGGFLSSLDLVILAVGLTTALALWLFLKRSRLGWAVRATAQDREAALQMGVDVNQVSRVSFAMAGALAGVSGLLVGLYYHSVYPTMGFSASLKGFTAALLGGLGNIPGALVGAYLLGTAESLAVAWLGSTWRDLVGIGLLLGVLLFRPNGLFAAARALLPEPTAGTFIPIGRPLPIPRWALPAAGAVALALPLVVRNGYWLQVLATAWIFGLLAISLNLIAGTAGQISLGHAGFLALGAYASAILTTRLQWPFLLSLAVAPVIAAAVGVVLCYPALRLRGQYLAVATIGLGQGIALVALNWTALTRGPLGISNIAPPGLFGVEITSAAGFYWLTLTLLLGGIWVAERLSGSYLGRALRAVREDEVAARAYGVGLERYKSIAFGLSAFIAGLAGVLLAHAYTYIAPDTFTHAMSLQVLTMVVLGGLDNTIGAVAGALALIVIPESARFLAEYRFLVYGLLLLVMLRFRPRGLLSAAS

SEQ ID NO: 27479 - DNA, 1050 bp, Symbiobacterium thermophilum
  CDS (1)..(1050)
atggcgaccgtgccgaatggcagcagctccttcgccggcggcgggcggccggcggtgacggtgaacgcggtggtctccgccgcgctgatcgtcgccctgtacatcgtgctctccctgctgcggcagcagggcatcatcggcacctactggggcatgatcctggacctggccctgatcaccaccacctcggcaatcggtctcagcctgatctacggcttcgccggccagttctcgctggggcacgtggccttctacggcatcggcgggtatgtgtcggcctacatcaccaaggcctacggcgccacgaccctcaacttcgtgctgggcctcgccgccggcaccctcgcggcggccctgatcgcgttcctgatcggcctgcccatcctccggctgcggtcggactacctgggcatcgccacgctgggcttcggcgtcatcgtcaaggtgttcatggacaacagcgacaagatctccaagctgctgggcggctccatgggcatgaccggcatcccgcgcctcaccacctttccctgggtgttctggtcggcggtgctggtgatcctgctggcccggaacctggtccactccagccacggacgggcgtgcatcagcgtgcgggaggacgagatcgccgcggacatcatgggcatcgacaccacccggttcaagatgctggccttcgtcctgggctgcgccatggccgggctggcgggcggcctgtacgctcacctgtatgtctacctgcacccgaagagcttcgagttcctgaagtccttcgacgtgctcctgatcgtggtgctggggggcctgggcagcctgaccggcacggtggtggccggcatgggcgtggtgttcctgcaggaggtgctgcgggacgtgctgggccagcagttcctggagtggcgcggcgtggtctacgccctggtgctgatcgtgctgatgatcctgcgcccgcaggggctcatgggcggctgggagttcagcctcgaccggtggctttcgcgtccgtcgaagggagggaaggccagtggcactgctggaatgccgtga

SEQ ID NO: 27480 - protein, 349 aa, Symbiobacterium thermophilum
MATVPNGSSSFAGGGRPAVTVNAVVSAALIVALYIVLSLLRQQGIIGTYWGMILDLALITTTSAIGLSLIYGFAGQFSLGHVAFYGIGGYVSAYITKAYGATTLNFVLGLAAGTLAAALIAFLIGLPILRLRSDYLGIATLGFGVIVKVFMDNSDKISKLLGGSMGMTGIPRLTTFPWVFWSAVLVILLARNLVHSSHGRACISVREDEIAADIMGIDTTRFKMLAFVLGCAMAGLAGGLYAHLYVYLHPKSFEFLKSFDVLLIVVLGGLGSLTGTVVAGMGVVFLQEVLRDVLGQQFLEWRGVVYALVLIVLMILRPQGLMGGWEFSLDRWLSRPSKGGKASGTAGMP

SEQ ID NO: 27481 - DNA, 870 bp, Symbiobacterium thermophilum
  CDS (1)..(870)
atgatcttcgcccagcagatcatcagcggcctggccacgggttcgctctacgccctggccgccctgggcctggtgctgatcttcaagaccaccgacgtggtcaacttcgcccagggcgagatggccatgttcggcaccttcatcatgttcaccctgctgaagaccgccggcctcccctactggggcgccttcgtgctggcgctggccttcgccttcctgatgggcgccgtcatcgagcgggtggcgctgcgccccctggcccaggcccccctcatcagcgtgctgatcgcgacgctggggctgatgcagatcatcaacggggtggccggctggatctggggctaccaggccaggccgttcccgacggcggtgagcggcagccccatccgcctgggcgacctggtgatcaccttgccggacctggtcaacctcgccgtcagcctcgtggtgatgaccggcttcttcctcctcttcaagttcaccaagctgggcatcgccatgcgggcggtggccgaaaaccgggtggcggcccgcctgatgggcatccccaccgaccgcatcctctccctcacctgggggctgggaggcgtcctggccgccaccgccggcatcctcatcgccccggtgaccaacctggacatcaacatgatggccgacatgcagatcaaggcgttcaccgccgcggtgctgggcgggttcacctcgctgcccggcgccgtggtgggcggcctcaccctcggcgtgctggagaacctggtcggccagttcgtcccgcagctgaaaaccccctttgccttcggcctcatcgtgctggtgctgatgctgaggcccagcggcctgatggggaccgtccagcgaaagaaggtgtag

SEQ ID NO: 27482 - protein, 289 aa, Symbiobacterium thermophilum
MIFAQQIISGLATGSLYALAALGLVLIFKTTDVVNFAQGEMAMFGTFIMFTLLKTAGLPYWGAFVLALAFAFLMGAVIERVALRPLAQAPLISVLIATLGLMQIINGVAGWIWGYQARPFPTAVSGSPIRLGDLVITLPDLVNLAVSLVVMTGFFLLFKFTKLGIAMRAVAENRVAARLMGIPTDRILSLTWGLGGVLAATAGILIAPVTNLDINMMADMQIKAFTAAVLGGFTSLPGAVVGGLTLGVLENLVGQFVPQLKTPFAFGLIVLVLMLRPSGLMGTVQRKKV

SEQ ID NO: 27483 - DNA, 1026 bp, Symbiobacterium thermophilum
  CDS (1)..(1026)
atgggcaagaagctgctcttcctcctgggcgccctggccgtgctggcgctgccctacgcgctgcctgacgaatggtcgtggctggtgctgctcaccaaccgggccctgatcctggccatcgcggccatcggcctcaacctgctcaccggcttcgccggccagatctccatcggccacgcggccttcatggccatcggcgccttcgccagctacggcctcaccgccaaggtcggcattcccttctggggcgccctgccgctggcagggctgatcagcgccgccgtgggctacgccctgggcttcccggcgctccggctgcagggccactacctggccatcgccaccctgggcttcggcgtggcggtgccccagatcctcaacctctggaaggggctctccggcggctggaccggggtgaagcccgccgccccttacctctatggcctctacttcaaggaggaccgcccctactactacctgatcctgatcgccctggccctcctcacctgggtggccctgaacatcgccagacggcgcaccggtcgggccttcatcgccctgcgggacagcagcgtcgccgcgcaggcgatgggcatcagcctggcccggtacaagaccaccgccttcgccctctcggcgttctacgccggcatcgccggcagcctctgggcccacatgatgaactacatcgccccccacgacttcaacctggccctgtcgatggagctgttcaccatcatcgtgctgggcggcctggcctcggtgcccggctcgatcgtgggttcgctgttcatgtccctgatgcccaaggccgtggaacggatctcgctggcgcttcagcggtcgggggccttcgaccattccccgttcctcatgaacgtcttcaagaacctgaatcaggtgctgacgggcgtcatcctggtgctggtggtgctctacctgcccctggggctcgtggacctgtggcggaggctgcagcactggtgggccgggcgccggcacgccgcggccgggggggtggagtag

SEQ ID NO: 27484 - protein, 341 aa, Symbiobacterium thermophilum
MGKKLLFLLGALAVLALPYALPDEWSWLVLLTNRALILAIAAIGLNLLTGFAGQISIGHAAFMAIGAFASYGLTAKVGIPFWGALPLAGLISAAVGYALGFPALRLQGHYLAIATLGFGVAVPQILNLWKGLSGGWTGVKPAAPYLYGLYFKEDRPYYYLILIALALLTWVALNIARRRTGRAFIALRDSSVAAQAMGISLARYKTTAFALSAFYAGIAGSLWAHMMNYIAPHDFNLALSMELFTIIVLGGLASVPGSIVGSLFMSLMPKAVERISLALQRSGAFDHSPFLMNVFKNLNQVLTGVILVLVVLYLPLGLVDLWRRLQHWWAGRRHAAAGGVE

SEQ ID NO: 27485 - DNA, 1068 bp, Desulfotalea psychrophila
  CDS (1)..(1068)
atgaaaaataatatctccttgtttttgtttgtgatagtcattgttggccttcatcttcttaccgccagtacgggttctctctacctactgacccagttgaccatgtccgcatattattccctgctggccataggcctctgcctgcttatgggccatgctggacagatatccatgggccatgccggtttctttgccattggtggctatctgtcggccagtctcaccactcataatatggtctcctctgctgaaacaggctgggtgcaaggcctctcatctctcggccttttacatgcaggcgaggatatgttcggtgatgccctcctcgtcttggcgccatggcctgcctgcctaatggctattgccgttgccgctctggtggccctcctgcttggcattcccatcttgaagctcaagggccattatcttgccatggcgaccctgggctttggcattattgtctaccgcctggtcctggccacggaattttttggtgaggcagatggcatttccgatgtacctgcctttgctatcctgcctggcttgagcattgttggagatttggatgtgcgggtggaaaattattatattgccgccgtaatcctcttcttcggctttgtccttttaagaaatctgaccaggtctcgggtaggtagggccttacgggcaatacacagcgccgaagatgcggccgattccatggggataaatgttgcccactataagttgattacctttgttctatccgccgtttttgccgcctttgccggtgtttgtctgactcactataacggtggcatcgggccttcggaggcggggatgatgaaatccgttcgttatgtggccattgttgccgtgggaggaatggcaaatctctggggagtgctgaccatgagcatggtgctgaactacctctcccttcgtggcatctttggcagttatgatgatgccgtttttggcaccgtcctggtcttggtgatgctctttgctcccgatggaatttttagcattaagcttcgtgccggtcttgcccaactccgggcgaaatatggagaggatctctcatga

SEQ ID NO: 27486 - protein, 355 aa, Desulfotalea psychrophila
MKNNISLFLFVIVIVGLHLLTASTGSLYLLTQLTMSAYYSLLAIGLCLLMGHAGQISMGHAGFFAIGGYLSASLTTHNMVSSAETGWVQGLSSLGLLHAGEDMFGDALLVLAPWPACLMAIAVAALVALLLGIPILKLKGHYLAMATLGFGIIVYRLVLATEFFGEADGISDVPAFAILPGLSIVGDLDVRVENYYIAAVILFFGFVLLRNLTRSRVGRALRAIHSAEDAADSMGINVAHYKLITFVLSAVFAAFAGVCLTHYNGGIGPSEAGMMKSVRYVAIVAVGGMANLWGVLTMSMVLNYLSLRGIFGSYDDAVFGTVLVLVMLFAPDGIFSIKLRAGLAQLRAKYGEDLS

SEQ ID NO: 27487 - DNA, 891 bp, Desulfotalea psychrophila
  CDS (1)..(891)
atgagtagccagttatttgtccagtatttacttgccggtattacctatggttccatgtatgccattgtcgccataggctttaatattatttataataccacagggattataaattttgctcagggggagtttgtcatgctgggggggatgctctccatctctctcttgcagtttatgcccctgcctttggccattggcctggcagtggtgctgaccatggctgtcggcggtctggtggagatactgtttatccgttggttaaaaaatcccggtgtactgcgcatgattgtgatcaccgttggcctctctattctcctgcgggaaatcgccctccatatttggggtgagggtgtttattcactgccctatttttatggtaatgagatcagcacggtggttattttgggggcacgggtatcaccacagattttatgggtcataggtgtctgtctccttcttgttgtcctgcttcatctttttttcaagacttcccccatggggcgggagatgcgtgcctgtgcggtcaataaaaaggctgccctactctgcgggatcaatgcccgtaatatggtcaccttctcctttatgctcagtgccggtattggtgccctggccggtgcggttatgtcacctattacctatactcagtatgattcgggcgccgcccttgccattaagggttttaccgtggctattcttggtggtctgggcaatctctttggtgccgtggcggcgggaatattgctcggggtgttggaggcattttcggtctctgttctacccctggcctttcaggatgccatcgccattagcctgctccttgttattctctgtgtgcgtccccatggtctctttggctcagcaacggccgccggtttaaaggatttttag
